United States Patent 9,518,277 (GENETICALLY ENGINEERED MICROBIAL STRAINS INCLUDING CHLORELLA PROTOTHECOIDES LIPID PATHWAY GENES) - sequence listing, part 2

SEQ ID NO: 2793 - DNA, 3612 bp, Chlorella protothecoides
atgtttcccccacctgttccacaggaggagagcctgggcgacaaggcgcgcaacgcctacgaggacgccaagaacgccgtcggcaacgcggctgagactgccaaggagaagatctccggcgcggccgacgagctgcagggcgccggcgaggacatcgccgacaagacgaagcgggaggcacgctccgctcagggcaccgccgagcgcaagctggacaacacctccgggtctgccaagggcaccgccgagcgcaagttggacaacacctccgggtcggccaaggtacattggatttgggtgatatgtatacctggaaactcagcttctttgatactgtttcagatcatgccatctgcctgcatgacaagtagccatcgcacagattggcttcatccagcaatatcccttctcactctgcctccacagagcgcgtacaacgacgccaagggagaggctaaggatcttggccagcaggccaaggaccagttcaacaaggccaagggcgcggtcgaggactttgcctccgatgtgaagggtgatgccaaggatgctacccgcgatgtgaagagcggtggtcgggatctgaagtccgatgccaagagcgcggctcgtgacgccaagaacgagggtaagaacctcgccgaccgtgctggtgatgccatcaaggatgttggtgacaagctgaagcacctgcaaatccagcagcacaaaccggtaccacagcgcccacagcgggatggtggccaggtgccagacggcgtgtgcgtccagggtgtgccagaggagtgggggaaagtccagcacctccagcaggctggctgcattcaggctggcaatgaagaccagcagcgaccggcggcttgggtgggtggcgccctcccgcgtccaccatgcccagcgcagccagagcagggtctgcaggaggcccagggccaggcaggccaccacccagccgccgtagtcaaagcggcgggtgagcatggcgtgcacgcgcgccaggtaggccacgcccagcacggcgcccagcgccgcgcggcgccgcggggcggcggcgcccacgcatcgcagcgtgcgcagcgcggttacgtgcacgcccagcgccaccaccgcgccggccaggaagtagtcggcgcgctccgtggcgtgcgtgtcgcgcgcgtggaaggcggcgctggccagccaggcggcgagggagagcaggcagtgcgccaggtagggcggcccgccgcggcgccccgcgcgccacagcgcacgcagcgcgcgcgcgtgcgccgcggcgttgagcagggaggccacggaggagaggggctcctggagtcccagccagcgcgtgaagggccacttgccgtggtacttttgcgccgcgtgtgcgtggggcggcggggtggggcgccaaggagtggggtgccgaggagtgggctgctggagcgcggcccttacctccggcccctccaccgcccacatgcacaggtacccgcagtcggtctcgcaggtccacgccgtccagcgcaagatgatgggcggcgccgcgctgccctggtccccgtcaccagggtcgcacagggcggagtggacctggccgcggcccccgctgccctccacgcagtggtagaggcagccgcggtactcaggggcctcgtctcccgagctggccaggcagggggagcccagcgcgcccagcaggacgcacagcagggccagcgccctcatgctgggaggccccgtcaggccccaagcgggagggcgcgggcctctttgacctcggcctgccactgctccgctcgcagtgccacgtccaccagctccgccgttagattgatcacctgcggatgtaggccggacaggaagtcaggaccctatcaagctccggcggggtccagtggggtcctcggcgacggggcccaccaccaggcagtagtctcctggcacgatggaggcgaggtccaagcccggcaagcgcgaggtcaccaccactgcaatcacggcgccgctgctgtccttcagattcaagcccgcgtctgtgcgctcacagaccgtgccctggttacgaagcagtgttctgagaggcttttggaatcagtatcacgaggtggcattggtgagagtggaggctccccttgcgtccggtaccatcaaggcgatgcatgctgggggtgtcaccaaaccgagtggtcgccagcctcactgtcacagtccctcccatctcgagcgggaatgcgtgcgattcccatcacccccgatccaacccatccattgccaaaggcactgcgcacctggatccagactcgttcgaatggggctccccactccgtgcgccggcgccgaagatcatctgtcgggggaagtttgtgcctggaatcatccaattccaattcagcacgtgaggaaaccgtggggacctctagaccgcgcgcggcatccaatccatttgtgaattttggccaaggccatgctggacgggcccatacccatgcaggaccgtcgtcgctcctaaacatcgacagccagggctgccagcctccccgccccgaccccggtgcgcgccgggctgcggcgccctgcgccatggtcaccacgtccagcgcggtgcaggcccagccgcccccagccgcggcgagcggggaaccagctgttctagaccgcatgaagggcgcagtgaccaccctgctggagtgcatcggcgaggatcccaagcgggagggtctcgtggacacgccaaaggtgggtgagggtggccaaggcctggctggacatgacgcgggggagcggccaggatcatacagggtgagctttgtcggagggcgtcccagctggtgcctgatgttgctccctgctgacccatctgttgtcgttccgacccccatactcctcaccacccatcaccccagtgcctttggctccgcgctgttccacgagccctgcctggccgccgcgtccgacggcctggtcctggtgcgcgacataaccttcgccgcgctttccagctccgccctgctccccttctacggcgcggtgcacgtcgcatacctgccccgtcacggcaccatcctgggcctgtccaagctggcgcgggtgaccaaggtcctggcggcccgcctgcaggaccaggcgggctttacgcgctccctgctggcggctgtggtcgctgagctggcgcccgccggcgccgctgtggtctgcgtcgcgcggcagctgggcggcatcgaggcggatagcgggccacgcgtgacctgcctggccgcaggtgcattgcgccgcgccgaccgcctgatagagctggaggcggtgctggatctggcgccgggggcgctggatttgggagcggagggggcggctgggctcgacacagagctcctgattgggtcggggcctgatcacgtggatgtgagcagagagcgaaggccgccctcggcgctcaaccccgagcctgagtccctcgacgactcggccgggcgcgcgccgcccgccacgcgcgcgcgcatggaggccgcggtccgcgtgctggtggaaggcgtggccgaggcgcacggcgccaaggtggacgcccgtgctctggtcgccagccggcgctacgtggcctggctgctgcgcgccaccgccggctacggcgcg

SEQ ID NO: 2794 - DNA, 2535 bp, Chlorella protothecoides
  modified_base (341)..(350): a, c, t, g, unknown or other
atgaggcgtcctgcgacatcgatgcgcggggtgtcgatcgccctgttcatcttgctcgccgtcggcgctccacaggcccaggccgagcaggcagctggcctcccctcctacctgaggagcctggtggacaggatcaagggatcctatgtctcaaatgaccgcgtggtcccagtgtccaccaacctccccggccatgtgggagaggtggagtacatccgcgtcacgctgggtgcgcaccagctttcatcatgctgccatcatcagtatacgagtacaagcccaatgcaccccagttcacccctccgtccccgtgcacctcctccttctcgcagcctgtttgnnnnnnnnnntgtgtccattcgacctgcacctcactgccacttctacatccgtgctcttgcaggacacctgccggaaacggacccagctcctgggaagagcttgcaccacagagtatgcgagtacaagcccaatgcaccccagttcatcgcccgtccctgtgcacctcctccttctcgcagcctgtttggtcgcgcctggttccatgccaagcgcctggccgggctgggcggctcctaccaggacgccgtgtatgcccaggcccagggcctgaagaacagcgccggggagtcctgggaccaggcgaccgagaccgcccagaaggcctgggagtcgggcaaggagacgagccagcagagctgggacgacgcaaagaaggcagcgtgggacacctggtcctccaccgtcagcttccccgcccgcaaggcagccgaggccaagtctgccgccgccggcgcctacgatcgcgcctctggcaaagccgcgggagccgccgaccacgcgaccggcaaggtcgccggcgcatacgaccaggcgaccggcaaggctgccgccaccgctgaccgcgcctccggcaaagccgcgggcgtggccgaccacgttgtcggcgcggtgaagggcgcctgggagcaggccaagggcgccgccaagggcaccgccgcccaggccgagggtgccaccaagggcgcggtgaaggaggccaagggcgctgcaaaaggcgtggtgaaggaggcgtccgccacggtgaaggatgcgtctgccacggccaagggcgcggccgcctccgccgcgagctcggtgggcagcggcgcgcagcaggcggtcgacacggccgccgactacgccagtgccgggtacgacaaggccgcggcggtggcctccgactgggcgggcgcggggtatgaccaggcctccgactcctggcgcgcggccatgggccaggcgtacagtgcctaccgcaccggcgcgggcaagggcaagggcacctgggaggacgccaaggcaaccgcctacgccgcctggaagaaggcggagggcaaggcgcatgagggctacgatgcggccagcgacgtggccagcggcgcctacgagcgcggcctggacgcggcctacaccaactgggagaagacgcggtcgcccgagacgtgggagggcgcgcgtgacgcgtttgtggacctgtggcgccgcggcaccgaggactgggaggatgtctccgcccgcacctgggagcagtggcagcgcaccaagcacgagacggggcagacctgggacgaggccagccgcgcggcggccgactcctggcgcgacgtgcgctccagcagctggctctccggctacttccccgagcccaagaaggcggccagctcagtgtggctgaagaacgcattccggagctggtggggctccaaggaggccacccagcagccctgggacgaggccaaggccaccgcgcagcgcacctttggcgtgctgcaggacacctcccgctccagctgggaggaggccaaggccaaggcccagagcgcgtgggagaccaccaaggccaagaccggggagagctgggaggatgcgtcggccaagacctggcgcaactggtacaatgccaaggcgtatgccggcggcacctgggccgacgcgcagaaggcggcggacgcctactgggcggagaccaagggcaagagcaaggacgggtaccaggagtttgccgatgcggcctgggagaactggaacgaggccaagaactcggcggggcagagctgggacgaggccgagaaagcggccaagtcctactactccggcggcttctggggccacaagaaaaagtcctgggaggaggcggggaaggaggcctggcaaaactgggtcaccggctccgcacgtcgcgggcacccttgggccgacgtcgagaccgccgccaaacggcgctgggaggagaccaagtccgccagcggcgagacttgggagcaggccaaggctgccgccgagaaggcgtggaatgcgcgcgccccgggccattcctggtgggacaacctgaccgacagcatcgcctgctcctgggacgacaccaagtgccgcgccagcgacggctggacctccctgaagaagtcagtgggccccagcgaggcggaaaaggcgcgtgtccaggcgcaccagaaggtggacgaggtgtttgagaagacgaagcaggagctgtga

SEQ ID NO: 2795 - DNA, 1002 bp, Chlorella protothecoides
atgtccaagagcccgagactccttgggagatggcacaccgatgcccgtgagcgcagccgtgattggaaagcaaggcatgccttaccaccctcgcgcgcctcctcccgtgtactccccgtgcaggcacccccagcgagccctctttcccgtgccggcagcccacatcgacaggtgcgtggggcggggacaaccagcgagaggagtctggattccccgacaccagggaagggtgccatcgccgccccacctccctcccgcaggtcactcgacgagcccgacatcatgtcgtcctctctggtctgggagctggtgaagaagaacaatgcctttctgaagaagaacatcaacggcattgtggtctccaccgaacccgggaacctgcaccagagcatgctcatagtgtcttcacgttgttcctcatcgcaggatgaacaagcacagctacaagtactctggcctggccaactttggcaagaccatggacgtgtctgccgacgagtctggtctgctgatcagcaccagcagcaagaagagggccggcaacctccggtcctttgctgtaaagtcccacgcccgcaaggccaccaagtctgcggtcgccactgccggcgccatccgccccgacctcaaggtgaatggcgggtctcgcctggctgggctttgattgcgctgcctcctcccctcgttctcacagctttcgcacccctgacaaaccaccatccaatccaccccaatgttcacccacaggacgctgcacgcgccaaggcctccgccctggcctgattcccattgggtgtggatgagggtggcaggggcttaggggtgttagtgaggacagcagtctaccttgcatgtttccaagcgtcggagcatgtcaaggtggatcttgtgcattcctcccaaattggcgaggcacttgccatcaagagaagtagggagtcaatctcgtcatctcactgtcccatccctgaacagcgattcccccccacattcggcatctga

SEQ ID NO: 2796 - DNA, 924 bp, Chlorella protothecoides
atgatggagctggcccgcgacgccatgactgcgcaggggtacgatgtgctgggaggctatttgtccccggtctccgacgcgtactggaaggagggcctggcgcccgccgcccaccgcgtcgccatggcccaggccgccgccgcctcctccggtgggtggatgagtgggctttggatctgcttgtttggtgatcttgggcctcaggactgtgggtgtgttgggatccaaaggggcccagacggcgccaagagacggatgctaggactttgtgatggtggacgcatgggaggcggcgcagccccactacacccgcaccctggtggagctgcagcgggtgcaggcggaactgggccgcgctttctcgacagaggagcgcggcggcgcgggggtgctggccagctccgccggccccgcgcccagcccgcgcgcggtgctggtctgcggcgcggacgtgctggagaccatggcggacccctcactctggcgccaggacctgctggacgcgctgctgagtcagcacggcgtggtctgcgtgacgcgcggcggcgcgcgggcgctctccctgctggagaccccgggcacgctcctgcaccagcacgcggggcgcgtgtccatcgtgcaggagcccgtgcccaccgacatcagctcctccctggtcagcgggcttggaatgttgttggttggtgggagcgtatgaaggggggcccaggaggcctaccaagataccatgcagctgagcatgccccactggcgacactccctcctcctcgatcccaggtgcgcaaggagctggagcaaggcaggagcgtgcggtacctggtgccggacgatgccctgacccacatctacagtcacggcctgtatggctcgctgcagcagcccgcccgggagggcacccagctccatgcccaacaacatgcatga

SEQ ID NO: 2797 - DNA, 441 bp, Chlorella protothecoides
  modified_base (285)..(294): a, c, t, g, unknown or other
atgactccctggtctcacttacggccagtgggataccacaagcccatccctcgctcctcttgccgacaggacgaggtggcgcgctccatggctcgaggaggaaagggggtggagcgtgcagccacggagaagaagattgccatcctggagagggccctgcaccaccacccagggtccgagcgactcctcctggccctgctggaagccgtgagttggattagttcaggatttcacatcgacatcccacttgaaggcatacacgaggacatgggctgcatcatgggnnnnnnnnnnctggccctgctggaagccgtgagttggattggttcaggatttcacatcgacatcccccttgaagacatatacgaggacatgagctgcatcatgtgtgggcaatttctccagggcacatgcctcacaatgcctctgccaatacactga

SEQ ID NO: 2798 - DNA, 1872 bp, Chlorella protothecoides
  modified_base (1463)..(1472): a, c, t, g, unknown or other
atgtgttcattaacatacaagcagattgtcctgcctgtttcgagctcccacccccccctgtgcatcccaaacctaaaaatacctactaccaacacacccctgtcgtgcagccactgggtgctgaccaagggcgcgcccgaggtcatccgcggcgacctggctgcagtgccaccgcagtacgacgcgacgcaccgccgcttcgcggcgcagggcgcgcgtgtgctggcgctggcctgccgccgcctgcccgccggcctggcggcggccgacctgcgtgcgctgccgcgggagcgcgccgaggccgggctggactttgccggcttcgcagtgttccgcagcccactgaagccggagagcgagccgacgctgggcgcgctgcgcgcctcgggccaccagctggtcatgatcacgggggacgcgccactgacggcctgccacgtggcggcggccgtacacatcgtggtgcgccctgccctggtgctccaggcgccggcgccgggcacgggacgggggcgcaagggtggcgaggggggtcccgcggccggcggcgacgccgccgactccgccctgctcgccacgccgcccctggagtgggtcagccccgacgagtctctgcgcctgccttttgaccccgctctgggggccgccgcggcgctggcggccgaccacgatctgtgtctgaccggcgacgcgctggcggcactggcggccacgggcgccgcgcccgcctacgtccccctgacctccgtcttcgcgcgcgtgacgcccgaccagaaggagctggttgtcaagatcctgcgtggcgctggcctgggcgtgctcatgtgcggcgatgggaccaacgacgtaggggcgcttcgcggtgcgcacgtgggcgtggccttgctggcgccgccggaaaagaagaagaagcggggcgatgagaagaagcggggcgacgacaagaagcggggcgaggacaagaaggggagcagggccttggcagcaacggcgggggctccatcgtcgggtccggtcgccgcaccagccgcgccgggtgcaccatctccacccatcgcccccgcgccgccgcccggcccgggggccaagatgctggaggacatggcgaagaaggggcggcctatcacgcccttcatgcgccgcatggcgaaagccatggacgacatggcggctgcgcaggccggggcgggggacgaggtggccatggtgaagccgggggacgcgagcatggcctcgcccttcaccgccaagcagggcagcgtggcgccctgcctggacatcctgcgccaggggcggtgcaccctggtgaccaccatgcagatgttcaagatcctgggcctgctctgcctctcctccgcctactccctctccgtcatgtacatggacggcattaagctgggcgacatgcagtgtggctgtgtgcgtggggggttagcgaggttcagagaacctttgcccgcgannnnnnnnnnggcgacatgcaggtgggtggttgaggcgaggttcagagaacctttggccgcggctcagtacggcagaagctctgccctcaggggccgtgccaggggtcctataaatgaatgcgcctctcgtcactcctcgtccatcgtcttctcctgcatgctcgccttgtcttccaacaccctgcactcaccccacccgccaggccacgctggcaggcgtgctgacggcgggcatgttcttcttcatttcccacgccaagcctctggcgacgctgtcgcgccagcgcccgcacgcgcgcgtcttcagcgcctacaccctggtgagcctgctgggccagttcgcggtgcatatctccttcctcatgttcatgcagaggacggcgcacgccatgatgccgcgggtgagtga

SEQ ID NO: 2799 - DNA, 1773 bp, Chlorella protothecoides
  modified_base (92)..(101): a, c, t, g, unknown or other
  modified_base (329)..(338): a, c, t, g, unknown or other
  modified_base (419)..(428): a, c, t, g, unknown or other
  modified_base (655)..(664): a, c, t, g, unknown or other
  modified_base (786)..(795): a, c, t, g, unknown or other
  modified_base (1404)..(1413): a, c, t, g, unknown or other
  modified_base (1505)..(1514): a, c, t, g, unknown or other
atgctgctgctggccggaagctgcatcgtggacgaggcggttctcaccggggagagcacgccgcagtggaagagcgccatcgatgagaacgnnnnnnnnnngttcccgctgtctgcagggcacgcagaggggggaaggggggaagatattcatgcttaccctaggctttctcacatcaagtttgacggtcaccgcacgcagcaccagctgcctcgtagctgccgacccaccgtcccgcagcatggaaaccacgtcgccggggagcaggctgtcccccgggatcttggcccacttgccccctcggtacacgctgagcgcctgggaggggnnnnnnnnnnacgagggaggcgccgaggctcggtgagggctcagtgtggttgtgtgtggggggggggggatgatgagaaattctgggtgcnnnnnnnnnnacgagggaggcgccgaggctcgcacctgccacgaagtttggcgcttaccccagccccaacctcccagtcccacatcatgtccccccttttctcaccgccaaaggctgtccatcaagcgggacaaggcgcacgtgttgttcggcgggaccaaggtcctgcagaccacgggcgagcgggccgccaggctgaagacgcccgacaacggctgcctggccgtcgtgctccgnnnnnnnnnnagcgatgcgcggagcactacagccagcacgaatgctcaaactggctgtcctcaggtcccctcctggctcagcagtcctcggcaagcccgacaccagcgcggcctcccatgcgacgagatctnnnnnnnnnnagcgatgcgcggagcactacagccagcacggatgctcaaacttgctgtcctcaggtcccctcgtggctcagcagtcctcagcaagcccaacaccagcgcggtctcccatgcgacgagatcacgaggtcatctcgttccactccatccccactggccctcccctcccccacctccttgggtgtctgcagggcccggacgtcattcaggttcttcagccgctgcacgaccacggtgcactcaaaggtcaccagcatgaagaggggcccagaggcccacacagaagacttggaagcagaagaagggggccatgagctggtcggccagcagcgccgcgaagctgggcacgggcacctcgaagcggttgtcgccccaccgctccagcgcggcggccgtggcggcctcgctgcccaggcccgtggcggcgaggtaggcgcccaccgtgtcatgagaggggtacttgagcttggtgaaggcgccggtgtctgcgctgtgcacgaagcgcagcttgcggaaggagaaagcgtagcgcggcacgccggcctggggagcgcggcgtgctcagaccccaagtcccagatcggcaaggagcagggcgcaaagggggtggannnnnnnnnnaaccggctttggcaccgcccagggtgcgtgcagtttagagaaatggcagttggtgtgggaggggaactactgccagtctggctgcctggcgnnnnnnnnnnaaccggctttggcaccgcccagggattgcttcagcgtcccaaatatgcagcactggagatgcttccccaccctttcaccggtcccactctcctcccacataggccggctgatgcgcacgatcctgtactccaccgagaaggtgtcggccaacaatgtggagaccttcctcttcatcgccttcctcctcgtctgggccatcgccgcctccggctacgtcctgtactacggcctggcggtgcgcactgctgtggcgcttga

SEQ ID NO: 2800 - DNA, 966 bp, Chlorella protothecoides
atggaggtggaggcacagtacgccgcggcggtacgctccgtggcgggagcgctggccctgcgccgcgcgcggggcgccgacctggcggaactggaggcgtgggagcgccagctggcggggctggcgctgcagggcgtgctgctgatgcgccagagcgggcacactgaggcctttgtgggcagcatccagctcctgctggagtacaccctgtgccgccccgacgattggccagaggatgccttgccagacatgttccctgactactgggcgggacggagtccgctcctgggcgagccagggtccaggggttgggcggcatggctggcaggctggcaggccgcgcccgcccctgtgtctgccacggtgccaaggcgcgagcccgcggctgccgcggcggctcccgaggagaaaggtgagagcggcgcaactgccggagtttggaccgggtgggaggagctggggcccgccatccggcggcgctttgggcacgggctggatgttggcggccctcagggcgatggtctccaggaggccaagccggagccaagtgacgaccggggcagcatcttctgcggtccaacagcaggtcctggcagtggatcatgcatccgaaactcaggtgtcaagcacccccttcccttcatggtttctctcaacctccaacacccactgcaccccaggctgggcctggagctggaggcggcgctggagtctggggagaccatgacagatgcggtgctttcctcctggctggagagcgaggagtccaggtctgctgcccagtggcaccccctgcgcgtgctcgccctggaccccggcggcgaggccgacccagggtgcgacggccagcgcgccgtcgcctggggccgggtctcccacctggccctgcccctgggtgagggcgtgggtggtcgccatgggatgcagggagatctggggtggcgagatctaggggggacgcaatga

SEQ ID NO: 2801 - DNA, 423 bp, Chlorella protothecoides
atgtccctccctgcagccagccgagtcatcatcgagaagtactacaaccgcctgaccctggactttgacaccaacaagcgcatcgcggaggaggtggccatcatccagtccaagcgcctgcgcaacaagatcgcgggcttcaccacccacctgatgaagcgcatccagcgcggtccagtgcgcggcatctccctcaagctgcaggaggaagagcgtgagcgccgcatggacttcatccccgacgagtcggcgctgaacaccgccgccatcgaggtcgacgccgacaccgctgacatgctcaaggagattggcctggggtccctgcccggcatctccatcgccaaggtggggtgggcggtcgctggacactgggcatggttggggacggggttgtcgggagccactgctggggctcctggctag

SEQ ID NO: 2802 - DNA, 1554 bp, Chlorella protothecoides
atgatcgctcatgtggggccaccggtgtcaccggccctgctccctgttgcgcccatcgcgcgtgggccagcgtttcgctgccgggcacccgtactccaaccccgcgtgactgcttcgtcagagccgcgccgactaggaggcatggaggagggaccccgatcgctccagcctcaccgggctgcctccaaggctgacgctgccaccgccccatccggcgcaccagaggctatatcggacttcactcgagtgtgtgtctccctgatgcgtgacacggtggatgggatgctgctgggggccagagaagctcaggcagaaggtgcagacctggtggagatcaggctggatgccctcaccgcctttgatcccgcgaacgacatcccccgcatcatcgccgagtccccgctgcccatcatcatcaccctgaggcccacctgggaagggtgcgcagggcttgttgtagggaagagggagattgatggggtatccgacctgaatgggcctggcggtgggaatgtgttgacctgcttccctgctgaggtcgctgcctgccagcctgcgtgcttggcccagtgcacaaatctgctgaaatgccctctgcagagggaagagcgagctgccagagccacggcgactggctgccctcaagtatgccgccattctgggggcggcgttcgtcgacgtggagttcaagggggtggtggggatgcgcagagcggcacacacccatcacagcacctcgtcggcacacccgtgtactttcatgactggcagcagggccctggtgccaggcccagactgagtctggcccacgctaccccgctccctccctcccctccacccctccccttccacttcctgcacagactttggcgaggtgggcccgggtacccgcttcatcgtgtcctcccacaacttcaccgccaccccgcccctgtcggagctggaggagcacgtggcgctgtgccggggtctgcaggcccccgcccccctggtcgtcaagctggtgaccaccgcactcgacgccgcggatgcgatgaccatgctgggcctgctgcgcgccaccactgcagccgggcagcccatgataggactggccatgggagaggcgggggccagcgccccagggcagccctttgtctcggcgctgctgcggcgctaccgcctcagggagcagcggccggggaagacgcgcgtgtggggcgtggtggggcgccccgtcggccacagctgacggaatccacccaggacatcctgccgcccttcatcatgatgaagtctgccctgtggttgaatgtgccctccccttttaaccttgcctcgcttctctcctcgcctcacagcaaggggcctctgatccacaatgccatgctcaaagccgccaatatcgacggcgtctacgtgcccttcctcgtgaatgacctgccccgcttcctcaaggccgccgctgcgagtgggatggacctcggtgggctcagtgtcaccattccccataaggtggatggtggctggtgtggggggactggagctggaggggagctggggcacatactctga

SEQ ID NO: 2803 - DNA, 702 bp, Chlorella protothecoides
atgatctccagcatcggcaagaaggtcctggccagcggcggtgtcctcactgatgtaaagtcccacggcgagcaggctctcgcatacgacatcaggcggccgggggagcggtactcccaggtgcggtgtggatcagcgcaccagccttctttcgcattgcactctcaacgcatcggaatcgaactgctgccgtaccggctttcactcagcgcctcacgggtccgtacatcttccttccccaggcccacatctggcaggttacctttgcctccaccccagaggtgctcaaggacatcgaccacagcctccgcgtggatgagaccgtcctgcgatggatcgtgcagaagcgagagtacctggaccggctcccgaacacgcatcgcgtggccaagatggcccatcttgcggccgtgccagagcagcctgctgacgctcagcagacgtgatgcctcctttcctggtgctgcggctgccaggtgtcattacctagccggtgagcgtggcttgcaggctatttcgagttctctttggggtcccctcagtctcaggctggcatgtgatgatgaactacaagttatccctgtccgaatgccgttaggccggcgctcgtgtggaccaaacttattagctctatctgatgccaccgccctgtggagggagggtgccccgcatgctggtcgtgcacagcgccatctgcagtga

SEQ ID NO: 2804 - DNA, 1416 bp, Chlorella protothecoides
  modified_base (1134)..(1189): a, c, t, g, unknown or other
atgtacacctcctacctcctggcggcgctgcacgagggtcacgacgggcggcggctgaacgactaccaggccatgggccgcgcggtgctggggcggcgggtggccgcatggactgtggcccctgtgcagaacgtgctgctggtgggcctgtgcatcacctactccgtggcggcggggcagagcctgaagggcctgctgggcgcggagtgcgcgggcgcgggctgcgcggccggcatcacgccctggatcctgggtttcgcggcgctggagctggccgccagccagctcccggacatccacgccatctggtgggtcagcctgatcggcgcggccatgagcctggcctacaccgccatcgcgggggtggtcagctgcgtggacgccgcgcgtggggcagggcagggccgggaaccgggccccggccgcgaacagagcgcggcagacgccgtgtttggggtcctgaatgcactgggctccatcgggttcacctttggcgggcagggcgtgctgcccgagatccaggtgaggggctgggcagggggggaggtgagcgattggcgctgccgcgcccccgggccgccctgcgtgctgtgtgttgcacgaatagtcgctgcgccatcccaccaccctgtgaagctggtgctacctcttgtgctccacaaagaatcgcccggcctcaccccactcctttgcacccccaaaccccacccccccacccccaattcaccaaccaatgaaggcaacattagcggtcccccccgggcagccctccacgctgcgccccatgatgatcagcgtgggcgtggcgtacatcgtggtcatcgcggcctactacagcgtgggcgtgggcgggtacgcggcctacggcacggccgtcgcaccggacgtcctgctcagcctgggcggccccgtgtggctgcgccgctgcgccaacgccgcggtggtggcccacatggctgccgcctaccaggtcttcgcgcagcccgtcttcgcgctgatggagggcgcgatcgcggcgcggcgccgccccgccgtcgcggccgtcggaccctcggtcgcggcgccggcgcctcattctgccgccgcgacgccgcgagcgctgcgcctggcggtgcgcagcggctttgtggcggnnnnnnnnnnnnnnnnnnnnnnnnnnnnnnnnnnnnnnnnnnnnnnnnnnnnnnnntgctggtgcccttcttcgctgaggtcatgggcatcattgccagcctgggcctcatccccatgacctttgtgctcccctgcgtcatgtggctcgtctcccagcaaccgcgcggcgcggagcgcgcgctgaactatgccatcgcgggcgggtgtggcgtgctggccatcctggcactgattggcagcacccgcaatgtcatcgtccagctcaagctcaagcacggctga

SEQ ID NO: 2805 - DNA, 1170 bp, Chlorella protothecoides
  modified_base (927)..(980): a, c, t, g, unknown or other
atgggggtgggagggggcctgtggtcgtgcccagccccaggcctggccggcgggcagggtcccgtctttcgctgtgccacaccagggcagagccctcacttctgccgcagcccctggggacgccttgcagcacgcccagcctccgacctcctcacgcatctcctcctccactcccacgcaagcaggagtcgcacggcgctacgacctgctttgcgcgcctgcctgagccccgacacggggctggccctgctgctcggggtctggcccctcgccagggacaaacagagcatcaaggaccagctggtggcggtgctgcgccgggccatgtttgggtgggtgtgcccgggcagttcccagggtcaatctgttgaccggggggagataaacaggcgggaatcgagggtcactgggtaccaactgacccctgagcaagcagccgcacgcctgaaattccgcacaagtaccaggttgcgcgctgcctgggccccccgctccctgcacgcggcttctcaacccctgacctctccttcccgacacagccagaggcagggcaccgccctgctcgccgttcgcgccttcctgctcctggtcgcagaggagatggcggggggcgccgggtccgctgaccctggcgccgccgagcgcgcgcccctcatccagccgtcaatgagtcagcgcgcgacgctgtgcagcagcgacgggccgggggtgaccctgctgcacgagctgctgggctcgctgcggcgctgcctgagccagggtgttgcggtgcgggccgccgtctatgcggggattccccacctgctcagggcggatggcaccgccagcgtgagtttctggcatgcgggcgggatgattggtccagggatggcggaaggaaccgatcctcagacacatgttgttctattatgtggggtgttcccggtnnnnnnnnnnnnnnnnnnnnnnnnnnnnnnnnnnnnnnnnnnnnnnnnnnnnnnccccccccccccccccacggcttgtgttgtggcgttgatcatgttgatcattcactgccgcatcccatcctctccctttgcagagcgcggtgctggagatgctcctggaccaactgcactgcctgcggcgcagtgcagaggagggggagcaggcagccccacccctggatctcgaccagtgcatcgctga

SEQ ID NO: 2806 - DNA, 609 bp, Chlorella protothecoides
atggcgctgggccggagtgaggatgatttattggctcggccgctcaagaacgaggcggggccctggggagtcacaggcgccaggctgggctgcagggtgggatgcaacagcagaacccctccccttcgacccctcccccaccccacaggcggcaccctgctggagtgccagcgcctgctgacctccatgggtgccagcgccgtgtcggcctacgtgacgcatggcgtcttccctcgcgagtcatggcgcaagttccaggcggcgcccggctccgacgccgcggcccccttcaagtgggtggcctggtcttgttccttgcggggccctgagggtcgagaggctttgtggagcatatgggccatggggaccagcttggacgcatggctctcgcatgctcaaggaggcatgagtcggtgcacaagctctcttcacaaaccaccgcaaggtccactccccagccaccccaccctcgctcaccccacgacccctcccaccaggtacttttggatcacagactcctgccccaagacctgccaggcggtggagaaccaggcgccctttgagatcctgtccctcgccacccccatcgctgccgccctgcagctgtga

SEQ ID NO: 2807 - DNA, 1215 bp, Chlorella protothecoides
atgtccccaagcttcggacacgctctggtgaccaacccaggcgttacctgtacatcacccccacgggctttcgatacaggtccagcacaatggtgttccaggatattatcacgcagtaccttgagacggtcgtccctgtcttcacaatccgtggccttggggctagataccggcgagtcggtgggccccagtgccaggggcttccgggtcacagcccccaacatcgacgtgaaacgggtgcgccggcgtgatcgccccatcccaaaggattctcctgtccgccacctgcatgtcccccacaagcatgcaacaccccccacatcagatacccgacgaccaattgaggagggactccttcctcttctaccacccggaatgcgagaccctggccagggaggttgcggaagtcagcaacggcaacgtccagctgggccggatcacgtggaagtgagtgccgggagttgcacacagtggagcacatcatacccaagcgagcaggttgctggggtcatctcgtcttgttttacctaccctcaaacactccctgccgctcagtcgttgcccgccgtgtcctgctgctgcaatgcttccccttccccaccgcccctgccctggcacaggcgcttccaggacgggttcccaaagcttctagtggacgatgcggagcgcatccggaaccgccacgtctctttcctggccaccttccacgaccctggcgtgatctttgagcagctgtccatcatctaccacctcccccgcctcttcgtggcctccttcaccctcgtgctccccttcttctccaccggcacggctgagagggtggaggtggagggtgacgtggcaacggcgtacacactggcccgcatgatcagcaacattccgctggccaggggcggccccgcatcggtcgtcatctttgacattcatgccctgcaggtcgtcacaatggagatgttggatcactggtctgaaaggcagcaacactcctgctctgtggccttgtgcgccaggagcgcttctactttggggacggagtcctgccgctctttgagagtgggataccgctcctcaggtgtccatcgtgtcacttaccaggccggaatgtctgagtctgacgtacagcatccaggcgctgtgtggaagcgcatgaaccatgagcatgccacaatcccccgaccaccgcaggagacgactggtgcagcttcccgaccatga

SEQ ID NO: 2808 - DNA, 915 bp, Chlorella protothecoides
atgggggacagtgaggctcctgacgacctggacgccctgctcgcggggtatgaggcccaggcgcagcaggacatcgaggaggtgcaccgccggacccagatcaagggcagggcttctaagcaggcgaggtcccggggcgaggtccctgttgcctccagtgccagagtgctcctgcctgaacctctctccactccactgcagggggttcaagatgcttgcggcaatggggtaccagccaggacaggggctgggccaggcggcctccggacccagagagccagtgcctctcacgctgaagcaggaccgtctgggactgggacgcccaagtcagagagccctgaagcgggcgaggagggaggaggcgggggccgctcagcctgccatggcgcctgtgcagctgccagattcgagctcttttctcaggcaagcagcggccagggtggccgctggcagggcagcggcgcagctgcggcgtgcccaacaggtgagagccgggtgggtgagcgcttggtggactcacctttctattctcatcacctctctagccacagacattctcttgctcaggattctggcaccatccttgcaatcaatgccaggttgggagatgcctcaacctaccgagcataccttcttacacaggcttgtgaaaatcttgactccgctgctggcgtcggcaatcgccacgggttctggcagactcgagctgcggcagagggccccgatgccactgccatggtcgggagtgcccctgtgctgctggaagcggatgtgacgcctcagctgggtgaggtgctgcaatacctaaggacacagtactggtactgcctgtactgtggcaccgcatatgagaatgcagccgacctggcgtcccactgtccgggaccctctgaagcagatcatgctgacatgtga

SEQ ID NO: 2809 - DNA, 1227 bp, Chlorella protothecoides
atgcacgagctacgatgctcttcctgtggagtgcataggcggccggtgtccctatctttcgtaatgaagccagaacatcacagggtaatgagatgcttgcccttggcaaccctgtggaaactcgaccaaactggaatgacatcgcatgcgcgtgcgatgtcgagcttcggacaaatacataaccctccttgcagtttgatgtctccagcagcattccttctggatctgtcacctaacttacatagattgaaagaagtagcgatggtggccccaaaagcaccacagttttatagtccgcaagtaaagcttcgcagcctcacagaagactactgcgagttcgtgctcagcaacgtcaatgcgagcatcgccaacgcactacgccgtgtcatactggcagaggtgcccaccatagccatcgagcttgtggagatagagagcaacacgacagtgctgaacgatgagtacattgcccacagactggggctcgtaccctttgtgtccagccgcgtgcatgacatgaagaccatttatgaggccacagaagacgatgactggacagacgtggagtttactcttgacgtccggtgcgtaagaatggggggatatggagaacctgttggagactgccccaagcctcttggctggaggtgccaagaaatttggatgtgcgtatcgttcgtgcatgcctcctgcatgctggacatctcccatcctcgggcgcttcaatggcgcagatgcactggggacgagacgatgaatgtgaccagcgacgacttgcttccagctgacacacgcttcccagatgtcatgccagtgggctacgatgagcgaggctccctcacacgcaagcacaagagcgtcctcctcgtcaagctgcgtaaaaaccaggagctcaaactgagagctggcaggcacattggcgatgatggacagatacccgaccacagtccgcatgtcatttgcggtattggtgtgggcattacttgggactatgcatgtggcgagacatctccctccaactccctctgcgcaggcatagggaaggaccatgcaaagtggatacctgcggccacggtgtcttatcagttcctaccagagatcaccatcaaccacgatctcatggacaccctgacaggtaaagcgctgtggcgtgtgtgcacatcaagcaggggtggcctctgtgtgctgacctgccacggaaacaagatctcccggtcttgttcttga

SEQ ID NO: 2810 - DNA, 1320 bp, Chlorella protothecoides
atggcgctgacgccggtggcgctgatggagggcatggccctggtcaagaccctgtttgccgggcaggacacggcgccagaccacgccgacatcgccaccgcggttttctcccaccccgagatcgggacggtgggcttgaccgaggagcaggtgtgtcttggttggtggcctaggaagggtcaaccgacattggattggaggttcgaattcatcgccccctcgctccaaatagcttgggagtttgtcggccatgaaacctgcgctgcctctcctggtgccaggcccacagcctctcctggcaaccttccccccacaggccgcggagcggtatggcgacctggacatcttcacctcctccttcaagcccatgcgcaacacgatcagcggcaacgagggccgcgccttcatgaaggctgccttgtgtggggcggctctcgtgctcgattcctgttgtggcttgcacttggcactttgggccccagcatgcccccccggaagcgcctcccctcacccccattcccctgcaacacacccccaggtgggcccgacatctggcgagatcatgcagggctttggtgtcgccgtgaagatgggcctgaccaagacccagctggattcggtcgtgggcatccacccaacctcggccgaggagtttgaggacccttgcccccacccaacgttgtgagagattacagcgcgacgctgccaaacacctgtgcacgctcagagcatgccgtgtgtgaggtccgccagctcagccccctccctgtccagctcggcgccgaaggtctgcagcttgccgctgagcacgtcgagggcggtgagcaccatgtcatcgggggtgagcgcccccgtcccctccaccctgaagatgaaggtgtcctgcgggagggggaagaaggagggggaggaggtcatgggcgggctgcaggccacctggcagggtggccttggctgccagtgatgccacatccgctcaagtgtgcgtggagctgtaccctggctccccacacaaaccagccgcagcctcggagggggactgctgagcatccctgccgggcaccaaacgctgacttggaccatgaacccccacctgccgctggcagatgtcgatcaggccgggcttgcccatctctgcagccttggcaagcacctcgccgtcgtacatgtacagctcggggtcgacgatttccacctgcgggtcttggaatgagctcactgactgagaggatgcaggcgaaccgaccatccactgcaggtcagaggcacatgggctcactccttcaagagcccctcatgctcaccgctttactgatctga

SEQ ID NO: 2811 - DNA, 498 bp, Chlorella protothecoides
atgacccaatcgtcctcaagcgactcctctgctatcacttgccgtgcccaaggagcccaatccaactgtccctcacaccctgtgcaggtccgtgactttgccgcaagcgagtatgcaaagaccggcatgcatctacacgccggcttctcccccgtgtctgtcaccaaggctgcggacggcaccttcaacgtcaaggccaagaccaaggatggcaaggagattaacttggagggcgcagactacgtcctcgcagcgacgggtgcgcatgtgtcagatggagggtgtgtgccagcaagtgcgacagatgcactcagcgctgtctgcggaagggtctgcccgatgcactcggtcgcagtccagctccaattttttgcggcacaccctatgcctccccacacatgtgcaagccgcacattcccaggcaagcctttgcccctcttccgtccccagggcgtcgccccaacatcaggaacctgggcctggaggaaactggcgtga

SEQ ID NO: 2812 - DNA, 462 bp, Chlorella protothecoides
atgctgccaacatgtcccacatgctctttccctgttccatcctgcctctgtctcctcactccatgcccacccctcccacagttcatcgagggtcggggcaggctggtcgatgcccatacggtggaggtcgggggtaagaagtacaccgcccagaatatcctcgtagccacaggcgcacgcgccttcgtccccaaatttgaaggctctgagcactgcatcgtgtccgaccacatcctggaggttcccaagttgcagtggcttggtgccctttccactgctcgttcattaacacatgcccaggttcccaagcgcctggtcatcgtcgggtctggctacattgccgtggagtttgccagcatcttcaacggtctgggtactgaagtgcatcttgtcttccgccaggaccagccactccgtggctttgatggagaggtgagtagaagcctgggagggtgggggtaa

SEQ ID NO: 2813 - DNA, 357 bp, Chlorella protothecoides
atgctggcggtgcccttctttcccttccatctgtcggccgcgcacacgctggctacccaggccgagttcgcgcgttgcgcaaggcacagcgcgccggtgcgccgcgccttccgcctgcacgccgccaccgccagcgcggccatcgccgccttcgcgttggaggaccggctggcggagcgcggcgtgcgcggcgcgcacgccgtgtggcacgtgctctcttgcgccagcgtcgccacgctaggcgcgctggtggagcacaaggagggcctccgacggggggagggcagcccgcacgacagcgttgccagcctggaccgcctgggcggcgggtcgcccaaggccaaggcactcgactga

SEQ ID NO: 2814 - DNA, 414 bp, Chlorella protothecoides
atgctaccagtatgcagcaccaatcagcatgcccccattcgcccactctggcccccttgcctgcagaactttggccagcacgcacgcgagctggtcacctccgagatcgcgctgggtctgctgcgcgtcctggccgacccggcccgcgagctgctcaccctgctggagcgcaggcgggtgggcagccccatccccatgctggagctgctggcgaagtcggtgtggaaggtcattcccctggagaacagccgcgggcgtgcggtggtggaggcgggcaggttctgcgagcggcgcaatggccgcggcgtggacaccaaccgcaactggggcgtggactggggcaagaaggagcccgactacgaccccaacgaggagttcccggggaccaaggccttcaggtgtgcatgtgtttaa

SEQ ID NO: 2815 - DNA, 1299 bp, Chlorella protothecoides
atggtgagcctgcccgtcagtttccggcctgagcgtgcggcccaccctgctgcccctccgctcctggccagcgggagcaggaggacctgccttgagggcactggatcctcagcacattcagcaacctccgccccccaaggactgctccagggtgaggagacgtccaagctgcgcccgcacccccgctggcaatacctccgctccctggtgtggattcgcgtggtgctgaacctgggcctactgtacctgctgggcctggccgtcgtggcgagcctctactccaccctgcctaccctggaggagttggcgcgacgcgcggcctcccggggcgcccccgccgccgcctccgacctccgcatggccatcccccgctccttcgacgagctgcgggcggtgcgcggtacactggccctctaccacgcccaggtcccggcccggctggccgccctgctggcggcggcccacatcttcttgcagaccttcttgaccccgggcgcggtgggcatcaacatcctagccggctccctgtaccaccctgttgttgccctgaccttcatcaccgtcgtgtcgaccgcggggtcggccacaaactatctgatggtgcgctggcagctcaaggacgtcctggtcgccctctttcctcaccgcatccagaccttctcggccgagagcagggtccttcccgcgtgggtggtccctcctttctgtgccggatgctgctggcgggccaccccggccgtggctgcatccctgagagtcctctgtcccagcaactccgcaccccctctcctttaccgccaggtaaaacgccatcgagcacacctcatgcactacgccctctttctgcgggtgacgcccatcttccctgcgtggttcatcaacgtggcctcccccatcgtcgacatccccttcagcgtcttcatcatcgccaccgcggtcggccaccagccgcacaacctaattaccatccaggcaagggcgtccgggggaaacaggacacttatgcgtggggaggatgcgtcgtgcgtgcactacaaggtggggccgcctctccgccgggccgaccgatcagtgtcagacggcagtgttgcacccgtcattgacgtcaggacactaacgatgcacagcctgcacgacctgtacagcctccagaatgtggcgctgctgctgggcatcggcctgctggccctcttgccccggttgatcaggaagctgcagggcaggaggggtccgctactccccatcagcgacccggcagccgccggcgacggagacaagactccagaccacaatcagtag

SEQ ID NO: 2816 - DNA, 906 bp, Chlorella protothecoides
atggatggcgaggttttggctcgaggtcggaatcttccggcaggcattggtcgagcaggccgccgggctgcttgtgaggcatgcctgggccgggcgcgagctgctgctcccagcgccacggcggacggtccgcgatccacacccccccactgcagcgagccggaggccaacctggtccgcgaggcggcggtcctcttccagccccacatctggatcaacgtgcacagcggcatggaggccctgttcatgcccttcgaccacaaggtgggggcgccggggggcggcggcgcggcggcctccaacgccaccctggcgatgctggcgggcgtgaacaaggaggtgtttggcggccgctgcgtcgtggggccgggcgggaagagcgtgggctaccttgcgcacggcaccgccaccgactacatgcacggcatcctgaaggtccccgtgtccctcacctgggaggtgtttggggatgagagcgcagcgtacgaggactgttacaggatgttcaaccccaccacgcgggaggggctggaggcggtggtggattcctggacggcagccttcttcgcgctgctcagccgcgtgccggaccacatgggcatgccccgccagttctggtccccgcagctggccgcacaggtggcggcggtgcgcgcgcgggacgtgagcaaggcggcgccggggaggaagggcggcgacggcgagggcgaggcggccctggcgcaggcgcggcgcgccgccgccgccctcggcacgaggcgggaggggttgggcctgacgcgcccggcggtcctcggcagctggggcctggccccctggatgggcgcgagcctcgcggtggttgcctttttcgtggtcctcttcaggcgacgaggacggagcagggcgacacatgctgcgcagtga

SEQ ID NO: 2817 - DNA, 477 bp, Chlorella protothecoides
atgcctggctcacagttctgcacgctggagccggagctgctgtgccacgccgtgtttgtccggggcgtggagtgcgagggcctggccctgcctggctgggaagaatcaatgtctcgtcagggaccgcccaaggccgccacccctggtgtcgccacccccggcgccgccgcccttccccccgccccgccgggcgtcgccactgcgcctgcggtcgagctgcccagctgccccgtctgcttggagcgtctggacgaggagagctccggcatcgtgaccacggtgtgcaaccaccgcttccacaacgactgcctgaggcactggggcgattcgtcctgccccgtactgccagccctccgtggccgacacgccccactgctccacctgcgcctgcacgacaggtgggtcctgcctgtgcattacgcgtgtgttggggggggtgggtgtgatgctccctgcccgagggcgtttggaagctga

SEQ ID NO: 2818 - DNA, 987 bp, Chlorella protothecoides
atgcctcccatcaacaccgcgaaggaagccgccctgcaagccgcagacgaggcggatggcctggcggccggcatcggggccgcaaacactctggtgtgggcgggcccccgcatgacccaggggtgcagggcctacaacaccgacgcgttggcggccctgcacgccatcgaggacgggctgcggcgaggaaaggagcgcggggcggggccgcagaatgctgatagtgacagagcgtcctccaacagtggcaaatcttctggtgttgccgaggcatcttcttcccacagcggtggtgtctctccgggcggcgctgacgccccacacggcagcctcccttctcccaccgtgacccacaccagtcaggcgtcgccgctgcgcggtaagaaaatcgtggtgctgggtgcgggcggcgcgggccgggcgctggcccttgccgccgcgcgggccggcgccgccgtggtcatcgcgaaccgaacgctcacgcgtgccgacgagctggccgccagcgtgcgcaccgccgtccccggcgccagcgtccaggcggtgcggctggacggcgtgcggagcggggagctgggcggcgacgtcctggccaacaccacccagattggcatgcaccccaaagtgggtaggtgggggggtagagggtgggggttggggtctggagagccgctgcacagagaacaaggtccagggcgcatggcgcgctgcacaccgcatacacaccgcgctggcgagctgcgccagcttctctgcgtgcatacgtatgagggcggttcccctgcgccagaaggggtttctttggtttcgactcaccccgctctcatgctcatgctaagcctggccctgcgcattccctcccgccaggtggacgagagccccgtgccggcaagtgcactgcggcggtacacgctggtcttcgacgccgtgtacaccccgctgcatacccgtctcctcaccgaggccaaggtgggtggccatgcttga

SEQ ID NO: 2819 - DNA, 195 bp, Chlorella protothecoides
atgacctcctccccctccttcttccccctcccgcaggacaccttcatcttcagggtggaggggacgggggcgctcacccccgatgacatggtgctcaccgccctcgacgtgctcagcggcaagctgcagaccttcggcgccgagctggacagggagggggctgagctggcggacctcacacacggcatgctctga

SEQ ID NO: 2820 - DNA, 273 bp, Chlorella protothecoides
atggtcggttcgcctgcatcctctcagtcagtgagctcattccaagacccgcaggtggaaatcgtcgaccccgagctgtacatgtacgacggcgaggtgcttgccaaggctgcagagatgggcaagcccggcctgatcgacatctgccagcggcaggtgggggttcatggtccaagtcagcgtttggtgcccggcagggatgctcagcagtccccctccgaggctgcggctggtttgtgtggggagccagggtacagctccacgcacacttga

SEQ ID NO: 2821 - DNA, 495 bp, Chlorella protothecoides
atggcgattgagggggagggtgtggcgggaaggggtggactctgccttccatgggatgaaaagaggaggtctacatccctgcacaggcatcgtagccctctctggcgcctcttggccacccaacatgcttgctgccgcctggatcttcgtgcctcaacgggccttccctacccccccctccctcaggtcgtctgtaccaaggtcagggatggcgatgcccggatggtgcagctgaaggagggctcgcctcaagggcgccatgtggtcattgtggacgacctggtgcagtcgggcgggacgctgctcgagtgtcaacgcctcttggccagccaaggagcgctcgccgtgtccgcctatgccacgcacggcgtgtttcccaagggcacttggtccaggttcctgcctggatcccaggagggttcgccagggttcaggtgtgccctgtgctgggtagcatggagcgagtgggagggcgatggggggagggcagcatga

SEQ ID NO: 2822 - DNA, 180 bp, Chlorella protothecoides
atgtaccccatcgtgggcgccctgcgctacagccacggcgggcgctgggaggtgtacaagagggtgcccatcctggcggagaagacggaggtgtacacccacctcgccagcttcgacacgcagccggggtccacggccatcaccgccgccttccacgccttccagcgatcgcagtggtga

SEQ ID NO: 2823 - DNA, 393 bp, Chlorella protothecoides
atgctggtgttacagagatggtcatcggcgaggggtactgtcgcaaggggcgtgtactgcgccctgcgtgcgttcgaaggcggcagtgggccccaaaacccccgggccatcctcgatggcaatccctggacacccgccggggccctctcctccaccgggatctccttcccgcgtctctctcggtcgtttgccgcagcagggactcagggagtgccctacgaccaactggctgtgggcgtacccaaggagtcctttgagggtgagcgccgtgtggcgctcaccccggctggggtggctgccctgaagaaggcaggcttcaaggaagtcctggtggagtctggggcaggcgctgccgccaacttctccgtgagtgaaacggtgcagggtcggtga

SEQ ID NO: 2824 - DNA, 399 bp, Chlorella protothecoides
atgaagctgtttgcggagcaggccaaggacgtggacatcatcatcaccaccgcactcatcccagggaagcgcgcccccgtgctgatcaagaactacatggtggagagcatgaagcccggctccgtcacggagcccaccattctcccccctgcataccttccccgacccatgtcaaccctcccacccgcagtggatctggcggctgagcagggcggcaacgtggagaccaccgtccccggcaaggtcgtccaggccgggggggtgacctgcatcgggtacaccgacctcccctcccgcctccccacccagtcctccaccctcttctccaacaacatctccaaggtgggggtggtgcggggggacaggggactttgcgtgtggggtgtgcaatgtgtgtag

SEQ ID NO: 2825 - DNA, 963 bp, Chlorella protothecoides
atgcaaacgcagaagaatgcttggtataactccccaatcaaagttctcacattatccgtatttctaaagcattcaaaacagtggcactggccacctcttaccaatggcatcgtcacaattgttctaacttttgttttccctccaattgcagtatggcgacctcttccgaagcttgcgaatgccagatgtccgtatcgctggtacagatctcacctaacccagatccctgccgcgcttgttagttttcaagtcatcggaaaatcacgagcacaattactctgtggcatttgcttgaagttgcacacaagtcttcgctcagtggtctcgccacggactgtgcctgcccccgggcccgcctcgtttagattctgtccaggacaaaggacattgcatggtactctgctgatccaactgtactgttttgcgagctgcggcatgggtacggggacgctcgctccctctctcaagcaggccttatttgcctacacctcgttcacactattgtacattttcggccagtttcgtgactttttccggaagcgctggagcaaagcctccctgaaggggtacgctcccatccgccaggattatgaagacttctacaccaggcgtatgcgatgtccccggtcaactgccatctgctggggaaagggagcaggtgatcaaccaggaactcagcagcttgcctcttgcccatgcgcatcgtgcaggactgcttcaatcggccaatcactggccctccctcctcctggatggacgtcttggagcgaacacccgtcaacagacaggagtgagtttgggagccccacttgcgtggtgggggttgactttgtgcgtccaatgcattatttgagcctcttctgctactgttgtgcgcattcttccatggctctaaagttctcaggcatgcacgggtgtaccagcgcaatgagcatcactggagctcgcttcgccatcctttga

SEQ ID NO: 2826 - DNA, 222 bp, Chlorella protothecoides
atggagggcgaggtggtggacctggccggcttcgtggcagtggccaagaagtacaaggcctacatctggctggacgaggcgcactccatcggggccatgggggccacagggcgcggcgtctgcgagcacctgggcgtcaacccggccgacatcgacgtcctgatgggcacattctcaaagtcgttcggggcctgtggcggctacgtcgccgcaaacaagtga

SEQ ID NO: 2827 - DNA, 663 bp, Chlorella protothecoides
  modified_base (344)..(353): a, c, t, g, unknown or other
atgccctgcgcacctgtatgcgacggccatgaccccccccgccgtccaaatggtcctctccgcgctgcgcctcatcactggcgcagacggcagcgaccgcggcgcgcacaagctgtcccagctccggaccaacgccaactacttccgctcccgcctgctgcacatgggcttcaacgtcctgggggactgggactcccccgtcatgcccatcatgatcttccagctggccaagctgtcggccacctcccacgagatgctgcgtcttggggtggcggtggtggtggtgggcttccctgccacgccgctgctcacctcccgcatgcgcgtctgcatctccgcctccnnnnnnnnnntgggcttctgcgcctgggcttcaacgtcctgggagactgggattcgcccgtcatgcccgtcatgatctttcagccggcaaagctgtccgccacctcgcgcgagatgctgcgcctcggggtggcagtcgtggaagtcggcttccctgccacgccgctcctcacttcccgcatgcgcgtctgcatctccgcctcccacacgcgccaggacctggactacgccctacagctcttcgactacgtcgcagaaagggaactgcagggtgtacctgcgctgcaggtgcctctctcaagcccagcctcacctctctga

SEQ ID NO: 2828 - DNA, 957 bp, Chlorella protothecoides
atgtccaggcacaacatgcagcctccatgcccggcatccacaggtggtggcagcggttcgtggcccccggaaccccggccccgcagcgatccgcccctggcagccagcaacctggtgttcctgggccccgcggactcaccccccgcgggccagcctcttggcccccccaacgagtgggtccccctggcccccagcgaccacccctcctcccctccacccgcctgggcccccctccccttggtcccctgggacctggccaccacggccaccgtgctcgccctctggctcctgggcttctggtgcctggcctacggcgcgctgccctgcgcgctggccctggccggcctggacccgggcagccccgcgccggtgttccaggcgctgcgccacctggcgctggacgtcgcccagctagcgctcacgctgggcctgctgggccgggcgctacgtgagcacgccccccgcgcgcgcggcctcttcgcgttgcgggccctccccctctccgactgggtggggccggcgctcgcgggcgccgccaccttccccgccatccacgccgtccaccgcctggccgtggcgctcaccgtgccgggagtgccggcccctggcggcggcggtggcgacgccgcggcgcgcgcgctgctgggctccggggacggcgccacgcgggccctctggttcttcatgctggccgcctgcgccccggtctgggaagaggccatgttccgcggtttcctcctcccctccctggccacgcacatgccgcgctgggcggcggtgctcgcgtcggccgccgtctttgcgtgcgtgcacttctcgcgcgagaatttcctgcccctgctcctcctgggctgcgtgtttggtgcggcttacagccaccgcgccaacctgctgccctgcatcctgctgcactcgctctggaacgtgttcctcctggtctccgtctgcggcttctga

SEQ ID NO: 2829 - DNA, 507 bp, Chlorella protothecoides
atgccgtgggttggcatgttcctgccgtcacgccgacgagtgcgcagctttgatggtgatggagctcccccgggcctgctttgcgcgaagagtgctctgattcccgacctcgtcgagatggccagctgggtcccactccctccctcgcaggccctgcggccgccgggcgtggccctgctggtggtggtcgtgcggggatgtggggtgaaagccgcgcgcacggtgccgtgggttggcacgttcctgccgccacgccgacgagtgcgctgctttgacggtgatgcagctcccctgggcctgctgtgcgcgaagagcgctctgattcccgacctcgtcgagatggccagctgggccccactcccaccctcgcaggccctgcgcccgccgggcgtggccctgctggaggtggtggtgcgggtgtttgctggcgtgcgggacccgctggccgaggggggcgagcccctgcttgggcagtacgaggcccagctcgtgtcggccatcaggtga

SEQ ID NO: 2830 - DNA, 2454 bp, Chlorella protothecoides
  modified_base (264)..(273): a, c, t, g, unknown or other
  modified_base (395)..(404): a, c, t, g, unknown or other
  modified_base (708)..(738): a, c, t, g, unknown or other
  modified_base (1044)..(1053): a, c, t, g, unknown or other
  modified_base (1277)..(1286): a, c, t, g, unknown or other
  modified_base (2125)..(2134): a, c, t, g, unknown or other
atgatgaatggtgacacggctgcaaagtcaagcaccctggacaggagccggtgctgccagctgccgcttttcgtggctccaacccgcgaaccaatcccttgcaggaacctgtgcgtcgtcccagacctgagggacggccccagtgaggcccgggacgccagtataagggcccggcatgcattcgtgcagcgctgcttcgaggagggggtgaccgacgtgctgaccctggccacctgcgccgcgggggaggtgcgtgtctgttgnnnnnnnnnngaaccaatcccttgcaggaacctgtcatgcttttgggatgagtcccccatcacaaccgacgagtcctcgcatcctccatacacacctacctgcttgaaggtgccaccacctcacctgacaannnnnnnnnnactggcgcccgccagggtggccattgtttcccccatcacaaccgacgagccctcgcatcctccatacacaccaacctgcttgaaggtgccaccacctcacccaacacactcaaaccccttgctcctcttccttccctccacagcaccccttcaaggcagaggcccctctgctggtggagatcatgcagggcctgctgtccctggcagagccgtccgccctgctgctggccccaaccgagccgcctcgcacagtcccggcctcgacaagcggccgctcagcggtctccagcgccggccgccgccnnnnnnnnnnnnnnnnnnnnnnnnnnnnnnncctgccccgcctggacacggccaccgcgctggggcgcagcgtggcccagcgtgctcccgcccggcacgcgcactccaacgccgtcttcgtgcgccggcatgcggaccacactcgggacgtggtcctgcgccacaaccaccggcggtcagagctgccggtgctgccggccatccagaacgccaagcaggcgcaggcgcagagtctgcctgcgatccggagcagctgagggactcgcaggctcgggacatcaggaaccctgtggccccaaacagccgttccccccgcgccttgcaccggcccatgaannnnnnnnnnggcgcaggcgcaggtgagggagggagggggtggggggaagtggtggtgcacatggagcacagggccagatttggtgcagagcctgcctgcgatccggagcagctgaggcactcgcaggctcgggacaggagggagggcccctctggctgggtgaagccaggggccacgagcaccagctcaggggctgtcctggtgccgagactcgcggccttcctcgaggagtnnnnnnnnnntcttgcactcgcaccgcagaggagggaggggccctctggctgggtgaagccagggaccacgagcaccagctcggggactgtcctcgtgccgagactcgcggccttcctcgaggagctcctggcggaggggtacaatgaggtcatgagcacggtgagccattgtgtggaaggatcgagaaaggatgctgggaggagtgtgcttggaagcctgggtcagctttcccacctggtcacgacacatgctcacctctggccccctcccatccccacaaccccccgccagatgtttgccgggctgcgtgcgggtcttctggtgtccacactgatgcaggaggacttccagaacttcgtgcggctggcggcctactgcacgcagtatgtccgcctgaaggaggtgcgcgccggaggccgagtcctgcgctgtgcaggaatgtccactgtccacctctgggtcatcatgacgaaaggcgccgagcccagcaccggtcccccgccgcaggagtcgcggctcgcctccaagggcgccgacacacccgaagccacaaagggcgatggagaggagcgacccacatcgccttttgccggcatcgcagccacgatgggctttgagaatttccactgggtacgcaagcccttgtattcatatctgaacagagtgggaatggctgtgtcgacgggcccaacaggcatgctgtgcacgagtactgggcaggattcccaggctgcccacagtcagagtatccatgtgccaggctggaggaggggacaaacagtgtcgtcaccacatctagaaggtttgagcacgcggcccgcccctcagcacaactcaaaagctcccnnnnnnnnnnctgggcaggattcccaggctgcccacagtcggggtccacatgctgtgggtgtccctgaccgacgtcccagccaaccacggcaagcagaccaaccatgcagacaagcactgggacctgcaggtggggtatcggaggcgttagggttgggctgtgcagctgcagccgttgcactcagtggccgccaggactgggggtggagggttctaccttcacctcatcctccaagaccaaggccctgggatgcagctcacacaccccccccaaacacccccccccccttcacccctgccacagcacgcctccgtcccgctgctgaagga

SEQ ID NO: 2831 - DNA, 1239 bp, Chlorella protothecoides
  modified_base (789)..(798): a, c, t, g, unknown or other
  modified_base (1182)..(1191): a, c, t, g, unknown or other
atggcagtgcgaggaagaaggatcgcttgtgcggggtggttgctcgtgtcggggctgttactcgacggtttggatgccgcgcctcacgcgcagcacaccgcccatgcatcacagcctggttacggggctaaaaggcgcacagcacctgccgccactgccacctccggccagccgcgcgcgcacggcagagctccgcgatgccgaagagcaagcggaataaagttggtacgtatgaaagctaaccctgcaatgcttgcatgccatgggcccacaataagcgacccgtccctctccgcaaattcccttcctgcagtgtcgctgacaaaagtcaagaagaagaacaaggagtggaaggagggcatcataacacaaactcgcagctatctggatgagtatgcctctgcctacctgttccggtaccagaacttcagaaacgacaagttcaaggacctgagggaggagcaccgcgcgaccagccgcttctgcctgggctccaccaagatgctgaaggtggccctcggtgccgatgaggccagcgagcacacccctggcagctcccagctggcctcccacatgcgcggcagcatgggcctgttcttcaccaaccttccccgcgaggaggtgggtggtgggggcctggctgcatgcagggggggtattcctcacagcagggggccgtttcatggttctatggtggatggcggctggcagccttctacgtcgggggacctacagcacctctgctcttgtgcgcgcatgccacccccctcaccatccaccaccacttgnnnnnnnnnnggcggctggcagccttctacgtcgggggacttacagcacctctgctcttgtgcgcgcgtgccacccccctcaccacccaccaccacttcttcttcttaccaggtgacgtccatcttcgaggatttcgagcacgcagactttgcgcgcgccggcgcgcgcgccacagaagacttcagcctcgaggccgggcccctgacgctgtacggcgagccgctggcgcacaccctggagccgaccctgcgatcgcatggcctccccaccaagctggacaagggggtagtgaccctggtggcagaccatctggtttgccgagcgggcgacaagctgaagcccagccaggtgaggggtggaggtggacaggcaaatgccagtgaggtgggggannnnnnnnnngaagcccagccaggtgaggggtggaggtgggcaggcgaatgccggtga

SEQ ID NO: 2832 - DNA, 600 bp, Chlorella protothecoides
atggcgctcacatgtggtctgacgggaccttgcatgcggtggagcttgtcccaccgggccaccccggcgaatgttacgtgggagcccgtgcgcaggcctcgacgagcgaggctcctgacggtgcatgcatcatggagcctcggagtccccgaggagctcccgcccagcgagaccgggacggtgcgtggtcatcacgcgcccggggatcaaagggtgggacatgccgggcgatgggtgaatgcagccgttgctgcgtggcatgatgggttggatggtacaggtccccgggtctatgccaggcacgcgtcaaaggacagcactccacatcaccccatctttcccccacccccccttccacagtctgcgactgattgcccgctgctgcagtatgctcacaaggtgtccttggaagaggtggcagcctttgacgcctgggcgccactggccgtgcagcatgccctgcggaccacggtgaacaacctggtcggcaacctcccctcctcctcctttgacgtcatcatccgcaccagcgcccccaagatggcgctcctgctcttcagcaccctcatgacaggtgggaggtggtgggggaggcggtag

SEQ ID NO: 2833 - DNA, 672 bp, Chlorella protothecoides
atgcttcctcccccctccctcaccgcccatctgcacccaggctacatgtaccacggcgcgtggcagaggctgtgcctgaacgagcggctgggggcagggtcccccatcgtggccccccaccaccgcaccctgatggacagtgtgcacagcatggatgacgacgagtaccggccgccggggggcgagggctcgcccgccgcccccggcgccggcccggaccctggctatgcccgcggctcccagcagctgggggtgacgggagaggtgctgcgctggcacctggcggcggggcgcgagagcatgcctgccagcgagtacatccgccagctggagcgggaggtggagcagcaccgcgcggcggctgccgccgcgccgcgcagcccgcccgggcacgaattgttggactttgtgcgccgcgcggacggcgctctgacggggcaggccagccccgccgcgctgcaggccatgactggcgtggtgcagcgctccatgggcgagagcgggggccggggcgggagctggcgctcgggcacgcgcgactgcgtggccgctgagttggctgagcagctctactggctggcgatcgtgggctggcagctgcgggccctggagtttgacgccaggaggggggccgcggatgccggcggggaggagagcgcggagcggccctga

SEQ ID NO: 2834 - DNA, 1125 bp, Chlorella protothecoides
atggacgcctgctgtgcggcctgcgtcgccctgccggcctgcaacgtgtacgtgtactgccactcggcggcgggctgcggcgaccagctcaccggcacctgctggctgaagcacgcgcgcaccctggacctggcccgccccgctggctcccgctccgacgccctgggctggtcctccggcgcggtggccaccgccggggaccgtgccgcggccctgctggccgccaagcaggcggaggagacggaggcggcgcgcctggcggccctgcgggccaacgcctccctgcccctcgtcttcttggatgtggccatcaagggcacgccgcaggggcggatagaggcggtgctcttcccggacgtcagcccccgctccgccgagaacttccggcagctgtgcacgggggagaagggaaccgtgccggaggggagggagggggcaggcatggcgtaccacttcaaggtgggtgcgaggagtcctgggcagctcgcgattcgactcggagggctttggtggggtgcactgggggttgtgattgacctgggagccagtgctgggccgctcgccgtggcctgccgggggctttggtggggagcactgggggctgtgattgacctgggagctgtagttgacctgggagccagtgctggatcgctcgccgtggcctgcccgggtgccagcccaaatggtctccaggacaatgaccctctcgcaaggccagcccgggctccatcgatcggcacgccgacgggcgcgtccttctaccgcatcatcgacgccttcatcgaccagtccggcatcaacaccgagtccgtcttcggcggccagttcagggacgatgccggcggcctggccctgcaccacacccgcaagggcctgctgtccatggccaacatgggccccaacaccaataccgcccacttctccatcatgatgggccccgccccccacctggacggctcctacaccatcttcggccaggtggtggcggggctggaggtggtggacgccatcaatgcgctgtccaagggccagccggagaatacggcgggccccgacgcgggggcagtcattgtggatgcgggagagctccgccacggcaccatcgtgcccaacctggaagcctga

SEQ ID NO: 2835 - DNA, 573 bp, Chlorella protothecoides
atggatcccaccgcctccaaacctcaatccgtttgcattgctggcccggatcccgtagccctggtgctcagcccctcgcctctgcgcctccccgagccagcccgggccgtgcccccaccccaacccccgaccctcgcccacatggccgcccgggtgcagcagctggtcagcaaggccaagtccacggtcgccccgatctactccaccgctcgcaaggaggtggtaaagcagtacgacggcctgctgtccaagaactccgagtacgtggtcaaggaccctgagcaggccagcaagctgctgaagcagtacacattcaccaagctggccagccgtggtcgccacgccacagggacatttcagggacctctctgtcccccaccctgcagcatccccgagggcatcgccacctgcaagaaggaggccgctgcagcgaggcaccgtctggggcagtggcgcgaccttcccgtgacagaggcggcaatgtatgctggtttcgcggcggaggtcttcgcatggttctgcgtcggcgagatcgtcggccgcggcggcaatgtcgctggctacagcgtgtag

SEQ ID NO: 2836 - DNA, 750 bp, Chlorella protothecoides
atgcacgtccatcctgctggcgcgtccggcctcattagactcagatgcacgtccaccctgctggcgcgtccggccccatcagactcagtgctccaccatctggcccctccacagcgcgctgtcctggccctgggcgcggcggcggagacggaggcggcggctcggggcgggcgcctggacgctgccctcggcaggctggcccaggcacttgaccccggtttcgcgccaggggtccaggccggcggtcgcactgctgcgctggacgccgtggtgagcctcatgcaggccgccgccctcctgaacgaaggcaaggctgctgtgggcggggccaggacaggcgtggcgaagtcggcggatgagtcagggactgtggatgggacgacagcgtctggcgcgaccgaggcgacgccatctgcggaccctgccgacgccacggtggtcatgtccgccgcgctgcgcgcgctggggcggctggtaggtgccgacgccggtggcgccagcgccgtcgcgctcgcggaggcggccgcgggtcgcgtggagacgcttgccgcccagcttccccccggcttcttcgacccgctgctgcccgccctgccagggccggagggggagacgctgcgcgcggcgctggtcgaggtggacgccgcgctgcgctcagagtacacgctgcgccgcgccatgctcaaggaaagggcggcagtgacgctgcgctcgctgctctggtccgacaggctggaggtggggcggtga

SEQ ID NO: 2837 - DNA, 513 bp, Chlorella protothecoides
atggctgatcctgccttgcagaccctgctgagcaccaaggctgccctcgatctgggcctggtaactcaggccgacttcgacatggtgaagacctccttcctgcgagcccagcagctcaaggctgctgtggacgtgggcgtcctccgagaagaggactacgaggccaccaagtcccagttcctggagctcatcactggtgggggcggtgctacgtcttccagccccactgctgctccccctgcaacggctcctgcttgggcccctccccacgtccaagtgccggcccccgcccctcccacactggctgctcggcccgcgccctcccccgcacccaggcccgcctcgcggccccagagccctgtgcctcccatgagcacgaccgcccccccaacaccgggatcacgtgcggtgcagcatgacatccccctgcagctgccgaagatcgggggcacccgatccaagcccaacggaggggtgagtctcttgggtggccgtggctggccccgtccatga

SEQ ID NO: 2838 - DNA, 324 bp, Chlorella protothecoides
atgccgcccgaccccgtcgtctcactggacgaggtgcatgccgcccgccttggcgacctctactccatcatggacgcggccaccagcggcgcggggtccggcgcctgggtcaaatccgtgcgcatcggggccgtgccggaccgtggagggagggtggaggggcgggctcgggccgcgcctatgcctggctggaccgcgaggaaagcggggaacgaaaaaggtgggctggggacaggggcctggcacgtacagcaccttacaacagacgcccaatgcatgggcgggcaagcggagtctgcacgtggcaggcaccttggaagctga

SEQ ID NO: 2839 - DNA, 1047 bp, Chlorella protothecoides
  modified_base (733)..(742): a, c, t, g, unknown or other
atgtctgcaacccttgttgcaagtgtgctcacaagcagcagctcctgtggcggaggatggccgtcacatccctccccaacaaccagtgccacacctccccactgccacaccacaaccctaccctcccaaatcccggcgacgcagaccaagtacgccaacgagccgttcgtgcatgtgctgccggcgggcatcgtgccacagacgcatcacgtgcgggggaccaactacaaccacatccaggtgttcaaggacaggcagagcggccgcgccatcgtcatctcgggtgagggagaagtggtggcttctggggaggtgaggatgttcctctggcatggcaccttcagtttacatctcttgaaatcctttggacacctgttgcctgcggtggaggtgcgagatctggcaaatcccagtaggcgcgtcgggccaggccatccagaacctgaacatcatgtgtgggatgcccgagacgacggggctgctgcagcaggcactcttcccttgaacattgttcataagggcaaggcgtgtgcttgtgattgcttgggccgagggggcaggccagggaggggcagcacgacaagtcgggggccaaggatgcagggcaaggggggagattctgcacaccttcctgctgcagcaccgcgcaacgcaacgtcaggctcaatgcaaggctgtttgacaaacgagaaaccgcaaccggagtttgggggagaacggactcgccggcttnnnnnnnnnncgacagacgagaaaccgcaatcagagtttgggggagaacggactcgccggcttgttgtccagtcatccaagtggaagaggttcagagctcgtcgtgcgcagcagcggtcgccgcgctcgctgcatcggcgcttggcttgcagcccagggcctcggcggcgcgccagacctcgatggacttggcctccagcagggccaggtggtcgtcccgcccctcggtcagcgtgcgcagcacgcccagcgtggcctcggcatgctgctgcaggtcgcacagcgtcttgcggctgtacccggcgcggatcatga

SEQ ID NO: 2840 - DNA, 2052 bp, Chlorella protothecoides
atgcactcaccaccgcaaagtcatcgtcatacacgaatccaaactgcagggtgttggcatacagcaggccggccgcgattgccagagtcagaggcaccacgaggctggggacgaggccggcacacatctggctgtgagcagtaccaggactcgcagggccgttccggggtttatcagtcgcactcacgggctccgacattgggctatgggatcagtggtatcggctcatgggtggggaccggcgaccatggcttgcttcgagtgaggcgatgcattggcagctttggcgtcttcaaactcgaggcctcagctcttgggcctttcgtgctttctagaacacatattctcttcctgggcctaccggaccaattggctgcggccaccactccacgccaaataaattgtttatttcgatctcaagctacagccatgcggttggtcgcgagcttgttgtgcctggccgtggtggccagcgcctaccacgagaagtttgatggagggtgggagagccgctgggtgcacagcgatgacgccaagtacgccggcaacaagctggtggtcgaaacacccgaaggtggcagcgaccccgctctgaagatccccgagaaggcccggcactacgggatcagcgtggccctgcccgagccggtcgacccagccaagggcctcgtgctccagtacgagctgaagctgccctccgcgggtcttacctgcggcggcgcctacctcaagttcgtgaccgccgacccgggcttctccccctcgggcctggtggactccaccccctacaccatcatgtttgggccggacaagtgcggcagcaccaacaaggtgcacctcatcctgcgccacaagagccccaagacgggagatattgaggagaagcacctgaagacgccccccgtcttccccaacgacgacctgacccacgtctacaccgtggagctcagcccctctgacaacacctaccgcatgctgatcgacggcgtggagaagaaggccggcgcgctggcggacgacttcctgccccccttcaacccgccggagaccatcgccgaccccgaggacgtcaagcctgaggactgggtggatgaggccaccatccccgaccccgacgcggtcaagcccgaggactgggacgaggacgcgccgctgcagatccccgacgaggacgcggtgaagcccgagggctggctggactccgagccggccgagatcgaggacccggccgcgcgccagcccgaggactgggacgcagaggaggatggcgactgggaggcgccgctcatccccaaccctgcctgctccgtcggctgtggcgagtggaagcgtcccaccaagcccaacccggcctacaagggcaagtggacccggcctcaggtggccaacccggcgtacaagggcccctggaagccgcgcgacatccccaaccccgcccactttgtggacgccgcgccgctgtcccacgtcggctccatcggcggcgtggccctggaggtgtggaccatggactccgactactacttcagcaacgtggtggtgagcaacgacgcggcggaggcggcggcagtgcgtgatgcgacctgggcgcccaagcacgccgcggaggcggcggccgcggaggccaagttcaaggccgaggcggccaagaagaaggcggcaggcgacgacgaggacgaggacgacgagggcccggtggagcgcctgctcgccgcggtgttcgactccccgctcctcgcgccgcatgctgcgcgcctggcccccgtgcggcggtacacggaggagaacccgcagctggtgctgggcggtgtggctggcctgacccttgccctcctggcgcccctgctcaaggcactggtgggcggcggcggcggccgcaagcctgccgcgcccagcgtggcccaggtgaagaaggcggacctccccaccaaggacgacgacgaggaggaggaggaggaggaggaggccaaggaggtggtggaggagatcgaggaggaggaggaggaggaggaggagaagaccaccacccggcggcgcgctcgccgcgactga

SEQ ID NO: 2841 - DNA, 342 bp, Chlorella protothecoides
atgttcggaggcttcttcgggggctatgcgcccacaggtcgctttgaagcgagctacagatgctacccagtatcattcatcgacaggatggatgcagagaagggagacaaggttttcctgcccccctctgccctggacagactctgtgagcgcaagaagccgagggtgaccactacgccactgcccatattgctgcgccacgccagagccacccgcattgagctgatctccccctctcaccgcagcccagcttcagatcgactaccccatgctcttcaaggtggagaaccgacagtcgggccaggccacgcactgcggcgttctggagttcatcgcagatga

SEQ ID NO: 2842 - DNA, 1179 bp, Chlorella protothecoides
  modified_base (613)..(622): a, c, t, g, unknown or other
atggcagagatttggatgccctgggggcacacgcctcgcacacatccctggcacccatgccaaccggctggtccctcccttgccatgtgccttgatgccctccaagcacacccaccgcgtgcttggcaaatatcaccgctagactcccgtcatggcccacattccttgcagttggcgacacggtgcccatcaactacaacaacaagagggggggactctagcttgaggctcgcacgcttgcctggcagggcacctggggtgctgggtgcagggctgcgtgatttgggtgcctcagcaacccccgtctgcgacagagcctgcccttgccgagcccgtgcttttggtctatccctgacagctcccaccaactccactctcaagctcccaccaattccactctcaaggtggattttgccccgcccttggattatgtggagccggaatacacgccagccgccccagccgccgaacaggcctccaccacccgccccgacggtgagtctgcaggagggtcaaccctgccgggcgggccaccctgtgtgcacggccaaatgtgttggactgcgcgggccagtctggccatcctcacacccaggctcgcagttccctgccnnnnnnnnnngccctgccgggcgggccaccctgtgtgcatggccaaccgtgttggactgcgcaggccagtctggccgtcctcacacccaggctcgcagttccctgccgtttgtaatcatcctcaccctgatcctcgaccccgcagctggcagcgggagcagcaccacggaagacaacggcgaccccgcctctcgcgcggctgcaccggcggagccgcagttcctggcttttgcagggacggccaagaggctggatggaaggcccgcagccgacccccggcccgtgcccgtgccccggcccgggggcaacagcgcctcgtcggcagggcccagcaccaaggacggcagctcagacgctcaggcgagctctggcgcgttgaagaaagcgggaaagctgatgtacagggaccgcctggcagctaagtttgcggccgccaaggacggcaggggtgccgctgcgcctccccccccgccgcccacgaaggcatcggatgccgagggcggcgcagagaaaaaggaggacggcttccagcccttcaagggccaaggacgttccctgaggggctga

SEQ ID NO: 2843 - DNA, 1185 bp, Chlorella protothecoides
  modified_base (118)..(127): a, c, t, g, unknown or other
atggtagatgcagaggacccccaacctccatctgaagccgaggtggccggcactcccccggtacgatggcgtgcatctccaatgatcgcaggggtgacctggccagtgcaacggtgtnnnnnnnnnngccggcactcccccggtacgatggcgtgcagctccaatgatggcaggggtgacctggccagtgcaaggaaggcggaagtgaaggaggaggaggatgccggcaaaccagcacccgctgcccctcccgccgccccggtgctggacacctacaccaaccgggagctgaagcacctggagcgcgagaggtcgggcgaggtgcaggcgcactatgtcatcaacgacggcagccccctgtcgggcaggctgctcatcgggttgaagaatgtgttctccaagtgcctcccaaacatgcccaaggagtacatcacccgcctcgtgtttgatcggaggcacaggcgagtggctccagggatggaggggttcgagagggccatgccatgccttcctgccctcctaccgacctgctttggaagacttgttgtctccgtgttgagccatggcattgctgcagggcacgtaggcttcccgggcccagtcctgagccgagatcctccttccaccgaccaccaagatctgccaccctgctcctcactccaggtccgtcgtcatcacccggaacaacacttcaatcattgctggcatcacctaccgcccctttcacagccaaaggtttgccgagatcgccttctgcgccgtggcccagagcctgcaggtgtcgggctttggcacacgcctcatgagctggaccaaggtgggggggtgggctgggtcatgagcctgcgcgaccggcgcgtctccatcgccacgcctgcctgccgctgggcagggccgagtgccatgcaaatacttgttggggttgcggacccgagtttccatgtcctcattccccctgggcagccacatgcaattgctatcctccccccccttccttccatcccctgctggcagctgcatgcacgggaccaggatgggtgccagtattttctcacatacgccgacaacaatgcggtgggctacttctccaagcagggcttctccaagaccatcagcatggagaaggagagggtgcgcagcgctcctgggtgggccttctggtgggctggaggcatcgctgcgtga

SEQ ID NO: 2844 - DNA, 1467 bp, Chlorella protothecoides
  modified_base (738)..(747): a, c, t, g, unknown or other
  modified_base (1083)..(1092): a, c, t, g, unknown or other
atggggtggggaggggaaggcagggccacacttggtaggggtcgagaacctggccaggccttttcggagatttttatgtgttcttcagtgtcgtggctcagcagggagcctgctccttcctactcatcccccttttgcgcggactgcccgtcaactaccaccacaaccatcgcagacggcgtggtgacggtgggccagcggacgctgctggagctggaggacctggcgcgagggtaccgccacccctgcatcgtagacatcaagatagggtaccgcacatggtacccggaggcgggcgacgaagcatacatagcacgctgcaagtgcgtgagcgcggggccccaggggggctgcagacattattgggcatgccagccgtggcagtgcttggcccgggaaaccctcgtctgctcgtccaatcctgccccactgctgcccctttcaacggccaatccccccccacgtgttgcaggcaaaaggatgcggcgaccacgcaggcccgcctgggctttaagatctgtggcatgcaggtctggcgctcatgccagggcgggtgctgagcgtgggcaaccttggggagggatgcaatggaaggctgatgccacagcagggagggaagggaagggacattttaggatgagccaggcaatgtcggcaacaaaacttggcccatgccccttagatgaaggcatgttgcggcatgcaatactccctgcatccacccgccccccgcactcnnnnnnnnnnattgggaagtggcactgttgccaatgggcactgatcttgtgtttcatggggtttcaaggtgctgagtgtgggcaaccttggggaggggtgcaatggaaggctgatgccacagcagagagggaagggaagggacattttaggatgagccaggcaatgtcggcaacaaaacttggcccatgccccttggatgaaggcatgttgcggcatgccttcactccctgcatccacccgccccccgcactcatcctcctcgactccactcccctcatcctgagcttgcagaaaaagggctgcacccccaacatgtgtttgggggcccacatggtgcggtggccnnnnnnnnnncgcagagaaagggctgcacccccaacacgtgtttgggggcccacatggtgcagtggcccagctccagaccctgctctcatgggtggatgtacagcgcagcttccgcttttactcctcctcgatcctcctcttccctggcgtgctgtccggccgcccaccatcatggtgggatcttgccccaacacaccgatccctccctcctcaccattgacagacgcagagggcgcggccgtgcgcgtcaggctggtggattttgcgcacagcttccgcacgaattcctccgctcgtgacgacaacttcctgctgggcctcacttcgctgatgcagcgcatgcgacgggtacaaggggaagacctggacatcgcctttgtttga

SEQ ID NO: 2845 - DNA, 546 bp, Chlorella protothecoides
  modified_base (154)..(163): a, c, t, g, unknown or other
atgagtgtgggagtttttcaagttccagcacctgacggcattgatgccagcttgctgccagatgtatgccgtccttgtgtgcctgggatgcttaggatcagcccctgtgaaccacatgccaccctcggccctcaacatgcttccgccctgcacnnnnnnnnnnttgggatgcttaggatcagcccctgtgcaccatatgcctcgctcggccctcaacatgcttccgccctgcacatccttcccaccagcttcctgagggtgggcgccatcatcatgacgctgcatgatgcgtgtgacgtcctgctggaggcctccaagctggccaagtacacggggcatgatgcaggggccaccgcgctcttcaccgcctttgcgctgtcgtgggcgggcctgcgtctcgctttcttcccgttcgtggtcatccacagcaccaggtggccgctggtatccgggattcacgggtttgcaggggccgttcctcgtggtattgcggtgaggggtgatgtgacgtcagaccctctcgctgctggcacacaaattgtgtga

SEQ ID NO: 2846 - DNA, 1845 bp, Chlorella protothecoides
  modified_base (1302)..(1311): a, c, t, g, unknown or other
atgccgcgtgaagcactctgtgagcactcaccagtagtgccgccgcttcagggcatgatccctgcatccgccgctggggggtccccacccaccacccctcacccccatacctgcaatcctctgcgcaggttcacggtggtcgcgctgcagtgggcgtctgtgttgctgggaggcgtggacaagcagcaccacggcatcgacctctttgggcgagacgctttcctgctgggccgcctgctcaccaccctgggtgcgttgcacgggtgccctgtcctggtagggaaatcaggtgttgtgcctgacaatccatcgcagccaagggctcccgagaccatcccgtgcccttggcagcctgaggcacccccgctcctagcctcctccatgctcaagcgctgccgccggccaccccttatcccatccctggccccccgttgcacaggcaccttcctggaggcaacggccgggcacgtggaaagtgcgggactcacggccgccacgctggagcttgtgcgctgcgaggcagtgcatgcgcatgcggagccctatgtccggcgcgcggcggtcctcgccgtcgcccaggtactgcaggggggtactgcaaagtttacctgtgctatagtaaaattcccgacctccaccatacaccgcgtggtgcatgggatgctgtgtgcagccagaaacacctgccctccctgccactcacctaccctgcattggaacgcaggcggtcacctcgctcccccccggcatcctcgctcgcgccatgctttccaccacctcggcgcccggcgactccatgctggtccaccagctggagtgggcgggggcctggttggacgaggtgcacggccgggactcagacgacacctgccggggcatggcggaagccacgcagaagctgcgtgcccacctggccggccaggcggcgctggagctgcggggcgcggcgggggcctcctccctgctggagcacggcgtgctgcacctgcccgggggctcaggcattataaccctggggccggcgcgcgatgtcatcctgccgttttcgcaataggaaacgctcagagctcgctgtccctgaggccgcaagagcgggagattgcggtgtgcaaccccttccccctccccatccttcccattcccttttctcccttaccggcgaatgcctgccaagggcaggctcgtgtgctccctagggacccaaccaggcaccttgcgtggatatggcccattttatttacacacagcagggcagagatgcgtcacctggtcggacgcagagcgccgacgccactcccatannnnnnnnnnacagcagggcagagatgcgtcacctggtcgaacgcagagcgccgacgctactctcatgatcagtgcgcagagggaaagaagcgggaaaaggctggaggttggcgagaacggggtggggaaagggatcggtgttggccggaaaatgggggacaagagaaacatccaaaaaatcgaaacgcaggttggcgagaacggggtggggaaggggatcggtgttggccggaaaaggggggacgagggaaacatccaaaaattcgaaacgcaggtcagactgagctgcaggggccagagggaggctccttcaaggctggttcccccagccgtatgtcatcaatcctcccggctgtcctcaatttcccccagggccacccgtcggtatgctaccagcaggatcagggcgaaccagtagacatgcatgaccaccaaggagaggaggaaggtgttgaaagcagtgaggcagggtgggcgataggacagaacctccacaatctcaaacctgcagcatggaggtgtggcagggtgatggacttgtga

SEQ ID NO: 2847 - DNA, 696 bp, Chlorella protothecoides
atggcatctcttgagaagcaaatcctcatcaagcattacgatatcagtggcttttactccgtacgcctgagcttggagggtgggactgactacgacttcgagttacccaggacatttccccaaactctgtgtgcatacatcctccttgcaggtgctgtgacgatgacctcaggagcgaccactctgaaggagcccctgacgctgcctgcgcatcacagtaccagcggcatattctggaagaccagaacatttgagaacatttgggacacatggaagggactacacctgtcccagctggaatgtcttggacggcccactctggacgagcctgagtgtacttcggcttgcgtcatctataacaccattcctcatccacgtggacaggacatcactttcaaggatgtttataagtgggcgagtacacgcaagtcgcactgcgtgaagggctacctgatgtccaccaccacccccacggccgcagactttgcggaagcctttcctccataccctgtggactggaaggctcttgccaaccctcccagtgagtttctggctacagctctgctggtgggagaactctactgggccatgcagtgtagcgctctcaagtggcaggtcgcggtatgggctcaaatggcggagcacctacccgatcttcgctttccatctcccttgtcatcagaccgtcgggcctga

SEQ ID NO: 2848 - DNA, 1695 bp, Chlorella protothecoides
  modified_base (29)..(38): a, c, t, g, unknown or other
atgccccgtgccagggcgaggcgtgttgnnnnnnnnnncggctgcacaggtcatgagagcaagcttgcaatcaacgtcaacaagctgtcgaatcttgttgctgactgcatcattacatgccccgtgccagggcgaggcgtgttatctccagactgggtgcaccaaagctggaaagcagggagcaagcagcgccagctgtcggtctccgctgatcttgcacggcagcatgacattctggggggtgccactgttgtggcagagccccaagtgtgccatgcttcggcggataggatgggagaagagcgtcggagggcatttgtggaagccctggagtccagagctggcgcggcgccgcagcactttcagtgtgagggaaatgttgtgtctggccgggaatgcaaccaagggcgctgtacgagtggtgggaggccagttgcagggcaccttgatgtgaggagggcagggcagactccacacagcctggtcgctgagttgcagcgtgaggtcagcacactgccgacccggctgctgatgggcgtctcctggtcgctgctggaggaccctgccacttgctgggaagtcaggcaggagctggaagaagctggagaaggttcctccgctcccgcagatcctggagactgggtggaggacagtcaggacgaggagacgggcccaccctcgccccaccagcccgatcccacccaggagcaaggggacgcccaggtcctgctacgctgcccttccttgaccctagtcttcccacgcgacaacacgggaaccctggcccacacctgccaaacccatgacctgccagagggtgggacctcggccctgcacctcctgcgcctggtgcacgctttctaccatgcgaccatggaccgggaggagggcatggcgctgatgcagcaggggggcctggcgggcgcggcggggcaggcgctgcgccgtgccttcctggacgacgtcccaatcaccagggcgcaccttctcggaccccggctccgctttgagggcctgagcagggcgacacgagacccggcggctgctgtgtatgaggcgcgagatctctcacagaaccgtaatgacaaagacagaaggagcatgtccagtgatgtgaatttcaagagcattcttgattcccttgaggcactgccagcggagccatctcccacctgggcgccgacagcttttgccctgggcggaccgcagagtacagctgatctgcgggttctcgcgatctgcacacatccgtgtctgcacaggagagccaccaaaaatgcctgtcgagaagggcgccctggcttcccggtcccagcgcctgctggatctgaagcccgcgcctcatttcgaggccttcatgaagggctacatggaccagtggtgaggaggcgatgccaggccggggggcctgggtccctgacaggcccgcccgcccgggtcactgaaggtcatgcttttgcaccccttcaggagccaggacaacccggaaggctacgtcctcatcgccgtggccgagaacaagctgcacagcgacgcctttgcgcacaggatgcaggaagcccttgcccgacccctgccggactgggtgatgaactacaccatgtgggttttgaggggtggggatggacaggagcaggagaggaatgcatgcatcgtcgtggtggccggtgctcggcaaggtgccatcccatctga

SEQ ID NO: 2849 - DNA, 1308 bp, Chlorella protothecoides
  modified_base (446)..(455): a, c, t, g, unknown or other
atggtttgggccgacaacgcgcccggtttacgatttttgaacgcgctgcatggacagcgacgcagggcttggacacgtcgggcacttcatgtaggcaagacagtggtttcccaacaagccgtgctccaagcgatggagtggcagtgggctgctggtgtgcttctatgcttgacgggattcgatcgcgagcagagagcccgcattcgggaggtggtggagacagcaggaggacggtactcgggatcgctgtcgaggcggtgcacacatctactcgtcgctgggcaggcgggacgatgcccctccccgaaactcgacgccgcattggcactgcacagcagatggggcctctgcatcgcggacgagagctggtgggaggcatgtgttgccagtaagaggctgctacctccgtcttctctggacgccaaggagaatgtatggcggcccgnnnnnnnnnnggaggcatgtgttgccagtaagaggctgctgcctccgtcttccctggacgccaaggagaatgtatggcgccccaactggggccaaaacttaactgcaccttgtcagcctgagttgagcactggaaccgccaggtcgcaccggcaggcctgccctccagagccgccatgcatggctgcgccacccctgccagactcacctctggccacctatgcctcggtgcagccggcggcacccccggctcgcacttcgagtatgtcccacagctgcctcctggctgcactgagggagagacaagcagaggcttccctgcagtgtccacagctcaagaagcccaggcctccagcgcaagagactgcaaccctgcccagaggagacagtcccccagacgccatggatgggctgcgcctccctgcaggcttacctgcgccggcagtactgcccgtcgaacttgggcaagctcaggagagaacatcttccaacttaccacatcagaattgcttggcacgagactccgtgaagcagccgccagctgccctttttgggggcatgcgtgttgtcctggacccagcattgagtagggacgtctcccagagggggctctgtaggggcagatttgtcaaatcatcttgtcactggactcctcacccaaagctgcggcaacttctgtgcattgtccgatccaagaaggcacggccgctcatcctgcgtcctgccctcctaggtgcaagagggagctggagggaggtggagccaccctgtgcggagcgcatgaagcctcgcatgtcgtgtgcctccttgccaaagccagctgctggttgcgagcgggtgagaggatctcctccccaatcttag

SEQ ID NO: 2850 - DNA, 2880 bp, Chlorella protothecoides
  modified_base (638)..(647): a, c, t, g, unknown or other
  modified_base (1205)..(1214): a, c, t, g, unknown or other
atggccgagaacatgcagcgcctgggggagcgcggcgagaagctgtccaggctggaggacaggacggcggagctggaggatgacgccggcaactttgcctctctggccaagcagctcgccgatagctactccaatcgcaagtgcatcctccatattcaggctgcattccggctacaacaatggtctcttgtagtgatcatgtacaggctcaggttacaacatctccgtacaccggaacggcaccgccgcggccacgtggagcatggcactggatcggcatatggcatgttgcgcaccctcaactcccatgtcagaaatgtagtcaggccctcactcgctgctgcccagtcacctccgacacacctgccacaagtatacctgcctccgcgccgcgctgggccagccatgtccagccggggcttcaattcgacattcggtggcttgccgaccacaatattcgagctgatgagccagctggctgccaggcatggcagcatcaacctggggcagggattcccggacaacgagctggaggggcccgcgtccatgaaggaggccgcgtaccagtgcgttgggggcatggccggtggtattgtggacagaatggggattcgttttcagggatgcattctggacgnnnnnnnnnntgaaggaggccgcgtaccagtgcgttggggcatggccggtggtattttggaaagaatggggattcgttttccgggatgcattctggacatggactctcaatcgggaggggtgcaggagccagctgaggtgcaagttgcggaagggtccatgctgcatgacagcaaccagtacccgcccatggtcggcgtgccagagctgcgccaggcgctggcagaacatagcgagcgctacacgggcctccccttggactggcagtcccaggtgctgatcaccagcggcgccaccgaggccctggcagccgccttcctgggcctactggagccaggggacgaggttgtggtctttgcgccgctctacgactcctacatccctatcatgcgaagggctggtgcggtgccggttgtggtccaactgcgggcgccagattggtcctttgacgcggcaggtgcggactggcgctgccaggggatgggtggtgtgatggtgcatgctgcccctttgcagcagcatcatggactgtttcaggactgctgtgggtcaggggggctggtgcaagnnnnnnnnnnactggcgctgccaggggatgggtggtgtgacggtgcatgctgcccctttgcagcagcagcatggactgtttcagggctgctgtgggtcaggggggctggtgcaaagcagcccacttctgccctccccgcccacccacccgctgcagagcttgccacagcgttcaacgccaagaccaagctgattgtcgtcaacacgccacacaaccccagtggaaaggtaacatggtgtaccttctcatgggtaggtgatgatgatacggagcaaacctcaacaagtgcggcggcaggagatctggcacagggttccctcaggaacgaacactgcatggctgccgggccccttcacaactcctggcgccttccttacccaccaccacaggttttctcacgggctgaactggagaccattgcttccctggtgcaggagcacgatgcttatgcagccctggatgaagtgctacgagcacgtgtcgctgcggacgctgcctggcatggcggagcgcagtatccgcattgggtctgcgggcaagaccttcagcttcacggcctggaaggtgggctgggtcaccggcccagcgcccatggtccaggccgcggccaaggcccaccagttcctgaccttcacggtgccggcggcgctgcagcgggcggtggcgcgggggctgagggaggagcgcagcttctacgaagggtgggtggggagtgggggctgcttgaggcggctggcgagggaggaatcatcaggcaggatataatctgcaaggacgtatttcgtggcttcaaccgtctctcagctcccacccgctcaccacctgcatccccccaccgcaaaccttctagattggggccgatgttcctcaagaagagggagtggctggcagccaagctcaccgccatcggcttcaagaagtcgacaggcttcacccacacccctcccacctctctcttccaggtgcttcctggtcagggcacctactttctgaccaccgacttctccggtctcttgcccgagaacagcaccgaggaggacgtcgaggtgagggtggtgggatccatagccgcaaatacagggagctgtccttctgcggcacgcttcgctctgcatcacattgaatcccaaaacctgtcgccccagttctgttcgaggctcacgacagagggcggcatcacactgatcccagtcagcgccttctacgaggacaggtgggcctgtgcagtccaccatgagcgtagaactggcccccctggctaccaatgcctggggtcttgcgtgctgtatatgggtggtgaatgcggcacaggcatcgcgcaggaccttcccactgctgctgatccagctccacatccaaagctggggaaagatacagcagaggctggcaagcgtatcaagggttccaggcgtgggaaaaggaggggggttctcaacaagggattcctaggggctgaaggcaaggtcctggcgatgcaaggggcaaggcgtgctgagatcgaggggggtttagactgggagtttaggagcagggaacaggcgcgagaggtaacgatctgggctctgtgtggaaaaaagagggaaatgggccgcagtcggccaagggcgaggcgtgtggctcgcagcgcagcgggcagcctcctcacccgacgctggcctcctcgcctcccagcctga

SEQ ID NO: 2851 - DNA, 468 bp, Chlorella protothecoides
atgccggccgacctgccccgcccgcctccccccgccccaccaaaaattcccgcggggatggcgccccccatccccgcagcccacccgagctactctgcggagccgtacaccgcgcccaagggcatggccccccccctggcagcgccacccagggcggcgccctccttctacggcgccgcggccgcggccgggatgccggcagtggaggtcccgggcgagaccaagaaggagaagccggccctgctgcgcgaggcggcaggcaagaggtgggtggacacgaccctgctggaatggcccgagaacgacttcaggatatttgtcggcaacctcgggaacgaggtgcgttggcgtggtgggtggagggaggcgcggcgctgcagagcctggctgcttggctggaccagggcatgcaggactgtgcatgagaactccacacccgggcggcgtgaaaggtatggggacccttga

SEQ ID NO: 2852 - DNA, 426 bp, Chlorella protothecoides
atggctgccttccagaactacacgtccttcaacaaggctaaagtcgcgcggaatggatacaacaaaaagtccaaggggtacggcttcgtcagcttccaggaccccattgagggtgcgcgcgtgctcaaggagatgcagggggcctacataggtaagcgggcggtgatccagggcgggggtttaagcgctccacaacatggcccctccgctcacacccgccgccgcacaacccccccaggcaaccggccggtgcaactgaagaagagcacgtgggatgaccgccaggtaaaggacaagacgggcaagcccatcaagcggctggtggaggagaaggccaagaagccggacaagagggcacgggcaggggcctcgtttgaggctggggtggggcccccggtgcagcaagcattctacacccggcggtag

SEQ ID NO: 2853 - DNA, 561 bp, Chlorella protothecoides
atgaacttgtggcagacccaggcactgggcccgacccacgacccttccacgctgcaaacgcggcactgcatggggtgctcaccgcccaagtctactgcatgcgcccctgtctcctcgtccaaagcctccaccacccaacgtcccaggctggcgcgacagctgacccccagccccctccagggatcccccaccgtattcgccggcgtcgcagcggcgctgttcgcggcccaccccatccacaccgaggcggtggcgggcgtggtgggcgccgccgaactgcttgccgcctccctggcgctggcggcactcgccctgtacctctccgccgcccgcgccgggcggggcatcgtgcgctggaccgcgctggccggcgtgatggggctgggctggctggcagcgctgtccaaggagacgggcgtcaccgtggtgagtcgttggggtatcagtcgcattgctcccaatcctgggtggtgcacacagatggacaaaagagtgggccgccatccgtccgctctgcagttgctggcccacatacatgtcgctgttgagctgccaccatga

SEQ ID NO: 2854 - DNA, 837 bp, Chlorella protothecoides
atgaccggcgacccccggctgcaggaggtgctggccgccctgctgcgccacaccttcctgaagggctttgaggtgcgggcacgcgacctcgtgatcagcaacggggtcacccccctcctggaccacctcttctttacgctggccgacgcgggcgagggggtgctcatccctgccccttactacccctccttcgacatggatctcatggccaaggacgatgtggttccagtgccgttctacctcgtggaagacggcgacgtgactgcccagttggcccaggcggcggccgcggcagccgaggccgggtcgcccatccgcgccctcctcatcaccaaccctaacaacccgctgggcatcgtgtactcaaccgccacgctcaaatccatgcttgagtggagtgtgaagaatggcgtccacctcgtcaggatttggaaagggggagagggctgttttggccgccactgcaccaccgaaaagctgaaggtcctccgggagcctgtgcctgcccaagtcgtgccaggcaggcctgctgccgccgcggatccactgcaatcgccgcgcccccaaggcaatcgccgcgcccccaaggccccgccacccctcgccgcacgcagcgacgagatctatgcgctgagtgtgcacggcgaggcgacctttgtgagcatgcagcgcgtggctcaggggttggtggaggagggggcgctgacgcaggagggcgtggacacccacctgcacctgctctggggaatgagcaaggactttggcgggtcggggctgcgccttggcgtcctgcacacccgcagcgccagcctgaagaaggtgggggcgctggagtga

SEQ ID NO: 2855 - DNA, 1029 bp, Chlorella protothecoides
atgtcggcggactggtccttctcctgcgtcgccatcgtgaagtcaatgtgggacccgcgcaacgccctctccctcctcctctacgcctggctcctggccaccgccctggccgccaaaccatggagcctcatgtcggactggaggcgggtgctggcgagcggcacaggggcgcggctccccgcgacacccagcagcacttcaaccgccgaggaggcaggcgtggacgccaagatccagctgatcgtggcgccgggcgcggcccccggctcggccctgtacacagcgcgctggcgcctgtttgtgacggccgggctgatcgtggggcccatgctgccagccgcaaacctgttcttctacgtcggcaccttcctcgcggagcggctcctcctcatgccctcaggcaaggccaggtggcaagggggggagggtcaaccagactgtatgccatggagcaccctgcagctattgaggacgggccttgaccaatccatcaccccagtacttgcagtgggcctggccttcctcgtcgctgagcagctcacggccgggctctctgggccgcggtccaaccgcgtccgcagggccttctcagccctcattctggcctccatcctggccctgggcgggcgaaggaccctgcagcgcaatcgcgactgggagtcagacgcctccctctttggctcggcgctcaaggtggggcggcttgaggacgcctccctcttcggctcggcgcttaaggtagggcggcttgagggtgccgggaggcccatgcactacagaagaggactgccggtgtgcctacctcacagtgccagccaacttgcaaaccagcccctcccttggcccttgcgctgccaccatcctgcgcaggtctgccccaacagtgccaaggtcctcctgaacacggccatcctttcccgccgctccgaggcctgggacgtctccctggtgctcctggaccgggcactggatgtggtgccgcagtactgcgaccctcactaccaccgcggcatcgcgctgatggggtga

SEQ ID NO: 2856 - DNA, 1644 bp, Chlorella protothecoides
atgccttcctttccccctttgcaaccatgcagccacctcgcagcggtccagcccgtcctcgtggagtcggcatccggccgctcacggcggcacacatctgtggcggccgcctccggcatcgtcgcagcagagctactgagcgcacgctttggatccccccagtcctgcgtcgcgtcggtggcacgattagtcgaggatctggctggtgtgggtgcggtggggcggcagatggctgaccgcccggagacctcatgcgctgcaggctgctcggaggccaccgaagccgaccaagagcggatcgccggcgcgctggccgcgctgccagacctggcgccctcctgggaacatgcctgcctggccgcgccagcctactgcgccgccctgctgcccgcgctgtcgtgggcagcggcatcaacggggccgctgggcgcacaggcgacccgcctggcggccgccaccacccagcgcctggtgaggcggggccacgcccagcccgtcggcgcggcgctggcgcagctggcagccgaggtggatggaatgtcgccggcggtggacgtcgctcgctcaaaaggtgatgcaggagccgatgaccctgccgaatcagacagggggatgcttaagggagcctctgcagagccttgccctcaccaggaccccctggttcccttcctcgctcccacccctccgctggcctggctggggcagctggaggacgcgcgggcggggctggccgcgctgcaggcagcgctttcctcccggcgcggcgcgcatgccggggccgtgctggcggcgctgggcgcggcctcgcccgcgcgttcgcccgagacgctgcagcgcctgctcggcgatcggatgctgccccccgccgcggtccgagcggcggtcacggagctgctcggagccgcagggccagaccctggcggcagcgctggtcgcctgctccccctggcgcaggcctgggcggggtcgtgtacgctgccagcaccgcgccaggccgcgctgacgctgggcctctgcgccgcgctggtggcaatcgacgtcggcgcgctggatcagggcccgctgctgccggccatcctcggtggcgtgtctgcccacctggacagcccacagccagaggtgcggcggcggggcatgcgcgtcgcgcgacagctgtccctgacgctggacccggcctcgcccgccctcttcgcggacgagttggccctgggggagttggaggagggctactgggaagccagtgaagacgagggcgagggcggtggggaggggaacgagtgcggggctgggcaggtggcggggcgatgcttggaggccccgcgcggcagcagtgaccgcagtgaccgctcgcccgctgatggttccggcgtggcgccgagcggtgaaggcatggcacgcgagagaccccgggccgaaagcgatagcgaagaggagctgggtccgctgaccgggacggactccgacgacgatgacgagcttgatgacacggcaggactgccggcctacgacctggcggagtctgacgaggatggtggggcctgggtggggctgggatttgtcgaggggcgggagggcccctgtggctgcacagaagtcgcatcctgtgcatcccctgtagcatcgctttgcggggaacgccagtga

SEQ ID NO: 2857 - DNA, 588 bp, Chlorella protothecoides
atgggttgcatgtgtgtgatccatgcaatccccgggccctgtcgtcacgctatgagcacagcaatcgccccccctccgctgtacagcgtgcagaaggtggacgcccacgacccctggctccaggcggcctgggcgcaggccctggaggcccaggaccgaggaaaagagggcgtggcgcacgcgcgcgcggcgctcatcatcttccaggacgccgccgcgcggctgctggcgggggaggcggcggcggccgacgccgacgctgagggcgaggccggccccctgcccctgggcagggacgggggctccctggagcccgccgccgcgctctccgccatgacctccgcgctgtcagacatgaccgccctcatgatccgcgccgggtacagccgcaagacgctgtgcgacctgcagcagcatgccgaggccacgctgggcgtgctgcgcacgctgaccgaggggcgggacgaccacctggccctgctggaggccaagtccatcgaggtctggcgcgccgccgaggccctgggctgcaagccaagcgccgatgcagcgagcgcggcgaccgctgctgcgcacgacgagctctga

SEQ ID NO: 2858 - DNA, 399 bp, Chlorella protothecoides
atgtcgcggagtaccagtcggcgcttgtcgcacgccttccgcccagcctccccccatctgtgccgtgccagggccatcgtagccacgctgggggcggagccgcagcgtggcggcattgctctggccaccgagcttgagctgtactccccgagcctggacacccaccagcgggtgctcatcctggacgcgctttcctccgcggcgctggagctggcgggcagggtgccggggcgtgccgggctgggaggcgggcgggggccgggtgctcgcgctcggccgccgttgcctgcgctgggcccggatggcggtgggagggtggggagggtgacgtggcgcgccgacaggagtctgcagtccctggggagtggaggggactcggagggctacaccaacaggtag

SEQ ID NO: 2859 - DNA, 609 bp, Chlorella protothecoides
atgcaatgggtgtgctggaatggactttgcacagcgcgagcgcgccgctgccggtactcaccctccgacagtgatgtcggcagtgcccccgatcaagagggcatccttgaccaaacacctccctcacacctcccacacccaaacataaaacaggtggtggccgtgcccgagggcctcccgcttgcggtcacgctgtcgctggcgtattccgtgaagcagatgctggcagaccaaaacctggtgcggcagctgcaggcatcggagaccatgggcaccgccaccgtcatctgctccgataagacgggtgtgagggagcggggcccctgctggaggcattgccctcacaccttcccacccccaccgccacaccaaatgtgcccactaaacaggcaccctcacccagaacgacatgacgctgacggggctgtggatggggggccgggaggtgggctccctggtggaggtgcacacgctgccaaccaagtctcggccagagcaggagctgcagccgccggggcccgtgctggagacgctgctggaaagcttggaggatcacagtggacaacggcagagttcccctggggccgtcgcgtcagcgagttcctctga

SEQ ID NO: 2860 - DNA, 2829 bp, Chlorella protothecoides
atggcgttggagctctttggccctggcatgattctccgcaacacttggcaccaaaattccaaaactaccctcccacccatcctgcaggccacaggtaccgctgcgtgcatataccaagggcgccccagaaatcgtgatcggtctttgcaagtggcagctggccccagatgggagccaggagccgctggacccgcaccgcctccaggggttcctggaccgatgccagcactcgggccaaaggtacagtcggaggacagagcctttgttgctgaggaggtgctgtggtggacggtgccgcttcagcaatcagtgtcccagcttgagtgtacccacggcattcccgcagatcaggatggttgccctgggcttcagggacgtctccgtgccctcccacaccctcacgcgtctgcggtatgccagcgcagctggcagcggttccgccagctccagcggcgacgaggattgcatgttgcgaggagccctgtagccccgtcgccgagttcacacaagtcagctttgcctgcgcaccctgctcctctattcttgctttccagggactggcgcctggacatggctgttgccgaggatctcgagcaggacatggtcctgccacctgtcgaggagccctgggtgtccaagcattccagcttgatctggatctttcgctcctctgcccagttgggcgtttgtgccatagaagaccccctgcgccccgaggtgccgggcgccattgcagctgcggccagggccggcatctccgtgaagatgctcactggtgaggaggggaagagggagagagtggttgggaggtgggctttgcctggggcttgcagagctcgagagggaggggagatgttgcccagcattgggatggactggaggagcggtgacaacgtggccacagccgccgccattgctcgccaggctggcatcctcccgcgagacgcgcccgccacccacgggcttcatgtcgttggggttcgagaatttgagaccgagccggcggctgcaggagggactacggccctcctccccgacacggtcatggagggcgaggagtttaggtcccgcatcctcagcccctctggagccatcatcgaggacgaattcctgaagacacagtccagcttcctggccggtcgtgaagcgctggctacccctgcccgccggctccacacctccaatttctcccgccgccccattccccagatctggccccggctccgggtgctggcgcggtgcacccccgccgacaagcacgccatcgtgatgggcgtgcgccagttcaccgatgacatcgtggctgtcaccggggacgggaccaacgacgcccccgccctccgtgccgcgcacgtcggctttgccatgaaccaggacgctcctctcacacataccagtccccctgccctccggcccatcaacccaggcaccagcatcgccaaggaggccgccgacatcgtgctgctggacaacaacttcgcctccatcatctcggccgcgctgtggggccgcaatgtgtatgccagcgtcacccgtttcctgcagtttcagctgaccaccaatgtcgtcgctgtggtcaccgctgtggctggctctttggccaccgcgcgatctccggtgactgccgtccaggtgtgttgggagggagggggtgatggtgtgagtggaggcagggtcaaagatgctgtgggtcaatctgctcatggactcgctggcagggctggccctggccaccgagccgccctcccccaaactcctggacctgaagcctttcgacaagggtgggtgggagggtgtacgttgcttttcatcaggctgtactcaagtgggactgcaccgcccccccctgctctgcaggggtgtgaggcaaccatggagattttcagattggtcctctcgtccacatatggccgacctgtcatcatcccgcagttcatcaccccgccacccatccacctacacttgcgcacagaccaccagttcttggcccccggctcgacctcgctccggaatgtggtgggtcagtccacgttccagctctgtgtcatggccctgctcgtctttgcagcccctgggctcctgggcattgaccccgggaacagctacccggcccacaccccatccacccactacaccatagttttcaactcctttgtctggatgcaggtgggtgggtgtgggaatgccttgtgctctgtggaaggaagggtctcatggctgtgggacggcctgagcaaggcccggctcttctgcatcatcctggccacggaggccgttctccaagtcctcatcgtgcaggcaagagtgattgagggaattttcatgggtttcctcgttgcctcgattcctgggactgggaaccggctctctggagagatgcgcaaagtgtggagggtgacatgtgtgtatggaagcatgcgcacctggaaggtgactgcaccttcccacacgaccagagcaagtactgtccctgtctccccatgccacccactgccaaaccatgcagtttgggggccaagtcttccagacccaacccctggagcccaagtactgggccatgagcctcggcatcggcgccctctcgctgttggtgcacgaggcgctgaggacggaggagagcgagggccagtagccgtcgcccgatgtcctccggcaaggcctcagcgtgtggtacccccctcatactatctgcttgtcatacaaacacgttgcagggtcactggccgcaccccttctcctggatggactgcctctccccaccgtattgctttgttactccaccagctgctggcaacgtggctctttcaaaagagaagaatcggagaatga

SEQ ID NO: 2861 - DNA, 1998 bp, Chlorella protothecoides
atgcgggagtgtcggggagggccccccgggacacgcctggcaatccacaccggactgtcctgcaccttcaggaactcttcgcctctcaccatcgcagtctggcacagaccggggagggcatcaaggagtgcgagttggtccagtggtttgtgtcggagggtgacaccatcgaggcctttgaccggctgtgcgagatccagtctgacaaggcgacgctggagatcaccagctccctgtcgggtgggtggtatcgtgggtgcctgctgcgtgcagggtggcatatttgatgcgtgtaggaggcctgggtccctccccggcgccacgcggccggcaccaacccctcccgcaccccacacgctggcaggcaaggtcgtgaagctgcactttgaggcaggggccatggtccaggtgggcgaaaacctggtgagcatcgagaccgacgaggaggctggggatggcgactcggacgcaggtcccgcgccctctgcggcgtcgcccgcagcgcactcgagccctgaggaccctgcgccgccctctgccaccccctcccgcgtgctcaccagcccggccgtcaggcacctggcgcgtcagcactcgctggacctggcccaggtgcgcgcctccggccccggcggccgcctgaccaaggccgacgtgcaggcccacctggatagcctctccgccgccgccacctccaccgtggcggccgacgtggcggctgcggtgcccaccaccgaggcggcggcggtgcgccaggccgtgcccgagcagcgcggcacgggcggcgacgccgcagcaggcaggatccccgccgctggagccggcacaaccgccggtgcaggaggcggcaccacgactgtgccgctgcgcggcttccgcaaggccatggtgaagagcatggcggcggcgggggcggtgccccacttccatttctgcgaagaggtgcagatggatgcgctggttgccctccgtgccctgctccgcactgaggccgtgctggggggcgccaagctcacgtatatgccgttcttcatcaaggcatgctgggagttgggggtgggggagtggaggttcagggtggagggaggggagcggcgcgccgtctgccgggctctggcagcactggcggcggcgctggcgcttgagcagttccccctggtcaattccagcctgtcccccgaccaggcctccatcctgcagcacggcgccaagaatattggcattgcggtggccaccgcccacggcctggccgttcccaacatcaagaatgtcgaggtaaggtacctgggtgtggggatggagatggtgagatgcaggtggtggaggaggagaaggaggatgcatcactttggaacggggcctggtcttttcttcgatgtgagcaaatgccaccctcccacccacgtacatgctccacctcgaccctgcggtccctcagctccctttagctcagagccccagcccatccagcccgacgccccccacgttccacacctacagagcaagtccatcgtggaaattgcggccgagctggcccgtctgcaggccgccgcggccgccaaccagctgcggcccgaggacatcaggggcggcacgttcacgctgtccaacatcggcatggtgggcggcacctacgccacccccttggtgaacccgcccgaggtgagcgttggaagggaggttcagcccttggtaccagcttcaagaagttcatgcttcctcgggtcggccgtggccttcccaccacctcgaaaccctcaccacgtgacactcgctcgcccacatccgctcccacaggtggccatcatggctctgggcaagatgcaaagcgtgccgcgctttgcccccgacgggcgcagcgtggtgccccagtccattctgaacatctcgctgggggccgatcaccgggtggtggatggcgccatgctggcaggcttcgcccaggcctggcggcggtacgttgagatccctggcaagctgctgctggagatgcggtga

SEQ ID NO: 2862 - DNA, 747 bp, Chlorella protothecoides
atgtttggcctgttctggtctatgaagacattctcagctgcaatggatcccaaagggactagcaagccccaggtgggggtgccaatgagggcggggcaggggtgcgccttccgatcctttaggacagacaagtacaagctacacttcatggaatcaccctcgggcatcaaggtgagggcattgggcttcggctggacaatttgcacccgtcaggcggtgttatgccagcgcgctggatctgactcctccctcacttccccacagtttgtgctgacaaccgacccctcggtgggtgacatgactaccgcgctacaccacatctactctgtgccgtttgtcaaccaggatccgtgcgtgagcgggcacgagcccggcttgctcactcactgctccctccctgatttcccactcccctgcgcctcagagcacgctgggacggcatttgtcaggagagcggctgatctcggcggcggcgacgcatctacatcgccgaccggcagctcgccagacaatcttgtctcagtcccaccagaagctgacggagaagctgacggtggtggccttgacaaagtgccaccagcgaggcgggatgtagagcacctcgcccggcgccagctcccactcgctaaactccagagctgccaggctggggaactgggccaggctcgcctcgtcctcgaggtcgatggtgctggagttggtgtgcatgccactcctgtgcatggcgatgggtacgagaggttgtaa

SEQ ID NO: 2863 - DNA, 1041 bp, Chlorella protothecoides
atggctgcagagctacccctgggtccaggcaatgccctctggtccgcacccgagtggggcgccctgctggccaccctgcgagagacgcccggcgggggcccggcggtggcagcgctcctcgcccaggccctggccgcgctgctggagcccctggccggctcaggggcggctgcccgtgccgagtcgccagagtatccatcccgcccacccgatctccccgacctccttgtcgcgctgtgctgggagaagctgcacaccgggaactggcacgaggtgggcctggcctggcgagacgcgtacaccgccgccagcctcctcacctgccgtggcctggtccggcgaccgggccggagcgccccccctgaccccggccccgccctgcgctgcctggacttggcggcgctgctgggcggccccttgctgagacggtttgtggatgccgccatcgatgcgctggacgcggccaggcctgggagggaggagggtgcgggctgcgacgcgggactggagggggtccgcggggcagcagacttggcgctcgagatccgtagcgattgccccagcccggcgccccctccatccacaccgctgcctctcggctccctccttgcccccgcgcgccgcctgccgcgcgtggccgcgccctccctggaggccttctggcgcgacttcatgggcggcgccggccctgcgcggcctgtggtcctgctggacgccatggccgactggcccgcgctggagcgctggcgcgacccgcgcgccctggcggcggcgcacggccggcgcacggtgccggtggagacggggcggcactacctggcagagggctggggcacgcgcctcatgaccctggactccttcgtcgccgaccacatcctgggcgcgggcggggcgggggcctacctggcccagcacccgctcttcgaccaggtgccggagctgcgccgcgacatccgcgagccggcctactgcgtgctgggccggggggaggacctcgccgtgaacgcctggttcggaccagccggcacggtgcgtggctga

SEQ ID NO: 2864 - DNA, 552 bp, Chlorella protothecoides
atggaggaggaggctgcccatgccatgctgctgcctccagctgaagcagggcgtgccgcctgcgtttgtagctcaatgaagccactccgactcagtacccacgtccccctctcttggaccaccaggggcctgtgggccctgccaccggagctggcacgctgcccgttgcagcgactggatctcatgcgctgcggcctcacggagctccccatcgctgtgggcaccctgggccggctggaggagctgagcctgggctgcaaccacatcagctggctccccacaaacctccaggggctcgccagcttgaagtccctttccctgtacagcaatgacctgcgcggcatcccccccggcctggcctgcctcacaaacctggaggagctgttcctggatgccaacccacgcctgcagtttggcgggggggcctcggtcatcacccagctcccaaagctgcgctgcctgtcagtcatgcaggaggggtgccaccacgacatggtgagttgtggacgtgagaaggggggtggctgtggcatcagaggcaggacgtgctga

SEQ ID NO: 2865 - DNA, 681 bp, Chlorella protothecoides
atggcatcgctgctccgcagccgcctgagcctggccctcgccacggcggccacagcggccagcagacggggtgcagggtctgcttggaagctttgccctcagctggagcttctgcaggggccgctggcgaccctgcaacaaggagctggctcgctctcgcctactgctctgcctgccccgggtctgccatgggcggcccgggggtttgcgtcaccccgccgcaagccgcaacgcggcaaccagcccgagctcgccgctgcgcccctcaaccgatgcccaccagggagtgacttcggcccttgctcatctgttggttcggctcggaagtatcccaaggactgcccctccgcaccaccccagaaaccaaccgcgcaccatccccattcctccaggaaccaggagattagggcggaggaggtgcggctggtgtacccagaggcagaggggaaggccactgaggtcgtggcgctgggtgatgcactggctgcagcacgaacccggcagctggacctcatcatggtctccgccggcgcacggccccccgtcgtccgcatcgccgactttgacaaggtctggcgcgaaggctgtgagatcacgggctcatcctggtgccggcccaggccccacgttcttgcactgtcgctgcaccgagccattgtcgctgcaccctgcgcacagtga

SEQ ID NO: 2866 - DNA, 480 bp, Chlorella protothecoides
atgcggaagaaggccaagaccgcagcaaagcagcagcgggagcagcagcggttggcggaccccaaggaggtgcgtatcgggtgccgggccgcgcccaacgacctggccctgaaggtgggccgggcccgggccttcctggaggagggccagcacctgcgcctctccgtactcttcaagggcgcgcgggagctggcggaggcgcgcggcgtcgtcctgagcatcctcgcccacctagaaggtgcctcaagtggactggttggggatgaggggggttgggggcccttcgatccacgtgcaggaagaagggctgcacaccagcggaagccaacagacgtgcgccggcgggcaatggcatcagagtgggtgctggtgccgcaggcccccctcccgggatcctgtgaactgtggggcgcgcagcgcggagtcatgccacctccgcctcgccccccatccctcctgccccaggcgtggcggtgctga

SEQ ID NO: 2867 - DNA, 1068 bp, Chlorella protothecoides
atgggccggcaagcggagttggagccccccagccttgtcaagtatgatgcctggggccggaggcaggaccaagtggccacctgcgagggctggaagggccagaaggcggtgtccgccagagaaggcctggtgggcctggcctacgagcgtcaccagggggaggcctcgcgcgtggtgcaggccgccaagctgtacctgtacggcgccagctccggcctcttcaactgcccgctggccatgaccgacggcgccgcacgcctctgtgaggtcctcaggtctaggcaccccgagctgggcgaggccttctcccacctcacctcccgtgacccgggcaccttctggaccagcggacagtggatgactgagaaggcgggggggtccgacgtcgccaccggaacccagaccctggccgtgccggaggtggcggggtcggggggcatcggagcctggcaccgcctgacagggtacaagtggttcacctccgcggcagacggcgagatggccatggccctggcccgggagctggactccagcggcaggcccgagcctggaaataggggcctctccctcttctacgtgcccatcgtcagggacgaccagggctgcccacagggttttgaggtggtgcgcctgaaggacaagctgggtaccaagcagcttcccaccgctgagctggccctggatgggctgcgcgccttgaaggtgtgtgatgtgattgtggcctggatgcaggaagggcgtgcatggttgagttgggagggtcgagggaagcttcggggggaaggtcctgacccgcagaccttgctatttcggggctcctgttcaccccatcagagcacggttcaatacttgcaccctgcggcgaatagcaccctccactccttcccatcccccaaccctggcaccgcacagatatccgagatggggaggggcgtaccgctcatcgccaccatggtgaacatcacgcggtaccacaatgcctgcgcggccacctccctcatgcgccgcatcaccgccctggcccaggtagggcggctgcgctggggttcagctgcctccactgactga

SEQ ID NO: 2868 - DNA, 1095 bp, Chlorella protothecoides
atggacctggatctcgatgccccagccaagaccctcaccctccaggacctcaaactcctgggccagggccgcaacggggaggtgtacgacgggggcgtggtgagctccccccgggacctggcacggggcctgggcacctccccgcacagcggcctcgccgaggacgaggccggtctgaccgcccgtgccgagcgctacggctccaatgccttccccgagcaggccagcgtgtctttttttgagctggcagtggaggccctgcaggtgctgagaacttggcttgggggtgctgtaaaagggagggtgttggaggaggggaaggggcataaaacatgcagacctgccccagccatgaggggccagccaggtcccgccatgaggccacagaccaatcaagcaggttgtgtacatcactgcgcacccccaacatcccttcccaccccaccccaccccccacacactcgcacaccgcaggacttcaccgtgctgacgctgatcggcgccggcaccatctccctggccctctccctgctggtctccggctccaccgcccccggcgccgagcccgggggcgggtcctttgtggagggcgccagcatcctggcctccgtcgcggtggtggtggcggtgggcgcggggaacaactggcagaaggagcgccagttccgcgcgctgcaggcgctgcaacgcgacgagacggtgcgctgcgtgcgctgcggcgcggagcgcgcgctgggcgtccagcgccttctccccggcgatctgctgctggtgtccgccggcgacatcctgcccgtggacggcgtgctggtgggcggcaacgatctacgactggaccagtccgcgctgacgggggaggcaggcgaggtgctgcgcgaccccgagcacgcgccgttcctgctttccggcagcagggtggtgcgcggatcggggcgcatgctagtcaccgcggtgggcggccagtccgcctcgggcgccatcgcgcgcgccgtcatgcagcgcaagggtggcggcggcgggggcgacggcggcgagctcaggtggggaggggtgtgcttttgggcctgggtttctggaagcggcgggatctggtga

SEQ ID NO: 2869 - DNA, 441 bp, Chlorella protothecoides
atgcagacggctgctggcggcggtgcaggcgcacgtccagccgctgctggcggagaacgggctgtggatgcaggacccccgggtgtaccacgccaccatcttccacgcttcaacccatgccgtgcgtgcctgctgacgggagctgggaagggaggaaactggcaggacccaagggcggccccacgccggacaatcgacgcggaggtgggcgcggcctcggccgcgctggacgcgctgtgcccgatgcgcactgtgctggagcgtgtggtcgccacccccggcggcgcgctggtggcctgctggcagttgctgggagggaccgagcccgcgcgcctccgcaccgcgttgagggccgcgctgcccgaggctcccaccacccaggtagcaggggttgcgtggaaacagtggggagcgtccatgtataactggctgcgaacctga

SEQ ID NO: 2870 - DNA, 786 bp, Chlorella protothecoides
atgccgctctacaccttcaagtccgtggcctggcagctgctgcgcggcgtggctcacctgcacgcccactgggtgctccaccgcgacctgaagcccagcaacctgctgctcatgggccccggggacgaacacggcacgctcaagatcgccgacttcgggctggcccgcgtcttccgcaacccgctggatcccctctggcacaacggcgtcgtggtgaccatctggtaccgcgcgccggaggtgctgctgggcgcgcgccactacggctcgggggtagacgtctgggcggcggggtgcatcctcggggagctgctgacgctgcggccgctgttccagggcgaggagagggccggactggagcatggcgtcttccaggccgaccagctgcaaaggtgggcggccccagggtgggtgagggagggggagagtggagcgtgcatgtgctgcccagcagttcattatgtaataggtggggtgtgggctgcaaaatggggcccggaaggcgtgccttgtgccatgggcgggaagggttgctgcggcgaatatcccaaggacagcccccggcctcgtctgctgtgtggatgcgccaacctctaccccctcttccctcttcactccgacaggatctttgcggtgatgggccacccaggtgcgggcggctgggctgacctggaggccctgcggcactggcgggacaacacggagaacgtgcggctgcggcggcccgaccatggctctcgctccctcaagcagctgctgtgggaggagtcgcccctgctcaggtga

SEQ ID NO: 2871 - DNA, 3570 bp, Chlorella protothecoides
atgaatgacgaggggcagcctgagaagacgcccggcaaggtggacgccaagttcatcctcaagcactgccctgtggagaggggccgcctgtacaacctggccgacgggcggaagacgctgcagaacgtgtttgcgctggacctgtttgacaacgtgcagatcctgccccgccagaacgagcgcaacccggggcaggtggaggtggacgtcatggtcaaggagaagcccatgcagacagcggatgtggaggcggagtggggcctggcagcggaaagacagcgcatgcagggcggagggaggctgtcgtccgccgaaccccccaacaaccacgctcgcctaccctacacgtgcacagatgagaagaacaggccgacgctggtgtccctcgtcccgggtggcaccatcacgtacgagaaccgcaacctgggcggccgcgccgcgacggtggctgcctccatcaacaccaagtccttcctggcgccctccgacgacatctcctaccgcctgatgtaccagaagcccttcatctggggtctgtcggacgagaaccgcaccaagctgcaggcaaccgtgttcaacgcgcgcaagctctgcggcgtcttcaccccaggggtggctctgatcgaggggagtgcagccccgcatcgggcgccagacaggggcccggccaccccgacccccacccatccgacccccgcgcacaggccccgacggggaggaggtcccgcccgtgtgggtggaccgcgccggcgcgcgcgtgcagctgacgcagcagttcacgcggggctcgcgcgggtcgctgggcctggtggcccaggaggtgggcacccgcgacgagacgggcgcgccctgcgcacgcggcggccgagtgtcgcccatgggcgccgtggtggccgacggcccgcccaccacgctgggggccgccgggcgcgaccgcctggcatacgcccaggccgcgctggtgcgggacaccacctacctgcgcgacggcgccacgctgggggcgcgcgacgtgctgaccgtggaccagggcctgggcatcggcacagggttccccttcttcaaccgcgccaccgccgcctgcacgcgcttcctgggcctgacccggccctggccgcgcgctcgcctggggcccgcctccctcgtgctgcacgggcgcgccggcgcggcgctgggcgacctccccgcctacgacgccttcctgttgggcggcccctactccgtgcgcgggtacaacgtgggcgagctggcggcgtgccgccgcttcgccgaggccgccgcggagctgcgcctgcccgtgctggggcgcacgctctacgcctttgccgaggccggctccgacctgggctcctccaaggaggtgcgcggcaatcccagcgcctacttccgccgcgcggggcgcggctcctccctggggggcggggtcaagctgggcgcgctgcgcgtagagggcgtgcgcgacaacaacgcggggaggtggcacgtcctgctgcactacggcgagcgtttctgaagcgggtgttgctgcgcgctgcgtggtggtacccgccccctgaccccggtcgccgaaccctcccttgctccttccccctctcgccgtctgtaatggtcagacacgttgcaatgctggggatgagggggggtgtttgtaggctacacacagcaggccatctgacatgcagcacagcggctgggtggaagctggaatcagcaactgcaccaggtccactatggtggagggagccaggctgcgatggcgtcccgcgccttgcttgccgtgatggagtccagcctgggtctctgatccttgagtgctgcgctggggtggagctgggtgtagcatgccagggcggcatagccctcgacggcagcggcacgcggtggggggccggcagggccggcctccttctgaggctgcggcgtggccgggagggcagggctgtcgtgcaaggacacgtgccatctgggaaggaggatgtgaggaggaggttgcatggtgatgtgcaagcacatgctgaaggctcggtgggaggggactgcaaatgtaccgtgttggccggtgggtcccaactctgcacctgcccacaaccaatatggcaagacgcagcgcacctggtggggaacaggcgcagggagtcgcgacgccagcatcctcagggcggcggccctcacggtggccagggcagccgagtccagctggggcaggtgcagcgctcgggcgcggtccagccaccaggaggcatggaggctggatctgagcatgaagacatagcgcaggatggctcgacccacgttccgggccgccccgttgacccctcgaagcaggagttcgaggctgagcgacctgggcagggttcggccacggccggggtacccaccaagcagccccagcaagagcaagggatccatagtgcaggggctgtcggagttggtttcgaacgcgcgggaaccaagagaaagtatgtctgcccgattgtgagaaggggccggttgtgccaggctgcgagtgatccgctggccacgatggcccaagtgcccgccaggcaggcttctgcctcgcaggcaccccctatcgtggaggagccgataccctatcaagccctgttggtgcccaaacagaccattctgacgaacatcaaggcagcccacgccagccctctggccgcagtggatccatggcctcaacccacgggtcgcccgccccacctgccatcctgccaggtcatggccgtggggcagcagtcaagccgcatcctggagtttgacgccgtgtctgggtgccagcgtgccgcggtcgactgccgcttcatgccctcagccatggagctcacccccgacggtgccagcctggtcctcttcgccaaggtgcggtggggcgcacccttcgcccggacccccaggccgcacgcgaggcgtgccggcggtggctgttggaaattcggcagctgccatgctgggggccaccggcatggccccaggttccccgccccacgtctccagggccccattctcattccctccttccgacccttcacagaccaacgccgtggcggtgtactcgacggacacctgggcgtgcgagagctcccacgccctcaagtccaagaaagcggagtggagcgccgtggccatgtgcgtcgcccctggccggccacggcccatcgtctacttcaccgtggagggcgcgccggggctgcgcatgctggacacgggcatcgccagcggcgccgcggcccgcgacgcgcgggagggcccggcggtgaagctcaagtccgagaaccgggccggcatcctcgccctggccgcatacccaggaggtgtgtggtggggggtccgagtgcgtctgtgacgggcgttgcacggctgtggttgtggtcaccaggagaccagggactgggcggtggttggaaggtgccagggccaggcaacgatacgctcatgtgcatgaacgtgactccacgagggcacccacggccggccctgccccttggagaccgtccaggaacgcaccgtgtgtctcacgctcccccacactccgccgcctcctgcctcacgcgcccaaaacttacg

SEQ ID NO: 2872 - DNA, 900 bp, Chlorella protothecoides
atgccggctcccgggtgctccatatcccatgcatcgcatatttcgagccaggcgatgaggtcctccggcgcatcgggtgcaggccagtgtgggcgccccgccctgatccctcaggccaggaccagcacccgtgcggcattcatatctcagagccggcccaggacccgacgctacctgcagaccagagccgggatagagacggaatccggcgatggagcccccatgcagccggggaggggtgaccccaatgcctcttcaacctcgctgctgcagcaaccactcctatgggcagccgtgccggtcgtcggccccctcctcgcctggggttgcggtggcggcgacggcaacggtaggggtgccggcggcggcggcggcggtggcggcagtggtctgccgcacgagatctttgccgtggccgaggatcaagacgagggtgggtgggcgtgggtgggcagcgcctttggcgaggaggtcgacgacgaggttgacgccgactccgacgacgagtcagaggatgagtcagaggatgagtcagaggatgaggaagaagaagaggaggaggccaggccgtctgccaagccggccgccgccgacggcacttttacttgcggcgagctggaggcgcagggcctgcccgtgggcgagggcatccccacccaagccgacctcttcgccggcctgcactgccagcccggcttcgtctgctcgcgcaaggagctggcgcaggacatcaaggccctttatgcttcgggcctgtttgagcgcgtgaatgcccgagtggtgcccctcaagaagaacaagttcaaggtggggggtgggtgttgtggtggcggcggccgtgaagcctgtggcggacactggatgggtccctgtggattccaacctggacaagggggatga

SEQ ID NO: 2873 - DNA, 996 bp, Chlorella protothecoides
atgctggcctcctccatttccgcgcgccagttgcgaaatccgacacatctgccaaacatcgccgctcgatcaactttacactccaattcaaccactcattacatctccctagccatgggtagttccttggccttgcgcctccagctcagggctgtgcggagcctctggcagggtggtccggcatgctctcgaccggcgaagtccatgccccagccctccctgatcaccacccgggcagtccattcctctgtagaccctccggatgttagaaaactggcagccatggcacatctggacctggaggaagaccaggttgagggcctgaccaaggagctgaccagcatcgtggattggttcagccagctccaggccatcgatgtggagggagtcccccctgcgctccaggctgacgtcgactctcaggactggcagagacctgacgagcctcacacatttgagaacaggtatgggcatggtcatgcagccgtgattgtggaaattatcagcaagtcatatcctggaaagtctcgtgtcgcagttcccggcgacagagggccccttcctgtctgttccccggactgcacccggcaccagcgaggggtgagcggctctgcacgtggcagcgccactgcctggggtcatgcagggatgtacagatcaacggtcaccgggaggcagagagcgcaccgtgaggcaaatcgcgctgccgcacagctccaaggtggggtgcctggacggggtgcgccattgcagactgttcggtcgggggaccgagtgcctgggtgcggggtacctaccttccagcaggtcgtccttcccgtgcgacctttgcggagccgcccggcggaacaccaggcccctcctccttcctccctctcgatcgatgccagcgccctgcctcgctcagccgccgatgacgagggcgctgctgatgcgccactgacccgccacgtggaccatcgtgtactcgacctgtggaatgcacagaggggatga

SEQ ID NO: 2874 - DNA, 657 bp, Chlorella protothecoides
atgggcccccgccatcggacccaggcactggcgaacgtgctgacggagcccatcctgggggcggtacgggcggaggcggatgaggccgcggccagcggctggttctggaacatccggcctctcaaatccagggggacggggaatccgcgcggcaagagaatggccggtccagagtgcgccgaccctccctgccccacccacgcgacgcaggtgaacagcatctcctccacccccggcggacccaccctggtgctggcaaccgtggacgagtccgccgacctctgggccagcaatgggaagaagggcgactcgtaccgcacgacataccaggcgagtgacgcaaaggaagggctgggatgccagggtttggctgccgacctgacattctttgggatgggcacgctgtgtgccaagacacgtggcccgataatcaatggccgccggcgagccaaattcatcccctctgtgcattccacaggtcgagtacacgatggtccacgtggcgggtcagtggcgcatcagcagcgccctcgtcatcggcggctgagcgaggcagggcgctggcatcgatcgagagggaggaaggaggaggggcctggtgttccgccgggcggctccgcaaaggtcgcacgggaaggacgacctgctggaaggtag

SEQ ID NO: 2875 - DNA, 357 bp, Chlorella protothecoides
atgcgacgataccgcgcgcatgcgtgcatccactcggccccggtcccagcagctccaggcgccatcttacccccttcaaacccaaccccacctgcagtgctggccgatctgaagaagaagctggcagccctgcccaacgagacccccttcacgatgcgcaccatggccctgatcaagacgagcatcgaggggtggtaccaatcgcgcggctacggcctgtgctacatctcccacttctcgggcatgggcaccgggtccatcaccgcccacgtgattgagggccgggccaacaagatcaacgtgggttcgacgagtgtgcactgtgtggtgtggctccgtgaagagcggcatgattga

SEQ ID NO: 2876 - DNA, 972 bp, Chlorella protothecoides
atgctcggtgcggagggcggtcaggcgccagggtgcatgaacggcgatggagcggcagggggtggaggtaccggccctggaacgccaggcgctcctccctcgccgccgcaaccagtcccccaagacagctcacgaagcgtgccactcccagatcctgggacaccgccgggcgcgccgcccgggctcatacactgcgtgcaaggccccggggacaccatctttgtgcccgccggctggtggcacgcggtcctgaacctggatgacacactggcggtgacccagaacttctgcagcagcgtgggattcgcaagggtatggcggcacacgcggcgcggccgccccaagatgagccagcgctggctggccaggctgcgcctggccaggcccgatctggccgcccaggcggacgatgccggcgcccagccgggagaggggccggactccgcaagctcctcctcatcctcaagtagcagcagcagcggcagcggctcgtcttcgtcctcaagcagcgacgaggaggacggagaggcagaggtgggaggggagtctgccatggccaagaggccgagggtgggggccgtgcccgtggtagatcctccgcccagccacgatgccgtacagcagcctaccaaggaggactttataggatcagcgaccaatgtgggcgacgtcagtcggctctgtgagttaccatggcaggggcccacaagtcacatcatgccctcatatttcacccacttcccggggatttcattgccagcctcgttgcatgcatcggcttctcagcctgtactggactacccattccaaaaggccccttgttccgcacaaatacgcgtatcacgagccgtccctgcatacccgggagggcacagagagcacgagcagatgttcatgggggcaccagcacctggaaaatcgcccatgcagtcggaatggggggatactgcagccgatcgggaagaagtgtag

SEQ ID NO: 2877 - DNA, 531 bp, Chlorella protothecoides
  modified_base (189)..(198): a, c, t, g, unknown or other
atggacggagagattcccaagtctgtgaagcatgtagtgttcaaggccccccgcccaccagcgcccccaggtagccaaacagggtgccggacaggaaagggaacgaggtctgagcgatgcatgcatggcttggggttgggcctctgggcagcccctcaggcttgcatcaaggcatgcacactcttcaannnnnnnnnngccaaacagggtgccggacaggaaagggaaaggggtctgagcgatgcatgcatggcgtggggttgggcctctaggcagcccctcaggcgtgcatcaaggcatgcacactcttcaggaaccgtcctcccagcagctggaagcaggccctgtcacaaccccattgcacccatctctgcagggtgcaaggacacgcaaaaggcgtgctcagactgggccgacggcggcgagtgtgacaacaaccctggcttcatggtcgggcagaaggggcaggcgggcgcgtgcctctactcctgcaaccgctgcgacctgatggacgcagcgacggccacatga

SEQ ID NO: 2878 - DNA, 2175 bp, Chlorella protothecoides
  modified_base (202)..(211): a, c, t, g, unknown or other
atgcacgagtctggctgtgatgatgcaggcacggccgcgcagcgcggccccgtgcctgcagggtcatcgcggcggcggccttctccacacacaccggcaggaagccctcccgaccttgccaacatgcaatctcccccccatgtcaatgcaaccatccaaccttccccccatatctcaccacttggtggcggcccacttggtnnnnnnnnnnttcccccccatgtcaatgcagccatcccaccttccccccacatctcaccacttggtggcggcccacttggtgcccttggtgacggggcaggacccgtgcagcgctccggcatccagcgtgccgtcggtgcgcaggctccagaagacgacggcgtcgcccttacgcgggcggtaggccaaccccgccatggcgcactcgctgtaccccgcctcgcggctctggctggcagggacagcagcgttggggaacaccgtctcgcccccctcctccacatccgacaggtacatgagtaccgtggccagacggttgccgccgttgtcggtccccgcctcgtctgcaagcagttgggcagtttgggaggcatgttatcgattgatgacaacaggtctgtctgtgggctgccgcatctagatacactgctcccacgtcccccctctcagttcatggccccaggccgccacccctcctcccatttcccccaccccgtccccagcctcacggaagaagtagtcaaagtggggcttgtactcctgcccattctcgtagcgcagcacctggatgccctcgccgtggccgacggggatcatggtggcctcgctcagccggttctccacccgcgcgagcacggggtcctccttgcggtcgaagaacatgccataggaggtgcggacgtcggagacgccgtctcgaccccggccctccacctccaccacgccgctgcgctccagccggggggtggcggccttgatgatgtggtcgcactcgtctgggaagaggtgggggtgcgggggtgggatcggcgctggcattccgcatcacctgagccaggatcaggatcctcgtctgacccagccgacaccaagacatgccggccacaagcagttcctgccccggctgatgcttgggcgtacaacaaacactccaactcctcatcacgcaccgtcggtgaggacgttctggaggaggaaaatacggggactccaactgaggaccttcattctccccagtctgttccctgtgccaggggcagcattgtagtcctcgctccatccaatcaggttgtcctcgtcccgtttcgaccaggcggggtgtaccagcatggccagcgctgctgccatgaggagcgcatgtcgaaaatgtacccccaacatattattctggattcgagtcctatcctctcagcgatcgacgctgggagtggaggggccagaccaggtgacgtgacactgggtagtgcccggtcgttgggtatggcacgcgcaccaggcaggtccaattcgagatcccaacagtctcctagcggcgcaatggcagcgacatgcgcgggtctgaagccttgcctttccacgtcgtgtcgccctgctggaatctcgacacggacacagtgtgtgggggggcccatggaatgggagtgtgggaatgggcacattaaaatggatttgccgagactagatcacgagagcctgcatcccttttccatcgcgcagcaagttcagctcgtctgccaggaggacgtgtctggcaagcccacaagctctcttcgggaagggcaaggaggtggaggcggaggtggtaatccctttggcaactttggcaacatgatggagaagctgaaggacgcgcaaaacctcgtgaagaccgagacggccaggctgcaggcagaactcgcacacgcagcactgtgcgcactccctcgacggctccatttcttcctccctccacctttgcttccacctgacccccttcacgccaggacggaatttgagggcttctccaaggacgagaccgtgcgtgtggtggtgtctggcaaccagcagcccaaggcagtggagatcacgcaggaggcatacaaggacggccctgaggtgggaggttgggcagcgaggcaggaatgtcatcccctgagcctccagccagcatgctcccgcagtggatgcaccccacttcaaagcgcagtctcgtga

SEQ ID NO: 2879 - DNA, 912 bp, Chlorella protothecoides
atgggtgtctccatcgcgagttcgccctggctgggtcccagcagtctcccctcctcggcctgttttcggtcgcctcggtcccgctgcccccgccccacccgccacctggccgtccgcgtgaagaaagtgctctccttgctctgccgcgccttccccagagcccctgccctccgccgcttctctgcccagccccggccccaggctcccgatgcagcgccgctccatccctcaccccttcgaatccacctcttctgccaggccgggctggagcccaagaagctgacggcccaggacctgcggcgcatccaggagcagggcccctccatccaggacctcacccgcacgctcaaggtggtctacgaaccccgcagcggcaaggtggtggagcccctggtgctgacccacgacttcgtccccccctccgcgctcaccgcccccgtgctcacgcccgagcccgactggcggcgcatcccggagatgcccttcatggagcttttcgatggcctccagcgccgcaactggacgcacccgcgctacgacccctcgctacccaagtgggagctggccttcttccgcgacaccgcccgcctgctgcgcccggtgtacagcggctaccgcgtgctggtgcagtgccccgcggaggggcgctccgcctgggtggcgctggaccggtcgggggccgacgccttcctccgcgactactccggcggtgggctgggcggcgccgtgcacaacgccaagcgcctgccccaggtgctggtctcgccgacgcagtacggcttcaatcaggttttcgagcaggtgagtcatccggctgattgggaaatggagggacaggagcgggggaagggggtgccagtaccgatggtggtggggagggggatgatggcgcggggggtggcgctgtactag

SEQ ID NO: 2880 - DNA, 243 bp, Chlorella protothecoides
atgtacctgtcggatgtggaggaggggggcgagacggtgttccccaacgctgctgtccctgccagccagagccgcgaggcggggtacagcgagtgcgccatggcggggttggcctaccgcccgcgtaagggcgacgccgtcgtcttctggagcctgcgcaccgacggcacgctggatgccggagcgctgcacgggtcctgccccgtcaccaagggcaccaagtgggccgccaccaagtggtga

SEQ ID NO: 2881 - DNA, 621 bp, Chlorella protothecoides
atggcgcggaggacctacagctctgtttactggtatgctcgtggcattgtacaaggccaggccacggtgcgctccgtgtccgacgctggcgccttccgaagcctggagctggcctttccccaggaggcgctctccggcatctcgatcggtgccagcgtggcggtgaatggcacctgcttgaccctgacacgacaggatggcgacaccggctggtttgacgtcatctcagagacactcgcccggaccacgctgggtaatctggccccaggtaagcccgtcaactttgaaagggccgcacgatttggcgacgagatcggcgggcacaccgtgtctgggcatatatgcaccacggcatgcatagcagcagatgcggtgacagagctgaaccggcggcttgagttcgaggtggtagctttgaacactgacgctggctgcgcccaacctgcacatgcaccttgggtctcattgtcgggtccaccacccatgcagcttgcggacgcctcctggatcaagtacataatgcccaagggttttgtcagcgtggacggctgcagtctgacggtgggagaggtgacctcgacgtccttctcagtctaccttattccagaaacccagaggtga

SEQ ID NO: 2882 - DNA, 1908 bp, Chlorella protothecoides
atgcacgagatcttcaacaagggcttctcgccgcgcaaggggaccacctactcgtgccctgccgacaagcagctctccgtcaccttccaccagaccctgccggccatcccacagtacggcatctacggcatcgcgctttcttttctcgccgtggtgctggccgtcggcatctttaagcctcgcaagcagatgcccattgacctcttcatgtccaagggcaaggcgcgcaaggatggcaccacgggcgtgggctttgccgacgtgggcggcatcggcaccgccatccacgacctgaacgacgtggtggccttcctcaaggccccgctgcagtacgcgggtatgaaggcgcggccgcccaagggcatcctgctggagggcgaccccggcacgggcaagacgctggtggccaaggcggtggcgggcgaggcgggcgtggccttctaccagatggcggggtccgagttcgtggaggcgatcgtgggcgtgggcgcgtcgcgcgtgcgcgacctgttcaagcgagccatggtgaacgcgccctgcatcatcttcgtggacgagatcgatgcgctgggcatcaagcgcgccgacgcgggggtgggcaccaacgaggagcgggagcagacgctgaaccagctgctgacggagatggacggcttcagccccagcctgggcgtggtgttcatcggcgccaccaaccgcgccgatctgctggacccggcgctgctgagggcggggcgcttcgaccgccgcatccgcatcaacctgccggacgaggtggggcgggaggagatcctgcgcatccatgcgcggcggaccagcatggacccgggcgtggacctcgcccagctggcaaaagacctgcccgggctgtcgggcgcagagctgggcaacgtgatcaacgagagcatcctggagtgcctgaggcggcgcggcaccaccgtcacccagcgccacgtcgacaacggcgtggaccgtgtcgtgcagggcgtgcgcctgccgccgctgcccaagcactacgccatgcgccgccgcctggcgctgcacgaggcggggacgggcgtgctttccaccttgctgcgggcgcgcagcgggcacgtggaggccgtggagcgcatgagcctggtggggcgcgggcgcgagctgtcgcgcaccgtgctggcgcgggggcgggacgagacctacctcctggtcacgcgcgcgcgcctgcgcgaccgcatgcgcgtcgcgctggcggggcgggccgcggagcacctgttcctgggggaggccagtagctactgcgacaaggacctccagggctgcaacccagaatcacccccaccgcctcggacgccacaggacgcgcggcgcatcgcgatgcgcacggtcaccgcctactgcctctccgacctgggcctggtcagctactccccgccccccgtcccctccatggagaatcagatgtttgggttcgaggtcaaccccgaccgcatcgacgacaacctgtttgggcacgcggtgcccggcggcggcttccagcccaccgacgccacctggaacgcggtgtgccgcgccgccagcgacctcatcctggcggcctacaacgacaacatggaggagctggcgcggcacgagccggcggtgcaggccgtcgccgacgccctgctgcgccaggagacggtgctgggcgaggagctggaggccatcatggcctcgcatccgcccgcggcacccgtgcgcgaggtgccccgcctagcgcacgactttgatgccatgggcgggatggtgggcgagttccaccgctaccagcgcctggaggccgccgagcgggaggccaagaaggcgggcgagggcaggggcctgggcgcgggggagttgtgggaggaggccatccgtcgcgcgcccatcggcgcgggaagcggcggctag

SEQ ID NO: 2883 - DNA, 558 bp, Chlorella protothecoides
atgaggggccagggtgagatgggatggccctattcagctggagcggagtgtccttggccctgcaccaaccccagacccctcctccacgccacctcccacaatagaaagtcttgcaaccctccccaacaacaggccctcatctaccccctggagttggtgcgcacccggctggcggtctgccccagcggcacctacggcggcatcttcgactgcgctggcaaagtgctgcgccaggagggcgtgcgcgccttctaccgcggcatcgtgccctccatgatcggcatcctgccctacgccggcgtggacatcgccgcctttgagctgctcaaggaacgcctgctggacgaggtggggggacggtgggagaggaggagttgggtttgttcatcgggggaggcgggaggggggtggatgagagtaggtgagtgtgatcgtatgggcgacggtcaggaagggagcctagtcgggcagccagcaggggcatgcagacgagtgcagctgaggcagtcggtcgccactccagccccgctccccctgcggcgatgcgcaaggggctga

SEQ ID NO: 2884 - DNA, 426 bp, Chlorella protothecoides
  modified_base (148)..(204): a, c, t, g, unknown or other
atggactgcgtgtggcaatgtggggatgtgggtgcatcaggcggttggtggagcgccttgctcgcagcaagggcaggggaagttggtcgctcgctggtcgagggcattcgcgttgtgcagaggaagcgaaagccatccaaccgtcagnnnnnnnnnnnnnnnnnnnnnnnnnnnnnnnnnnnnnnnnnnnnnnnnnnnnnnnnncccccccctcttcctttcacagaggagggcgacttcaccaccgcctacagctactactatgaggcgtacgagcagtacgcggccctttcctccccacgcgccctgcccctgctcaagctcatgctcctggcgaaggtactgatgcgtgcatggtcatgggagagggggaccgttggtacccttcttgcctgcctggacagagaggcggaggcatgctgctga

SEQ ID NO: 2885 - DNA, 729 bp, Chlorella protothecoides
atgatgcatggtttaagctgcatagtagttcctcctgcggcgatgaagagtgaggcggcagcaatcttcccgcgagcgcgacgcgcgctcaggactcgaccctgggactccaccagctacaccggcaaaatggcagcgacaaccgagctcttcactcgaggagggcccgacatggcagacaacaggggccagagcatggtggccaagcacttggacaagctgcaaaagaacaaggaggatgccgcggtggccaagctgaaggccttgatgcctcacataggcccggttgctcgggagatggccctccaggaatgtgggtgggacactgagcgtgccctggccctgttgcgcaagtttgccctctccaatgcccaggagctcagcacgatccaaaagtctcttccaaatgggcattatgggactggaagtgcttggacttctgccctagtacctcgcaacccctgccctggttccaggagaggacacgtcatgcggagactcagatggcagctcgcattgctgctggaaggagtggagatgggtctgagagcaattccgacgagagtggtaagcctgagtgggtggttggggtggcgaggaaaggcagggaggaagcaggcagcgacttgccgtgcggatcaatggactgctcaggctccagagcggctccttgcggagacgcaccatggctacagcgggtgtgcagggggtcacatacctgtgacttaa

SEQ ID NO: 2886 - DNA, 2007 bp, Chlorella protothecoides
  modified_base (965)..(974): a, c, t, g, unknown or other
  modified_base (1815)..(1824): a, c, t, g, unknown or other
atgccttctgcgagctgtccgtggtccatgtttctccctcatgattcaatgatgatgtcccggcctcacggtgcggcccctcgcgctgcatcctccgccccgcacagccatgcctgccatgctcgcgtgaaggtacagcgttctcgtagtcgccggatgtcggccatgcccggccgtgccaccgcgacggatgatcacgtgtgcgtcatcggggctggaccggccggcctggcggtggcggctgccctgcaccaggtgggcatccccgtggtcgtgctggagcgaggcacaggacccccttcctccggcaccgcactgggcctttggaccaacgcatggcgggccctggacgccctgcacgccgcagaggagctcagggcccagtaccgcgaagtcagcctgtgcgtgcaaaggccctgggttggggtgatggcggcaggaacggggcgcgaggagttgcagggactctcctttgcctcacatagttcccacacatgttttgcagcggcgcctgtccggccgaccccagcagtccccccttccttccccaatctcgccagagtgcagctgtgccgcgagggcgggcgcctgctgaaggactttgacctgcactcctgcgacggcggcccgcacgagttcaggggtgtgcggcgttcgtccctggtggcagccctggctgcccgtctcccgccggagaccatccgctatggccacgcggtgagcgccgtcgccggcgaagatcagggggccggcgtggctctgactgtcgagggcgaggggtccggggggcagatgcggttcgccggggtggtgggcgccgacggcagcgccagcgtggcggcgcgtgctgcgggaaggaagcccgcccgctcggtgggccagacggcggtgcggggcgtggcgacctttccctcggcacgagacatgccgtgcgactccatccgccaggtctggtctgtcggtcnnnnnnnnnnaaagcccgctcgctcggtgggccagacggcggtgcggggtgtggcgagctttccctcggcgcgagacatgccgtgcaactccatccgccagagcgttttgctgtcgcctgcaccgtggaagcccaccctgccatgccgggagggagcagcaagactcactccacagccccactttctcctcctcccctgccctcccgccaatcaagacacggagctgtactggtttgtgtgctacgacaccccttccacaaaggcatctgcccgggcttctgcccgggagcaggcgctgcgggtggtgacggggtggggctggggcgtggaagccgccgtgcacgcgactccggacactgacctggcccgcaacgctctgggcgacaggtgggacatctggcccggggccgtcgccggcgccggcctggccttgaccctggcgggggatgcgctgcaccccatgacccccaacctgggtcaaggggcctgcaccgcgctggaggacggcgttgagctggcgcggggcctggtgcgggccggcttccgcgacgccggctccggggtggaaagggcggcgcgcttccgcgaggcggcgcgggagtacgaggcgcagcgcaggcggcggaccctgcccctcacgctgcgctccaacctgtttggcaagatcctgcaggcgccggtgggggtggtggccgccgccagggacgcgttcggagccgaggaagcacctcaggcaacatcgacctctgcggatccgcccagcaagccggggccggtcgccagaaatctctcgcatacgccccaaggggacaccggcaagacaggaatgtgtccagggaatctatgtgcnnnnnnnnnntgccagaaatctctcgcatgcgccccaaggggacaccggcacgacaggaatgtgtccagggaatctatgtgcattaccgggctccgtaacccattacagcgatcaaaagttttgaatatcagtgcaccctggtatcggcccgccgcactcgtcggaggagctcctggtacgtctgcagtctag

SEQ ID NO: 2887 - DNA, 321 bp, Chlorella protothecoides
atgcgctgggggtgtcgggcgacatcagctcaggtgcaggggggtggggtggggtccgacaaaacggtgcagagaatctctgggcctgaggaggagccctcatccccactacccgcagtgttcacggaggctgagatccgtgccagtgtggttttccagctctctaagctggcggcgacgttgctcaagggcaccgagctggtggctggcggctcgccctttgacgtggtggtgggcggggaagcttctgggaagctgcaggaggtggatgccctgcagcccggctgcgccggtgtcgaggtgggtgctgcgatcgtttag

SEQ ID NO: 2888 - DNA, 957 bp, Chlorella protothecoides
  modified_base (39)..(48): a, c, t, g, unknown or other
  modified_base (344)..(353): a, c, t, g, unknown or other
atgaccaaccattactcctctgcgcatctcaccgggccnnnnnnnnnnacagtgttcacggaggccgagatccgtgccagtgtggttttccagctgtctaagctggcggcgacgctgctcaagggcaccgagctggtggccggcggctcgccctttgacgtggtggcctgcgtgctggtggtcagatctgccaccggggacgaagaggtgggcgccctgggtccaaacctccgcggcatcatcctgcgccacgacatcccgcacctctcccacctagaacatcaaacctctgcaccatccccatggccccccgttgtcacactcatcaggggtgcgggctcgcnnnnnnnnnngggaatttaccatcagaacatcaaacctctgcaccgtccccatggcccccccttgtcacactcatcaggggtgcgggctcgccaggagcaggtgccctttgtgctggtggaggacgacgctttctttgaggaaagcatcgcgccgctgctgggcaagcacgtgacactgagctcggtgccggacgccaccactctgacgtctggcgcggctgacgcgcccggtcttacaggcaaggcttccaggggacgccccgaagccggcgcggaagattggaagggggaggccccacgccgcatctccaagctctccgcctcggcagccgttgttcccctggctgaggtggaggcaggaagctgcggctccaaggccgctgcctgcagccggctctcgcgcctggccgtcgactccaaaggaaacagcggcagcgagtttgcggcgcccccgggtgtcgtcctgccctttggcacgatggagctcgccctcgaggtaaggtatcaggagggtggtgctggcagggaagctctggcggtgtatagtggcggacaggtcaggaatggcactgatgcatttggcgagcaagggcttctgaccaaaaacccatga

SEQ ID NO: 2889 - DNA, 1797 bp, Chlorella protothecoides
  modified_base (5)..(14): a, c, t, g, unknown or other
atgtnnnnnnnnnncatgtactgggcaacgcatgccataccgcccagcaacgaatggagacctgcagctgagctgacgggatgttccctctcacccctcactcatcaggctggcggccaggcatcggctttccgagacctcctcggccagttggatgatatgctgcgggagcccgaggacgaccctcgcaatgcccggctggcgcggctctgtgaggaggtccagggcctgatcctgaacagcagcaagctgccggatgaggtgcggaggtcggtgggaaggagaagagtgggtgagtatcggtgcctggctctctgccaccttgaagatgcgacaccaggctcattcctccgccctctctgctctgcaggtcatcaaggcactgcaggactccctgcctgcagactcacctgtcattgcccggtcctctgcaaacgtggaagacttggcaggcctctcaggttgctggtggagggtgcaggaggaagcactcccctggctcaacatactgcagcattggaggtgtcaaacacagtgttaatgcgagctgcccacttcagccacacctcaccatccaactctttccccctctccactcctccaggtgccggcctctacgactccatccccgggattgacccgagcagtgccacgtcgctgcagcgtagcatagccctggtctgggcctccctgttcagcaggagggcggtgctcagccgcggcgctgggggtgagtggctctgtgtgctccgccggcacagcctcggccaccctggagctctgtctgcatgctgctcattgacaatttgggaagcgcagggactgtgctgggtcgcccacgcctccaacgccgtttgccaaagcaaggccttccaatgccccacaacccccttcacccgcctgcgcaggcatcccctcccaggccgcagcgatggcggtcctgctccagccccagctctgccccgacctctcctttgtgctgcacaccgcccatccggtcacccgcgacgccggggtcatgtgggccgaggtggccccgggccagggcgagatcctggccacggggtcacgcggcgcagcctggcgcatggaaatcgacaaggccggcgacacgctgcgcatgctttctttcgccaacttcagcaccgcgtggctggtggcgcggggcacgggaaagggtggcgtggccaccctcactcccatcactgtcgactacagctcgcaggccctgtcagcacgacagccgtgagcacggaaggacatgctcatttgcaggctccgaggaggcccgggcgcagctctcccggcggctgctgggcgtgggcgccgccttggaggcggagatgggcggtgcacaggatgtggagggctgcatcgcagccgggcagctctacatcgtccagacccggccccagccatgatggtgaatgcctggaggccggtgcaggagcaaagctgtgcgatttcaacaggcccatcaactggaacgtcggatgtgcagcgcacccggttgccatcaagttgctctgtgagaatcgacgccgctaccaacatgctgctttgtgtatgccattcctgcttggcttgtgctcctgtcctgtgatcgcaggagcctcttcactccgctgcagctgccgtggcgctggccttgaccaccctccccacaatggggtacttggaatagaactgggcctgccaatcccgcagggtgtccagctccgagagcgtgcagtccgccagttcatcattgcagtctgcaagcaggagagggcgaagaaaaggatgatcaatcgatga

SEQ ID NO: 2890 - DNA, 1161 bp, Chlorella protothecoides
atgctgtatctgggcagatatctcaacgccccagatcccattttaaatcgcgtgggcggggagtctgaagcgcccaaaaccagtgcacggatgcacgggcttattcccgtgtgggcacctcgagtgcatgtcctctgtctacctggttcccccagctcccttttcccgaattgctggtggagcgcagcggccacaatggttttcacgatattctcgtccatatgtgccatagccttcgtggcgatattctcctggatgatattcacaatcctgagggtcgtgttccagttcttcttccctcgcaagctggtcgcggtgaagcgctccttccaagtgggcgacgtcacgctggaggagctgagcaagtactcgggccaggatccctacctccccatcctcctggcggtgcgaggccggatctacgatgtgtccgccaaggccaacttctacggaccaggtgagcctggagggcgccagcgtgtttgtcgagagccttgttgttccggctggcctgagttggggcctgggggagttggaggcggcggctacagtgtgtttgcagggcgggaagtggcgagggctttagggaagatgcagattacagcagaccattgcagcgctgacacctcagacttcaccgagaaggaggagaagacgctgcaggaatgggttgacaagtttgaccaaaaatatgaagtcgtgggaaaggtatggtggagtttgtggggtccgagctcaacattggagtttgggagcagtttgatcaggccgggaataatcaataggagaggagctgtctctgtgagacgggcatcatgcatggcgcggcaggggagcagggcggtcgtccccgatttgagtctgacactagagcagctggctgcatatgacggggagacaaaccctgctcccatttaccttgccatcaagggtgtcatctttgatgtcactagaggtatgctgttgaggtggccaacgatggctgtgagtgcctcaagtcacttgcacccccatgggccagctgagcggagtcagttctatggccctgacggggcttacccctttgggggccgggaatgtgcacgggcgctggcaaagttctcaacagagattgatggtgaggacactagcactggctgtgcccagatggaagttggctga

SEQ ID NO: 2891 - DNA, 327 bp, Chlorella protothecoides
atgcagctggaggtgtgtagagcccaggtggagtgggctgcggctgagaagcgatccttcctgcggcagaggctggagaccaggtccgcggcttggcgagcgggtggccggggccgggcattggctggcttgctgctggagatcaaggactaccccgctgccctgtccctgctgagcaagctcttgtcggaggtgaagaagctggatgataaactcctgctggtggacatctacctcctggaaagccaggtaccaacacgcttgcatgcatgcatgcgtgttgatgctgggggtctgtacatgggttcaatgacgatgatcctgtga

SEQ ID NO: 2892 - DNA, 939 bp, Chlorella protothecoides
atgctggtctactactacaaaggcagcgacgagctaggaccggtgggttgggaatctgagtgtgattgccgcgcacgatgcgtgcactcacggaaggcaaggctgcccagcacccactccatccggccaccgcccctgtccgcacctgcccacccacaccagtgcctcacagcccccgcccccaagacacaccctccaccaacacatgaaacacaggccgttcccgggaagggttcgccgcacccggcgctgacgctggacctggccctggagctgtacggccttgaccaccacgaggcgatcgtggaggcgcagcaggacctgacctgcatgctgggctggagcgctgccaggcggactgtggtgctggccttccgcggcacctcctccatggccaacgtgtggctggacctgcaggtctggcgcaggccgcacccgctgggcatggggcggtggtgggacagcacccggcccctggtgcactccggcttccacgcctgctggctggagcgcggattcggccagcgcgtgctcgcccgtctgcgcgccatcgtcgccggcgagggggccgcggagggggccgcggaggaggggggcggcgtgggagcaagggggcctgacggcgcgccctggcgcgtgctctgcatcgggcactcgctggggggggcgctggcctgcatggccgcctgcgacgtcgtggatctgtcgcgtgccctggagcgggagcgggcggaggcgagggaggggcggggcgaggcagccgccccggcggcgagtggatcaccgccagccgccggccccatcctcgtggccagctcatatacctacggctgcccacgcatcggcaaccacgcctttgccaagcactacgctgatgtggtacctgacagctgggatgtggtgcacaccaacgacgccgtggccaggaacggaaagtga

SEQ ID NO: 2893 - DNA, 306 bp, Chlorella protothecoides
atggctccagccaccattatcgggggcctgctgggcctcggcgtgcaactctactgcaacgccgtgcgcaagctgcccttgatgcgcaacccctgggagcacgtcctcttcatcggcgctggcgcagcctttggcaactggctggtcgactttgaggagaggacggcactggagctcaagggtaggaaagggttgcgcggcaaggggtgggatccctgggaggtcacctcctgcaaccctggtggcgaggtcctggccaagagggaagctgccttcaaccactcatcagcggagcgggatgcctga

SEQ ID NO: 2894 - DNA, 558 bp, Chlorella protothecoides
atgctgtgtgcctgcatcttcagtcatgagacccgcgttggcaccgaggcccacaaaccaacaagctcattccccatcctgaacacgcccgtgcaggagtacccggagcagctgacggaggatgtgaacgtatccacccaccttgcccagctgtacagcacgctgctggagaagaacctgctccgcctgatcgagcccttctcgcgcgtggaggtggcccacatcgccaggctcattgacctgcccctgcccaccgtcgaggccaagctttcccagatgattctggacaagcagctcgcaggatcaggccctggcacgaaggccggggcccaggggagggcacgccctctgcgcagaggctcgaccgatctcccacgaccacctccttttcacccctcgccaggcacgctggatcagggggccggcctgctggaggtgtgggaggagggcaccaaggacgaggtcttcccccctgccctggcggcctttgagaacatcgggcgggcagtggacttgctgcacgcccgctccctcaagctcatggctgctgccaactga

SEQ ID NO: 2895 - DNA, 1206 bp, Chlorella protothecoides
atgcacgcgctccaggaagaggcgctgggcgaggcagggcccgggggcctccccctcgacccggtgtgcatctcccccgcggagtgcggcccgcacggcgcctgcgaggcggggcggtgccgctgtgtggtgctgtacaccggggtcgtgtgcgggcacgccctggtgctcagccccacgctgctcgcgccggggctgccccgcttcgtgcccgcctacgagggcgagctgatgctgcacgcgcagacgcggcacgccgacatccgcgtgctgcgccccggccccacgctcgagtgggacctgctggccgacgcggccgagacggcggcgctgaaccgcatcctcccgccctccgacctggtgttcaagagcaaggcgtacccgacctgcgcggtggtgggctcctctggctccctcctcctgcgccgcctgggccccgccatcgacgcccatgtgctggtcctgcgcctgggcgccacgcccagcgcagggcacgaggcctcgctggggtccaagaccaacctgcgcatgaccgacgagcgcgactgggcctggcgcgagcggccggaggacctggccctggtgcgcagcgccagccgcgccactgtcacgggcctgctggccaacgcggcctcgcccgcgccggccgccatcgtcgcgctcgacccggactttgagtcctggctggccgatgggctgggcttcgcggccgacctggagctggcggggacgctgctggcgctgcagacctgccgcgccgtgacgctgtacggcctggcgccgcaggggccggcgcagggcgtgccggaggcgtaccacgagccttgcaagccggcggtgggcacgacgggcgacccgccgggcggcgccgcggcgcgctgggcggcgctccaggccctggctcgcgtgggcctggtggcctggggcgagccctgcgtggaggagtgcatggccgcaccggccgcctgcgatacatgtcgagcggcgctgggcatcgtgccgaagcccgtcgacgcctggtgcgagtcggcgcgggcggcagggcgcccgccggcggaggaggcaccgggcggtggcgcggcgggggggggccgaggcaatggcaccgccgtggggaacgagagtgcagcggcagggtcgggacagggcgcagcggccaagacggagcacaacagcacggcggcggcgacgaccacccggcgatga

SEQ ID NO: 2896 - DNA, 696 bp, Chlorella protothecoides
atgtgcgctctcatcgaggatcagggccctggaaatcagggtgagacacctcccgcaactcctacccttgccccgtcgaggctgcggacccaccagctcgcaggaaccgcggctggatacagggagcaggctgttgcccacggcatacccagcaggaagcatgggctgtttgcggacgacgatgccctgctgcttgagctctgcgcctccccggacatggcggcattcgagaagcacctgccgggggaggcgggtccctatcagccccttccacgcggcggctgggtgacgggagacgaggctgctgcgcggggcatcgacctacgcatgttctataggactccagccccgggggaggagcacggatctctggagggcgtggtacgtctcggggatggcgccagcatcggcatcgggttctgggtgtcggcccatggcggcgcggtcgagtccgtgttggacgaggccaccgctgagctggccaagtgcgaattcacccccgtgctggccaccgtcgaggcgaacttccggatcaaaaaggcggtgcccctccacacgacgctgagggtggagtgcagggtggtaaagatgcgtggcattcgatgctgggtggatggccgcctgacctctccagatcgcagcgtggtgtatgccgagtgtgccgcccagctcgtcaacataagcagctggctctga

SEQ ID NO: 2897 - DNA, 357 bp, Chlorella protothecoides
atgatgtctccccaaccttcatccaccacccaccaggacatcgagctgaacattgtgtatgtatcgcgggcataccacgaggcccccaggccggatcgatctaccttccgtgtgtcccagctgcaatggcaccggcggcccgaggccgccggccccgacgctgcgctgcagctgaggtgcaaggcccggcacggcccggacagcgtggcgtgcactctggagatggccgatgctgactcagcatcgggcgtcgtcaccctggccacgcccgatcagggcctggccccagggcagtttgccgtgttctacaaggatgacatctgctgtgggtcgggggtcatagagggcggattgtag

SEQ ID NO: 2898 - DNA, 681 bp, Chlorella protothecoides
atgcagtgggttggcaacgggactctggcctgcgcggagagcgggggccatcaccggcccaaccgccatgctgagctggcgcgcagcatgttccggtccctggagtgggtgcttgccgagggagggaaggacggcgaggcccaggccctggccctcctggcccgccggctgcaggcctacctgccctccttcgacgccgcctacaccgcctccacccccctcacgcgcatcagggacattgcgcacaggtataggattggggggaaatgtgctgctcagagggcgtgccggcagcgaatggatgctaggatcgtaatcaacaccacctccctatccctccctcctcccttacgccgcaggaacgacatcccccacgagctcaagcaggagatcaagcacaccatccaaaacaagctgcaccggaatgcggggccggaggacctggtggccactgaggccatgctgcggcgaatcacccgccaccccggcgaataccccgacgcctttgtgggcgagttccggaggttccacgcggagctgagtgattttttcagcgctgggtcgctgacggacagcctggccgccctgaggcccagcctaggggacgacccctccgatatacaggtggctttttggtgggcggggggttctaggtgggaagtcgccgctgtttggtgctga

SEQ ID NO: 2899 - DNA, 876 bp, Chlorella protothecoides
atgtctggcctgccgctgcttggccctcctcctgttcccgcttccctgtccgcgactcccccttcctgcctccctccattcctcttccaccccccccccaccacaccaccacacacttccctgcctcttccctgtcaccagggcattggtggtctcgtggatgacaacttcctggccatcctgaacgtcaccgtgggggccatctgcttggtcaccctcctgtttgccctctggctcctgctctggcgcatccaccgagccatgctctccggtcgcacctggacccgtccccgccgcttcctcgtcaacctcgcgctctgggagctggggctgcaggtggtgaacctcaccttcttcctggcgcccaacgccgcatggttggcagacccctgcacccccttccgcggcatcgtccacggcgccgtctttgtccagttctcatgctggctgggtctcttcaccatctttgtcatcagcgtccagggctttatgcccatcacgccagggacagccagcgtgcggggcctgcccctctacagctggtggctgcggcgcaatggggagacggtgccggccgatgccacctcggtcctggatctacctacttgggtccatgcagacctggtacgtggcagcgggggtgccttggatgggtggaggtggggccgggattgcagcaggccatccgacatgcagggacgcgacgatgtgaatttgttgctcctggcacagcggttcttgttgagggggaggactgggggattggagggttgtgctctgcagacggcatctgaggagctgccttggcaggttttggctcgagtatgctgggtggaccagcagcaagagtctcgacgttggcttctcttgccctga

SEQ ID NO: 2900 - DNA, 612 bp, Chlorella protothecoides
atggcgcacctggtgcgtcacccccgcatccacgcctttgacaacgtggagggccgatttgggttggagtccgggtatgaggcagtgcgcctgctgggccgtggcggcacgggccagacctggctctgtcggcggcgcgggacgggggaggaggtggcactcaagctgcagcagcgccccctgcccaagcacaccctggacctgacctacaacgaggtggtgatccaggcggaggtgggttggggctcgccccacatgtgcacgctgcaggaggtgatgctgaccccctcccacctcgccatggtcctggactacgaggcgggcgggtcctgcgccgagtacgtggcggcccagatccccaaggtcgcccgcctggagctgtgcgtggacgaggagcgagcgcgctacatgttccggcagctcatcgcaggcgtggagtacctgcactccctccacgtcgcccaccgcgacatcaagctggacaacagcctgatggacggcgccgaccccgcgcgcgtcaagctctgcgacttccagttcgccaagtactggggcaagcccgagtacgcgcgcatgaccacccacctcgggtgtgtgttaagggggggatga

SEQ ID NO: 2901 - DNA, 804 bp, Chlorella protothecoides
atgcccccttcagcaacaacacatcatcccgcccccgccctgtccaatgatgcaagcctgctgcaaggctgcgagccggggccccggctcagggtcgctgccctgctgagtggcggcgtggacagcagcgtggccctggctctcgcccagcgagccggccatgaagtccacgccttctacctccagatatggttccaggaggactttaggaacacctgggcgtcctgcccctgggaggaggacctggagcagtgccgggaggtgggcagcggatggacacgtcgtgtgaagcttgggcggctgtctgaggagtgccatgtgccccctggcacccggcccaatgttcccactgttccccctttcccaccacaggtgtgccgggccctgggcgacatcccgttgcatgtggtccccctcaccgccgagtattgggccctggtggtagaggagtgcatcgcaggggtcaggcgcgggcgcacgcccaatcccgacatgctctgcaactccagggtcaagtttggggcgttccacgcctggctggcacgccaggagcctgccttcgaccgcatcgcctcggggcactacgcacgagtggagcggggcggtgcaggcggtacgggcgaggccacaccgcacctggccacctcgcccgacgcggtgaaagaccagacctacttcctgtctcgcctgagcggcgagcagctggcacggtgcatgtttcccctgggccacctccagaagactcagctgcggcagcgctcagcgcaagaatgcatctgcatgtacgtgcctgtgcatctctga

SEQ ID NO: 2902 - DNA, 351 bp, Chlorella protothecoides
atggcttctgccctgcagactaggctggaggctatcgatggtgcctccagtgatgcagcgcagcagctgcgggcgctgttgacgggcgaaggtcccaacgatggagagagtgtaaaggtcaaggagagcgcccttacccgcctgtgcgaggtcttggtctcctcgaaagatgcagatgctctcagcagtctgctcctggacttgcgcccgctgttcgctgtcatccccaaggccaagaccgccaagatcattcgcacagtcatcgatgccatctcccgagtgcccaactcgacgcagcgcctggtgagtctgaggatgtggcaaagctccctgtgcaactttgcggcgtag

SEQ ID NO: 2903 - DNA, 555 bp, Chlorella protothecoides
atgtcttggggccgctgcctcacgacagccctccctcaatcaagcacacagtttgtcagcatctccggctccaatgtggaatgggagtcggggtccaaccacgtcgtccctgcccccgaggccgacgctgccgtgtccttgaactggggagcagccgaggctgtcgtgaagaaggcagaggccggtagccccttcgccagcagccccggtcctgatccaggcacacagggccccgccagcgacgattcgccggttcgtgctcgctggagtggaaaggagccggtcttcatgcaggggaacgagcacagccgggagcggcagggccggtgggagacggagggcctggagggggcgacgctggagatcgtgaatggcgatcgggacgcgggcagctggctgcagaagctggcagtcgcagagaagctgctggtccaatctgcgccgcgcctgaggccgaggctggacgcggtggccgccgcctatgtgtacctccaggtgagacgtttgtgggtgcttggatgggggggtctgggctcctggatatcaagtatatga

SEQ ID NO: 2904 - DNA, 393 bp, Chlorella protothecoides
atgctgctgactagaaggaggggctctatttgtcagccccgaccccttgcaggccctggccctgagtgtgttctcactccccagcaccatccttcccccgcctccccacaccccgccctcctccccacaacccatcctcctcccacatcgccgcagatcatgaagggagacgtcgcggaggtgccggccatcatcaacagcaagaccggcgccacatcgacggagagtcgcgaggtggcctccatgcgcgccgtggctgaggcttacgattcccgcagcctgcacgacttccaggcggtcctcgaggtgagcaccgggtggctgggcatgggagaggacttgccctacaggaagggggggggggaggggtccgaggagccgccggatccttga

SEQ ID NO: 2905 - DNA, 1029 bp, Chlorella protothecoides
atggcgctcgcggtcttccacagcacaccatgcgtgaggcatagtctcacacaacgtaacgcacctctcataagactaccattccgaagcagcttcgtggtttgccgaagagcagcgctgctgccggacaaggtatctttaagtcgtaaggctgcctcccagggcgtgaagagcagcgcatgggcctcgccgcgtggcacccatatccacacccgagccaccttgtctgggtctgggccctcgagctctgcgagcgacgccgagctgcccacccgcaacctgccgggcgtcgttgctctcctggtgctgggggcattgggcgtggtgggttaccgatggctgttccagtcggaggtggggagcgcctggctggaggccacgcgtactgcgctggctcggtcaggctttgcccgctccggcttcctggcggccttcagtctcatcttcacctcagagctgggagacaagacctttttcattgccgccatgctggccatgcgcctcggcaaggccatcagctttcgcgtgcccgccagcatcgagaccacggagttcctgggccaatggttgggcgctgcgctcctcgctttctttggcatccgtaccctgctggacgcctggcagtcggaggagaagcgggcagacgaggagaaggacgcagagaagtcgcgtgcgtgtgatttggagaagcgggcggacgaggagaaggatgcagagaagtcgcgtgcgtgtgattcgaccggcaagatcagtgcgcgcggctcctggcgcggcatcctggaggtggccagcctcatcttcgtggcggagtggggtgacaggtccatgctggccaccatcgctctgggcgcggtccaggctccctggggcgtggccggcggcgcggtggcagggcacgcggcggctacgctgatcgcggtcaccgccggcgccctgctgtcgcgccacgtcagcgagaagacggtggggtacaccagcggcatcctgttcctcgtcttcgcggcggccaccgccctgaacttgttctga

SEQ ID NO: 2906 - DNA, 486 bp, Chlorella protothecoides
atgccccaccactccccaactacccagatcgtggagcgtttcctggaagccaagcggaagctggaggcagcaggcagcagcgccgacatgaacgacgtggtcgacacgttgcacacgctgggcacgctgcgcgcgctgctctgttcccgcctctcctcaggcctgcgcaacgacgtgggcgacggcgtgctcgccgggcgcctggcgttccttgccgtcacggagcgcccgctggtgcatggtgtcgcagacacagccccctgccccgtctccatgcccaggtggcggcaggccgagatccaggcggaggactatgcattcgtcctgctttctcgcttcagcaacctcctcgaaagccaggtggggtgggtgcggtggggcagggcaggacctggagggtcaggcttgtgggcggggacctttcccgccgtcaagaaaaccccaacctcttcgcagcggcttgaggagtccgcaatggcagagtag

SEQ ID NO: 2907 - DNA, 567 bp, Chlorella protothecoides
atgtacgtgggccttcgacgaggagggctgggagcacttccgctgtgtgcagactcctgtccaccggacgcgcagtgggtcccatgtctaaagattccgctccttgctctgcaggtcaagcgcgtgcgctgcgagtcgtccggcgtgctggtgcccaaggacaaggccatcaagcgcttcatcgtgaggaacatggtggatgcgtccgccatccgcgatctgcaggaggcctgcaccatcgacagtgagtatctgggatacgggaagggtgttgctggcgcccggcgctggagagcaccagctcggcaaggagcgagttcgccgacccctgctttgctgccgcacacctcgcatgctgagactcactccccgtacccctccttccctacactctatctgcagactacgctctccccaagatctacaggtgtgcagtcgttcgggaaagtgtactactgcatctctgcggccatccactccaagatcgtgcgcgtgcggtccgtgaagaaccgccgcaaccgcgagcccccaaagcgtcccggcttcggcccccgccccgagcggtga

SEQ ID NO: 2908 - DNA, 1068 bp, Chlorella protothecoides
atgtgcgcaccgatgggttatgtaatgaggttactcagcattcattcaccgattgcgctcgcgatgcgatacctggacattgtagggcttgttggtgtccgccagcaaggccaggcacttggcttcggccatgcctcctcaagcttctccagcagctgcctcttgtaccctaggaatatatacgctgcgccactgatacgagtatcgccatttgtcctgtccttccacatgcctctcgccctcgcgtcattcaagtctggaggctccacgctgtcggtcacgggaaatcgtattggtcttgggcgcgggaaagttcaggtcacctttgttcctccaccaagtgctcttccaggaggagcaacaggcagcagcgattgcacagctttcctgcttgagaagagcacatggtgctgctgttttgaggtgtctccaccccagcccctgctcgtcagtttcagagggatccggccttcggagctcctgcccgtcccgcccggagcatctccgaccatggcgcagcaggtgcttgagcgcgacccgctgttcagacggatgcgcatgaagccagaaaacaaggtgtgctttgactgcccggccaagaacccggcctgggcctcggtgccgtacggcgtgctcatctgcctgaactgcgcgggcgtgcaccgcagcctgggtgtgcacctcagcttcgtgcggtccaccaccctggactcctggacggaggagcagctggcggtgatggcggcggggggcaacggccgcgcccgcaccttcttcaagcagcacggctgggacgaggtggggtccgacaagatcgaggccaagtacacctcccgcgccgcccagctgtaccgccgccagctcgagaaggacgccgccaagctgctggagggcgacgccggcgcggccggcggggccggcgccggcgacgcgtccgacccctggtcggacagctaccgctccaagggcaaggcgcccgaggcggcatcgcccgcccgtgccaactccctggcctcgcagcgcccctccagcgcggaggccgccgcgcctgaggccccagaccatcag

SEQ ID NO: 2909 - DNA, 1413 bp, Chlorella protothecoides
  modified_base (879)..(888): a, c, t, g, unknown or other
atgctggcgtcgcaaggattcaagaaggcccaggttgaaaaggcactcatggcgctcgccgaggccgggaaaattagctgcaaggagtttgggaagcagaagctcttcattccttctcaagagggtctccctgagctcgatgcggcggcgctccattcctccacgtcgcactgcaggagaaggacgccaagctctcgaggatcagccaactgcagcagagccgcaaggagtttgaggccgaaatctctgctcagcgaaaaggtgaggggggacgttgatcactcagtcacttccctccaccctgtgcaccttcccctgtcgacagagctggctcagctgaactccgtcctgacggtggaggagctgcaggctcagatcgccacccgactgcaacaggtgcaggaagccgagacgaaactggcggcgcatcggggtggtggcattgtggccgtgtctgctgaagacgtggcagcagcggagcaggtgagatcatgcctgtggggcacaaggtgcctgccggggttgagctgttcggtgcacaggatgcagactctaaaggggccagtgcatgcctgccctgatcgagcatgtattctgagtttgcaaaggtcatggtgctgtacacactgcgccacattacgccgattaaatgcacctctctctcatcctgcgctccccaaacagaggtttgccacgggactgaccgcatgggagaggtatcgccgcatgttccgcgacatctgggacacagtatcagaaaatctggaggcgaatcaggtatgggtgggggtgtcgattgtattgcacttgtttaatccagacctgctgatcggccatggcaaggggcctcttcgagtcacatggtcacgcccctctccnnnnnnnnnnctgcttaatccaggtctgctgatcggccatggcaaggggcatcttcgagtcacatggtcacgcccctctcctccctcatccaggctgacgtctttgaggacatgggagtggagacagatgaagccatcggcgagaccctggcagcataccagcacctgcttccaggcaggaaaaaggccaaggcctgctgagattctgtggtgatctgagatacgaagagaccaaagggtcaagaaactctgccatgaagatcgttacaggatcaaaaatcatatgcgggtcaaggaccttgcatggatgcacgaagctgatgctgaggaatcgtttgaaaattttgatgaggtgatggggttcaacagagctgcagagggcgcctcatttggtgtcagtgtgggagcggggcaacaaccccgagatcgctgctgtcagatgaatgaggtgaaaggggctgctgtcaccactccagcaataccacaacggcagtcatgttgtcacgagtctggagcgcggttgccctatggatga

SEQ ID NO: 2910 - DNA, 1521 bp, Chlorella protothecoides
  modified_base (498)..(507): a, c, t, g, unknown or other
  modified_base (607)..(616): a, c, t, g, unknown or other
  modified_base (727)..(736): a, c, t, g, unknown or other
  modified_base (1382)..(1391): a, c, t, g, unknown or other
  modified_base (1494)..(1503): a, c, t, g, unknown or other
atggtccggcgctgcatgcagggcagccgccgcttcgccatgaccagccgccggcacccgggccgcgcctcggacgagctctgctccgctgcctgcgaggtggagatcactgagtgtgtggcgcagccggatggccgctttggcatccacgtggtcggccggcgccgcctgcgcctccagggcgtgcaggacatcgacggcctcctctacaccactccatccgacctgcgagacggcgcgacctcagagccaccctcgccggagctccgcgcccgcgtggcggaggtggagaggcgggcgcaggcctggatcgaccgcctccaggagctggttgagcattcgccgggtcccttgtactctcatcctcggacgctcacaataccctcactccctgccttgcctcccctgtccaaccccattcagagcaagcctggtctgcgggcacttctggacgcggcgtcagacagaccggagcccggagatcacgaggccctctcnnnnnnnnnnagcgacctgggttctgcaccacccactgccaccctcatgcccccccgcaactgccaccctgacctctgggcccccagcactcgccggggcccttgtccannnnnnnnnncttctgggcggtgcgtctgtcaggccagctgtactcctgcgtcgccagggtgcccgtctctggtctgcattcctcatccatgcatgtgtggactttgctgcatctggccannnnnnnnnncttctgggcggtgcgtctgtcaggccagctctactcctgcgtcgccagggtgtccgtctctggtctgtcttcctcatccatgcatggggggactttgccgcgtccggcctgcatgggcctgcctgttcccacgaccctgcgtttcaaccctccccttcgaccccggcgcaggcgggactggtggtccggctgtccgacaaccctgccaggtatcgccgggagatcatggagatggagagcacgctggagcgcctgaccctggcctccagcctcttgtttgccgcgcagaagaagatcatgggtgggtgctgcatcagctgaggtgggggcgctgcagcaacagtccatgggaggctgcgacgacagcagatgggtgcctccacgacacccctcgggtctccatcctggtgctggataagtacacgcgctccaccacgactcgacttcgatttttcccaccccttgtacatcagggccgtgcctgcagccaatgtctcccttgcagaaactgttgctccgaagactgcctcgttctcatcatcgtcgtcgtggaactatctatcatctcctgtgcaccctgcagcgtcgtagtgtatgacttgcgtctccccctgatgtttacccctaatattcagtttgatcaacnnnnnnnnnnatctatcatctcctgtgcaccctgcagcgttgtagtgataatgatggttgaggaagatgtcgggtgcatgtggtctcaacaatatgagcaagaaccaaaaaannnnnnnnnntgctgttgtgaaggataa

SEQ ID NO: 2911 - DNA, 684 bp, Chlorella protothecoides
atgagcatcgtatgcaccgcacttcatggatcccacccgcgccggatcccctgggccccgtgcgagggaacgccccatgctgcaacgaaacaacgcactgcacggcagaaataccgattcaggtccagactggcttcgtcggcccctgttccctcgggagacgaggaccaggaggcaattcagtcggcatacaacaaggcgatcaacacgagcaaccctcccgatgtcttcatacaagacatgcgagacttcgcgacgtcggtgctgaggggggcggaccccaagaatgctccctcgcctgtagcggcagagcagtggtttgctgagtacgacctgaatggctctgggaggctcagttctgcggaactggctgcaggcctccgtcgttccggagtggagattagcgatgcccaaacgctggcattcatggaagctgcagggatatcagcatccccggaaggggacctagcagtcagaatagaggccttccagaacctgctccagtgcatggcaagggctgaattttatggccagcgcgctttcagcgcaaacactccgacggcaggggttcctgcgccgcagccacccaagggtgaggacctggagataatccaggtaagctttggtttagggtggggtggagttcccattctgcaggacgaattcttggagaaagttctctga

SEQ ID NO: 2912 - DNA, 1056 bp, Chlorella protothecoides
  modified_base (264)..(320): a, c, t, g, unknown or other
atgctaccccccggcacatggcggatgcggcagcggtcaatggccatcatcccgctcatccggtcactgcccaatgcgacttttgttcgtcagcgtgttccagcgcctgcatcgctcgtccattctcacgatccggaaccctcccatgcagtcctggctggagacgcagcgcgctgcggccgcggacgcggcggccgccgccgccgcggcggaagaggaggatcgcctggtggggcccgaggcacctgcgggggccggcgaggnnnnnnnnnnnnnnnnnnnnnnnnnnnnnnnnnnnnnnnnnnnnnnnnnnnnnnnnncggggagggcaccgctatggccgcctttgtgcagtccggccagcgcatcccccgccgtggcgaggttggcctgaccagcagcgagatcgacaacttcgagagcgcggggcatcagctgtctgcagccgaggagggcagtgggcttgcaaagcccggcaaacccccaggcaggatgcctgtgctggttccccggcgaagactggagttccaggcgcctgtgccgcccggagcgacccatggtgcactctgccgcgtctacgcccccactcatcccgcacaccggcctgtcatcgtctcaccccctcacgctccagctccctcccttcctgcccttgttccccccgcgcaggtacgtaatgtccgggaacaggcatgcgcgcatgaacgcggtgcgcatccgcaaggagaaccaggtgtacacggcggaggagaaggcggcgctggccatgttcaactacgaggagaacaagcgcaaggaggccaagatcctggacgacatgaagcgcctggtgcacaagacgcttgggcccgacgccgggctggacccggtggaggaggagggctgacgggggtcggagggctaggatcggggccgggcgtggccctctgcgcctggccatgccagcctgctgcctgtgaccctcacccgctggagggggggggcggtgctgccggcacgcccaaggtgcaacaggcatggggagggcggcacggtggggcactccggttccagtag

SEQ ID NO: 2913 - DNA, 1845 bp, Chlorella protothecoides
atgaccaccaccacccaacacacccacctgcgcaatcagggctttgcgcgtctcctccgggggcgggtaggtggcgtcgccgtagagggtgacaaaggcgtagatgacctggcccttgatggcgtgctccacgggcaccaccgccgcttcggcgcacagatggtgccccaccagcgccgactccacctccgcggtgccgatgcggtgccccgacacgttgatcacgtcgtccacgcgccccaggatccagatgtagccgtcctcgtcgcggcgcgcgccgtccccggtgaagtagtagcccttgtagacgttgaagtaggtctgctcgaagcgcgcgtggtcgcccgcgatggtgcgcagcatggagggccaggagcgcttgaccaccaggtagccctggccggggccctccacctccttccccgactcgtccaggatggcgggctccacgccgaagaagggcagcgtggccgacccgggcttggcggggatggcgccggggaggggcgtgatcatgtgcgcccccgtctccgtctgccaccaggtgtccacgatggccgcgcggccgccgcccaccacctcgttgtaccagcgccaggcctcggggttgatgggctcgcccaccgtgcccagcacgcggagggaggagcgcttggagcgcgtgacaaactcgtcgcccgcggccatcaggctgcggatggcggtgggcgcggtgtagaacaggctgacgttgtacttgtccacgatgtcccagcagcgcccggcgtcggggtaggtgggcacaccctcgaacaccacctggctggccgcattgaagagcgggccgtaggtcacgtacgagtgccccgtgatccacccgcagtcggcggtgcaccagtagacgtcggaggcgcggtggtcaaacacgtacttgaaggtggtggccgcgcccaccatgtagccggcggtggtgtgcagcacgcccttgggcttacccgtgctgcccgaggtgtagagcttgaaggaggggtgctccgcgtccacccactcgatgggcgcctcggtggactgcccgggcaccacgtcctgccaccacacatcccggccctcggtgaaggccaccttgtcgcgcggcagcgcgatggagtggtcgtacaccagcaccgtggtcaccgagtccgtccctggcagggccagcgcctcgtccactatcttcttcagctcgatgggcttggcgccgcgcttgacgcccgaggtggtcaccaccacggagggccggctgtcctcgatgcgccccgccaacgactccgcggagaagccggcgaagacgaccgagtgcaccgcgccgatgcgcgcgcaggccagcatggtggccggcagctccgggatcatgggcaggtagatggtgacgtcggagcccttcttcacgcccttggacagcaggaagttggccacctggcacacctggtcctgcagctgcttgtaggtcacggtgcgcgactggtccacatcgtttccctcccagaagaaggcgacacggtcgcccatgcccgcctcaacgtgcctgtccacggcattgtaggccagggggtggaggggtggggggaaggatggggtggggagtcaagtgggaggtctgtttgtgatggaaaagtggagtgggataggtcaaggggaatggacacagagtgcaggacgacagggaggaagcagggatacattgactgcacgatatgtgaggaagcaggacgcaagaaaggccggctagataccgtgactccgaggcatgcagagagggcaacgagcatgcgcccagactccttgcaccattggagccacagaacccaactcccgatttccccctga

SEQ ID NO: 2914 - DNA, 1737 bp, Chlorella protothecoides
  modified_base (504)..(513): a, c, t, g, unknown or other
  modified_base (728)..(737): a, c, t, g, unknown or other
  modified_base (1441)..(1450): a, c, t, g, unknown or other
atgacaggaacaaaaatggcctcctatcctccgccgcccggtcttcagtgccctgcagacctcctggcctcagtagatgtactctgggatcgtcaggtgcacagtggggcaggctgcctcgatgaagcgggtgccctgcgcctcggcgtcgccctccttgaagccaaagctgccggtcatcctgcccgtggggcagggcatctgcgtgcacgaggtgtaggtcagggaagggccccccgcactgagctgggggaagagtcccaccacgcctggtcccgacgccaggatggggtcatggtctgtggggaggaagtgccaggtgcggttcaccagctggacggccagcagggggccaaggggatggcaggtggtcggatggcgtgcgagtcccttcatctcttcctctggccaatgcctcgagcaccctctgaccctgccacccagcctcatctagcgcaagggggaccccaccaggccgccgtccctcccacgccacaccagccnnnnnnnnnncgccccccagcctcatcaagcgcaagtgggaccccacacggccgccgtccctcccacgccacaccagccccttcccagccctctccttcccctccctggagcccggccggaggcaatgctcccagccgactcactggtatgcaaaggtgtaggcctcggtgccccgcgcctcatcctgtgggttgctgcagtactcggggaggaagagcacggannnnnnnnnngggtaccccgcgcctcatcccgtgggtggctgcagtactcggggaggaagagcacggatgcgtgcaccctgatgccctgggtcacagcgacctgggcggggccatggggaccgctgctgcgcacggggtacaggcacggcgtgctggggctgcgcttgagggggaagatgggggaggcggcgtacacaccgtcccgcagccgccgcgcgtactcgcagaaccagcgctgcacggcgcagcacgcggcacctgccgcggggttgaggtgagtgtgacagggatgtcacgccgtggaatctggccggtcgggcgctgcccagcgagctctgcaggggccggactgctggaattcagcagcatcgcctcgctcacgcggtacccggacggccatgcagcggaggcagggggcggcccaggggagcagcccatgtccctgataccaagtaccttctggagccgcaggaaaggccacagcctggccgagtatcgacgccacggccccgttcactttgtcaatgcagatctgcttgacactgccttgactgcatgcaaagatgaggctgcgaggggtattcaggggggtcgagggatttgggagtggaatgggatgggggacgcattaaaccgcatgagcaggtggcatgtatggggcatggggagcaccggtgctgcaccgtgcccagatgccaagatcctgttggccnnnnnnnnnnaaaactgcatgagcagggggcatgcatgggacatggggagcaccggtgctgctccgtgcccagatgccaagatcctgttggccatgagcctgggaccgcacatggatgcagcaagcccagccaccagagggctctccagacaccctcatctggctgaaggtgcctgcgaggcagggcacacccattccctcgcccactgcctcacctggaactgtcacgtccaccttggctgttgcaactcgatgacagagccaagatttcacgaagggacaggaggcccatcgtga

SEQ ID NO: 2915 - DNA, 354 bp, Chlorella protothecoides
atgtacaaggaggatcgcgtgctgagcaatccgcggggctcccgcatctcgcgactcaacatgtctagggccttaggggacggcaacttcaagtcgccccagcgtctggtggaggcgacgccggatgtggtgagggtggccctccggccccaccgagaccagttcttcatcttggccaggtggggggaagactgcgcggcaggtcttggaggggcttttttctggtgctgcgatggggccctgggattgacgggcatccagaaccaggcagtgtgggtggaagatagccgtgctcaaatcccagcccagcccatagaggcttacgaggaagccatcgctgttccttacatttga

SEQ ID NO: 2916 - DNA, 240 bp, Chlorella protothecoides
gggctgcagatcgtggtgcacggcctgcccttcgcctacaagtggcaggacctgaagccgctgtttgagggcgtgggcgagatcgagcgcgcggacatcgtgcatggccgcgacggccgctcccgcggctacggcaccgtgcgcttcaccaccctggaggccgccgccgccgccatcgagcagttcaacgggaccgagctggagggacgcaccctgtccgtcaagctggatgcctacgcc

SEQ ID NO: 2917 - DNA, 471 bp, Chlorella protothecoides
atggaggaccgacatactatccttcccgacttccaactttcccccaccacatcgggcatccctcatcagtttgcggccgtgtacgacggccactgcagtgctcgaggctcagagcacgcggctgacaggctgcatgagctgctcgccgagcagcccgagatccagacatgccagggcatgcgcgaggtggacgacacggccatccagcgcgcctttgcgcgcgcgttccacgagatggaccttgagatggtggatgtggccagcgccgcgggacagcagtacggcaccactgctgtgtgcgccctgcgcatcggtcgcctcatgtacatcgcccacaccggggactcgtgcgcgctgctgtgccggggggggaccctggtcaggctgacggaggaccacaagcccgcctccatgcccacagaacgcgctcgcatcgagggccagggtgagggtgtgtgttgggtggtttga

SEQ ID NO: 2918 - DNA, 1611 bp, Chlorella protothecoides
atgggcgaccgtgtcgccttcttctgggagggaaacgatgtggaccagtcgcgcaccgtgacctacaagcagctgcaggaccaggtgtgccaggtggccaacttcctgctgtccaagggcgtgaagaagggctccgacgtcaccatctacctgcccatgatcccggagctgccggccaccatgctggcctgcgcgcgcatcggcgcggtgcactcggtcgtcttcgccggcttctccgcggagtcgttggcggggcgcatcgaggacagccggccctccgtggtggtgaccacctcgggcgtcaagcgcggcgccaagcccatcgagctgaagaagatagtggacgaggcgctggccctgccagggacggactcggtgaccacggtgctggtgtacgaccactccatcgcgctgccgcgcgacaaggtggccttcaccgagggccgggatgtgtggtggcaggacgtggtgcccgggcagtccaccgaggcgcccatcgagtgggtggacgcggagcacccctccttcaagctctacacctcgggcagcacgggtaagcccaagggcgtgctgcacaccaccgccggctacatggtgggcgcggccaccaccttcaagtacgtgtttgaccaccgcgcctccgacgtctactggtgcaccgccgactgcgggtggatcacggggcactcgtacgtgacctacggcccgctcttcaatgcggccagccaggtggtgttcgagggtgtgcccacctaccccgacgccgggcgctgctgggacatcgtggacaagtacaacgtcagcctgttctacaccgcgcccaccgccatccgcagcctgatggccgcgggcgacgagtttgtcacgcgctccaagcgctcctccctccgcgtgctgggcacggtgggcgagcccatcaaccccgaggcctggcgctggtacaacgaggtggtgggcggcggccgcgcggccatcgtggacacctggtggcagacggagacgggggcgcacatgatcacgcccctccccggcgccatccccgccaagcccgggtcggccacgctgcccttcttcggcgtggagcccgccatcctggacgagtcggggaaggaggtggagggccccggccagggctacctggtggtcaagcgctcctggccctccatgctgcgcaccatcgcgggcgaccacgcgcgcttcgagcagacctacttcaacgtctacaagggctactacttcaccggggacggcgcgcgccgcgacgaggacggctacatctggatcctggggcgcgtggacgacgtgatcaacgtgtcggggcaccgcatcggcaccgcggaggtggagtcggcgctggtggggcaccatctgtgcgccgaagcggcggtggtgcccgtggagcacgccatcaagggccaggtcatctacgcctttgtcaccctctacggcgacgccacctacccgcccccggaggagacgcgcaaagccctgattgcgcaggtgggtgtgttgggtggtggtggtcatgatcgaggtggtggggccctgggcgactcgtgccgtcgaggtgggagggaggccgagtgtcctcccgacaccctggcgccctga

SEQ ID NO: 2919 - DNA, 579 bp, Chlorella protothecoides
atggggccacggcgccggccgcactgcccgaccaagagcaccaaggccgtgcccacaggggagaacggggtgttcacctccctgttccggggggtgaccaagcaccggctcaccgggcgatacgaggcccacttctgggatgcctcacacaagcgggagaccaaggtgcggtgggtgtgggtgtggaacagggcgggagcgagggaaggatgggaacactgcagagaaacagcgcatccagaggccagggtccgctgcatacgcacaccaagtcacccgccaatgatgggcatcataccacctccccatccatgccgaccgagtccgcagggcaagggcggccgcacgcgtgggcgccaggtgtacctgggagggtacacgtcggaggaagaggccgcgcgagcatacgacctggctgccctggccttcctgggggctgcagctgccatcaatgtacgattcgctgttgcgaagaggtgcagggggggtgttcttgcgatgactgatgaatacatgggtgctgatctgatgcagtgcagaagacaccacctgaatccgttccctgtcgcgatgacatga

SEQ ID NO: 2920 - DNA, 639 bp, Chlorella protothecoides
atggtggagctcagggtcttgcgcaccatcctggagcacgacccgggcgggcggtggcattgcgtgcgcctgctggactggttcgactaccggggccatgtggtcatggtgtttgagcgcctgggtccctccctctacgactacctgcggaagaacgactacgcggccttccccctggatctggtgcgtgacaccgcgcggcagctgctggaggccctggccttcctgcactcgctgggcctggtgcacaccgacctgaagcccgagaacgtgctgcagcgaggcgtggaggtggtgcgcgcctcctggccctccggcagccgcctggcgcggcgcctgcccgccacccacgcgctgtgcctggtggactttgggtcggcggcctgggacgccgacgcacacgcgcacgtggtcagcacgcgtcactaccgcgcgcccgaggtggtgctgggcgcggggtggagctggcccgccgacctctggtctctgggctgcatggtggtggagatgctgacgggggacgcgctggttcttgcagggaaactggtgttggaagggactgaaggggcgctgcgcggccgtgcccgggcgccatggggggccacctgcatcctgttaacccggcatggagactcctga

SEQ ID NO: 2921 - DNA, 588 bp, Chlorella protothecoides
atggcccggaaacctattccgctgggtgcccctcctccgaacccacctcacacgctggacgttggcatcacacggacgcacagcggggcggggagtaccctaccccaggaccgtacggggtccagctccgttcctccaccccagcctcatgcgtccgaggcgattgagcaggccggtccagggccaagcagcctgcccccgtctcccggcaattcgtcagactcccaggaggccgacacctccacccaggtccctgtcctgcccggcgaggcgcctcagaaacgcccccgcaccgtgtaccccccgccgagggccgccctgccagagcccatcccccccagcgagctcctgtttcccgaccgcaccagcggcccggtgcacccccccaactcggcggggcacttccagtatgaggtgggggagaacctgaccgctcgcttcaagatcatgcgcaagttcggggagggcacctttggccaggtgctggagtgctgggaccggcgacgtggtgagtatgtggccctcaaggtcatccgctgtgtccaggtggggagtggaaggtgttcaagatgggaaggcgggatgtga

SEQ ID NO: 2922 - DNA, 435 bp, Chlorella protothecoides
atggaggaactcacctccgacgaggtggtctcccggctgcgaaggggctcggttgggtttgccagtcagggccggaccattatgcagaggggactgcatgtccacggcaatggaatcagaatccaaggccaagagtgctgtcatgtggagatgacaagccaccgcctcatcgcgcaaacaccgccgcgcctctgcaggggtgcatcccagtaccgaggcgtcacgaagcaccaccagcacggcaagtgggaggcccgcattggccgggtggacggctccaagtacctgtacctgggcacgtttgagagcgccgaggaggcagcccgggcctacgaccgagcagctgtcaagtttcgcggcagaaaggtacctggggggttgtgggatgtgggatcggctggtgcaggttggtggggatgtaaactgatcctatga

SEQ ID NO: 2923 - DNA, 1212 bp, Chlorella protothecoides
gtcgccgcgagcagcgacgcgcctctggtcgccgtcagcgcgcgcttcgaccgcctgacggcggcgctgggcagtccggccacgctgcgcgcgacgggcgcgctgctgggcgccgtccgcgctcgccaccccggacccctgccgcccctgggccacctgctgcgacgtgtcttccctcccagcgccgcgcgcgtgccgcgctaccccgcacgcgtggtgctgtcggcctacgcggtggccacccaccccgaggtcgtgctgagcgggctcggcggccaggaggccggcctggtgcacgccggggcgcgcctcgccgccgcgctgcgcgccgtggccctcgcctgggtcgagggcggagaggctttggacggcgacgcggcttcgcgcaccgccacgcaggaccccactcccacggcggccctgcccgcctttgacgcggcctgggtggagtacctggagctcttcgtggcctggaaggcggccgacgccgccgcgctcgaggctgatctcatccgcatcgcggtggagctgcaggcctcggccgcgcgcaagcgggaggaaagcgcggcgcgagatgtgcgcgcacgcagcgcgccagacatggcggctctggaggcggcgctgcaggccgacctcgccctcctgcgcgagcgggtgctgcagctgaccgggcgggcggggctgcgccggctagaggccgccctgcgcgccacgccgggggagggcgaggcggtgggaggggcgccgggactcgatggcgctgaggggcaggggcgtggcactacctcccagccggccgccgccgccgaggagggcggagaaggtggtgtggcgcagacgatagacgcctgggacgtggacgccttcctggcacagcaccccaacttcaggctgctctggcagctcctgcacgaacccacctggcgcctgccgacagaggaagccgaaggcgcgtggcgcggtgctgtgcgcgcagagaccggcccggacatggcttcgagccccgtggtcgacgccgggagcgggagggtcgacgccgcgcggttgaggaccatcgcggaggcggcgttctgggacgggctgcgccacgacttgaacaaggctgacaccgcagggacggccggcgagacggcgcggcgcggcgtcttgcagcgggtgggtaaagcttgtggcttgacgtcccgtagaaagggggcagcagcgacctcttga

SEQ ID NO: 2924 - DNA, 471 bp, Chlorella protothecoides
ccacgcagcgcgggcacgcgccgcggcgtcggcgcggtgtccaccccggggatgcccagctggccgtgccggttgctgcccagcgcccacacctccccgccctcgccgcgcagcagggtgtggtgcttccccgccgccaggcccagcacgcgcagcgtggccggcagcgccacgcggcgcggggccagcacggcgctggacccgccgtggatgtgggcctcggggtggcccagccgcccaccccgcccccagccccaggtccagaccgcgccgtcgcagcccagcgccacgctgtggaacttgcccgcgccgacgcgggccacctggccgccgcccagcccgtccaccgcgccggggtcgggctgcacgcccacacaccccgtgcccagcgcaaagttggcgccgtcgccccaggcgtagagcgtggcgccggcggggggggcgccgccgcaccgcgcggcggggccgggg

SEQ ID NO: 2925 - DNA, 3303 bp, Chlorella protothecoides
  modified_base (1342)..(1351): a, c, t, g, unknown or other
  modified_base (2558)..(2567): a, c, t, g, unknown or other
  modified_base (2849)..(2858): a, c, t, g, unknown or other
atgttctcaattgcggggaaagaccgcggcgcgggacccgcgagaccggaacatgtacccgtgtcacaaccaccacatccgatcaccacggacgtcattccggatccgcagcgcctttggttcgtcagaccgtcacatccatttcgacgcgcggttctctcgctcgccaggtggcaccggaccacgccccggagatcgacgtgtttcggctttgagggcagattgcatttgagatgcatacaagacgactgcacagatcctctcatcttggatacgatactcaaagtgagctttcagaagaaaatatccgtgaaccccaagtcagcttctcacctggagcgactcgaattacttacctcacacttcgaactatcggggggtgtacttaatctgggtgggatcattcctcattggcattcaaaacgaccgatggacagggtaaagcctcctgggtacctatatcaccagtgtatggcgagttgtgctaacaacgcgcttcactcccgctgcatcatagtcacgagtttcagtagcatctctgaccgccatctccaccctggttggcagacgatgccattttgcaagggtgctgagaaagcccttacttgggagaagggcggaggacatatgatgccgtggcgaactctgcacatggagaaactggagagcggctgcgctcacatcctcgacttgcagtgcattggaaggaccaggaaggggtatatttgtgaggctgaagaggacataggagagaaggaaaattgctggcgcaagcatcacttgctatccaagagtgctgtgttggccgcggcattgcgatgcacacatcagccctgtagaatgagagtcccccctgcccacatctgccagaaaccgcagctgccaagaaccgtcgccagcacttactctagcctaatcgtttacggggcaaaccgtgaacccctgcacccaccacgcgcgccatccgcaagaagatccgtcgtcagccagcagctggccgataaacacatgtcaacatcgaattcacatcgctcgatggcttgccaggcaggggccgggctgcaggccagagatcggagcgggctggcgagtgctagcgggtggggttttacagccagagtgaatagtatccgctcgtccgtgtctgcgtgcggtcggtgcacgcacgttggcaggtatgatggggaggagggcttctctgccatcctaccctcaaccatatgcagggcccccggtctgacacggcacagctaccacgcaaaagcatacgttgtgacccgtctaccgtgcgtgcccttgccccatcttgcaacccctacacccctctcaaaccaccccaggnnnnnnnnnnagtgctgctgggcggtgaatccaccagctcacatgcacagcatccgttgtgacccgtctaccgtgcgtgccctggccccatcttgcaacccctacaccccctctcaaaccaccccagtccagacccctggacgctccctcggcgggcatgcccggccaggcccgggatcccactgccgtgcccccgcggcggcggcggccgccaccgacgtcccccctaccgccgacgcgcaacgcagcgagcgcacgtttgacatccccggggcccgcgtgcgcgtggaggtggtgactcgggcgccctgcggcacccaggccatcaccgtggccaccgacaagcccggcagcctgctgctgcactggggcgtggagggtggcgcagggtacgagggaggctggcgcctgcccggccccggcgcccgcccgccgcgcacggtgcagtacaagcagcgcgcgctgcagacgcggttctcgcccgccgccgacggcgggcaggccgtgtcgattgagctgcccggccccgaggcctccgaccgcctgaactttgtgatcaagaacgagggcaagggggagtggtacgacctcaacggcgccaacttccaggtgcagctgcgcgacggcaaggggggtggcgcggccgcgcccgccggcgacgtccgccccgccctcctccccgccgacgcggtgcccaacctgccccaggagctgtgcggcgtctgggcctacctggcctgggaacgcgccggctgccccgcgcggagcggcgccgaggccgacgccgagtacgacgccggcgtggccgagctggtcctgctcctgcgccgcggcgtcggcctggacgagctgtgggccgtggcccggggtcaagtgccctgggcccagttccaggccgcgctgggtggggcagtgggcggggaggacgcggcggcggggcgagccgagggggccccgtcgccgccggcgccggcgccgcctgcgcccgccgtgcccgaacatctggtgggcacccaggcgtacctcctgtgggaggccgcaggcaagccggacggcgcggactttggcgccgacgcgcggcgcgtgctgcgcgagcagctggccgcgggcaggtcggtgcaggagctggagcacgcgctgggtgcatccccgccagaggcctcgccgacggcgtcagcgccggcgtcagcgccagcgccagcgccagcgcaaactcnnnnnnnnnncgctgggtgcatccccgccagaggcctcgcaaacggcctcgcagacgggcgcaccgccggcgtcagcgccagcgccagcgcaaacttcggaggagtcgggcctgggcgcctcgcgcggaatgcgcagcgtggaccccctggacctgatcaagcgccccgcggccgcaccgctgctggccgatgtgcggcccggtgcccaagactcgcccctggcgcccttgcggtccaggggtctgttggtggtcaagcgaatgagagaggcagaactgttgggcggcgccnnnnnnnnnnggatggactgaagcggtccaggggtctgtttgttggtggtcaagcgaatgagaggggcagaatagtggggcggaggaccttcccaggtgctgttgggctcttcagagcgcagctgatccccgcgtgccgacgcccgccgccacgccaacgtcgcgctctgagccccctctcccctccgcgcacacatgtatacctcgtcagtcgctgccacccctcacacctgcccccttccccccccccatgctcatctccttctcggcagaccttcaacctgggggatggcgcgcagctgctggccacggtgcggcgcctcggcgacccccatgcgcccgcggatgactcaccagagctgatggtcgagctggtcagcgacgcgcccgatgcgctggtcctgcactggggtgtgcgcgcgcgggacgacggcgcggcctggctgccgcccccg

SEQ ID NO: 2926 - DNA, 897 bp, Chlorella protothecoides
atgtcgtgcatcccgctgtacctccgcgccctcaagtaccctggcgcgtcgtccttcccgtctgatactagagcctcaattgaagtggaggcagcacgtcccttggtcacctggctcgagaaccagaagatccggcactacaccatcccccagcggcagggtctcctggccacatctgccgatgactggcgggctgcctacggccagtatctgaccgcactggagtgtccatgctcgtcagaaggcctgccggcgaccctccagtggctctgctcgcgagcggtgtccctggagtatgcagaccgcaacgagcagctgaatgcctccacttccgcggcagtggaggttggcggcgccgtctccgactggtcggagcattccctgccaccctttgccgacacagcctcccctgcagtggcggctgcggtgatgcgcatgctgcgcacgctgcacatggaccaggaagaggtgttagcctccttgtacccaccacccctgttgataaccccacgatcagcaggtgaccccctccaccgtggagcggctgagctcggtgctggacacccaggtcctgccggccttgcctggggacgaggacaccgcagccccctccgggactggacggcagggcgtctcagccgccggcccgatcgcgctgctggccggcttcccgctcggcttttccaccggatcgccgctctccgacgcggcggctaccatcctgcgcatgctgtacctgcgcgacctgcgcggcctacaggacgtcgtggatcgggagctggagcgggtgcaggcgagcaccgtgggggccatggcggacaaggcctacggccgcccggcgcgatgacagcgcggcgacgagtcgctgggaggacaacagcggtgtggcgcgtgtag

SEQ ID NO: 2927 - DNA, 513 bp, Chlorella protothecoides
atgaacgctaccatcgaggcccacatcgccagcggcttcgtggcctacaactactttgatcggttcacgcaccccacgggtgctccacagctctttgcctacgacaggtgccgcggaggcagtggggtggcgttacttgggccgcacatcatgggccatgcagagtgcagcgaccgctcaccatgtccaaacctcaagccgcccaccccccggcgtcagccgccctgtgccccaccgttccacttccacgccgccccgcaggtgcctggaggaggggcgcccgctgcatgcctggatgggcttcatcgacgtggacgagttcctcatcttccgggggggggcagggcccatcaggaacctgggccagtacctctccaccaagcactcgcaggcagcaggtctctggccagggcgcgaggtggctcgggatgctggccggatcgcgctccagcccgtctcaccggaggggctgacctcgcgccggctcttccacctgtggcaatgcttgcttga

SEQ ID NO: 2928 - DNA, 375 bp, Chlorella protothecoides
atgccacgaggaaggtgtgtctgcagcaagactggagcttgtacagccctgccaatgtgcacgcctcagcctcgactccccatgcacacacgatctggctcccccatggcctccatgccacaggctgcagatgacctggacgtcacgagcaccgtcatcagcccctccttccgttcggcgccctggaaccaggaggccaaggccaccttggcgggtgagcccgagccatcctcccaaaccctggtcttgtttgtgagcgagagcggggtctgccgctcagccctggccgccgccgccttccaggccgcgatccaggctgtggggctggaggacagggtgcgctgccaagcggtggtgagtcacgcatgtgtttga

SEQ ID NO: 2929 - DNA, 492 bp, Chlorella protothecoides
atgcgctgcctgcctggcactcatctgaggcctctcatcctcccacaagactgcccctcccgtagtgctgtccctgcgttcgcgagagtgaatgtgcaatctggtcagcacccccgatcacctggagcccccccttcttcactggccctggcctctgctgcccccgcccatgcatgcccctcccccccctgcgcgcaggccacccagtctttcaacgtgggcgagggtccggagcgcgctgccgtcaccgcggcgcgcgccaggggcctcgagatcccgcctgacttcgctgcccgccagtttgacccgggggctgacatggcgcggtgcgacctggtgctcgtcatggacaagttcaccgcctctgacgtcctgcgggaggcgagtgggctggctgtggggtttggggggttgaccccgtgggtgtctgccgacgctgagcaaggaagggccaacaccggtgtgagcattcatcatgtgcctcaccaatga

SEQ ID NO: 2930 - DNA, 369 bp, Chlorella protothecoides
atggctgatctgaaggttcagcgtgcaatcgtcttccgcacgctgggggacacttctgtgctggaagacgtcaaagactggcctgttcctgttcctggcaagagacaaattcttgtggcggtgaaagctgcgggtgtgaacccagttgacgcgagtattcggggagggaaggatttccccaaggcgatcacgaagcttccacagatggtgcgtacgggagggacgccgtgccactccggtgttgcagtcagttcattccctcaagtggcgggaaatcctggcgatggcaccattgcatcctctccaccatatatgaggtgcatttttctcagcctgcaaagggtgtcctcgctcactaggcctcaatga

SEQ ID NO: 2931 - DNA, 603 bp, Chlorella protothecoides
atgccgtcgcaggtgtctggctgcgactttgcagggaccgtcgcggccattccagagggcacagagaccaacctcaaagtcggcgacagagtgtatggtctggctgatggttgggcgccctgggcctccgacggcagctttgcccagtacaccgtggtcaccgccgccaacgcggcacggattcctgaaaaggtgtcgtataccgatgccgctggggtccccatcgcggggctgactgcctggcaggcgctgaatgccacgggactcgatgccgggagcggcaagcgcatcttcatctctgccggggctggaggggtgggcacctttgccgtccagtttgccaagctccggggcctgcacgtcaccacctccgcctcgcctgtcaatgccgacttcctcaaggtgggtgaggggaaggtgcaaggtgggctgggggggctcagtgtcatacatgccagacacgagtccagccgttactgctatcaactaccttttcaggatcttggagcggatgaggtgtacgactaccacaagaagaacctggtggagctgtacaaggacaacccattcgatgccgtgatcgacagccgtggaggtgggtaa

SEQ ID NO: 2932 - DNA, 318 bp, Chlorella protothecoides
atgttctctacgccgttccaggccccgcgggccgtcacaggccagagggtcgccttcggtgcctcgcgcccggtgcgcgttccccatcgccatgccctgcgcaccatcccccgggcatcagtcgctgacgtagcacgatacctggcggatgccgcggcacagatcttcaacccagcggagtcggatgtcaaatgggagggcaccagctctgggtttacaggtggggcctgccccatggatggctgtgcatgggtccctggacagggatacgcctatttaccatcctcagccgcttcatcattggaaaacgcgacgtag

SEQ ID NO: 2933 - DNA, 306 bp, Chlorella protothecoides
atggcggtgtggagtgctggtcagcacatgtgcgctgcggtcccatggcacactcagctcctgccccaccattccaatgtgcacaggaaactgaccgccatcgcgcgcctgggcccctctttccaccccatcttcggcagggcgagtgggaaggatctgacagacatcgtcggcctcgtcgctgaggggaaggtgaaggtggtcatcgatcgcaccctgcccctgggtcaggcggcagccgcccacgagtatgtcggcaagggccacaccaagggcaaggttgtgctcactgtggatgaggaatag

SEQ ID NO: 2934 - DNA, 714 bp, Chlorella protothecoides
atgtgcccctccaagatcaatctcttcctgcgggtggaacggcgccggcccgacggcttccacgatctggcctcgctcttccaggtggtcagctggggcgacgacatggaattcgagccgctgggcagcagcgccggcgcggatgtcctcacctgcaacatgccggacgtgcctaccgacagcagcaacctggccatcaaggtcggacatggatggggcaatgatggggttgtggtagcaggggcactggacctgttccgccgcaagacggggagccgggagcggtaccgcgtagggctgcgcaagcgggtaccgcacggcgccgggctgggcggcggttctggcaacgccgccacggccctgtgggcggccaaccagctggcgggccgccccgccgcggacgacgacctgctggcctggtccggggagatcgggtccgacatcagcgtcttcttcggatcgggctgctcctactgcacggggcgaggggaggtggtccaggatgtgcgcccggtgcccctctccacgaacacccccctgctgctggtgaagccgccggcggggctccccaccccggccgtcttcaagcgcctggacctggagcggtgcagccgggaggacccgctgcgcctgctgcagggcctccaggggctgcgtcgcgccagcgcggccctctgcgtcaacgacctccaggcacccgccttccagctgtga

SEQ ID NO: 2935 - DNA, 756 bp, Chlorella protothecoides
atggagttccccgaccccgtcatcaaggtggccatcgagccgcggtccaaggccgacctggacaagatgggggcggggctggtgaagctggcgcaggaggacccctccttccacttctcgcgcgaccacgagagcaaccagaccgtgatcgagggcatgggcgagctgcacctggagatcatcgtggaccggctgaagcgcgagttccgtgtggagtgcgatgtgggcgcgccccaggtcaactaccgcgagggcatctcccgggcctccgacgtgcgctatgtgcacaagaagcagtcgggcgggtcagggcagtttgcagatattgctgtccgctttgagcctggggagcccgggtcgggcttcgagttcaagacggagatcaagggtggtgccatccccaaggagtacatcccaggcgtcatgaagggcctggaggagatgatgtcaagcgggtccctggccggcttccccgtggtggatgtgcgtgcagttctgtacgacggctcctaccacgacgtggattcctcggtgatggccttccagatcgcggcgcgcgccgccttccgggagggcatgcgcaaggcgggggtccagctgctggagcccatcatgaaggtggaggtggttacgcccgacgaccacatgggcgacgtgatcggcaacctgaactcgcgccgtgggctggtccaggagttcacggacaagccgggcggcatcaaggtgggccagggacgaaggggggccccaccttga

SEQ ID NO: 2936 - DNA, 201 bp, Chlorella protothecoides
atgagcggcagcggcagcactgtagtgggggtggggagcgatgccgtgccggacagcatcgccgcctggcgacaggacctgttcctggcgcccgcacgtcccgttctccgggaagaaggggcctggtatgcggcgcccgcccccgaacttctgcgagagctgggcgtgagtgcggtggcgcaacccgtggggggaatatga

SEQ ID NO: 2937 - DNA, 663 bp, Chlorella protothecoides
atgaaggacaatgggccctccctgagcatcctgcgcagcgctgtgctgccagctctgggaggctacctgttcactttctacaattccaagaaggcggacgagcgcaaggcccagatccagcgcatcaacgaccaggtccgcctgctgtacggccccctgttggcctgcgtgcacgcttcgcgcgctgcctacgcggccatggtgcgccagcactcgcccgacggcacggtgggggggttcctggcggccatgcgccgggatccaaagggtcacgagggctccgcctacaggcactggatgaaggatgtgatgcagccgctgaacgagcgcgcggccgacatcatcgtcgaccacgtgaaccttctggagtctgcagagatcgacccccgcctcctgcagctggtggcccacgtgtccgcctacaaggtcatcatctcgcgctgggaccggggcgcggtgggggagtggtccgccatatcctaccccaacaccctgctggactacgtccgcaccgagttccagcgtctcaagcggcgccaggccgagctgctgggcatcaagcgcccggccaagacggcgggcaagcacgccgcgccctcgtccgccaacggggacgaggccatcgtcgccagcaaggcctcccagacgcggtcaaagctctga

SEQ ID NO: 2938 - DNA, 606 bp, Chlorella protothecoides
atgagaaggagatcagggctggtgctgatcttcgcctgcctcggctgcttggcgctgctcgcctgtggccaggagactggaggagctgcagacagcaatcaaattggcaacaatccccctttcccccagcctgtgcacacagcctcgcttgtttccgaggcaggagcagaggctgtagctcaggcaattgtcgacgcccctaattccccggagaatggagaaggaggtggtacaggccaagctggtcaccctaccatgccccaggaggccggcccctccccaccatcttcggagcctctcccaaactttgagtcaaccccggcgccgtaccaggtccctctggaaatgcaggacatgcagcccagtcctgaggagctgacctcctccacatttctgacacacggtgaccaggtggcacccggttcggtggcactctgtctcgccgtgcgagacgcccatgaggacatcctggagtggctgctccaccacaagaggttggacatgcatcgagattggcagaggcggtcttgcctgggatgcttgggggaggtgcggcttgacacatggctgggcctgcccgaagagaagcccatgcttgctgtttga

SEQ ID NO: 2939 - DNA, 270 bp, Chlorella protothecoides
atggctgatctcacgtgtttccccccctctttctgtacacagatcatcaaggccttggtgcccctggcggagatgttcaactacgtctccaccctgcggtcaatgagcaagggccgtgcacagtacaccatgcaggtgcatgcgctcccaccgctccctcctcgcattccatcacgccagctggagaactacgaggtcgtgcccaagcacatccaggagacgatcgtggcctcctcagccaagggcgagaaggccaaggtggccgcctga

SEQ ID NO: 2940 - DNA, 1722 bp, Chlorella protothecoides
atggaccgcatcggtgatggccaagggcttggcaccgagatagcccgctgggatcaggctgctggccgatgcgagggggagcaggtgcaccttggcgccccggccggaggcgtgctccccttgcagccggacacacagggggcacagccacagatcgccaggcgcagcggggcacaggtcgaggcattcgctgcaacaggcagccggacaggcggagcatctcaggtcggggtcctgggagcgaggggtgccaaggaccaagatgtgtcgagtcgggtccaataccaatgtgttcttgggcaagtgccctgcaagaacatggaagatgcctcgtttgcttcccatcagaaagcaagaggaagccccctattctacctgccgtccagagaagaggcaggtgcggtcgtggggaccctcggtctcctgctctggggcctgggcgccgctcaaccgcccagcctggagcatcgcctcctgcagagtctgcccgctcaccgtgtggatgtgctgtgcaggcctgcggtacctcgaccctacatgtccagtgggtgggtaagaggcggtccgaacacagagtcaccttctgcacgtacatgtgatcgcgcatcgagtctgctcggaccctccccaccaacctgcttgcgcctcaaacgccgtgtaggtaaggaggtcagagcagcctgccacctctatacccccatgccgcgccagccccaccagcatcagttcgccttggttgctctgcaagtcagcacaagaaggcgctggggggtaccacatccgacacaggtccggactggtgggcactgcaccatgcacagcttaagatggggtctgggcactgacagacaggcgacggtcgtacccgatatcggaggagctcgccgtccgatacaaggcccgcatccagcagaccatctatcagtgcgattttctttcgctccattgaaaggtgcaggatctcggcggatcctgccacaatttgaccgggaaccccatgcccgttcatttcctaatggaccaatgtcagctcaagtccccatgacacccctaacgccttcctacgcccctcatcgctcaccctgcaacttgtgctccatgtctgcaccagcactttattcatccgccaggacacatgctgcgcaggtgagtgttgggctgaggtgccatgcgcgttcgtacctgttgccccacccccaatgcctctctacatgccccgcctcctcgcacgccgcagctggctgggcagacatggttttcgggacccttcattcccccaatgaacgagcggcgacatcgactacccggtcgagggaaggtctgcgtcgtccgggctcaccatgggagcggggattggaggggagctggggggaaggtagttgctggaatggccctggctgccgccatttccctgagcccctggcagcagacatggtgaagaccgggacctgtctcctgcaaaagtgtcagccggagctggcgaggtgcttgatagatggggagtgcgtggagaacctcgtctgcctccaggtctgcaatgggaaggacgatgagagcgggtgccaagtaaaatgtgccgatcggtacaagaatgacattatcgacaagttcaacgcctgcgccattacctctgggggctgtgtgccacagaaaattgagaagggtaggctgggatgggttatgtttgctggactacagagtccctcccagctggagatgtag

SEQ ID NO: 2941 - DNA, 723 bp, Chlorella protothecoides
atgcagaggtttgtgcaggacccagggaaccctggtgtcctgtacaatcacgataatgagtacctgcactatggtacgaccacggtcccagcagctgggggcatggagggcatgcatgggattgcatgctggcagcttggtaggcgatgcgacgggcccttcaccagccccgcagtgattgcggagatggatgcttgctttctcacgcatcgtttccttcccatgcctgttgttgcagaggacgactggtatgttgtcggctgggagcctgattcatatgccttcattgtgtacaagggacagaacgatgcctggaaagggtatggcggagccactgtgtacaccaggttcgtaaatgtgcggtccaggggagagtgcacaggccagacactctggggctgccttgcaacatgcggcacaggttgccgtagctgctgccatgccgggtgtgtaattgcagcaggtccacctgccctccaacagttcccacacctcacccctgtgccattgcaccggcagtcactcaccccccgtatgctggcccatctacagggactcctcattcccacccgagctcacaaacaagatgcgagagctggcgagccaagccggactgaaatgggaggagttcaagttgacagacaactcgtgtggaccccacccaccccagcgaggtggtatgacagacttcgagcgggaggtgagtggagtgggattcggtaa

SEQ ID NO: 2942 - DNA, 744 bp, Chlorella protothecoides
atgccggaggcagaagtagcgcagggaggggcggatgccccccccgcccagccgatccgcccaccctccccccagctcgctgccacacccatcccaagcccctcgcccaccgacctcccacacccaggctcggactgggtcccgcccccggccctgttctacgtcgggactgctttcctgggcgcctcttacaccttgagcatgacctgcatggagaccttcctgtccaagaaggtcacccagtttgcggacgtggtggggaacaatatcggcaagtacctcagcctcttctacatggccatcagcgccgggcgctttgccgggccgctgatcgtcgggtccctcacccgcatctccacgcccaacggtgagtctggctgggaaggagggaggtggtacccgttgagcgcggccatggcgggtgcctgcatgactgcagggaggcttgtgctgggtgaagggtggacccttggaccccgtgcagaggaggggtggctggatgaccccggctgcgagctgggctcgcttcagctcgccggccctgcgcgtgttgacagtgcttgccgagaagatatgtgcagcccccggcacctccaccgctccatgcctcctttgttgacccggcgccctctcacaggggacacatttgtctgcaccacgggctggatctacgagcccacgggcgacgtcctctgcacaggacccgccgaccagcagtgcggggtgaccgccagcgactactag

SEQ ID NO: 2943 - DNA, 1551 bp, Chlorella protothecoides
atgattgcatgcggggctctcagctcccatgcattcacgacaagaccactgaggcatggggccgacctggcgcgggctgggctcgtgaggggcgccccatcggctcggtgtgtacggcctcatggagcacatgacaggcacccacctcggtccagccttcagtcgtccagctcgcgcgatcgtaccggatccaaggccttaaaaacactgcaaatctcagcccagggcacggaggcggacggggccaggccccgccgtcatgccgcctccatcgtgatgctccttggcatgcttgctctcagctcctggcaccccgtgacagcactggcttctcctctggacttgatcgcttcctcgcccgccggcccggggcccctcataccaggtactgcatgtgcttgccaggctgctgccatggtggccctccaggaggccaccatttctgtgatactgcgggaaggaactgaatgtctgtccagccactgcatgcccgccttggctgctggccatggtacttctgtggagcacctgcaagatgtgcccgtgtttgctgtgcatgctggtccgcgaccccaaggagtctcctccctcccccgaactggttgcccctcattccccaaactcaaaccctcgaaccccgtctccccccctccacctgacccaggcttcctgggggacagcacgctgcgcgagggggccgtctccgccttcttcctcatcttcctctccgagctgggcgacaagaccttcttcctggccctgctcctggccctgcagctcccccggggcctggtgtttgccggcacctggggcgccctggccatcatgaccctgctctccgtgggcctgggccgggccctgcacgtcgcgcaggtggtggtgcccagcctgcccggcggcatcccgctggacgacgggctggcggtggtgctgctggccgcctttggcgtgcaggcgctgctcagcgtgccggatgccgacgaggcggtggaggacgagcgggcgggggcggagggcctggtgggagggctgctggccaagagcggcaacggcataggtggggttttttggggggggttatggggtgcctggttgaaggggaaggaggggataggtgggtgggaccctgttggttgcccctgtttgaagggaggggggggggagagtgagtggatgttggtgctcacaggcagaagacaccccgtgtgtatcgtggatggggttctgatacagaggcggcccgctcagagagtctcgccgcgctacactgagggcccaccaacccctcatcgcctcccccgcccctggtccctgttcccaactcacagggggctcgctgggcctggtggcgtcctgcttcgcgctggtatttgccgcagagtggggcgacaagtccttcctggccaccatcgccctttcggcggcctccgatcccctgggtgtgaggggtgttgggagaggcgggcaggcggtccctctgcaacactggtgggcgagagtgtgccgtccctaaacgctctgccaggttctgatgcgctgcatcatagggag

SEQ ID NO: 2944 - DNA, 1386 bp, Chlorella protothecoides
atgctcattcgcatgaccgatggatgcaagaatgcatggtgtcgcaaggtcagaccgcctgggggcaattgtcacactgaccccggcatcatggagaaagttaacaatttcggcaccagcaccaaatgtggcgatcgccggaaatgtgctcgcagagttgcgtcggcaggggtggttcccagcagtctggcaatggccgagagcatagggtgcgcgaagaagagggctaggccgtgtacgccagaccaagactctcagttgacgaaatgtgtcaccggtactggagtcatgaggcatgccacacctacatcgggctgcacgacgccacacagcgagcatggccccatggctcatgccgacggtcttgtcagtcccatcgtatttctcaccccaccctgcccggtaaagtactggcatggggggttgtggcagccgttatgcttgcatgcccgtgctggtcatccgtgcatcaaaatcgttcctatttccatccctatgcgcagtcactcgaatgtcatgaggtcgcaaaggtgtcgagaggtcccttgccccaggtgggcagccatgaacctgtgtccagggcagacaattccgtctggagatctcctctgcgacctcagcaggacacacgtggaccatccaggactatgtcctggaggtgaaaacctcgctgggcgaaggaggtctcgggacagtctacagggccgagcattccagcgggcacattgtggcaatgaagataggcaacgcaatggaggttggggacttcacatggtgagtgatgtggaggcctggatcttggtgggagagcctggctgcgatcgtgtcgacttcatgcaggggcagacattcctgacggagtggaacgtgtacgtcgccctcacacacaagcagcactgcaagtggatcccacgtgctttccagtttggtcttcactctgccccgactgggactgctccctggatgaccatggagctgctggggccgtcgctccacgacctgcgccgccgccgggtgatcgctgcaccacaagtcaaagccctgggaagtcatgccctggatgctctgcagtggctgcatggccgtggatacctccacagagatgtgaaaccagaggtcagtagtctggtgtgtgagaaagggtggtacggatccggtgcggtcaggattgatgtctggaacctggtgatgcctcatggctgggtcccggacctggagcctgctgttcgcctgatagacctcggcatggcacagcagtggcaggcaggacaggacccacctcgcccaacctttgcaggttcaccagagtactccttgccagggaatactatcaaggaacgggttggtgtttgctcagaagcgaccctttgcatcctttggcaatga

SEQ ID NO: 2945 - DNA, 204 bp, Chlorella protothecoides
atgcctgccctccctgcaccacaggatgtcgcggaagagagggagaccctcagcgctcctccatccgtgccgtcggacggcctcacgtcagctccgggccagcgtagccctgtgacgccctacttcttctggcccaaggaggaggcctgggacctgatgaaggagacgctggagggcgagagtagctggattccagaggagtga

SEQ ID NO: 2946 - DNA, 456 bp, Chlorella protothecoides
atgatgttcatcggcgactccatcactcgccacctggcggccgcgctcctgcgagccgtgggcagcacaggcctgggaggtgccctgctcctcgtgaccctccaaccccctggcaagtcctccacggcagatgaggtggtggtgggccatgccgacttcgacctcacccttcccggccgcgacgcacgcctctccttcctctggcgcccctacccctggaacgtgaccgaggccctgctggaggaggtgcccgccctgcccagaccccccagcgtggtgatcgcctccttctgcctctggcacgccctccacgtccgggacgcagacgccttcgcggaggacgccgcggagctcagcgccgctgccgccaaggtcggtgagggctggggctgggtggtgtggtctggcaaggggagcaggaaatcgcaaagggccagcctgcatctctccccttga

SEQ ID NO: 2947 - DNA, 873 bp, Chlorella protothecoides
atgcgcgcctccgacccctacttcaacaagctggtccgcatcatggcgacgcgctgcatgacgcaggccgtatacttcaactcgggcgagctgtcggtgccggagtaccaccactacggcctggctgcaccgctctacacccacttcacctcccccatccgacggtacgccgacgtggtggtgcaccgggtgctgatggccgcgctgggcctggcccccttgccggggtccatgcgggaccggccccgcgtggccgacaccgtggacaacctgaacgtgcggcacaagaatgcgcagctggcggggcgggccagcgtggaactgcacaccctcatcttcttcagggggcggactgtggtggcggacgcgcgcgtcacgcggggcatctcagtggagccatggtccctggggggcggaggctggcgtgctgggtttgtgagtggccaggccgtctatgtgggctgcgcttccagtgcccagccccccaagtaccttccaacagtgtcccaaccctcactcacccataatccaaccctccccatatcccaggtccgcgccaacgggctgctcgtgttcgtgcccaagtacggcatcgagggccccgtccatctggacgacgccgaccgagctggaaaggagggcgtcagcagcagcgccccggccgccgtcgactcagcgccaggcgccgtaccccggtttgtgtatgatgaggagaagcagaccgtgtcgcgggaggacggcggggtggcctacaccatcttcgacacctgcgccgtcaccatcagcgtggaggagaccgccggcaaccgccgggtactggcgctcaggttgacagaccgagcgcagctgcccgatggcgagcgcatgggctga

SEQ ID NO: 2948 - DNA, 1002 bp, Chlorella protothecoides
atggtccccggcggctatgacgccgccttccgagtgctggccgctggcctgccggtgcgcctgggctgcgccgtggacgcagtggctgacgcggcggacggggcgcgcgtgtctgtgcgcgtggcaggcgcccaggaggaaagactggaggccgacgcggtgatcgtgactgtgccgctgggcgtgctcaaggccggcgccatcgccttcagccccgcgctggcggcctggaagacggcggccatccagcggctgggcttcggctgcctcaacaagggccatgtcaagggtgctgtgttaggctcggtaccagaaagcactgtgcacgccagtaccagaccatttccccaccaccaccacccgcaggtggtcctccagttcccccgcatcttctgggacaacggcctggactattttggcggtgtggcgccggcgggggagcagcgccgcggccgctgcttcatgttctggaatctggcgcggcacaacggcggcgtgcccctcctctcctgcctggtctctggcgcggcggcgcgccgcctggaggccggcagcgacgaggaggcggtggccgtctcgctgcgcgcgctgcgccgcctattccccggcgaagggacggtgcccgacccggaggcgagcgtcgtcacgcgctggtccgccgacccacacgcccgtggcagctactcctacgtggccgttggggccagcggcaaggactacgacgccctggccgcgccgggatcgtgcaggtctccggggtcactccggggcccgcatacccactcttggcttggccctgcgaaccttggagtcggccgcccgcgggcctcctcgacaacctcccccccctcatcccaacaggtgcggcgccgcatcctgtttgccggggagcacactgcacgtgcccaccccgacacagtgggcggtgccatgctctcgggcctgcgggaggctgtgcgggcgctggcgctgttggacggcagcgagggcctggaggtgtga

SEQ ID NO: 2949 - DNA, 288 bp, Chlorella protothecoides
atgctgcccaagcccctgacggaggacatctgctccctgcgcagcggcgtggaccgcctcgccttctcggccatctgggaggtgactccagacgcacagggtatcctcggcaacaccccttctccctcaacctcacatcattcgctgcaatcctcccctccccctctccagatcctgagcacgcgcttcaccaagagcatcataaggtcgagggaggcgctgacctacgccgaggcccaggcccgcatcgacgacgagcggctgacggacgacgtgtcggtgagttga

SEQ ID NO: 2950 - DNA, 525 bp, Chlorella protothecoides
atggacgacgcggcggccgcgctggcagacatgccggaggcggccagcgcggggctgagctatggcgccctgctggagcgcgcgctgcgtcagcgtgaggcggaggggacgctgtttggcagcgacgacgaggaggaggaggatgcgacggggggtgccaagagtgtaggtggcgacgccagggaggcaggcgccagggatgtgccagaggccgagggcggcgcacctggaccttcaggagcaaccagacaccctgccgaggtcgacgccgaggccgcggtgcggacctgcatgcaggccatgctgcgggctgtggaaggggcggaggacggcgctgagcctggaagccagacccccaggcggcgggtcgggccccggcacaccctcctgcccgaggagcggcggctgctcgagtggcactgggccaacctggagtacggctgctccgcctccctgtcagaggtgatcgacaatggaggcagcagaggggagggcgaggaaggcatgtggaagagtccagcgtga

SEQ ID NO: 2951 - DNA, 525 bp, Chlorella protothecoides
atggcatccgaccaggggtgcaggcttgtcctcaagagaacgttgcacacattgcactgccctgccaatccacaggtgggcgattatctagaacgcggtggccccccgcccgagttcttggccaagcaggccgccctctccgccgcagccgcgggccaggcggcggaagcggcatccaagaagaaggtgatcgtcattggagcggggccggcggggctcactgctgcgtcccatctccagaggcacggcgtggaggtggtggtgctggaggcccgggaccgggtggggggcagggtgcactccttccagggtcacggcctgcgcgcccccgtggacctgggcgcctccatcgtgactggcacggcgccggacgtgaagtcgggcctgcgacccgacccctccaccctgctcctccgccagctgggccgggacctgcacaccttgtcccgagacctgcccctccacgacgggcccgaccccgtggatgcgcagctggacgcgcgcattgagcggtgggtgctctga

SEQ ID NO: 2952 - DNA, 735 bp, Chlorella protothecoides
atgcggtcccaaaagtcgaaataccactgggacaagcgcagcaaaaagtacgtcaagctccaggcagacgagacggtcaaggcggggcgccgcatcccagggtcaaaggtgagattctgtgttgggtggatgtcgtttggaagacatggtactcaagggttggctgctgtactgtctgaatttctgtcgagatactggcaaagacatggtgctttcaagggcagcctactctccgcccggcatcaggagcatcagccagcatcccaagtgcctgcaccccatgcgcagagtggtggcaagggcaagaaggaggagggttctgggctgtacaagaagtgggcggcaaagaacaagatgcaggtggctgggcctaaggaggcagctggagcggcagccctggccaagcagatgggtgaaagagtctgtgccctgcggtgctgtggagagggtgccttgccgacaccccacggaccaggccgccagccttcgacccgctgtgcaccggccatgcctcggaggcatcgggcgcattgtaacccctcgcgcgcaccgggaacccacgctcgaacacccattgaccacccctccaggttcaagcgcggcgggcgcggctgggtgaaccccctgaagcccgaggccggcggcgacgatccccgggcgcgcgacgagatcaagaacccggagcaggtccgcaagcagcgcaaactagacgagcgcatgcgggagcggcagcag

SEQ ID NO: 2953 - DNA, 1311 bp, Chlorella protothecoides
  modified_base (67)..(76): a, c, t, g, unknown or other
  modified_base (902)..(911): a, c, t, g, unknown or other
  modified_base (1081)..(1090): a, c, t, g, unknown or other
atgatgcgctgtgtgcaaacttgtggccagtgccccagacatgcaccagcccactttggcccccctnnnnnnnnnnatgatgtgctgtgtgcaaacttgtggccagcgccccagacatgcgccagcccactttggcccccccgacctgtgccccaggctggcacagaaattggtcgtcagcaaggtccgggccggccttggagtgagcaggggcatcgtctccggtggagggtccttggctgcccacctggacgacttttacgaggtgcggcaacttgctggtgccacggcggcctgaggggcctggccatcggcatcccggtgctgaatgggtggggcctgaccgagacgtccccagtcctggcctgtcgctccatgacaaccggccccaacatccgcgggtcggtggggaggccgctgcccgggacgcgggtgcgggtggtggacccggggacaagggaggaggtgcccgacggcacgcagggcctcctgctggccagcggacccggcctcatgtcaggctactggaacgatgccctcggcaccgcggcagttgtgctcgagtcccagggccagaggctggaaggtgccggaggctgggggcgcagcagcgggggctctggtcctcaccgtgcctggacctcggcggttcggtgctcccactactgctgggagctgcatccctcaggccgccaggtaggctgcctgagccgtgatgccactcccctcttccacaggacgtgccaaggacacgatcgtgctgtccaatggcgagaacgtgcagccccagtccctggaggacgccatctgtacctcgccctacataacctttgctgtgctgctccccgctcaacctgcttcccaatgtctggaatgactccacaccttgcccccctgttcgnnnnnnnnnnctgtgctggtgagcaatgggcgctggatggtgttgtgggtgacggccatcgtgccttgggcgcgctgctggtccccaaccgcgagacgctgggggaggtgcctggggcgattgatgattcaggtgagggtgcgcggaggctgtggccaggactccaccccccctctccannnnnnnnnntttgccagcccagggccatcaaggagcacaggtggacccaagcacccacatttgcgatttggccaactccctctaccctgtccctgccccaggaccccgccccccctctccctgagctcgtggctcctggcgtggtggccgggatgctggcactgcaggctggccctctcgttgagtggagggagttttgccagcccagggccatcaaggagcacatgtga

SEQ ID NO: 2954 - DNA, 1317 bp, Chlorella protothecoides
  modified_base (888)..(897): a, c, t, g, unknown or other
atgtatactaccatggggcccgccatggacagccttcctgggatgtcccgtgtgcttcccttgggcacaggccacacctcgcaattgaagccatggcggacgaggcctttcatgactcattcaaaaggaacacgaaacggacgtgtacatcgtatcaagaggaaggtggccgaggtacagtactcccccgccccacagcccctggagaggaccacctcttcgagaaagccgtcgctgcgtgtgaccgaggcagcttccctgcctgacctgtggcagcaactctctgaagtccatggcgatgctgtagcatttgttgacccccaccagcagcctgtcagctccatcacgttcaggcaaggcgcccatggagttgagcaatggcgtgcccggttaaaccctgagtcaatctaccaggacatccaaatggtcagtgtatgcctgattatgactgtctcacctgtccaagccccagcccaacaatttatgtgccacaacagggagttctctgagacaatcgatcgctttgcagccggcttgcagagcctaggattggagaagggggagcgggtggccttgttctcagagggcagctcacggtggatggtggctgaccagggcatcataaaatggtgtgcatctggtgtccatgtaaacagtcttcaggcaccccgcgactttggccgagcctgcagcatagcatgcctacttgcgtgctatgaccacatgtacctccacagcatgctcgatggcttcttcataggtgcgtggtactgcaaacccggtcgaggagctggagcagatagtgctcagctcgcaggcgtcaggattagtcatccaggatgcatcgagcctggccgcgctcctgccccgactgtgcgaggtgagatnnnnnnnnnngcaggcgtcaggattagtcatccaggatgcgtcgagccttgccgcgctcctgccccgcctgtgcgaggtgagacgagggtcccgaatgggagactgggttggaagcctctcaccgtgaccgctctgcagggtgtgccccagcgtcagctcaagtttgtggtgcagctgtggggggatgtggcagaggaggcacgtgcagcgcttccctgctcggtgttgtcctatgccgagctgctggctcggggggcggagacctccctgcagcgagtggatttgacagaggatgacctggcaacgctggtgtacacatctggcaccacgggcaacccaagggtgagtgcgcctgtgtgggggacagtggggcgaaggatgggcatggaggcgcctagtgcagcctgggggacgggcctgcaggtgtga

SEQ ID NO: 2955 - DNA, 3276 bp, Chlorella protothecoides
  modified_base (487)..(496): a, c, t, g, unknown or other
  modified_base (708)..(822): a, c, t, g, unknown or other
  modified_base (889)..(898): a, c, t, g, unknown or other
  modified_base (1183)..(1192): a, c, t, g, unknown or other
  modified_base (2017)..(2026): a, c, t, g, unknown or other
  modified_base (2296)..(2305): a, c, t, g, unknown or other
  modified_base (2492)..(2501): a, c, t, g, unknown or other
  modified_base (2632)..(2641): a, c, t, g, unknown or other
  modified_base (2901)..(2910): a, c, t, g, unknown or other
  modified_base (3233)..(3242): a, c, t, g, unknown or other
atgggacattgcaatatgaagcaagtgcactccctgagatacacctcgagtgcctgtcaaaaagggccggggccggatcaacctttgaaggccggcgcacagtgccgtcactggggccatgtcaccggcgaggtccaggagcgcgtctccccgggagcgcagcttgagcaggagtcccagccgcgacctcatctccgaccattcccgcagccccagccgtacgtgtgccgcctgtatgaccctcgatgccgcttatttgtctgctgccccgccccggccctccctgccgcgaccgcccggccatgcgcccgcccgcgaagcgtgatcttcttcccaccctccacgcccgcagccgcgcctcgggctgcctcccgcagtccccgccgggactcccggtccccaagccgcaagaacacccgcagccctgctcgcagcaacgactcgggcagccccgcaccccggagggggtcgcgcagtccggcccgtnnnnnnnnnnacccgcagccctgctcgcagcaacgactcgcgcagccccgcacccaggagggggtcgcgcagtcccgcccgccgcggccgttctcgcagcagatcgcctgctgcggcttctcgcccaggatcatggaaggtgagggtcacagcaagccggatgctgcagggccatgctgccggggcgtgccaggcctctgtgtgaggagagcagccgctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatgtcagacatggctggtgagtttggggtggcgatgcagtgggtgggggaaagaggttgggggnnnnnnnnnntcatggaaggtgagggtcacagcaagccgggtgctgcaggaccatgctgccagggcgtgccaggcctctgtgtgggaagagcagccgctaaaccatgcctcggtgcttgcgatgttcaggcgaagctggaggagctcttcgacaagggcaccctcaagagctcagacttggacgacgccctgatgtcagacatggctgtcggtgctccagggcatgctctgaggagctccaaaccgggccacgcaccgctcacctcccctgccccgtctgccctccctgttgctnnnnnnnnnnggggtggcagtcggtgctccagggcatgctttgaggagctccaaaccaggccatgcaccgctcacctcccctgccccgcctgccctccctgttgctgggaccctctgtcttcccctgatgctccaccaacccacccctcacctccatgcagctcttggggaggagggcgccctctgcgtcgtccagcgcctgtccgagtcggacttttcgcgcgtccactccatcggcggctttgtcagtggcatcatccgccgcgtgcggcaggacggccccgaccgcgggaacggccagatcgacatcctgccgcgctccgtgaggcgccgggtagaggacctgatcgcccaggtgtggtgggtgggatgaagcggcaggcaggggagtggggagactcacttcatggggccggcccaccccgaaaagaggagaatgtgcgctctggaaaccctggagtcggtgctctgtcccatgcagactgctattcggcggccctcggtgctgcacccacatcagccccttctcgcctgggcccctccccatgcacggcggccgactcgcgcccacccatgtccctcgatgcgcaggacaagattgggaagcacgaggtggatgcccgtatggtccgggccctggccgacctgccagagcggctgggcgaggaggcctgcacgcgcttcgatcagagcgtggactcgggggtccgctcccgccagggcttcatggtgggttttgagggtggcatctgtaggggtaaatggatgaggcgactgcccggccccgcagctcagagtgggccaggaccggttgcagttgacggtcttgcgcacnnnnnnnnnngtccgctcccgccagggcttcatgagagggcgtggagcaggccgtcgaacatgccaccaagcacgcacatgcaccccttgacccgtgcagatgggcatcatcaagcgtctggtggaggaggaccgcttcggaaggcccccgccagcgggctaccgaaggagcgggtgggtggggtggagcgggatgctggatggacagtcatcagcacacctgtgccagacctgtttggagagctggcaaggttcctgtcgcgctgctggcttgctcagnnnnnnnnnngagcgggatgctggatggacagtcatcagcgcacctgtgccagacctgtctggagggctggcaaggttcctatcgcgctgctggcttgctcaactcctttctgggggaccttttgcatccttgggccagctatggcggcggcggtggctatggcggcggcggcggtggctacggcagcggtggccannnnnnnnnncggcactggtggcgggtacggcgggtacggcggcggtggcggctatggtggtgggtcggggggctacgaccgcgggtatgagcgtcccagatacgatgaccggccacgctacgaggagcgcccacgctatnnnnnnnnnntggcggtggcggatatggcggtggcggatatggcggtggcggcgggtatggtggcggcactggtggcgggtacggcgggtacggtggcggcggcggctatggtggtgggtcggggggctatgaccgcgggtatgagcgccccagatacgacgaccggccacgctacgaggagcgtccccgatacgaggagcgcccacgctatgacgaccgcccccgctacgacgaccggccacgctacgacgatcgggaccgctatgacnnnnnnnnnnccctggagagggagcttgcgatgggagggacgggtgccgtcctgggtatttgcctctgccgctctggccaaagccagccctgttgatctgattcttgtgtgcaccctcccggtaagaagtcggactgcaacaggggagtacaggggctgcagagggcctgaatcggagcctgctgcacggcgggtcaggaggaccttatcctcgagcatgacgtggcaccaggccggggatgccgagtttacgaacaattgggcgagtgccaccggaagcctcctgcgcagcaaaaccagaacttcgaggcaaaactcacctgctctgaccgnnnnnnnnnngtgccaccggaagcctcctgcgcagcaaaattag

SEQ ID NO: 2956 - DNA, 909 bp, Chlorella protothecoides
  modified_base (513)..(522): a, c, t, g, unknown or other
atgacacatccacccaaccacccgacctgcactgcatccccacgtgcaggtgacggggatcgacgtgccccactcgtttccagaggactacttccccgtctttggcatggacctgcgcacctgcctggagtactaccacgccacctacccggcggagtctccgtggacgattggtacccggccctcagcgtggccaaggaggacctttttaactccctcaccgccggcggcatcgccgccttccccgggatcaaggagctgatcgccgccgcgcggggggcgggcttgggcgtggccatcgcctcgtcgggcagcccgggcaagatcgcgcggaatctccagtcctccggcctggccggcctggtgccggaggagctggtgagcggcgcggctgtggcagggagagggagaggggacgtgtgcttgcccgctgagagcctgtgtcgggcatcatcgcgccgcagcaccccgttgctctgccagccgcatgccgcctccccaccccgggggggnnnnnnnnnngccggcctggtgccggaggagctggtgagcaacgtggctgtggcagggagagggagaggggatgtgtgctcgcccgctgagagcctgtgtcgggcatcatcgcgccgtagcaccccgttgctgtgccagccgcatgccggctccaccccccggccccacccctcctcgagcatcgcacctccacgatgctggtcaccaaaccatacgcaacttgcagacggtgagcgcggcctacgtggcgaggggcaagccggccccagacgtctacctggaggcgctgcgtcgcctgggctgcgccgacgccagccgggccctggtgatcgaggacgcagtgaacgggtgccgggcggccaaggctgcaggctgctttgtcgtgggggtgactaa

SEQ ID NO: 2957 - DNA, 2142 bp, Chlorella protothecoides
  modified_base (83)..(92): a, c, t, g, unknown or other
  modified_base (941)..(950): a, c, t, g, unknown or other
  modified_base (1854)..(1863): a, c, t, g, unknown or other
atgccccgtctgctccccctcgaggaccttaaggcgaccacgatggctgccgtcactcccgttcagatcaccccaggtgcgtnnnnnnnnnntcgattctggatgccccgtctgctccccctagaggaccttgaggcgaccacgatggctgccgtcgctcccgttcagatcaccccaggtgcgcgggggatcacgggtgtgggtgggaggcgctggcagcatcaaggacatcgatgccctgggcatctcccatgtggtggtgagtctggcgaggtggtaagcagggtggctggagccatcgcagctggagtgccgctgcctgtggctggacttggaggattcccccacagcaaatctgttggtcctcctccccgacgccaccgccttcatccagggggcggtgcaggggggcgggagtgtgctcgtgcgctgcgcccaaggcgtctctcgcagtgccgcggtgcgacgcgtggaatggcgaagggggtggtgacctctgcgcctgcctctttgtgttgtccaggcgggttgcataggggtatcagggaggccccacccgctgctgcgctgcacgggaatcgcggtggcccacctgatggccagcgccggcctggacgacgcggcggcgctggaggccgtgcgacacgcgcacccggccgcgcagcccaaccccggcttcctggagcagctggcgctgttcggcctcatgggctgccggctcgactccggcaacgcggggttcagggagttccgggcctaccaggccgcgctggccttcgccgagaccggggcgctggactgcgcgggcctggccgacgtcgattcgggcgcctcgtcctctaccaaggaggcgctgcaccgctgccggcggtgccgcgcggcgctggcccgcggcggcaactgcctggaggtcgaggcggggcccgggccggcggcgttcnnnnnnnnnngtgccgcgcggcgctggcccgcggcggcaattgcctggaggtcgagacgggccccgggccggcggcgtttgcgtggcgcaaacgcgacaaactgggcgcgggcggcggcgctacggccgagccctcgctctgggtggagccgctggcgtggatggagcctgcgctgcgggacggcgcgacgcagggcaagctgtactgcccgcgctgtggcagccgcttgggcacctacaactgggcagggatgcagagcgcctcggggcggtgggtggtccccgctttccagctgcaccgctccagggtcgacactgaggcgcccctggccggggagcggacggcgcccatcgcccgcgccgtcccgcgcctgctggcccggaggcagcctgtggtgggcggggccagacaagaagggaacgaggccgctgatgccggcggaggtgctggggtgaacacaggcgacggcgggggtgccggccctggcgctgccacggatgcggttcctggcccggcgcaggcatcgactggtgccagcggcgatggtgagagcaccggcgcggccgacacggccgctgcgctggaaggcgggctggggaccggggtcaggcccacaccagccggcggggcgacggcggcaatcggcccgcccgcatctctgccgtcctttcctgccttcacgcacctgatcctggactgcgacggggtcatggtggactcggagcggcccagctgcgagtccctccggctggcggtaaagcaggtacccagacaggggggaatcgggggctgcggtcatgccgcttcactcctcgccacgctccctgcccgcacgcctgcgccgatcggggctggctgctggcctgggcgcagcgtcgcagattggtttcgggcacccgccccgcagcaggcnnnnnnnnnngcccagctgcgagtccctccggctggcggtgaagcaggtacccaaacaggggggaatcgggggctgctgtcatgccgcttcactcctcgccatgcaccctgcccgcacgccagcgccgatcggggctggctgctggcctggccgcagcgtcgcagattggtttcaggcacccgccccgcagcaggaagggaagccgtgcctgagcagtgcaagactgatctcatcgacgactcatccacccagccacccgacctgcgctgcatccccacgtgcaggtga

SEQ ID NO: 2958 - DNA, 282 bp, Chlorella protothecoides
atgcgtcgcctcctgtcccatgcccagcgtcgccaactggctcaagtcaaggcagagcgccagggtctgctgggcgccctgatcagtctgaagaatgaagttgggaagtcgggaggtgagctgcagcagcaagacattgcagccttgcttcgggaggtggctgcaaagaaggaaagactcaatgacctgcgtgaggaggttcgcgtgctgcagacgaggcaaggaggtccaggggtcggacagttcacgggaccgcaactcatgcagcctggccggctgtga

SEQ ID NO: 2959 - DNA, 363 bp, Chlorella protothecoides
atgctcatgatccctgggccgagcgagaccgaggatgccgccaccgccacgctggcggcgctggaggccacccagtcggagatcacgtccctccaagcggctcggaccgcagcggcagcggcagaggccaaggccaggcgcgaccaggcccaggcctctgcggcgctgctggaggccactcgcctgcaggaggcggcaagccaggacgaagccaccctggtgcaggcagtgcacgacaccagcattgctcgggaagctgccgagcaggcactgcacaaggcggccaccatgtccgagcaagtcctgacggactggcacaagaaggtcaaggaacgggcaaaagaggtgggtgctctggggtga

SEQ ID NO: 2960 - DNA, 1662 bp, Chlorella protothecoides
  modified_base (1099)..(1108): a, c, t, g, unknown or other
atgcggcagggtcgcctgtttttccgtctgtgcccagcgtcagtgtcggagttttgcaagcgctgcactcaaggtatcactgcaaggctgtgccagggaccactccgcacctgctcctcctcagcatccaatcccgcttccgtacctttcctcccagggtctggccgcgccaagaaaggggggtcgggcgggaagtacacctggggcggcctgctggaggacgaggagagcggcgccacggatgcggtgacagaccgccgcgaccccaactacgactccggggaggacggcgacgacgccagtcagcacgtgttctggcgcgacgccgcccgctccgaggtcgcggccttcaaggcgggcgtgaccgccgccctggccgagttttacggcacaggagacctgactgaggtggcggcctgcctgcgcgacctgggcagcccccagtacggctactgggtggtcaagcgggcggtggtgggggcgctggaccgccacgaccgtgagcgggagatgaccagcgtcctcctggcagccctgcatggcgaggcgagtggggacattctcccaaagtggcgccctcctgtcacccagctgctcacgtcctcggacctgcgcaagggcttccaagccgtggcggccgagctggaggacctagaactggacgtcccgggcgcggcagacgccgtcgcgctcttcgtctgccgtgcggttgtggacgacgcgctggcccctgccttcctttcctccctggacacggtggggccggcgggggaggccctggcgcgcaagtgccgggcccacctcgctgccaagcacgccgcggagcgcctggcgcgctgctggggcggcacagccgggttcgacctggaggagagccgggcctccatcaagagcatgctggaggtgggctctgtttttttggaggggaagagggcggggattgtacgctggggaaccaggagcgttgggtgggccttgtgggagtctggtgcgatgggcttgattgaagccgctgcactggaccacggtacagcgactcggcacgcaaaacttcaccgtgctgtctcacgccgcgctttcctccccgcgcaggagtacnnnnnnnnnncctccatcaagagcatgctggaggtgggctgttttgggggggagggaaagagggcggggatagtacgctggggaaccaggagcgttggcgactcggcgcgcaaacttcaccatgctgtctcacgccgcgctttcctccccacgcaggagtatgcctcgggtcgcgacgtggaggaggtgaggcgccgactccacgacctggccgtgcccttcttccaccacgagctcgtgaagcaggcgcgtggagttgggggcactggacgggtcgaagagggtttggagaatgtgcggcgacgtggccgtgcgacgctgatgagtacctcgtcgcagcgcggcgtgacagtgcctgctcccagcgccgagcacgggcctgcttacccctctcatgcaggccatcgtcaaggggctggagacgggggacgtggcgccgtacgtcgccctgctttccagcctggcgggcgagtgcgtgctgtccaccagccaagtcggaaaggtgaggtggggccgaatttcagtgcaagactgggggcgggccacggcttcaggtgccgatga

SEQ ID NO: 2961 - DNA, 927 bp, Chlorella protothecoides
cgacgacgcggcgcgcgcgctggccgccgcccgcccccccctccgcgacctggacctgacgtacacacgcgtgggcgacgcaggcgtcatggcgctggcgagcctggacacgctcgtcgccctgggcctggaggcgtgccgcgtgggcgacgccggcgcggccgcgctgggggccctgcgctccctcgagcgcctggacctgtccgacacgcgcgtggcggggcctggtgcctgcgccgcgctggcccgcctcccacgcctgcacacgctgtccctggccttcacgggcgtggacgacgcgggcgtggtggagctggcgcgctgcacgagcctgcgccggctgaacctggacgcgcggggcgtgaccgatgccggctgcgccgcgctggccggcctgcgggcactggaggcgctggacctgtttggcgcgcgcgtgaccgacgccggctgcgccgcgctggccgccctcacctccctccgctcgctggaggtgtgcggcggtggcgtcggcgacgccggggtcgcgcgcctcgccgcactgatccacctgcgcacgctgtccctggcgcagaacgcgggggtcacctcgcgcgcgctgggggccctggcacccctcacccgcctccgcgccctcaacctgagccagacgggggtgtccaacgcggggctggccgcgctggcccgcctccccgcgctggaaaccctggtgctgcacgggaccagggcgcgggcctcgggcgcggtccgcctccaggcccagctgcccggcctggcggtggtgggggtgcccgggatagcgtcgcccaagtgaagggtggtgaggtgagcgggcgggggttggctgtagaggtgggaaaagggcggatgatgagggagagggtatggccaagagtctatgagctgggctgtggcggcagggatccgtga

SEQ ID NO: 2962 - DNA, 618 bp, Chlorella protothecoides
atgaggattgaggaagttgcatccaccgccaagtcatcgcgcgtgagcccccatacccacatcaagggcctgggcctcacccctgccggcgatgcgctccccctgggctccggcttcgtgggacaggagcaggcccgagaggcatgcgggctggtggtcgagatgattaaacagaggaagatggcggggcgcgctctgctgctgacgggagccccgggcactggcaagacggcactggcactgggcatcgcccaggaactcgggaccaaggtgcccttctgtcccatggtaggctcagaggtgtactccgccgaggtcaagaagaccgaagtgctcatggaacacttcaggagagccatcggactgaggataaaggagcggaaagaggtgtacgagggggaggtgactgagatgacccctgttgagaccgagaaccagggcgggggctatggcaaggtgatcagccacgtcatcatcgggctgaagacagtgaaggggaccaagcagctgaagctggaccccaccatccacgacgccctgcaaaaggagcgcgtctcccccggcgacgtcatctacatcgaggccaacagcggatccgtgaagcgcgtcggccggtga

SEQ ID NO: 2963 - DNA, 204 bp, Chlorella protothecoides
atgcagggtttcggccgcgtttctgacctgctggccgacatcgagctggatgtgccaaccgcgcgcgagacgtttgaagacatggtcgccgccgcgaccaaggctgggtggctggaggagggcttccagagcggcggggagacgccgatgggtgggtcgacttgggaggaaaggggtgggggagggggtgtcgcgctggattga

SEQ ID NO: 2964 - DNA, 426 bp, Chlorella protothecoides
atgcactcgctgtggaaggagttcctcctcccccgcctccctgttgcccgatgccgggtccgcccctgtcctttcccgatgctcacccgcctctccatctctgccaggagcgacgcctatgccaccgagttcgatttggaagcggaggtctacgtccccctcccaaagggcgatgtgcacaagaagaaggacctggtccaggatgtcacgctgcacgacctggacgccgccaacgccaagccccagggcgggcaggacatcatgtccctcatgggccagctgctgaagcccaagaagacggagatcacggacaagctgcgccaggaggtgaaccgcgtggtgaacaagtatatagacgagggcaccgccgagctggtcccaggggtcctcttcgtcgacgaggggtcctcttcgtcgatgaggtga

SEQ ID NO: 2965 - DNA, 768 bp, Chlorella protothecoides
atgatctttactggccgcccacacccctcatcgccctccccaaactcgcctttccctcaccaggctgtgcaactggcgcttgaccgcaaggatcgggagagggagctggtgtcggccctgctcccgaccctggtgccctctgtcatcagccacggtgcggcgccgaggggtcccttggcgaagggccatgctgtggggccagcgcagcgtgcggtttgcctcaccggctgcctggtggcggcggcggaggacctgaccctggacattcccgatgcggagcccctactctccctcttcctgggccgcgcgatcgtggatgaggtggttccgccgcgctttctcgtcgagtcggtgccgcgcctgcgcggcgacggcgccagcctgcgcgtgattcagcacgccggcgcgcacctgtcggcgcgccacgccggcgagcggctgggcacctgctggcacgagcgcgtgtcgaggcccgctgagctggcgtccgccatgcgcgaggccgtgaacctttcagggcggattccgcgccgtgctcgcccgcccgaccgccaccagtcgccggtccccgcgcccttgcccggctgcatgcacgagtacaccgcgacgcacgacgtgcacgaggcggagcgctgcttgtcggatctggcggtgccgcacttccaccacgagtttgtcgtcaggtgggtccgcggggcgctggcacgatttgatggtggatgtgggggtggcatccctcctcgtccgctgctcggttgtgggtcatga

SEQ ID NO: 2966 - DNA, 453 bp, Chlorella protothecoides
atgctggacatagaatgcttcacctacctcaaccgcgcgctggagtccagcctggcccccatcgtggtgctggccaccaaccgcggcatgtgtgcggtgcgtggcaccgacgtctccgcaccccacggcgtccccgtggacctcctggaccggctggtcatcgtccggacccagacctacacgccggaggagagcatccagatcctggccatccgcgctcaggtggagggtgtggcgctgggcgaggacgcgctggccttcctggccgaggtggcggaggagaccagcctgcgccacgcggcccagctgctgacgccgggcgcggtgctagcgcggagcgcggggcggggggaagcggcgcggggggacctggaggaggcgcacgcgctcttccaggatgccaaggcctcggcgcgccagctcagcgcgcaggccgacaagtacatgacttga

SEQ ID NO: 2967 - DNA, 438 bp, Chlorella protothecoides
gacgctctggagatccgggcagaggaggttgaacccttgctggtcagggccatcggcaagaagctgctggaggcgcgcatcgaccagctggcccacaccgtgtcggtgtccaagtctgctccgcgcgcctttggcgacggcgactggaaggcgctgcaggccaccctgcgtgtctggcaggtgcggcgttggccgacgaggttggaaaggaggggatgtggggtggggagtggagaccggggtcttctcgccagcacacccatgcaccaagcacactgcccgagggtttgggagacctgcctctggaccggcgcactcagacagggtgccaacctctccaccacctcgcattcgcagggcgcgctggagcgggcggagcagattgcagaggaccgaaagggcctgctgcagcagggcctgaccgccatcaaggcctga

SEQ ID NO: 2968 - DNA, 282 bp, Chlorella protothecoides
atgggagtagacgcagatgagaacgagctcatcaccctggagatcatccacgagtttgttgaggtgctcgacaagtactttggcaatgtctgcgagctggacctgatcttcaacttccacaaggcgtacttcatcctggacgagctgctgctggcgggcgagctgcaggagcccagcaagcgcgtggtgctgcagaaggtggaggcccaggaccagctggtggagcaggtcaagtcgggcctgagcgacgagaagatcgtcatcaccgggcccaggggctga

SEQ ID NO: 2969 - DNA, 1314 bp, Chlorella protothecoides
  modified_base (168)..(177): a, c, t, g, unknown or other
atgggtgaggcggccatggaagatggtcctgcggcgtcgcagcggggtctggaggacaagggatgctggcctgtgccaaacaggcagagatggcgtcaattcacccctcaaacccggcccacgccatggcttcctcacaggaacgagacggcgcggctcatggcatcnnnnnnnnnnacctggcccacgccatggctccctcgcaggaacgagacggcgcggctcatggcatcggcgctggggggtatgtcagatgccgaggtgggccccgagccgcctcagtacgtcactttccgagaagctgcccgagccgagatgctcaccatacgcaccgagatgacggagctgaggggcttgcatgggcgggccaccctcagcaggtttgacgagagcaacgacgacgagatccaggtgcagcatacgtggcagggaggggtgtgtggtttaccttggttcgtcatgagggaagctgcatggggggcagttgtcattgcggcgaggttgctggacccatccacgttggtatctaatgcggtgcaggagtacttgccgttccaggtggaggtgacaactcagcagatcaccaagctcttccgacgctgcgaggcgcgtctccagaagtttgggtctgtgccgtcggagaacgaggccgacgagaaggtgcgatgcggaatgttgcctgacctgcaatcgtgcactgggtctgcagcgtccgctgcttttgtatccctgcccgacacattaagaattccccatccacctacccatccgcccccctactcccacacccgccacgatgcacaggtgaagcgcaacctgcagcggaccctggctgcggagctgcaggagctgtccatccagttccgcaagcagcagaaggcctacctggcccagctgcggcggcgcgaggcgggcagcgccgcccccggcggcgccctgggcggcctggctctggcggcgcgggacggggactacgacaccggcttctcgagccagcaggcactgcaggccgacacgctgagcgccctgatcgatgaccgcgaccgcgaggtggcgggcatcgtggccagcatccacgagctggcccagatcatgaaggacctgtcagtactggtgatcgaccagggcacggtgctggaccgcatcgactacaacatggaggccactgccgcgcaggtgacggagggggtgaagcagctggccaaggccgagaagaagcagaagcagggcctgatggcggtgtgcatcatgttcctccttgtcgccatcggcatcctggtgctctttgtggtcatcaaggccattgtattctga

SEQ ID NO: 2970 - DNA, 3738 bp, Chlorella protothecoides
  modified_base (708)..(717): a, c, t, g, unknown or other
  modified_base (1475)..(1543): a, c, t, g, unknown or other
  modified_base (2129)..(2138): a, c, t, g, unknown or other
  modified_base (2288)..(2297): a, c, t, g, unknown or other
  modified_base (2382)..(2391): a, c, t, g, unknown or other
  modified_base (2745)..(2830): a, c, t, g, unknown or other
  modified_base (3017)..(3095): a, c, t, g, unknown or other
  modified_base (3285)..(3294): a, c, t, g, unknown or other
  modified_base (3545)..(3554): a, c, t, g, unknown or other
atgcacatcaccgagggcacgctgttggtctgcccgatgtcacatcatgccccccctgccactgccactgatgtgaacatgctcactccggggggcagcgggggcatccatgtccgagatcaaatcttggggacgccgggtcacgccctccatcggaaattgtgcgatggagacggactacgtcaaggcacagatttcggggcagaagggagaggtgcgccgggggaagtggtgggaagggtttcagggttcgtctcccgtcggcgaggatcaggcgacagcttaccttcgggcattctgcaggaccgaatcatagccgtgcatcgagcctggcctctggatgacgagttcgtctcccgtcggcgaggatcaggcgacaccttaccttcgggcactctgcaggaccgaatcatagccgtgcatcgggcctggcctctggatgacggcgagggcgtgtcggtggtgggcaccgcttccgagtccccgaccagcaatttcctgcaagtctggggcggtctcgagcgggatgcggacgccagcaggtgcgctgcgtgcgggttcacgggacgcagggatgattttcagtgtgtttccagaggaccgcggggccgtcggatgcccgtgccctcggccctgaccccccacccgctcccccaccggcttgtccctgcagcccgacgacgggccccgagtaccacctcttcgccnnnnnnnnnncccccaaccgggctaaccaccatgaccgcggggccgtcgggtgcccgtgccctcggccctgaccgcccacccgcacccccaccggctcatccctgcagccccacgacgggccccgagtaccacctcttcgccgtgttcgacggccacaacggcgacgccgcctccaccttcgcccagtccagcctggtcccggtgctggaggcctacctccccgtccccgagatggtggagggtgtggacggcgccgcggcctgggccggcgcggtgcaggaggccatggtgaagacgctgctggagatcgaccgtcgcttcgcggcccgcggggcgacggggggcaccaccgccaccctggtcctccagattggccagctggtgacctgcgcgtcggtgggcaactcgcgcgcggtgctggacacgggcgcggggcgcgtggcgctgacgcgcgagcacgtggtggccagcaaccccgatgagcgcgagcgcctgctggccgcggggtgcaccctggcgcggctggacgtcgccggcggcggccccgccgtcatctcctcgcgcggcacaggcccgctccgcgtctggccgggcggcgtcacgctatcgcgctccctgggcgacttcagcgtgggccccgccctcctggctgtgccacatgtggtggcggtcatgctgccccccgccggcggccgcatcgtgctcgcctccgacgccgtgtggaaagccggcgtcgatgcagtgctggccgctgcggccgccgcgcnnnnnnnnnnnnnnnnnnnnnnnnnnnnnnnnnnnnnnnnnnnnnnnnnnnnnnnnnnnnnnnnnnnnnccgcgcatgccgtgctcaaggcgctcgggccgcgcctgcgcggcgatgcctcggtggtcgtggccgacacgctgccgcgcggagagaccttcccccagctggctgcgcgcctggcgcagggggggggagggcgcgcggggcgccccgcgcccatgcgcgcgccctccgcatcccgcctctggtccctgctcaagccgcggcgggcggaggaggcggcgccgccggcccccgccctctccgcgggggaaggcgggggcgcgcgcgtgctcaccgactgcgacgtcgccacgcttatgggcctgaccacgttgaccctgggcgaggacgacccccagcccatctggggagggcggaggtggggcgattgtgacgctggatggcctgtgacgacgggggacatgcgatcacctgggctgcggctgcgaggggcacgggtgtgtgcggcgccggctgtgtcccggtgggcagcgacttcgttgggtgagagacctgctgtcgaagagcgggatgcggtgctctctcacatcgttgaacaagccaccccgaggccagccgactggtctggcgagcgtgctggcacaggcannnnnnnnnngcgtgaggtgagagacctcttgtcgaagggcgggatgcggcaccagccgtgcttcggtcgggatggcttgacccctctttcccaacacgaactaccaccctccaccggctgctccctcacccacccacccacccttcctcctctccaccnnnnnnnnnntcccctctttccaaacacgaaccaccaccctccaccgtctgctccctcacccacccaccccaccttccccctctccacccccctnnnnnnnnnngcgtggcggatctggcccgctgcgcgcgccatggcgctgagcaacccggcgctggcctccctgcgcccctcccgctccatcggcacgctgtcggagctggtggggtggagcgcgccgtccagcggcgccgcctcgccgcgcggtggcgtgggccgcccgcccggccgcccctccttctcgcgccgctcctgcctgaagcagccgggggagtcgacggacggcggggccagcgacgcgctgggtgccggtcccggcggcgcctccagcgacgagaccctggcctcgcccctggcctccaagcgcgtcagcttcgcggcgggggagcgcaaccctctgcgccgcacctcctccgannnnnnnnnnnnnnnnnnnnnnnnnnnnnnnnnnnnnnnnnnnnnnnnnnnnnnnnnnnnnnnnnnnnnnnnnnnnnnnnnnnnnnggctccacgccgcccagcagctggctgggcggcctgtccgacgccgacgcgggcaacgggcgcggcggcgacgcgcccgcgcccctcggcggcggcggccaaggttcgggcagtgccggcatggcctccatgcgcagcctgagcctgcccctggccgcggggcggccgccgcggccccccggcgccnnnnnnnnnnnnnnnnnnnnnnnnnnnnnnnnnnnnnnnnnnnnnnnnnnnnnnnnnnnnnnnnnnnnnnnnnnnnnnnaccacgcgctggcgggacagctacagctccaccgcctcggtcttcaccaagcgcggcgcggcgcgcgagcgcgaccgccttcggtgacgcctgcaacggcgttgggcggcgccagccgcatggcgaggccccggccccagccggggtccagcgactcgtggccccaggaccccagaatgcaggccccgcnnnnnnnnnnggcctgcaacggcgttggatggcgccagccgcgtggcgaggccccggccccagccggggtctagcgactcgcggccccaggaccccagaatgcaggccccgctcgcctcattgcgttgacatttccgcttgcacacacacacacacatacacacacactatgttgcccggccacagccccggaaacccttgcaccccacccaccgtcctcatcattgcaccccccaccccccttgactgtgcggtccaaannnnnnnnnngttgcccggccacagccccggaaacctttgcacaccacccaccgtcctcatcattgcacccccaccccccttgactgtgcggtccaaagcgcagcggagggccgtgccctcccctcgccgtcagttttcccttgagcggtcagttgctgcggtaatgcatcccttctccctgccacttccctga

SEQ ID NO: 2971 - DNA, 1155 bp, Chlorella protothecoides
  modified_base (882)..(891): a, c, t, g, unknown or other
atgggggccaggctgactcgttccggcacgattattccatcggcgcggggaaatggccccgccccggaatgccgacctggcattcagattgcggatccaggcggtcatgtcgtcgtagaaatccacccgcgcagaactcatgcagaactgtccagcacgcataagctcatagggtcactccgtttatttctcacctgtgagcggcgctcaagcgtggacgcatgggatgcagcgagccgggctcacgatgaggcccctcggactcatgccgcaacggccaggcgtcctgcccgctcagactcttcgccttggcgccctgaatgtccggccagctcgggtgcgtcgatcaaggcacattgcgcatgccctttcgagcctcgatctactccacatcttcaacaccgggctggccctgctgcccctggcctacgagcccgtagttctgccatgccacacccagaactgcggcgaccaggtccacagaaggtagcctgccccgcacgcattttggcctcccctcatcccccttgcagcaccctggatcctgtgctgcggttggagcagaaggggatcaacccccagggcgtcgtgctgtgcctgggcctcctggtgtacctcttcgccacccctggtgtcctccccggcgcgatcgacacatacatcaaggccccgctccagcgactccgtgcccagccctactgcagcgaggacttcactgtcggcaagaaggtggccagcggagggtttgggacagtgtacagggctgagatgaaggaccctcgccgccccggagagacccggaatggacttctgggaacagctcccccaggcttctgtgtgtctctatgtgaacaactggcatcgttccccaagacatgggtnnnnnnnnnnagacccggtgagtgggatgctggtgtggggctggtgcaggtggcggcgcgaggctgcccgtgctgggttgccagtccggcaataccatgcgggtgttgctgccgtgagggaggaatggacttctggaaacagctcccccaggcttctgtgtgtctccatgtgaagaactggcatcgttccccaagacatgggctggtcatgcttggccaccatgcttctctgagctctgttgactcacccttggccccccccctcctccaataa

SEQ ID NO: 2972 - DNA, 330 bp, Chlorella protothecoides
atgtcctggggatgccctcctccactcagcacctctctgctgtcgccttcccctgcggccgcagggatcgtgcaccgcgacgtgaagccgcacaattgcatcgtctccaccgtggaccgccgcatcaagctcatcgactttggcgcggcggccgacctgcgcatcggaataaactacgtgccgaaccagtacctgctggacccgagatacgccccgccccagcagtacatcatgtccaagcacacacccaggtaccgggcagctggcggtggtggcatgtgggtttgtggctatggagtatgttgcctggggaggacagggcccggatga

SEQ ID NO: 2973 - DNA, 582 bp, Chlorella protothecoides
atgcgacgctggcgatcaagtgcagcggctcggacagtgttgatgcttcaagacagagtggtcctccaagaatcacgcccagcaccagacaccctctcaccctccagccccatcccctccccccaccccacacacaggctgtcggcgcagggcgcgctgcgccacccctggttcgacacctcgcccctggcccggttggggtctgcctttggggacctgacgcagcgggtcagccaggccacgaccggcctgggcgggcagtggcttggggaggtgatggcgaggtcgggcactgccgccagcggcggcttcacggaggcccagctgagtgaggagctggaagaggacggggaggtgtggcaggcgcccccaaaggacatctcgagcaccatcgcctggtggcagcagcgggaggcgcggctccagaaggccgcacgcgtccagcagaggaaggctgccaagcagctggtcaaccttcggaaggacacgcgaaacacggtgaaggagatcaagaatagggtgtcgctgctgtaccccctcctgggcggaagatctggccgggagacgggggaagggacgtag

SEQ ID NO: 2974 - DNA, 351 bp, Chlorella protothecoides
atgaatgagcgcatggcccgcaccaatcccctggccgtggcggacttcgtggccgccttcacggagttccccagcgcgcgcaccgcaaccgacccgctctggctggtgtggcagttcgagggggagcacaccctggcggagctgatggtgcgcaaggatttcccccagtgcctggcgccgctgctgtttgaggaccccagcgtcgtgccacccggcgtggccggccaggtgttcctgctgaagaccgtgatgcagcagttactggagggcctggcggcctgccactccacaggtgcccggctggcctgcctgagactggaggcacaaaaaaaggggtggggagtcccgtga

SEQ ID NO: 2975 - DNA, 465 bp, Chlorella protothecoides
atgccatggatccaaagtttcccaatccgcacattcccaatcctcttccctgttcccacctttctccctttccccaagggcctgggcagccccgaccacaccaccctcctgctcaactgctacaccaagctgggggacggcgccaagctggacgccttcatcgccggcgcgggggacggcgccggcgcgcccgcctttgatgtcgcggcggtggttcaggtctgccgcgccgcgggctacttctcccacgcgctggccgtggcgcgtgcggcgggggacgacaccacctacctcgatgtcctgctggaggactgcgggcgctgggacgaggggctggaccacatgcgcggcatggggcggcgggccgctgcggccgccttgctcaagcacggcaaggtgcgcagggatagtctatcttggtgggagggaggagctgcgctgttgcaccattgggctcgcgcgtga

SEQ ID NO: 2976 - DNA, 201 bp, Chlorella protothecoides
atgggccacctggagccgtcgtacgtcatccagcgcttcctctccgtccagcgcctggccaacctgaccacctacctggagaagctgcacgccgcggtgtggtcaagtgggggggttagaaggggagaatacatggggtgggggacagaccacctctccctcagccgggtcttgagcctcggcacctggacaggactgtga

SEQ ID NO: 2977 - DNA, 1092 bp, Chlorella protothecoides
  modified_base (796)..(805): a, c, t, g, unknown or other
atggtggtcacgagtgagacgccatggagcgagaagtacaggccacagactctggacgaagtggccttccacaaggatataattgacacgagtaggtcgccggggcgaacagcgggacctggttgtttatgcgtcggcgacgagatcactttgctggagtggcccttcaaagcatcaagcccatgtctgagccaccaccctcctcccgataatgtagtcaagaagcttctgaatgagaaccagctgccgcacctgctgctgtacgggccgccaggcacggggaagacctccaccatactggcactggctcggcagatgtacggcccaggggctgcaaacatggtgctggagctgaacgcctcagatgaccgtggcatcggcatcggcgggtgggatttggacaagcttggctctcgcccacacagtccccctgttcctcctggtgatgcggcccaaccccttgatgcgagccgccgccgtcctgctctagtcaattcccctcacacacacacacactctgtgtctcacatccacagcaataaattcaagctgatcatcctggatgagtgtgacgcaatgacacgggacgcccaaatggctctgaggagagatcatcccagcgctgcagtcacgctgcacacgcttccgcttccagcccctcccgcccagcttcgtgacggagcgcctcacctccatctgcgccctcgaaaagtgagtcctgggagggggatgctggaggtcgggaagggggatctgttggtgctaccacgaggcgtcgccgtgccgaaacttaatnnnnnnnnnngagtcctgggagggggatgctggaggtcggaagggggatctgttgggtgcccacgacgcctgaggggctggaagccctggtccagctcggagagggcgacatgcgacgcgtgctcaatcttttgcaggttgcaagcgtggggaatgagggttaggcccagcgcggggacacgctccagtgcatgcggtcccacccgtcttgcacgctccggggatccctccaacccttggggttggcgtcaagcaggaatcttgcagcgttcattcttctgcatcaacggcacctga

SEQ ID NO: 2978 - DNA, 351 bp, Chlorella protothecoides
atgatggacatggcaactcggctggggcacaaccatgaggagggagggggtggtaagcggcccggcgcgcactgcattaccaaccagccccatcccttcctcgctctcacaggaaacctggtcgaggtgagcttcgctgagctggaggctgatgctgtgggcacgctgcgatccatctatgacaggctgggcctcgctggctttgacagggtggagcccgacgtccagcactactgctccacacttgccgactttaagaagaatgacctagagcggtgggagtcatgggtggtgggagtgcctgtggctgtctgcatggccgggcagctcggacaaacaaggtttccgtga

SEQ ID NO: 2979 - DNA, 1050 bp, Chlorella protothecoides
  modified_base (689)..(698): a, c, t, g, unknown or other
ctcgatcgtgctctgtctcttaattttgacatccatcgcctccacccacccctcccactgcgccccaggctagactgcatcgtgggcaacgtccggctgcaggaccggttccagtgggacgtctcgcgcatcgatccccagggccccgagatcttcgcgcagggcctgtgccgcgatctgggcctgcatggcccctggcccatcgaggtggccatcgcggtccgccaccaattggcgctgctggcgcgccagggggcggccgccgcggtgggaggcgtgggcaatgtgcggacggcgggcggcgggggagcggcgagcggcggggaggcggcgagcggcaccaccccaccccacgtcgagcacgaggagccgggggagtggggcccgcgcgtgacggtgctgacgcgggaggagctggcggcgctgatctcggcccggagcgaggcgagccggggggccggcgcctcggccacggcatcggacggctcgaggcggggccctggccagagccagggccaggcgtcgccggggcaggacggcccgtccctgggcgcgtcccccgcgctcagcgggcgccagctgcgcaagcgtcgtggcgcccgcctcgccgagctggtctcctccgagctggccggggacggcgcccgccccgtcgccgccccggggtcctcaggatcgcccccggggannnnnnnnnnacggcgcccgccccgtcgccgccccggggtttgccgaatcgcccccggggctcccgcgccaggcgccccacgcgcccctcggggcgccgatgatggaggggatgggcgccgccgccgccgccgcatacgcctaccctgggccagggctggccgggcaggcggaggcccagctgcaggcggggcgcttggtggctcccgaccccgggctcgacgcctttggcatcgggcctgcgggcatgtaccccgtgacccaggcggcgccccgggccccgcccgtgagccagtttgcaaacctcttccccgacatgttttgaggagcgaggggtgggacccatccacgtccctgacctga

SEQ ID NO: 2980 - DNA, 435 bp, Chlorella protothecoides
atgcccgggctgggcgcgctgcccggcggcgacggcggggacaggggcgcggggttcgcatccctgggccacccctcgggccccctccgccccggccaggagatcgcggcggaggagatcgcggcggaggtgctgtctgcgctgaagcccctctcccccgacgagttcaccacgctgctgaccaacttctaccgcgggctgaagggcaagtacaaggtgcccacctttgcgcatcgcgacctcgacctgcacaccgtcttctgggcggtgagcgcgcggggcgggtacgagaccgtcaccgccggcaagcagtggaaggagatctgccgctgcctggacgtggacctgacggggcagacctccgcctcctacaacatgcgcctcaactacgagcgctgcctgctggactttgagaattacctggccagcgggaag

SEQ ID NO: 2981 - DNA, 594 bp, Chlorella protothecoides
cgcgccgacctcgcgcgcctggtgcgcctcgccggcggccagctggaggtggccgccgcgctggggctggcggcctgccgccgccccgcgggctactgggactgcgcggacaacatgcagcgcgagctggccgccttcgtggccgcgcactggacgaggttcgaggagccgggcgaggcggaggtcggcgaggagcgctggggcgtcggacgcggggatggaggcggcgagggggccaggggcatggggggtggcgacgacccacgaccaccgcccggtaccccggaccccgccgccctgcccccccagccgtcgaaggccgggtactggtacaaccaggtgacggggcgggtgtcgcgcgaggcgccggagctgccgaccctgatcgcgctggccgatgatgggagcgaagtgctggccgagccgcgggaggacgtggtcatgccctcgcgcggacacctgctggcggcggggcggtacgacctgcactacgccgtcacgatgcacggcggctaccgcgcggtgggcgcggcgctgggccgcgcgccgccccgcccgcgccagcgccacctgggtggggcgcagcgcctgcgc

SEQ ID NO: 2982 - DNA, 1233 bp, Chlorella protothecoides
atgcagccggccgtcgagcatcagagcggtgccctggtcatgggtctggcattgtggtgtgtgcctgctgtctgtcaacatgaatgttgtcctccctttcaccctcacacccctcccaccacctcagggagcatcaccgacatctcctggaccgaggtcaaggtgggggatgcgctggtggtgcgggacgacgagctcttccccgccgatatggtgtgcctgcagtcccagctccccgaccgcgtctgcttcatccggaccaccaacctggacggggagaccaacctgaagatccgaaagcccatcgacctcaagggcatccaggtgggcgggtgtctcgttgcggaggatgtggttccctcgggtctggacgtggcctgcctggtcgggaagttgcggctgattccgagcgggagggatgaagcgtctggggcattctccagggccctgcggcaagacactcaccccattccacaatgcacaacccctgtcacaggccagctcggtgcaggaggccatgcgcctgcgcatcaggctgtctgccgaggcccccaaccgcaacctgcaccgcttcaagggacaggccacaatcctgagcgagcagtttgcacgtacccccctgagccccggctcggacaagatggtgtggagcgggaacggcacggccgctggtgggtgacagtgtggtctgtgcatgggttgggagcttcagggtctagtcatcgtgcgccctgttgggagggggatgttgcacaggctcttccatgcagtcgctgcgccagactggcaagctcgtgcggcttggatgtcgagccagctctttgccagcaggggtgttgtgagcgttggtcgcagcatggatgtcctgcctgcacgggagtccactcgcctgcccccttttaccccacccacacaccaacgcgcaacaggggaggagccgcacgtgaacgtccccgtgaccatgaacgagatgctgctgcgcggctgcatgctgaagaactccggctccatcctgggcctggtggtgtacacggggcgggagtcgcgaatccagatgaacgcggcgcgcacgcccaacaaggtcggctccttcgaccgcttcctcaacctccagatcgggctggtcatcgccttccagctggtgctggtcatcttctgcgccgccgccaacctggtctggcagaacaccatgggtgtggaccgctattacctggcgctgaaccaggacgtgca

SEQ ID NO: 2983 - DNA, 933 bp, Chlorella protothecoides
atgacggtggccgctgggcccagcgaggctgtccccgctccccccgcagaggctgcacccagcacgcccaccagtcatgtggagattatccccctgggagcagcgcaggaggtggggcggtcctgcgtcatcgtgcgctttgcggggaagacggtgatgttggactgcggggtgcaccccggcttctccggcctggcctccctccccttcttcgacgtcatagacatgtccagcgtggacgtaatgctggtgacccacttccacctggaccactccgcggccgtgccttacgtggtcgggcacaccaacttccgggggaccatcctcatgacgcatgccaccaaagccatcaccagcaccctgctccgagattttgtaaaagtcagcaagggaggcgcaggcgaggatccaggggcttgggagggttggggaggggaggtggaggggccagggcaagggctggcgggcgaagccggtgaactccacttcgtggaggcggtgtgggtcggcctggacgctaggaccccgctggcgatactcgctgtgcgccatgaaattgagtcacccaaccagcctgtagggagagagtccgcgtcggatcttctgtcaccctttgcctcccatcaacaacccctgccctgtccaccgccagatgccgggctgtacacggaggccgacctggatgcctcgctggagcgcacgcatgtcatcaatttccagcagaccctgtgtgtcaacggcatcagcatcacggcctaccgcgctggccacgtgctgggcgccgccatgttcatggtggagatcgccggccagcgcattctgtacaccggtgaggagctgtggcggcgttgggtggcaagggtgggttgcctcgggcctggctcagcccttggcaacactcgtcatggcgttcgcaagacgcttgaatcttga

SEQ ID NO: 2984 - DNA, 507 bp, Chlorella protothecoides
gggggcgcggcgccgtcggcggccgcgggccccgcgctggccgccccggccccgcccacgcaggacaaggcgctggcgctggtggagacgcagctggccgaggcggtgcgccgactgcaggaggagcgctccaagccgcgcgcggcgcgcaacagcttcaagtgccccaagtgccaccgcgtgacgcaccccgagggcagcccgctgctcctctgcgacacctgcccccgcgcctaccacgcggcctgcctgggcgcggcctgggccgagctccccacgggcgactgggcctgccccaagtgcgtggaggccacgcaggccgcactgcgccgcgtcgtggacttggaggcgcggcggcgcgaggcgctggaccgcgccgcggcgcgggagagggaggccgaggagcgcctgctcaagcgcctgctggcgcgggaggagaaggaccggcgacgcggcgacggcgtggggccggggtcgggggccgcgctggccggcggcgcggcgggg

SEQ ID NO: 2985 - DNA, 846 bp, Chlorella protothecoides
atgcacgagacgcacccgggtgtccaggacatggcctgcgagaccttcctcaagatcgtgtccaagtgcaagaagaagtttgtggtgcagcaggtgggcgagacagagcccttcatctccgagctgctcacggggctgaccgccaccatccaggacctggagacgcaccagatccacatgttttacgaggcggtgggggccatgatcgccgcggacccaggtgtgcagggaagagggcgggccggtggtaccggagggtcggtgcgggggggtggcggtgtgggtgggaaggggggggtttgtgtgtgtttgagtgggtctgattggggagagagtgggtggggaggacggggagctgtgttcaaaggggcgcagaggcgggaccccacccttgcacggtgctgtgcctgcgaagggtgcgcgcaccgttctggctgccggaccaagaaggagggaggagaagggcactgcatgcatccggtcgaccccacatgccacgccacaagatggcatgcacaccaagcaatcccccccctctgcagatgcggggcggcgggaggagtacctggtgcgtctgatgggtcccccaaacgtgacctggcaccagatcctggcccaggccaagcaggacgtggaggtgctgaagcagggggaggtgatccgcaacctgcagaccgtgctccagaccaacgtgtcaggtgtgtgtgggattgggggttctttgggggggtggggttgaaggcgtgtgttttggggtggaggccaaggggcaaggtgtgttggcaggcagcatggagagtgttgggtgcagtgtgcggaagccctgcacctgtgatgggacccacg

SEQ ID NO: 2986 - DNA, 315 bp, Chlorella protothecoides
  modified_base (138)..(147): a, c, t, g, unknown or other
atggcggtgatgcagcagccgttgacttcccttcctgctcgctcatactcagcgtgcatacctcaggctgtggtggctgcagtgatgcaggctggactggcggcttttatacctccaggggtggccttcttcgggatnnnnnnnnnnggtgatgcaggccggactggcagcttgtatacctccaggggtggccttcttcgggatgaggccatcctcctactccagcgcttctacagtgctggaaaccctaatggtatggagttcatggtgatgtctgcagggatccattgtacgatctgggaggcaatgtgttga

SEQ ID NO: 2987 - DNA, 1179 bp, Chlorella protothecoides
  modified_base (278)..(287): a, c, t, g, unknown or other
  modified_base (475)..(484): a, c, t, g, unknown or other
atgcctccctcgccggtttcccctctttgcagcgcccaagccgcacagacctgtgaaggatcgcagcatcaagctggctgcagctctggcgagccattccagggacaatacccaagatctccactgctagcactggtcctgttggagcccagatcatctcggcagactgccgcctccaagccagggctgcagggagattctgcactggctgtgcatttggagattgtcatatttcactccccttccagtgaaggcgcgcacgtgagtgtcgatcgtgnnnnnnnnnnagctgcagggagactctgcactggctgtgcatctggagattgtcatcatgcgtctgatacctcgagtcctcctgaccggaaggtggaggtttcgccatgctgtgagcatctccaggacccctgtgatgagatgctccaaggaggggcagatatcactacccttcctgtgaaggcgcgcacggctggtnnnnnnnnnncctggccatgccaaggaacaaagttgactgctccattcaaccctgatccaagcgctgcaaggagtgatcagggctggtgtactccccagcacgtcgtggagctgccgaccgcgatcctgtctctcgtggcgcatggatgccctccccagcagcgcagccctctgtcccctgacgaggtctactccgccctcaccgcctccctgtccgctgatggcacgactcgcacccaggcccaggccttgctgcaggagtgggaagcggattcatcccccggcttcatcggatcactgctgaatatcgtgcatgaagtgaacagcgtgcctgaggtccttgcaccattccttaccttgcttgcaccaacaggaggcccgcctgatggccaccgtggtggccaagaacgccgtcggctcctcctggcgcaagatcatgggcacgcgggagtggtcgcgcgtgccaggtgcggcataggcaccttgatgctgccgcttccaagggctatgagacatgcaggactgccgctgccaccacttctcgcccacctgccgactgaccgcaacttcacttcgctcccccccctccccacacacacatcgcgtgcagatgccgaaaaggcgcaccttgatgctgccgcttccaaggactatgagacgtgcaggactgccgctcccaccacttctcgcccacctgctgactga

SEQ ID NO: 2988 - DNA, 537 bp, Chlorella protothecoides
aggaaagcgcgaatgggtgtgtgtggacatctctggtgctcgtggagagggcgccgcgcgcatgggtgggtgccccagccccgtcgttcacgactgcttcgcgggtttgaggctcgccgcgccccgccatacggatgcaccatgcccggccgagcccctggcctgctcaccacgcgctgtccctcccctcaccccgtgctccccactcgcatgtggcccacacctcccccccctcctccccaccacaggttcccctttgtccctcagccctacggctaccccatgcccaacatgccctactacccgacccagggcggcgcctacacccccggccagggcgccacagcctacaagtacccgcccgcggccgccggctacggcggctacgaggagcagcccggcgcggcctacggcgcggcggccgggaagcaggagcggctgggggcccgcggcggcgaggcctcccaggccgcgctgtacggcaaccaggccgggtactcgcagtaccagggccagttcgggcagggccaccgctga

SEQ ID NO: 2989 - DNA, 510 bp, Chlorella protothecoides
atgcatcatcccttcctctcaatcccggtggcgcagggggttagcggcgaggacgggcccctcatcttgggactcctaccccttaatgtgaacgcctcggccttcgatgcgatcgacggacccttgccgcagatcaccccgcccttcactggtgacacactcttccatgggcacagctccgcggaggatctgcttggacccctggccgggggaactcttgcggacctcgaggaggcgctcgcctctggagagacccaggatcagagtctctttcatcccactctgccgttgtcaccgccacgtgcaggtggtcctctataccacacagaatccaggcggcatcctgcggggacaggtgatgccgcacagcgccaagaattaaccagcggcgttgcgcatgactacagaacgagattcctcgtccgcatgcgctaccaaagcctacatcctgctccattcacacgcctcaggggtcctggcaacaccttgggctaccttatctgtccctaa

SEQ ID NO: 2990 - DNA, 4161 bp, Chlorella protothecoides
  modified_base (267)..(320): a, c, t, g, unknown or other
  modified_base (442)..(451): a, c, t, g, unknown or other
  modified_base (649)..(658): a, c, t, g, unknown or other
  modified_base (1070)..(1079): a, c, t, g, unknown or other
  modified_base (1861)..(1870): a, c, t, g, unknown or other
  modified_base (2061)..(2070): a, c, t, g, unknown or other
  modified_base (2951)..(2960): a, c, t, g, unknown or other
  modified_base (3145)..(3154): a, c, t, g, unknown or other
  modified_base (3686)..(3695): a, c, t, g, unknown or other
  modified_base (3768)..(3777): a, c, t, g, unknown or other
atgacaagatgtgttacggtgttgcgtcagaagcagacgcctgttagagatagaagggcaaggagcagcatcttgcacatccaactcgccgatcttgcttgggtcactgcttctcattgtttttctctgagtaccccgatcgggcatgacctcggtcggaaacacgtgaaggaccccggccccacaaccactttggggtcaggaaacgagacatccattataatgttatttcaaggtcgaagtgtgttggagggaagcgtctcattnnnnnnnnnnnnnnnnnnnnnnnnnnnnnnnnnnnnnnnnnnnnnnnnnnnnnnatacaaccgtgacacgaccgactgtgcagcggttcctgccgcaccacgcgcacctcaaggttacctagggtgtcgctctcctcctctcaatcctgctgctcacctcgttcgtggtggtgcgnnnnnnnnnnacgggaatccctcgcggctgtggggccggggtccttcacgtggttccgaccgaggtcatgcccgatcggggtactcagagatacgtaacagcagtgaccgaagcaagatcggcgagtgggatgtgcaaaatgttgctcgttaccgttcaatctcttataggcatctacttctgacgcaacaccgtaacacatcttgtnnnnnnnnnnttgcgataacgatgacgacgacgacaacgacaacgacaacaacaggagcagtaacaataactacgatgatgacgagtactacgccattctctccgggtcagcgacgtccagaacctcatcatggcccacattcatctggtaaggtggatgtggtggttgcatgcacggggaggggagccctgcgcccgtactgtcgggagttggggtgcgtgtgcagaagtggagcccggcagctcgtaggggaacgtttcctccctttcttccatcgcgaccattctctaagccctccatctcttttaaccattttcacagggcggagcgggcacgaacggtcccgtcatcgtcggcctgctgcccaaaggctacccagcctcagcctttggccccaacgccaccctgcccaccatcactnnnnnnnnnnctgcgatgacgatgacgacaacgacaacgacaacgacgacaggtacaacgacagcgacgataacaacgatgatgacgagtactacaccattctctccgggtccaatcagagccctgccataaacacaccgacgactggtcgcgcctactttgatctggatgacgacgaggatgagtacgagtggacgattcaggttagcaacgtccagaacctcatcatggcccacattcatctggaatggagccgtcagctccaagaggaatatttcctccctttcttccttcacgagcatgagaaaattgtccacgtcgtccaatcttttccacagggcaaagcgggcacgaacggtcccgtcattgtcggcctgctgcccaagggctacccagcctcagccttcggccccaacgccaccctgcccaccatcactccgccattcagcggatccaacagatacagcggcaagttcactgccagggacctggcgggcccatacgctggaaggcccctgagcgccctcacccaagccttcaaggctgggggtacatatgtacgtggggatttacctcagcgtggcatcctgaaaaccctgcctgctgcgcttgcacagaccaaaccccatgatggaattctcaaagtgtcagatttccaaattggtctcaacctgcccctctccaccccctccctgcccctcgcaccaggtcaacctgcacaccacccagtaccctgctgggctggtgaggggccaagtcatcccgcagtcgtgaggcctgagctggcgccannnnnnnnnntttcactgggtcgaacagatacagtggcaggtcaacctgcatacgaccaagtaccctgctgggctcgtgaggggccaagtcaccccgcagtcgaggcaaggaagtcgtaccaaatgggactgcaggcctgtagcgtgcacagctgtctacgtattggtgggggggaggtggaggggatgcttccctggcgnnnnnnnnnnccatattatcggagcagagcgttgagcagatttgaggatgcgcctgcatgttctgcagtctcaggaggcaaggaaatcgtatcaaatgggactgcaggcctgcagcgttcacagctgtctacgcactggtgtgggggaggtggaggggatgcttccctggcgggtgtcaatggaagctgtggtgacatgacactgcgctgttgcaagagagtgctgctgattggaacgtccccatgctttctggcaacacgtaagtctcgcttgtgcactgatggggtccacagtcgacgtcatcagcttcccgctttcgactatacacctgtcgacgaggttaaacctcccaccttctcgtccaatacattgtcagccctgacagctggcactcccgctccagcgaagtgcagcccagagcaagtttggtccagacgctctaccacatccctcctcagcgaacaggaccaggcgcaccgaccaggcgcaccgtacactcaatgcttaggaaaacttcaatcagggcggagtatacaacacaatcacctacacggctcaccgcgttcgaaattatatgctggaaccaccaaatcgggcgcagccacgttcgtgccatcaccgcgcgaaaccgacatcattatttgcttcacagctgtagctgtcctcaaaatgaatgatcgcccattgatacggacgtgggcgtccaagtccgggttgctattccgccggttctgggcatgctttccttgcagcaaagttaaaaacgtacgtttaagactccaagccggtcatcatggtttccctgcgctcctccctgcttgccgtgctggtggtggtcgcccttgccaagcctgcgctctcgcacagcgacgactttgccacggacgacnnnnnnnnnngtccctgcgctcctccctgctcgccgtgctggtggtggtcgcccttgccatccctgcgctgtcgcacagcgacgactttgccacggacgacgacgcgcctttgtttgagttcaccgcgaatgtcacggcggcaaagtcggtgccccccatcaagagcaacacgaccgccttctttgctgccagcnnnnnnnnnnatctcccatgctcagtcaataccccaattctgttcctattgcaaaggtgggcgaggctaccaaggaaggtcctgcaccgccggctggctgccggatcagtgttgcatccgcggcaggggtttgaaagcatcaactcctccccaccctcttccgagctcgtagggcaactctgtgaccaacggaccgatcatcgtgggcctgcttcctctgggcgagcccgtggacgccttcgacgggagcatccctcccatgttcaaacaccccaggaccggccttcgcctcgctttcaatggaacattcaccgccgacgacttcgtgggcccattcgcagggctagagatggacgacctcatatattccttctacaccgaggaggtctacgtgagtggaatgagtgtggggggtccgagggtttgctccggacatgggcgagggtaattccagcggggcacgccccttcgtcggcttcgcgccggatgcgaggtgcttatagcagcggaatggcctctgccagagcatgcctttgcccgcnnnnnnnnnncgcctgcctcccctatacaggtaaacatccacaccgtgcgccaccccgctggcgctgcacgcggacaggtgannnnnnnnnntgtcggcttcgcgccggatgcgaggtgctgatagcagtggagtggcctctgccagagcatgcctttgcccgcccacgactttcaaacattgtacaagtcgacctgccatggtctgatggtttggccccagtctgttcacagaagcaccccttcccagacgctgaatgccttaaatccagcacacaaagaacactcaccttggatgcctgcctcccctgtacaggtgaacatccacaccgtgcgctaccccgctggcgctgcacgcggacaggtgaatgccgacccggacgtgtagggtcttggcattgcccacgctgcttcaatccaccatgccttagcctagcagaagctgtatatgcagtgaacttgccactgaatccatga

SEQ ID NO: 2991 - DNA, 2469 bp, Chlorella protothecoides
  modified_base (453)..(462): a, c, t, g, unknown or other
  modified_base (563)..(572): a, c, t, g, unknown or other
atgccctcctcccccccccccccccccccccaggttggcatgcggtacttccacctgaacaagaacaagtacttccagcccatcatcaacctggacaagatctggagcctggtgggcgagtccgcgcgcgtcgaggccgccaaggacacctcctccgccgccgtgattgatgtcacgcagcacggctacttcaaggtgctcggcaagggccagctcccagagcagccgctgctggtgcgcgccaagttcatctccaagctggcggagaagaagatcaaggcggccggcggtgccgtggagctggaccgggggggtgggaggtccaggacagctggtggttggggtgaaatcagagccaagcaggtggggggatggaagggcatccaacagaagacgtgcaggaatgttactcgctggaaagcaagtcggccatgtgcacgcagggcgaggatnnnnnnnnnnattcatgcccctgtaagccttccacacccatggcgtgacacaggggagaggtgtgcaggaaccccagagctgggtggcctgagatccagaggatgtgagannnnnnnnnnatccaacagaagacgtgcaggaatactcacagctccaggaggcgttacagccatcattggcaggcaagtgttggcggggcatgaaaggggtaccgtacaatgcatgggaggcgcagggagcctggaacgtcttcatcaaactgcgcactgcatgctccaaggactctacatcccagggatccttgacaagggaggggaggaaagtgaggctctcgcctcacagccagatgtcgctgctgcagtcgccgccggggtagcgcacctcgtgcgccagcaccggccccccgggctcggccccgaagtccacgtagaagtcgtggttgatggacagcccgccgttcacgtcgtccacgtcgatctgcaggaggtaggaccccttctccaccaggtccgggtaaaactgcttgtcccagggagagaacagggagttggtcacgtacaggcgcttgccgtccaggctgcacgatgggcaagggggagggatgggttaggttgggaagaaagggcgggtgggtcagtgataaggtggacggaaggtgtgagtttccatgtacctgagctggatcatctggggccctcccagcagcttgtgaccctgcacggttggaatctccggctgctcggtcagccccagctcctccagaccctccgtcacctgcggggggtgagtgctcgccttgacgggtccgtcgcggcggatgctgccgcccacccacaccctccccgccagcctggggtgctctgggtcggtgatgtcgtactgcacgatgtcaccccgcagccagttggagaagtacagatacctgtgggggtgttggggtgggggtgggatggggtgttgagcagggatgcaggggatctcccagaaaagtcacccataaaggtcccaggggcgacgaccggcgctccctcgttcggggtgtcgggcagggatgcagggggttctcccagaaaagtcgcccatgaaggtcccaggggcgacgaccggcgctccctcattcggtctcaaaagggaaatcagaatgtcggtgatgagcgggggctgctcgggcagcgcccagccctccaccttggtccagggctgcttgatgacgggcttggccacccactcctctccgcccggcggcttggtcaggtggatgacgttggaggacagggccgcgccgatgaagccgtggcgcgaggcggggtcgtgcttgaaccggatctccagtgggatcaacccgtcctggcccaggtggatggtctgcttcaggtcccgcccctcccagctccagatgtacaccgcgtcgccgtactctgtgggcacctcggccgggttgaagcccttgaacagcgcggcgggggccccccaggaggtgctggccagcaggtcgtgggccggctggtaccagaagtcgtagccgtactccacctcacttccggaccaggtgcccttgacctccaggttctcatccagcacgacgaacccgcccttggccttgccgtcgggggtgcccagggcggagaccacgatgtcgccgttgcccaggcagtgggaggtgtgcaggaagcccagccccgtcttctcctggatggcggcgggctccaccaccttgtgcaggcgcggcgcgcgggggtccgacacggtgtccacggctgcaggagggaggctttgcgcacaagcaagaggaaggcccgccagccaattcccatccccaaaccatggccacttgccgtagatgcgcccggacttgagggagggcaggatgaggagggacctggacttggaggagttgccgtggcagctgctgcaggcattccagccagagtggtgaagctcatcccccaggtgggtcacgggcaggcggtggatgacctggagaggaaggtgggagaatggagggcccgaccttga

SEQ ID NO: 2992 - DNA, 1824 bp, Chlorella protothecoides
atggacctggtgatgaggatgcagactctcaaggtgagacgcgtttacgatgcagttttgttggatgttttgaggttgggagccccaaagcaggcagcaacccgtagccctcaaatttcagcccctccagcattcccggatctcaccactcgctgtctccttcgtagttgggagccccaaagcaggcagcaacccgtaaccctcaaaattaagcccctccagcatccccggatctcaccactcgctgtctccttcatagtagaagagggcaaaggggatgacggcgaatgccatgacgacgatggcaacgtatatcgcataccacaggatgtccatcggcagcgtggtgctgcagtccgccagcggcaggtccgcagaacaggcgtggacattcgctacatccaaggggaaaaggagcacggtccatatggccaagcaaatgcccaggcagaccacgatcttggggaaccaagcctggttccggtcctccgggtgttggaaggctatgaggaggtagacggaggatgccatggtgagcagccctaccaccaccatgatgatgatcaagaaccagttctccatggcgtggggcggagcgcgggtctcgcccagccaggggaggggccacgggagtcagtgccgggaggggggtgcgggggaagcctcgctgccccaatgttatgcccggcgaatccggtgcagagtacgaaatggtggggacgaagcgcgcccgatcaccagctgtgtgtgttcgccacagttctcggccagccgagacactcttactcgcacatgatatcatgttgcctcctttgtggtcagcgtcgctcgacaagggcatgccaacactattggggcgcctctgaacgaccaccagaatggcgtcctgctcagctggaggtgatcagggacactaatggaatactgggtattccccatgacaaatcttaccgcgcggatttcggcttgacaattcctgcaatgctgcacgttctcatgaccagcaccagccgtcgagctgggcaagggctcgttcggctgacttcctcacactgtgcctcattctcctctgcaagcaacgagggcgtcaaggtgggcgagtccttggagctccctttgggattctcgtgccatgaagtacccaggattcagcatattcctccccttaccctccttcacctgttacccgcccgccagcaggagctccgaagagcccgcagggcatccaatcgtcgtctgagagagctctgcaagggcttggatcgaggggcaaacaccgtgtggagcaaccccgtgcaaggctcggatccgaggttgtctggggaggatgcctggctgcagctgctcctccggcagtgccgctccaagaggaaggcccggcgcatggcagccagctggcgagcggatacgggggaagcacgtggcgccggccattctttcaacacaacgggtcctgacagggacgagggccagggaacagggagtgcccactggtggtggcgtcgggagtctcgcggcgaggccccaggtggtcagtggcgctcccagcgaggtcagacctcgcagacgcagggagatcctggagcagctgacaatttttgtggccaaggaccccaccacccacatgcgcgggaactggctgtgctgggtatgtcccctgcacatagcctcacacgcaaggctctgcggctgtccttcctggaggtcgccaggcggtggcacccagacttacaccctccagaccgccgagccgctgccgaggctcaattcaaaagtgcacaggcggcatacgacaagctcgtgtcgttgctgccgtcctcgtga

SEQ ID NO: 2993 - DNA, 627 bp, Chlorella protothecoides
atgattacattgcacctttcgtcttccgggccgttgcccccgctgaggcaaagggccccgctgcatgagcgtccgggcgccctccggaacctggttgccagtcatgggcagcaggctcccatgaagcgggccctccatcgccggccgctcctgctcctccccttgctcactcctttactcctcgcggtgccaaatgaggcgagagccgcacagtcccccaatggtgggtccatgtgctggccccctctctacccttacgtccctgcagaggcaccgccggcccagtactacgacctggcggaccgcctagtcagcgcgctgggcgccgcgctagacacggaggagagcggcgccagcgagtcggcgttgcgccgcagcgccgaccccgcgcgcgccgccatccgcgagttcaccgccgactgggcgagcgcggcgggggacgccagccacgtggcgctgtccgccgccatccgggagctggcggagcactaccggcgggaggggcagcgagcccgcctgccccgccaggtggtgcagagcatacggcagaagctggagcaggcgcggcaggcagtgcagagcgcaccctcccgtcagctgctcgtggatggcggggtcaaggcctga

SEQ ID NO: 2994 - DNA, 1101 bp, Chlorella protothecoides
  modified_base (565)..(574): a, c, t, g, unknown or other
  modified_base (805)..(814): a, c, t, g, unknown or other
atgattccctcttattttgccttctcccgtggaactcagcaggcccagccatcgccgccagtctccgcggcgccgactccctgcccagtggctgcactggtctgcgccccacccacctctgctgcggcaggtgccaccgacgatgccaaggagcggcggcgcagcctggcggccgcagcgatcgcggcggcccgcgccgccgccgcggcctcggcctcccagctttacggcgaggaaagggtgattgagacgcgtaggtttgcgggaaaggacgtgacggtgagcaggtcggtgccgagcggcggagcagccgccagcacctcgggcgccgcaggccatgcggcgccagagaagaaggggggcctggatgctatgctggcctccctggcaggtcccaagaaggtgaatgtgttggacaagacccggtcagactggacggagtttaaggctggggacgaggccatcgatgcggagctggaggcgcacaagcggtcgggcagccaggtatgtggaagggagtgggaaggatggggggtaagttgcgtggtagcaacaggaacgcaannnnnnnnnngtggaagggagtgggaaggatggggggtaacttgcgtggcagcaacaggaacgcggtgtgcaggccacatgttcctggactactcttccttgggattccctctgcttttggaccttgtacgttacgctacccatgagagcccccctcgtaagaaattggcaatagttggcgtctgttcaaccccccaacccacccctcgcgccttcgtgcagtatttggagaagcaggctnnnnnnnnnntcttccttgggattccctctgcttttggactttttgctgtacgctacccatgcgagcccccctcacgtgcggcagtacgaggcggagagggacctgcgcatgcgagggcgatgatgggccctgccaacgacgcatgcttgctgtgtctttgccactctgagcgctgcgctgcgcccctctgttccattcccattttgtcacggtatcttagttcaacgctgctcccagagtctcactggtttgagagagggagtcatggacaggggcaggggtccaacctggcataa

SEQ ID NO: 2995 - DNA, 1365 bp, Chlorella protothecoides
  modified_base (495)..(504): a, c, t, g, unknown or other
  modified_base (914)..(923): a, c, t, g, unknown or other
atgccgatgaggcccatgactctcctcatgtcggtcatgcaagcatgtagggaagagataggcaatagcgtttgcaccaggtcatgcttcacatcacgcttcttgacaagagtcgaagggaacggtgaggagagtgaaggtaacattgcgatgagacatcctgtcaactgtacctgtgaggcacatgattgcatgggggacggcaggagcttcagatcagttctccgtcactgcgcgcgcgcagagttgaggcctcactctcaaacgcaccagcgtcttctggtgtggggtgcagggtggagaccgaggcctgcagcacctcgagccgcacccacgccctgtcgcaccggccatgccgatcgtctgctgccggactatactctaccacgaggaaaatcaaacatggggtgcgaagagaggctgagcgggggggcatcgagccccaccgcccagcaggcgccggtcttgccccggactgcgtcccgatccaggcgnnnnnnnnnntcccatcgagccccaccgcctagcaggcgccgagcttgccccggactgcgtcccgatccaggcgcccactccctgcgcccgatccgggaggtggctggcgcaaggtgcagtcgcggggatggcctccctgatcattccctctgggcaggccctagccgcgggcgcgggcttcgtcccctctggcctgctggagagcgtcctggtgagctccctgggggcggttgcgtgtgctcgaggcgcctgggaatccccttgcagctccatgcaggggccagggaagagcaggtttcctcaggacatgcccgccgcgtcctgctgggtccccccccgtcttcctggatcagacacgcaccccacgcccgccagcccctgcacaccgccctccgcagcacacgacggagtcgctgggnnnnnnnnnnttgctgggtcccccccccccgtcttcccggatcagacacgccctccccacccccgccagcccctgcacacccccctccgcagcacacgacggagtcgctgggcccgctgggcccgctggcctttgtcacggtcatgtcgtgcgcggagtgcatccccctgttccccacccagcccctgctcctggcctccggcctgctcttcggcacgcgcaccggagcgctgtgcatcctggccgccaacttcctggcgggcaccgccaccttcttcatcgcgcgcggcgtgggccggccctgggcggagcgcctgatgggcgccgacaccacgtccccgctggcgcagcgcgcgcagcagctgcgcgcggtcatcgagcggggcaggttctggcagcaggccgggaccatcctcctcctgcgcatgacgcccatcgtccccttcaggtag

SEQ ID NO: 2996 - DNA, 855 bp, Chlorella protothecoides
  modified_base (760)..(769): a, c, t, g, unknown or other
atggttcgcaagctggtcgtcgccgtagacgactcggcggtcagcaagagcaccctccagtgggcggcagaaaagctgctgcgacccgatgacgagctgcacatcatctccgtgctggagcctgccagtggcggaaacttcgcctcaaccgccgagacggcatacccagtgtccatgcaggaggtgaggcgagctcggggccaatggattgcgaatctggcctggggaggagatgtcgcattcatgactgtcgaacttcttccattgggagtgacacattgctcaccccatgggggtcttgtgtgtgctgttccattgctttacctcatccaacttcttcactgttgcatacagtgcaagcccgatcccttggcactggagagggcacaagccttcctgaagaagtgtagagaggaagcccagaagcagggggtgagtggcggggatgcatcatcctggcacatgtcgcagcttcctttcctacgctctatgttggctggcggcagggctgcagctgaggggctgccagccctgtcagcgcccttgccatggggaccgtgcctcctcaacccccatcccctatccttgctcaagctgacccattcacccatgcaggttgcggacgtgaagctggccacccttgtgacgtgtgtgggcggcgctgcggacactgggcgccacatcgtcgactactcgcggcggcaggatgccgatgtggtgctcatgggttcccgcggcatgggcagcctgagacgtgccnnnnnnnnnntgacaccgggcgccacatcgtcgactactcgcgacggcaggatgccgatgtggtgctcatggggtcccgcggcatgggcagcctga

SEQ ID NO: 2997 - DNA, 738 bp, Chlorella protothecoides
atgcacacctccgtgcattgctcggagggcacgtcgcgccattcgggtggtgtcggaaggcaggtcggcgacaggcgatcattctcccacgtgagtggctggacagctagacaacactgccctcatgtccatcgacggaaagaggggtgcgactccggcttcgtcttgagagcgcgtcgggggcgggttgaacaggctccctcatgcacggtgctcaacatccagccggatggctcggatacctggcgcctgcagacagccatagaagacctcctggcgtccaaggtgggaagatgtgatctcttgagggcaggtagcgatgcagtaatgtattctagttatgaaatcagacagtgccctgctgtgggactgtttgtcggacctacagctatgaggcacccaccccgtccttccctggccctgcagattggcatcattcccacggacaccagccccgccttcgtgtgctgcctccatgaccgtgtggccgtgcaggccatgtttgacatcgccggcctctcggtcagcaagaagttgagtgtcatggtgcggggtatcgcagagttggagtccctcacgacgggcctcccagctgccaacgggccagggcagccggcactcttcagaattctaagaagcaccctgcctggccctgtgagtgggcgggctttgtgtgttttctctttggggctggggaggggaatgaactgggggcagctatgccttgtcaattcatga

SEQ ID NO: 2998 - DNA, 2253 bp, Chlorella protothecoides
  modified_base (1726)..(1735): a, c, t, g, unknown or other
  modified_base (1959)..(1968): a, c, t, g, unknown or other
atgacctccgtcgaggcccctccccgccccaccagcctgaagaagctgggcttcgtgcccgaggccagcgcccgcagctacgagatcgccaccaacatctacagcacagcgaaaagctacgtgccagccagcctgcagccccgcatcgagaaggtcgaggagactgtgacgaacgtgagcagagtgtggcgggggagacttcgggaagtgccccggccccggcgccgatgcaggctgccaccccctgatccccctcacctccccgatcgccgaccctcgcaggccagcgccccgtacgtgaccaaggcccaggacaagggcgccgagctgctcaaggccgcggacgagcgggtgcggaaggtgttgcgaacctgctcccgccagcttgtgccggtctcaggaaggccccaccgtggccatcggccaggccagccaggtgtacgccaacaactctgcctttgtggccgccaccgtggaccgccagaaggcctaccacgcccagaacctggagtcgtacaaggccgcacgcgagcactacctcaaggtagtggagcagggcgtggactacctgaagcgcgagggcctgggcggcgccacgcgcgccgcagtggacgaggtgtcggcgcggctggccgacgcgcgtgccgtccccggcctggttctcacccggctgcaggagtcggtggaccgcctgctgcgcctcgcccccgtgcaccgcgcagtggagggcctcaagcccggcgtggacgcagcctactcgcgctacgcggccctgcacgacggcgtcgtctcctccccccagtacaagcgcgcactggccgcggggcagaacgtgctggcacgggcccaggccacgcagctgtacgcgcggtcgcgctccgcgctctacccctacgtcgcgccctacgcggagcccgccgcgcagcgcctgcagccctactacctgcgcgtcgtggagcacctcgcgcccaaggacgcctgaacagcaggggagcgagcgggggagcgagcggagggagggggctgttggcagcgtgctcggtacgttggcccgggtcatgccctggcagtgtaccctggcccctagcgacccgtcccctatttttgtgccctagagccgtcacccgctgtttccctgcattccctgcacaccccatgccccgtgcccttagctggctgtgctggggcccctattccccgcccagcccccgtgggccggccctgaaccgctcgagatcaaaacctttcggagaacctgtgcaccgcgtgtgtaattgcctagccccacgcatgccatcatgcaagaacggaatgggaaaagagactggattcacagcggcgcggccagggactccaggctgggccgcgccgactccacgggctggtattttggggtctggcgctggaggatggaataggacagccgcttcagcgcctggagcatgtttgggtcgggcggggggattggggggtcacgatacagaggaggaggggaagagtgcatggacgaagcaagcgacctggcttctggaacacaaatcttcctcccgaacgcctctcactggcagggcccacccgatcgctttcttggcggcgctcgcccgcaaccacgccaccatttcaggcgtcaatggaattgttcggctcctcctcctgccctctcccacgacctccagtttccccacttctgccctcaggttttcacgctttcttgccgtgttgacgnnnnnnnnnntaggcctctcactgaaagcccacctgggtccctgtgaggccggggcccgcgccattgctcgtgaacttgaggccggtgaactcgttaacacacagcccggcaaaggcctgcatgttacatgtttggggagggaggcagcgcgtgtggaggtcttgagattctcttttgaggggctaacgccagccctttctcacttgccagacccatgtgccgaagcacagccnnnnnnnnnnctggagtccttcagcgcccaggccctgggcctggccgtgggagctgccgcgccttccaccgaggccgcgctggccatcggccccgccgccatgctcatctccatcgtgtttggcggcctatttgtgaacgaggccaatgtgccgcgcgtcctgtcctggctccccaagaccagcatcatcaaatatggcgatcatgtagatgcccgacttcccaaggctggagatcctttcaagaggctgtgcttcggcacatgggtctggcaagggacaaagggcttgcgttag

SEQ ID NO: 2999 - DNA, 348 bp, Chlorella protothecoides
atggagaactggttcttgatcatcatcatggtggtggtagggctgctcaccatggcatcctccgtctacctcctcatagccttccaacacccggaggaccggaaccaggcttggttccccaagatcgtggtctgcctgggcatttgcttggccatatggaccgtgctccttttccccttggatgtagcgaatgtccacgcctgttctgcggacctgccgctggcggactgcagcaccacgctgccgatggacatcctgtggtatgcgatatacgttgccatcgtcgtcatggcattcgccgtcatcccctttgccctcttctactatgaaggagacagcgagtggtga

SEQ ID NO: 3000 - DNA, 702 bp, Chlorella protothecoides
atgcatgcgcgtgtcatcccctccaaccgcctcgtgatcccgtctgtctgccgacgggtacccgtggacaccgtgtcggacccccgcgcgccgcgcctgcacaaggtggtggagcccgccgccatccaggagaagacggggctgggcttcctgcacacctcccactgcctgggcaacggcgacatcgtggtctccgccctgggcacccccgacggcaaggccaagggcgggttcgtcgtgctggatgagaacctggaggtcaagggcacctggtccggaagtgaggtggagtacggctacgacttctggtaccagccggcccacgacctgctggccagcacctcctggggggcccccgccgcgctgttcaagggcttcaacccggccgaggtgcccacagagtacggcgacgcggtgtacatctggagctgggaggggcgggacctgaagcagaccatccacctgggccaggacgggttgatcccactggagatccggttcaagcacgaccccgcctcgcgccacggcttcatcggcgcggccctgtcctccaacgtcatccacctgaccaagccgccgggcggagaggagtgggtggccaagcccgtcatcaagcagccctggaccaaggtggagggctgggcgctgcccgagcagcccccgctcatcaccgacattctgatttccctggatgacaagtag

SEQ ID NO: 3001 - DNA, 255 bp, Chlorella protothecoides
atggctggcgtggatgggcccctgctctgcactacggtgcctgggcgggatgacccaggcggcgaggagcaggctcccgacctcgcggaactggccgaccgctactgcgctgcaggggtggggtttgtggtggccgaggagggtcagcgctggggtgcgtcgaccgtcatcgacttctcgggggcacggccgactgtcgtcagggtcggggacggagacctggacccttttttgccatacctccctgacgtgtga

SEQ ID NO: 3002 - DNA, 186 bp, Chlorella protothecoides
atgctccaggcgctgaagcggctgtcctttgccggcaccagcatcgggcagagcctggtgggtcagggccgcgtgctactcttctactactggctcacctattccatcctccagcgccagaccccaaaataccagcccgtggagtcggcgcggcccagcctggagtccctggccgcgccgctgtga

SEQ ID NO: 3003 - DNA, 681 bp, Chlorella protothecoides
atgatgtttggtggacggtgtcgccccactgcccagcccccctggaatgctcttgccccagatgcgagacatcagcgccctcttgacaacccctgcgcctccccgccatccttccgcaggctgatcgcggaggtgctgcagaaggaagagcgggaacggggccgcagctggaaatggcggcgcaacacgcgtgccctgggcaaccagatgatcgtgctggaggaggacgcggtgcagctggagctggtctacccccagggatggtgtgcagcgacccctaaagcacaaggcatgctgttgcccgggaggccagcaacttcttgcacaggaggcggcgcatcaggcacacgctgccccgtctcccttccaagagccctgatctcccccagcaatcaacatcctgtgccatcccgcacctcacagggggaggacccggagtacaagtgggtgtggatgatcatgaagtactggctgaagctggtggttggcatcctgagcatcggcgtcactatctcctggattctgcagatcatcctgtacatcctcatctccccacccgtctccccgctcctgaacaccgccttcaccaagtgcgccgtaggggtgtggtgtgggaaagcaggaatacagtttcggggggtggtgacgaggcctgccgtggaactccgcggcgcggcctga

SEQ ID NO: 3004 - DNA, 414 bp, Chlorella protothecoides
atggaggagtgcgaggatctggtggaggcctactggctgcaagtggacgccctgctctcccgcctggccctgctgcaggagcgcatcgccgccacggagcacctggtcaatctggacctggacgcgcggcgcaaccagctggtgtcgctgggcctggccatcgacctcctgctcatggccttcgagtgccacatggccctcacctccattttcggcatgaacctgacctcgggcctggagccgctgcagccctactccctctggggcatcgtggcgctcggcgccggggcgggcgccctgctcaccgcattggtgggacgctacgcgcgccgcaacggcctcctcttcctccccagcttcggactggcgggggcggagggcggcgcgggcgcgccgcccctcaggccggcctga

SEQ ID NO: 3005 - DNA, 2391 bp, Chlorella protothecoides
  modified_base (1004)..(1160): a, c, t, g, unknown or other
  modified_base (1730)..(1739): a, c, t, g, unknown or other
  modified_base (1997)..(2006): a, c, t, g, unknown or other
atgctgaaggcggaaggtggtgcgcaggtagaccgatcggcatggtcttgctgtggaggtgaccctcacagagatcaatgcatgagtcttcagcctgcagcaaggatgagccgctcactgccggttagcatattgcaaccaggaacaggccagatccaatggcatgcaggtggttttggtggggttattcgaggagttcgctgggacgagtgcttgacctcatgtgctactcatgaaggactcatgtgcagcacactcttaaagaatgaaatgcatcactccatgcagcaaggacgagatggctacgagttctcaaatctttgcgtacccatgatgcagggattcatgtgcagcacactcttaaaggatgaaatgcatcactccatgcagcaaggagaggcaatcttgcaccaagtgggagctcacaggggtcgttttggcgggaggcaaggctcgatcggaatggcttcgccaaacacccagctcgttgagagcctggccccgattcctcacaggaggagacggtcgctcgagatcatatatagattgctgaccagtgaagctggtgggagtgcgttgccacatctggagcctggaaaggacggtgccgctggttgtgaagtgatggttcgcctcctcgtcggaaatcatcgagagtcctctaccaggagtgtcaatgcgcacttcatacgtaactccaacttggtcctgacagccgagcagcgcaccaccgtcggtcatgagccggatggatccgcagagaccctgtggggcaacatgcggggcaagatgggggacaaggtgcagcgcagcctccccgagggcctcgcagagcgcaaggccaaggccaagcgtgacgccacggccggcgatggcgccggagccaagcggcggagggtgcgttggatcgagacaagggaatttcagagtcttgggaagttccagctttggccttgcccaaatatttcgctgcgagatgacctgcatctcattcctcacgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggccgtgctcaagaacgaccggctgcgggtgagttggtgttctggattggccgggacggcagctgcgccggttggcgagggagcgtggggagggaccctgctcatgcattacacatggaaggggcctgcccaggggcgctgggccagggtgccggacgcagttcccatgtcaatcgccaggggtgggtgtgcatcgaatgcgggccggactccaccatcatgttcaaacctgcctcccacccaaccttcccctccgcgccaaacccctccccctccccaaataacacaacaggacccggagcgccagaaggagctgggcacgctgctggacagccccgtcagcgacgagcgctttgcgctgctggtggagctgggcaagcgcatgaacgactgggcgcccgagtcggccgcgctggcggcgggcagcggcgaggccgcgctggacgaggagggcgtggccgtggagtttgacgacgagtctgacgaggacgagggcgaggagctggtggacgtgctggatgacgaggaggaggagggcggggatgccgaggaggaggccggtggcgnnnnnnnnnncgaggagctggtggacgtgctggatgacgacgaggaggagggcggggatgccgaggatgaggccggcgggtcgcgcgccggcgtgcgcaccggcggcgtcgacgtggacgccggtgaggaggagcgcgcgtcgggcatccccgtgcaggacatcgacggctactggctgcagcgccgcgtggcgggcgcgctgcccgcgctggagcccgctgcggcacagcgcaccgccgacgagctgctggaggcgctggcggcgcnnnnnnnnnngcagggtccctccccacgctccctcgccaatcggcgcagctgccgtcccggccaacccagaacaccagctcacacgcagccggtcgttcttgagcacggccaggacctcgtcagcggcgccctgcagcacgctttcctcctgcccgcccagcaggtccaccacgacggagagcagggcctcgtaggccatgcgcgtctcctcggtgcgggggcgatacaggcccgcggtctccacctccagcaccgaggcggcagtgggggcctgtgtgaaaagggagggtgtggtggcgtcaggaatgagatgcagccctgggcaggtgctcatttgcatcaaccagcacaataccactactggatacgtatgaagtgcgcagtgacactcctg

SEQ ID NO: 3006 - DNA, 780 bp, Chlorella protothecoides
  modified_base (200)..(209): a, c, t, g, unknown or other
atgggtgggtatgcggatgacttgcggggtagtgaccgagatgtcggtcttacacgctcggggcctgcagtctttgctccccgagatcgtgtgcacatctgcctcgcatgtggaggtcggtcggtgttccgtgtctgggcgcgcagatctgaattgaacgcttcctccgggcggccagacctccgcctaccagctcctcnnnnnnnnnnatcgtgtgcacatctgcctcgcatgtggagctcggcctgccgcagtggtccctggctggtgttcaacctgaaatccccggcctcctcgacgagcgccgaggctgctgggacggcaatggcagggtccccgggtccttcattttttgaacgacatgacaacgtctacctctacgtcccgaatcttataggtgtgggtattcctctgttcagcggtcacacagtgtctgagctccggcccagtcgccccactcccccctcccttgctcactcctatcccccagggtatgctcgcattgcctttgctctgtatggattcgctgtggccagcacctctccaggggccatggtattgtcctatgccctcagctttgtgtgtgatgaactggacggccgtttcgctcgaatgctgaatcagacctccactctgggccaggttctcgacatggtgacagacagctttgcagaaccctatgataggttgggcggaccatacaacagcggcaaagtagcactcgtctgcgccgtgcttatatccttccgccctgtggctactgaggcatggccctgctga

SEQ ID NO: 3007 - DNA, 495 bp, Chlorella protothecoides
atgtggagatcatccctcgcggtgtcgctgggcactggcgtgggcaccctggtgtgtgtgggaggtgcaactctcctggtcagcagcgtcggcctccacgccgtcaaagctgtagtgaagcaccggcaggcaagttgcaggcctccacgatgtatgaaatatccagtgttcttcgcatcacctcgaactccagtacatcacccctgcaggccaagcggctcgtggcctgtcagccatgcagagcgactgggtaccgctcctgtgacatctgccacggtgaggactcatggacatggcgagaagctgatgctgtgtagagcaccggtctccgcacgctcgctcaagcagcaacaggcccaaagtgccgcgacacagcccgagcctcaggtcctctgcgtctgtcccgcctgtggttccactgccaaacagcggtgcctgaactgcctgggcacaggcaaggcgctgccagaggaggctggtgtggcatctgcttga

SEQ ID NO: 3008 - DNA, 627 bp, Chlorella protothecoides
atggcctacgaggccctgctctccgtcgtggtggacctgctgggcgggcaggaggaaagcgtgctgcagggcgccgctgacgaggtcctggccgtgctcaagaacgaccggctgcgtctcgtcggcggtgcgctgtgccgcagcgggctccagcgcgggcagcgcgcccgccacgcggcgctgcagccagtagccgtcgatgtcctgcacggggatgcccgacgcgcgctcctcctcaccggcgtccacgtcgacgccgccggtgcgcacgccggcgcgcgacccgccggcctcatcctcggcatccccgccctcctcctcgtcgtcatccagcaccacgtccaccagctcctcgccctcgtcctcgtcagactcgtcgtcaaactccacggccacgccctcctcgtccagcgcggcctcgccgctgcccgccgccagcgcggccgactcgggcgcccagtcgttcatgcgcttgcccagctccaccagcagcgcaaagcgctcgtcgctgacggggctgtccagcagcgtgcccagctccttctggcgctccgggtcctgttgtgttatttggggagggggaggggtttggcgcggaggggaaggttgggtgggaggcaggtttga

SEQ ID NO: 3009 - DNA, 282 bp, Chlorella protothecoides
atgggcttctgctgtgtgtgctgtgaagtgctgtacctatgcctctatctacttgcctggccgcagtaccgcgcctggggagtgctgcccctgccccagacatggttgcagctgggcgggagcgcaggcgtgtgctccgctgaagcacgaggcatcccgctggtggcgctggtcgccttggctgcgctgcccggcgtcgcagtgaagcagtttgtgaacgtcgtgcagctggggaatgccatgaccaccctcgtccagctggacacagcaaagaggcagtga

SEQ ID NO: 3010 - DNA, 309 bp, Chlorella protothecoides
atggcggatgagtccatcatcgtgcggggcaacggcaccatcttcctgggcggccctcccctggtcaaggcggccacgggcgaggatgtgagcgcagaggagctggggggcgcggagctgcactgcaccacctctggtgagccgatggggaggaagggggcgggcgctgctgctctgggagtggcacaggtgtgtcgcaacggcaaaggctctgcatcatgcgcagtacgcccagagccagacgcccgcacgccgcggagcgcaccgccggcacgctgctgccccaccctgcccccttcatcccccccc

SEQ ID NO: 3011 - DNA, 261 bp, Chlorella protothecoides
atgtcggcaggcaccctcaacgaagtcggcgtgcgtaatcttcaggcgtcaacaacccacccaccacccttcccccaggcggtggatgtgctggtccgcacacaaaaagtggcctatgacttcgaattcttctccctggatcaagaggcagatgcccccgtcaccgtcctgtcctgcggccgttcactgctaaaggacgcgctgggcacgagcctgcccctggctccaaccgcgccgctgggtgaggggaggctgccgtga

SEQ ID NO: 3012 - DNA, 942 bp, Chlorella protothecoides
atgccggccttcgccatctccttccgacccagccttggggctgggctatgtcgaggtcatgatagcggggtcgtccggccctgcccacgagcaggcagcgtgcgggtgcagggcgcgaaggctgcccccaccaccactggtcggcagcccaggaagaagcatggagatttccctgtggaggagacccgtcgtgtagatgtgaggtggtttcggacgctgccgcgtgtggcgcggcgtgggcaccaggggcgggtcctgggcattagggacagggtcacccatctacccttgtccctcggcctatttcccccccccaccccctcccccccccagtcggtgggcctggtgcagtggtacccaggccacatcgcggctgcggagcggtccctgcaggccaagctggcagcggttgacctggtggtggaggtgcgggacgggcgctgccccgtggcaagcgcccacccggcgctggcggggtggtgccgcggcaagcgcacgctgctcctgctcaaccgtgtggacatggtggggcgggaggagcgcgcagcatggtcgcggcacctgcgggaggcgggcacgcccgccacctggaccgacggtcggcgcggcggagtacgggaggtggaggaggccgcggcgcgcctgggcgcggcgctgaatgcgcggcgcgaggcgcggggcctgcgcccgcgcgccgtgcgcgccgcggtggtggggtttcccaacgtgggcaagagcgcgctgatcaaccgcctgctgggtcgtcgcgcggccgacagcgccccccgccccggggtcacgcgccagctgacctgggccagggcgggggagcagggcaacatcgacctgctggacacgccaggtaggggaggggtctgcccgcaggatggcgcctgccgggctcgggcacccatgcctgcagctgcagcgctggggttctag

SEQ ID NO: 3013 - DNA, 519 bp, Chlorella protothecoides
atggagggggaggggtcagcccgctggacggcgcctgccgggctcgggcacccgtgcctgcagctgcagcgctggggttctaagcctcccgaccctaccacaagcatcagcccacaagccagcatctgcatgcaatcatgccccatcatcccaatcttcttcccttcccatactccacttctctcaggcatcatcccggtcagcctgaaggacaaggccgccgccgcgcggctggccatgtgcaacgacatcggcgaggcggcatacaccgcctcgcgcatcgccgcctccttcctggaccaggtcagcgtcctgccgcgtgaggcagaaatctgggcggccatcgaggcgcgataccgagtgcggcggggggggatcaccagcgaggagtatgtggagcgcatcgcgcagcgcctcttcaatgcggaggtggagagggcggggcagcgcatcctgcgcgacttccgggacctgaaatttggggagatctgcctggaggtccccagtagcaccgtgtga

SEQ ID NO: 3014 - DNA, 258 bp, Chlorella protothecoides
atggacctgccatgcaactgcatgggggtcgccacggcggcccgagtcccggtgaagcgctacaacttccttgttcccagtgttttccaagctgccgaggtggaacccagcctgggacagacccccggccctggggttgaccggagcgtgaagaagctttgcgagtacctgtctcgaaatgagcatcgcatccccaaggtgcggagggggttgggtgcccaggccggcgacacacgagtctttatggtgccttcgtga

SEQ ID NO: 3015 - DNA, 735 bp, Chlorella protothecoides
atgcttcattcctcaaccccccccgattcctcactctgcagatgtgccgttttctctggaggacagggtcaaagcggtggacgccgcctcgaggttccaagacgcctcgggccccactctggcagaggccgcggagctcacagaatcgctgcgaaccaacgtgcgtgtgttggggaagtgttggaagactggtttgcctgcggacctgctggtggagggcgtggctgcgcaggcagccaacctctcatgcaccgcccagaacacccccatctgttacagattacttttgcaagggagtacctgccggacgtccagatccaggagaagcagatcgagtacctggtggaggaggcgcggcgcggcgcggtcatgggccaccgcgcggagctcttcgcggtgcgggtggcccgagtgagcgcggcgctggagggccgggatcgcgtggacgccgatgacctgcagaaggccgtgcagctggtcatcctgccgcgcgccctgatcaaggaccggccgccggaggtgcggggtttgagggggacttttgcctgttctgggaaggaggggagacgagcagccccccccgccgccgccgccgccgccccccccgcaagaccagaaggaggaggaggaggagcagcaggaggagcaggaggagcaggaggagcgggtgagcgggcttggattggtgttcaccgcggggttggcttggcactgcatgtggcctggacctcgtca

SEQ ID NO: 3016 - DNA, 1716 bp, Chlorella protothecoides
atgggggattctgttttcgagggtctcacacggttcccgtctcttgtgtggaatgccttgccgagctggtatggcgcccctctgcagcctgagcttcagattgtgcatggggagggcgcgcacattccaggcggtcagcattatctatccgatttcttgcatggagacagcgcgctgcaggggagccttctgtctccgcggcatggcacagagctgcagcgcattgttccaaataataatataggtaatcaagtaccaaccggggacagccgatcaatcatctccgagatcccctttgagcgctccaaccctggggtggggggcgacaggggatcaccatgcatgcctccatgcgaacggccccggtgcgcccatgccggccccggggtctcgtcaccaaagcggtggcggaggtcgcaggtgtgcagagcgtcaggggttgcggggaggttctgggtccaggattcttggcgagctgagtttaacaacgtcattgcaaagtcgatagggtgtgataaatgccgccatgatgcaatcctctgtgctgtcagccacactcctccacgcagcactgacgcaccccctgttccagaccctcccgccggcgaggcctccccagagccggaggcgtacggcgcactggggccgcgctcctacccactggcggcggtggtgggcatggaccacatcaagcaggccctgctcctgggagcggcggacgtgggcctgggcggcatcgccatcgccgggcggcgcggcaccgccaagtcggtgatggccaggggggtccacgccttgctgccccccatcgaggtggtggagggctccatctgcaatgccgaccccagtgaccgcggggggtgggaggtgagtcttgtggtagccgggggggtgccgagctgcttttgtgcgtcggtggaaggttggcgggccgtcacccctgcccgcggccccctccgatacctgttgctctttcagtcacatgttggcactgagccctcggaaccttgcacgatgagctggccggctctggcatctctctacaacagttctgtgacaaacgcgtcgccacccccccggcaatgctcaccaggatgggttggaggccaggctgggtcccggcccaccccccaccaagatcaggccggcgccctttgtccaaatcccgctgggcgtcacggaggacaggctcgtgggcaccgtcgacatcgaggcttccatgaaggcaagggcctcatagacggtgcacaagagccgacatgttttcctgccaacagcacagccactcggtttttctatcgcgtgtctctacctcggtgttcttccccatccaccgtggacctccgtccccactcccacctcccacagctgggcaagccggtgttccagcctgggctgctcgctgaggcccaccgcgggatcctgtacgtggatgagatcaacctgctggatgacggagtggcaaacctgctgctcaccatcctgtctgacgggatgaatgtggtggaacgtgagggcatctccgtgtctcacccgtgcaagccgctgctgattgccacgtacaaccctgaggaggggaccctgcgtgagcacctgctggatcgcatcgccatcaccctctctgcaggcgagctggatggggtgacggcgggatgggttaaaagttccccacttgccataccgcagtctaccgcaactttcaccaagtccgcctga

SEQ ID NO: 3017 - DNA, 570 bp, Chlorella protothecoides
  modified_base (234)..(249): a, c, t, g, unknown or other
  modified_base (484)..(493): a, c, t, g, unknown or other
atggctcctgtgtggggcgtagttgctgatcgaaggatggggatacatccctgcctggccaaggatgtcctgcgagcagacgaattcccttcaacctggcggcgcccatatctcactccaccagataatactttcgaggatgtcgaaccggtggcagtcctggagagccggaatgagggggaggacagggagtttctggtcaagttccacgactccgaagagactatgcagtcnnnnnnnnnnnnnnnngctgcgaggtatgtggccgaggacgtgatgcaggactttgaggcggggctggagtatgcccagggcctggaaatcctggacatgcgccagcgtggcgacagcagggcctacctggtccggtgcgtgactgggctcaaagaagagtgtagtggagattcggtcctcttgttcagtggggtgttggagagtttggtgcaggtatgggtagctgggccgtcgacccctaatgcctccnnnnnnnnnnctggccaaggatgtcctgcgagcagacgtcggctgacctctatgggctgtggtgatggtaagaggaacgctgtatga

SEQ ID NO: 3018 - DNA, 1092 bp, Chlorella protothecoides
  modified_base (231)..(240): a, c, t, g, unknown or other
  modified_base (621)..(737): a, c, t, g, unknown or other
  modified_base (822)..(831): a, c, t, g, unknown or other
atgtgcccctcgccattgcctgtccttcaacaccgtgtttccaaaaacagggaacctgccaagaatctggccgatgacctcctccgcgactttgaggacaggtggtgggccgctgctcgccagggtgatgaggagaccatgctggccatgatgaaggtggccaggagggttcatggaggtcgtactgtgaccaaaggtgcagtgctccatcgtgcatccaccacccaactnnnnnnnnnntgccttcctagtgcatctcatgggcaaggagcggagcaggtgcagtgctccattgtgcatccaccacccaaagttgcatcccggtggcaggccgacggcaaggtcctggcacgcacgctggatgaagagcggcattcggccctccactttgcggccgcccgcgggaaacccgagctggtgaaggccctggtccaagcgggagcggaggtcaacctgccagacagagccggctctgccctactgaaaacaaaatccaacggcttgtgggcatccctcgccgttcagctctgtccgcctgtgctctctgggcccaaccccctcccctccctttcttcggcaggctacactccgctgcacatggcctcaggctacctccacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaggcgtgcaaggtccggcagcatcttggagctgcacttcagtttctgcagttgcccccaccactataaagcccacattcagnnnnnnnnnncggcaggtgccgatccggagcaggaggatgcccagggcaggaggtgggtggcgtgttttaggtggacttggaggcgtgcaaggtccggcagcatcttgcagctgcacttcagttgctgcagatgcccacaccactataaggcccacattcaacactcctttgtctgcagtcccctgggccttgtggaggggctccgagaggccctccccaccaacaacccggccctcatcgggcggcgcatggccttggaggacgtggtga

SEQ ID NO: 3019 - DNA, 1461 bp, Chlorella protothecoides
  modified_base (987)..(996): a, c, t, g, unknown or other
atgccgattggcatcgcagcgatgggtgggaaggcgtcccctctcagttctcccttccttcgtctaaattcgcgccctagttctcagctgtgcggcgcgctcgcggacacagcgacttcaagccaccaccagctaagcaccatgcgatacattactcatgttgctaaaagccatttcactaatttctgccctccagtagagctgccgctagtgtctgccgtccctcacatccaccctcgcgacacgccagtgggcgcagcagtgccaccgcggagcgcttgcctggccacatccgcggcagccctttcgtacttagacatgggtaaggcaaagcctgcacatcacaccagcgctgaactcagggccaaggccagggcggccacccagaatgtcggtggtggggcagcaggcaaggtggaccggttaggaggtcaggcaggacaccagaagtttaggtgggtgggagggatcaatgcttgccggaggaggggtagacacatgcgagcacaacagaaatcagtgcctggactgaccacagctcttctgacagccgtcactcaatctcctcaggtgcaccgtctgcggtcagagcgcccccgacatcaagaccgctcagattcacttcgaggcaaagcacccgaagatgccctgggaccccgtggcggccgtcgcaaatgtgcacgagctccatggcggagttaccacaaaggtgacgttttgttgttgtgggcaagcttctctgacagtgggagagtttgcactgtgctttggccttcacatgctgtgggcgtgattgccactcacccctctagatggcacaaggccatgccggagtgcctcaacgtctgttggtctttctgctgcccgacagctcaagggccgaaactcatatcgtgcactctaatgcacgctccatcatccctttctttccagggggtcgctgtccgtggaagcatgaagaaggtgcactgtccatcgtttaaactnnnnnnnnnncgagacctcattcatgcacccaacaagcatagtaggcagtgtcctttagaccctcgacactcgctgagggtgcactgtccatcgtttaaactgttccaggctatttttatccatggagatgctggtccttggcatggacttgcatcctgcaaaggcgtgcttaggcactgtaagcaccctggtgagccgccggattggtgggtagggtttccatggccggccgtacaccgtctcgcggcaacatctgggaggtgtcgcggacatgagcccgcagacatgcgcgattggaccccgatgtaccatcgtgcgagcccgtctgacatgggcaggctggcgcgggaatttcaggaacgttcgcgcaatgttcaaagcttccaactaaggaggtgttttcctaagtgccaggatcgtgctccgggtttcagggtacacgctgggaggaagctgctcatggtaagagaatga

SEQ ID NO: 3020 - DNA, 2475 bp, Chlorella protothecoides
  modified_base (1475)..(1484): a, c, t, g, unknown or other
  modified_base (1879)..(1888): a, c, t, g, unknown or other
  modified_base (2444)..(2453): a, c, t, g, unknown or other
atgatgaagaggagatcatggggaccttttcgatggtgtgccaccagggagggcgtgcaagctgtgaatccagagcaaagtgtctgctccacttccccttgccgtgctgcctggcaacatgtcgcatccttggtctcttgcctctcccagattttctggtacctgaccatcattgtgctgatcaagtacgtaacatttgccctacgtgccgacgacaacggagaaggtgagccaaggtgcctagctggcacgcggtgccttttcccatggaccatgtcgcagacagcccatttcctcgctggtggtacattcgcgctgtacgccatcataagccgcgcctgcaacctgaggtctggcggcgcgacccacacctccgactttgagctctcaggctacgaccccctggcatcggccaccgctccccagggctcagacgtggcacccgccccaaatgcgaatgtgaaagtgaggagcggcgccaatgcgcgtgtcaagagtgagtcgtgcccggagggtgcgctggtaccattctccatggcttcaggagggcatgctgcagaattgcgctactcacaactgccacgcccacccatcgtcgatggcgtgctcacccccgcgatctcggtcgtgtcggctgcgcagggcatccagtaccagtcccacatatccaacggcgagttagggtctgttgggtgcaccttgagagatctcatgtggattgcgacggagggcagggtcgggtctgagtacttgccgctcgacatcaagcaggccatcaggaagattgtagactcatcattcccctctacaacagatgctgtggtggggattagcatcggtatcattgtcatcatcttctcagttcagcagtttggcaccaagaagatcaggtgtggtggtccatcttttgcatgctaccacggtctcgggtgtcttgctggacattcacagaatttgcagcttgctggtctccaagctcggtcaaccagaccctcaagctcccctcctgacccaccctgcagctacctctttgctcctgtcaccaccatctggttcctcgccatcgcggccgtaggcctgtacaatatcttcaaattcaggcccgcagttttcgcagccatctcgccacactacctgtactactactggaaggtgggtctgctgagaaggagcgtggaagagggctccgtactcaagtgcattgctttggcctcttctccatgccaggctggtgctcatgaggcatgggtgaagctggggggcgtcaccctggctctcaccggcgcggaggcgctgtttgccgacctgggtggttgctcagcaagattggaggtctctgtctacacggtcttcttgcagaatgaggggcatttcagtcctttgataaacccattcactcctcaacaaaccgccagcgggcgtactgcaccagactccgccaaactgatgcgccctggccccgtgcctgcccctcnnnnnnnnnnaaatgagtgtcccgttccaaccagcgagcacactgcaccagactcagccaaattgatgcgccctggccccgtgcctgcccctcccaaaccacaacccccaccccttgctccctcccaagcgcagaccagcttcatcgcgttcgtctacccctctctggtgtgtgcctacctgggtcaaacggccttcatcatccacgaccgctcggcggcgcccaccgccttctggtcttccgtgcccaagccgatctactggcccatggtggtgagtcgccctgcattgaggaggggcatggttttgcccaggattacgggccgccgggacgcctctttgctcagagaggtcccggcgaccactccctccgctcccacctcccctccaggtcattgccactctnnnnnnnnnngctcctctttgctcagagaggtcctggcgaccactccctccgcccccacctcccctccaggtcattgccactctcgcggccattctcgcatctcaggccatgatcacaggctgtttctccatcgtgcagcaggtgccgggtcaggcagggatgcacctggtgtgatgaagtgtgttcaagggaggccttgcccgtgcggcatggccatccccccttggaatcgcagcaactccttttgccccaagatcatggtggcatgccagcctatgaggcacaatgacccctcacctacaggccgtggccctaaactgcttcccaagggtcaccattcggcacaccgaggcgacgcaccgggggcaggtacctgggccacttccttggtagaccccgggttggccactggcctgaccctgccatgtgcatcacaagcctcccccgaatccagtgccgcccacagatgctcaccctggggaacacgcatgcccgcagatctatgccccacaagtcaactgggtgctgatggcagggacggtgatcgtcatcggcatattccagnnnnnnnnnnagcccacagatgctcaccctga

SEQ ID NO: 3021 - DNA, 492 bp, Chlorella protothecoides
atggcggggacggtgatcgtcatcggcatattccagaccgggcccggcatcggcgcagcctacggtgagaggggatcgttcatgtgcctggctggcgtgacgcagccaggcaaagggccatgggctcttccctgcccagcagacccatacccttgcgcactggcaccccagcagcctccgacccctgcccctcaccaccatccctctccaggtctggccgtggtttccaccttcttcctcaccacctccctcctgtcactggtcatgctcgtggcatgggagtggaattggggctgggtgctcctcttctggctgccgctctctacgctggagggcatgctcctctccgccaacgccctcaaggtgtgtgttggcggcgagcattgtttttgtgatcgctggggcagcgtggctcagcaggcacctggcggactcgagcgagggtcgacgtgcttgagcggaatggcagaccatgggatgtggacagactga

SEQ ID NO: 3022 - DNA, 1032 bp, Chlorella protothecoides
atgccagtgaccacccccgccatcaaggtggcggcggtgcgtgccctgggcgcgggcgtggagctggtgggcgagacgtttggcgaaaccaacacacacgcccaggcgcgcgcggcggcggagggccgtacctttgtcccgcccttcgacgacccctacgtcatcgccggccagggcacggtggccgccgagatcctgcgccagaccgacatggactccctggacgccatcttcgtcgccgtgggtgaggcggggggggccgagggtgaatgggaaaccgggggcgcgttcgaggcatgcatgaaggcagactctccacacttccacccacttacccaccccacacatcaacacacacacacacccctcccaggcggcggtgggctgatcgcgggcatcgccgcctacgtcaaggcggtcaagcctgggatcagggtgtacggggtggagccggcgggggccaacgccatggcgcagagcctggcgcgaggccggcgcgtacagttgtcgcgcgtggacggcttcgcggacggcgtggcggtgaagcaggtgggcgcggagaccttccgcctgtgccgggccctggtggatggcgtgctcctggtggacaacgcggccatcagcaccgccatcaaggacgtgttcaacgagacgcggtccatccttgagccggcgggcgcggtggcggtggcaggggccaaggccttcctgcgccggcccgagggcaggggggccacggtggtggcggtgacttcgggggccaacatgaactttgaccagctacgggttgtgtcagtggagaaccgtgcgggagggctgcccgatgtgtgcgcaccttggtcctccacgatcaacaccatcgtactcgaccccctccctcccatctcgtgcacagagatggctgacatcgggggcggggcggaggccatgctggtcaccaccatcccagaggaccgcggagcctttttaaacttcatggagattgcgctggggggcagcccggtgtccgtcaccgagttcaagtaccggtga

SEQ ID NO: 3023 - DNA, 897 bp, Chlorella protothecoides
  modified_base (336)..(345): a, c, t, g, unknown or other
  modified_base (838)..(847): a, c, t, g, unknown or other
atgacaactcgcaatgacaacccaaatatcgttacgcacatcactaatcccaaggcgaaccttccccagtccctccgattgtatgtcaccagctgcttatgcaactccttatgtgcatcgtggccttcccaggtcccggcttcagcagcagctccggacacccgtattgccccctgcgctacagcgcggacgcgtggtgggtggcagggatccccgaaactggccacgactcatatcggtgttcgagggccttcggggcagagggcctcgtacgcaaccctcgcccaacccgcgacagcgcgatcaggacacatttcagaccatcggcacacacgnnnnnnnnnngcaactccttatgtgcatcgtggccttccccaggccccggcttcggcagcagctccggacacccgtagtgccccctgcgccacagcgcggacgcgtggtgggtgggagggatccctgaaactggccacgactcataccggtgttcgagggccttgggggcagagggcctcgtacgcaaccctcgccctgcacgcgacggcgcgaccaggacacatttcagatcatcggtacacacaccgaaagttaccaaacctgcttcccatcggtgacaagtatggtttcaacagctcagtgaccatcttggctccggcaggtgccgaggacgagaccttcgagctggtggacgaggacggccgggtagtgggtaccgcccctcgcggcgactgtcacgctcgcggcctgctgcacaagtctgtcttctgctgggtgatggaccccgagggcaacatcctgctgcagcagcgtagtctggccaagaagttggggcggggcnnnnnnnnnncctgtcggtcgcagaacacttgcagccgggagaggagtatgcggaggtga

SEQ ID NO: 3024 - DNA, 765 bp, Chlorella protothecoides
atgcctggtcggccgccgcggccgccacccacccctgctgcgagggctacttctgcccctcgggcctggattgcgtcatgccctgtccgctgggcgcctactgccccaggtgtgcttggtggggggtggggttcaggggaagggctcccgggccgttccagcagggccggctgggcagggctttgcacacgggagtcccccaacacggacaatgctctcatgaacaccctcacccacaccgcctcgactcaccgtggctcccgccacaccaaatcacccatgcacagggccgtcccagcgccgccgccgcctccctaccgcaccgggcaccctggcgaggacctggacatgtggtgcgcgccctacgcctacaagcgccgggcggggctgggctgcggcggcgccgacaagtggggcatcgttccgcccgagcacgctttccccgtggccgactggagcgagggcaccggatcggtgtactgcagggggggttcctactgccccaccaccctgcgcagcgtgccctgccccgcccggcacttctgccgccaaggcaccactgagccggagacttgcccccccggcgccgtctgcccgccgggcaccgagatcttcgacgacaacttcacaggtgcgcctgccggaaaccagcgggggagaccgattgtccttgcgcttgcgcagccgccggccggcagggtatttggtccgcagaagtgctcgccatgggcacgagcgcatgcgtatgggcctcgccgcggctga

SEQ ID NO: 3025 - DNA, 1668 bp, Chlorella protothecoides
  modified_base (372)..(381): a, c, t, g, unknown or other
  modified_base (791)..(800): a, c, t, g, unknown or other
  modified_base (1066)..(1075): a, c, t, g, unknown or other
gagcgcggccggccgcgaggtccgctacgacgcggccctgatctctgccgcgcagcgcgaccccgccgccatatcgcgcctggaggccgcgctggccgacttcgtggccggcggcggcccgcagcggcgcacgctgtggcccatgccgcacgggcagcgcgccgtggcgcacgcgctggcggggcgctacggcctcgtcagcgtgggcgtgggccaggagccgcagcgctgtgtccaactgctgcgcacgcccagcgcggccctgcccctgcgcccgctgtcgaggttggtcgatgtttcttggtgtgtgaggagggggagggccccggagaagcagtcgtacggacatcccctcgaccccgcatgccttcnnnnnnnnnncagcgctgtgtccaactgctgcgcacgcccggcgcggccctgcccctgcgccccctttcgaggttggtcgatgtttcttggcgtgtgaggagggggaaaggcccgagagaagcagtcgtatggatatcccctcgaacccgcatgccttttcaagcgctcgacgccccgcccatcccccgcatccccagggtcgcgccgggggtcacgcctgccgagctggcggcgatggaggcggcagaggccgaccaccccgtccgcttcacggaggtggccctgtccgccgacctgcactactacctgcggcgctgggagggggcataccggctggactgggagggtgcggacgtggccatcgcccagttccccgccgccgccgaccagaaaggtggggtgcacgcgggggggggggnnnnnnnnnncgtggccatcgcccagttccccgccgccgctgaccagaaaggtggggtgcgcgttgggggggaaggtgtctgggatcgggacttgcccgggcagaacggtgtgcgcccagtgttgcccttgcgctccggcactgtggccgtgatgtggcctgtcgctgcgacggtgcccgtcttcttcccctcgctgccgggcacaatcgacggcacggcctgcggggccagggtgccggtgctggatgcttttggcggcggcatccgcggcctcnnnnnnnnnntgaaatgtgcaagcactggccttgatactggaccccttccgacactgcgctcccggcagaggtgctggatgcgtttggcggcggcatccgcggcctgttcaagatcgaccggtcctggacccggggggggcccctgcggcgcgcgcgcgccagagccaggagcaggacggaaggtgggcggtgatgaagcggccggtgcgggcggccgaggcgccggcgcggccgcagctggcgcaggggtttgggtggcagttgctcggagtgccttgaagccggggcaggtgcttgaagctggcctggactgcccggtgatcatgcatggggttgcccctgtacattggacgcagccacacccaccatgttggttccacaacccagaagccactgcttacaaacaaaggtggagcagggaagcaaagagctgcaagggtgacattgtacaaggccagaatgctgcgcgggtatgcattggggaggctaggatctcaggcgagcagcggggcaccccccctgcgcctgctgctgatgctcagctcgtcaaaccaggtctccgtccgcctggcgaacaggggttggacggtccgaggagatga

SEQ ID NO: 3026 - DNA, 396 bp, Chlorella protothecoides
atggcccagctcggaggcgacacggtcgccgaccacagcgaccccctgcaggcggtgctcgccttcctgagcggtcggtgcaggctggccgtggtcagcctgggggaggatggctgcatgatgcgcgcccggagcggcgacgaggccaggggccgcgcccggccgcgccaggtggcggacaccgtgggcgcgggcgacgccttcacggccggcgtgctatggggcgtgctgggcgggcacagcctcgccggcgccgcgctggcggggtgcgaggcgggtggcgtggcggtggaggccgcaggggcggagccgggcgtggctgcgctgacggcgctgcgggcgcctgttgccagaacacggctcgacagggaggtgtgcgctggacgtgctgaatga

SEQ ID NO: 3027 - DNA, 315 bp, Chlorella protothecoides
atgcccccccccgggaccttccccgcgacgccctcaggctcgacgccatccctctcgtcaatggcagaccatgcaaacggcgcgggcgcgcagccgccagacggggctggggaggcggggccggcccctcccccttctccacggccccagctgcacatcgagttctttgcgctgggtctggccctgggtccccgccgcaaggcggtgctccagggcgtgactggctgcctggcggcgtcgcggctgacggccatcatgggtccctccggggcaggtgagcaggacctggctgcgacgccagctccggggtgttga

SEQ ID NO: 3028 - DNA, 294 bp, Chlorella protothecoides
atggtgggtcaggcagatgccgaggacgagatattcgagctggtggatgaggacgaccgggtggtgggcaccgcccctcgcgctgagtgccactcccggggcctgctgcaccgcgctgtgtactgctgggtgacggaccccgagggcaagatcctgctgcagcagcgtagcctcgccaagaaaatggggccggggcagtgggacctgtcggtcgcagaacacttgcagccgggggaggtgtatgtggaggtgagcagggcttggtgggacactgccaggcactgcgggacctag

SEQ ID NO: 3029 - DNA, 1122 bp, Chlorella protothecoides
atgcaccccgacctcaccgtggcggaggcgctggccttcgcggcgcggttccgcctgccctcccacacacaccccgcccagcacgaggcggcagtgaagcgcacgctgcgcgcgctgggactggagggccacgaggcggcagtggagcgcacgctgcgcgcgctggggctggagggcgtggccgacagcctgatcggcgaccccgacgcgcgcggcatctccggcgggcagaagaagcgcgtgtccatcgggctggagctcgtggccgaccccgccctgctcctgctggacgagcccaccagcgggctggacgcctccgcctcacgcgcgctggtggcggcgctgcgcggcatcgtgcgtcgcggggtcacggccgccgccgtggtgcaccagccctccgcccaagtgctggccatgctggacgacgtgctgctgctgggcgccggcggccgcaccgtcttctacgggccggcgcagggggtgcaggcccacttcgagggcctgggctacgtgctgccgccgcggctgaaccccgccgacgcgttcctggacatcatcaccggcgaccgggggagggggccggagggcctggacgccgtggcgccgggtttcctggccgaggcctgggcggcgcgcgaagccggcggcggtgcggaggctgggccggactggggcggagtgtatggccgcggggacggcatctcggagcggggaggagagcccgcgggatggcgccggccggcacgcctctgtgatcccgaggaggggcttgtcgccagcccctcgggccgctgtggagagggctcgccgcacgcactcgacagctgctcgtcccccgctgggccgctctcgtccccagggaagaaggtcacctggcccgcgctgcggctgtggcgccgtagggtctgggaggtgcgtgggagtgggtgggtgttactggagggctgtgggcggcgggagggagggaagaacggttggctgcccagtttgcacagggcgagggcggtgcagagtgccactcaccaggacatctgcttgaagtgcggtccgcacatgcgggaccagcagagcgcacgccctgccggccaggatcgcagcagcagactgtacacgggggagtga

SEQ ID NO: 3030 - DNA, 531 bp, Chlorella protothecoides
atggcgccctccctcgcagccctgatcgagggtctccccaccgggactgaggccgaccagctcgccgacttcgaggccgaggtggaggccactgtggcccgcctgcaggcggtcaaggcggggaacaaggcactgaccgcggagatcgaggggctgatcgaggaggtctgtgcagggcgggccgagctcctgtcgcgcggcgctgacctggcggggcgcctggccgctctcccccctgcgcccggcccggcggaccccgatgccggcgccgccgggggggcagaggaggtgggggccgagctggagcgcctgtcgcgcgagctggccgtcgcctccgaggaggcgcggcggctggaggcggagctggcctccgcggcctccgcgtcggaggacgcgctggcggccacacaggcggcgcgcgacgaggcctccggcctgagcgcgcgtgccggcgacctggcggcgcgccgaacgcgccggggtcaagagcgcgccggccccgaccactgcgccgacctggtccgctggtga

SEQ ID NO: 3031 - DNA, 210 bp, Chlorella protothecoides
atgcccttcactaccctttacatctcccccaatcgtcttcctgcaacccatgcgcagagcgtagtgctggcgcccctcttcgtctggtatgagcttctgttcctcctgggctaccgaccacagctctatgccgacatcaacgcccgcatccagaggaatgtggcggagtacagggccgcacagcggccgctgctagcatccgggcagtag

SEQ ID NO: 3032 - DNA, 1089 bp, Chlorella protothecoides
atgaacgctctggtggtctgggcctcgtcttcggaggcactccagcatctcagcccgcacagttgggctgaggcccagcccccctccctggcccccgtcccggcccacaagacacaggatgccgcacatcctgcagtcgtcgacctggcgcgcgcgtgcgtgacggcgatctgtcgacccttgatcatgcattccgatggatgctcgatcccgccatggcctgatgcgcgtctgtccgatcaccagccatccagctatcctggctctgcatcgcccttcacaagacgcagcgcgtacgacgcagcgcgtacgggggtggaagtaagggagcagtttcccggagtctggccgtcgtcgcacctccgccagcctcccaccagggctgcccctggatgcggtgatgcctacacgatgaccctgatccaggaccagctgctcggtgcggagctgcgcgcggcctccgccaccctcgccgggggcctgtcccagcccgcggacggagccagcaccgaggagtcccccttcgtccaggcctacacccgggccctggccctgcaggagcaggccgcaggccaggccccggatctccagagggaaagcctgctggccgcctgcaccgcctaccaggaggccagccggctggcggggcacacccacgtggccgcgctgtacaaccatggcgtcgcgctctccgatctgtaccgcctgggcgacaacgacgacggcgacgatgggcgggccacgctgcgggccgccctggaccggtacggcgcggcgctggccctggaccccgctaatccgcaggccctgaacaacagtggcctggcgctgcaggagctggcgtcgggcctgccgcccgccgaggcggggcccctgctgcgccaggcggtggcgcggttccgcggggcggcccgcgccctcccgggcttccaccgggccctgtacaacgccgggaccgcgctctactccctcgctgctgcgctccgtgcggctgagggcgtggactctgccgacctcctccagcaggaggtgggggggatggcggccggggtttggttggatggttgtgtttctgctgcaatgtggtag

SEQ ID NO: 3033 - DNA, 1575 bp, Chlorella protothecoides
atgggcagactcggcctgactcgcccgtccacgcaggtcgccaccccctccggcgcgacgctggagatgcacgggtccctgctccagctgaggggcagcgccccctcccggagcccactccttgacccagcgacgggatccctgctctgcttcaacggcgaggtgtttggcggcctgccggtctgccccggcgccaacgatgcccaggcgctattttgcgccctgacacaagcgacctccagccccatggaagtgctgtcgagggtgcaggggccttgggccctcgtgtactggcacgctccctccggcaccctgtggtttggccgggatgccacaggtgaggggccgctcggcattgccggttgcacccgcagccctgcgacatctggcagacccacattctcctctgcgtgcgtcgacgcaaccacatgtctgtcctgttgtaaggcccattcgaaatgcagccccaacccaccctgcgcagggcgcaggagcctgctctgcagcctcgccatggatgaggcggagagtgctggttcaggcgaacaaccatcgctgcgccttgacatcaaaacgagcctgtcgtttcagcaacagcccggtgctcccttcatcctctgctccctggacacggacccagggtccgagggggccccgcccctacacgagcttccccccggcctctactccctaccgctggggcgaccgcaccccgccagcgctcaccagtttcaccctcagcgccacccctggccctgggtcgcccccctgcgccccagccacctcatcccggaaggcccgcagggccccacagcccggccctcgcccgaggccctgcggcgggcggacgagcgcgtgctgtgcgcgctgcgcgccgcagtcgccgcgcgctgccagctgcccgagtgcgcccggcctggccacctcaagaccgccgccccgtcaacccaggcccccctgatggtgctgttcagcggcggcgtggactccacgctgctggcggcgctggcgcaccaggcgctgccgccctgcacgcccatcgacctggtctccgtctgcttcgacgcggggcggtcgccggatcgcctgtcggcgctggacgcgctgcgcgagctccgcgcctgggccccgcgccggtgctggcgcctcgtgcgcatcgactgcggcctggccgacgtggacgcgcactcgccgcgcctcctgcgcctgctctcccccgccgcgacggtcatggacctgaacatcggggcggccctgtggctggcggcgcgcggcgcgggcagggcttgtcttggggatggtgaggcgcagggaggggcccccctggaggggcaaggggcgcaggcgggggacgaggcgggcatccagggggtgggcgtcgaggaggcgggcggccaggagtacacgtcggcggcacgggttgtgctgatgggacacggcgccgacgagctctgcggcggctacggtgaggctggaaaggcagaagaactgggaatggggtgtgtccctgtcccacccattcctggagtgggctcggaaaggcatggtgctgggtccccctcgggcgccagctga

SEQ ID NO: 3034 - DNA, 462 bp, Chlorella protothecoides
atggcgctggacatgcagcgcctttggcttcggaacctgggcagggacgatcggctggtggccgaccatggacgggaggcccgccaccctttcctggatgagggcgtggtggcagccgtgctggacagtcccttggcatgtgtcacagacctcaggctgcccagcgggcagggagacaagcgggtgctccgcgccgcgctgtgcgcgctgggcctgccccgggcggccgctcggccaaagcgggccatccagtttggcacccgcatcggcaggctgaacaacatccggcagtttggggggacccggaaggccaacatggcaaacgccggcagcgtgctcctctcagacctggcatgcctgccgcctgtggagagcgctgctgcaggccggggtgtgggacagcatggtctgctgtctgatcaaccagcatgctgccccgtccatagactcttccctggttaa

SEQ ID NO: 3035 - DNA, 1344 bp, Chlorella protothecoides
  modified_base (350)..(359): a, c, t, g, unknown or other
  modified_base (1110)..(1119): a, c, t, g, unknown or other
atgggctggactgcttgcttccctgagagggaggctgacatgaggggacagtccgggttctctattccaagtggtcgagggtccccggacgtgagacctcgccctctgtgcgtcttggtggcgaacaacggcctcgccgccgtcaagttcatccgctccatccgctcctgggcgtacaagacctttggcaatgagcgcacaggtaccgcctggtggcgcggggggccgggatggtggggactgcccccacctggtggggtgctctccccaagccactcgcagccacggccgggcaggccgtggccccggatggcgacgcgagtccgtggggttccctcgccaggcggttnnnnnnnnnnactcgcagccacggccgggcaggccgtggctgcgagtggcgacgcgagtccgtgggattccctcgccaggcggtatcctgctggcgcaaggcgctccccgcctcccattcctccccgcacgcgccatccccctgcctctcctccctcggcgtcctcgcctctgcgccactctccccccgattccccacaacctcgacccctcctcccttccccgcaccgccgcagtcaagctcatcgcgatggccacgcccgaggacatgcgggcggacgcggagcacatccgcatggccgaccagtttgtggaggtgcccgggggcaagaacgtgaacaactacgccaacgtcggcctcatcacgtcggtggcggtgcgcaccggcgtggacgctgtctggcccggctggtgagcttcgtgtgtggtgtggggatgggagggggtccggggggctcatatgggggtagcagggaattcagcttctatgcacacatttgcaagggggtgggggggggcctgcaagcagcggaaactccgtgccaagtaggctcctcaggcgctgacgacttggtcaacccggcgggagcagaccgtggcggcgaggtccctcctcccaggggcatctctgcgttgggcaccttgctccccgccagggccctcgcgcatctcacatcccccacgctgccgagttgtcgccctcgttctcgatgtattttcgaagctgaggtcgggcgatcccatccttgccctcctcccatnnnnnnnnnnctccccaccctgctccaaggtgctggggaggcgtggcgcttttgtggtggcgggggcatggggccgtgccagggcgtccgcccatcgtcctccgcgtgtgcctgctccggagcgaggcaggcgacgagctggtctgtaaacaggaagttgtgtcagattccagtcatccctttccctcccctggccacagtgcccgagcccagcgacgaggagtgggcgcgcgag

SEQ ID NO: 3036 - DNA, 1875 bp, Chlorella protothecoides
  modified_base (84)..(93): a, c, t, g, unknown or other
  modified_base (1684)..(1693): a, c, t, g, unknown or other
atgatgcatgtcttgagtctgaagcacgcatcctacccctccgcgccaggaccggcgagacgtcccagctctgcaccgagctcnnnnnnnnnncgtcttgagtctgaagcacgtatcctacctgtccgcgccaggactggcgagacgtcccagctctgcaccgagctcttctgcccgatctactccattggcacttcgccccagccggccctcgtccaggcggcagatgggccggactcccgaacaaacgccagcgatctgtatatggcaggggagctggggtgggtgatgtttgagagttcttgtcattcagggatctttggagtcagttggtcgctgcaagatgtcgaactggaaaactgtgcggaggccgatcaattttcgcgcaagaagctgaacctggtgctcctgctcgacgtctcaggcagcatggacagcccctttaataactattactacgatcaggtgcagggaagggtcaagcgtgtgaactatgggaacttgagcattcaccatgtgcactcagtcgtggtacgcatgataaggtttatcatggcaacccccttgaatacgctcacggctgcaccactctactccctctaccatgcgcagtttggagtgcagcagaacctgacggatgaaggtacggctgttttgcgcctgcatcctccaggcagcaatcctgcgtgggactttgattcattcaagccaggaagcctgagaatgccacatgaggagcagcgcaagaccaagatccaggtggcacaggaagtgctgaccggcattctggacctcctcggaccggaggatcgggtctcaatcgtcctgttctccactgacgcctgtcagccgctgccgctgggcaaggttgggtgcctggacgtgaaggccctcaaggcagacattgaggagcttgtggctgctctggatatgtatatgaaccttgggagtcgcgtacaattctatgcacgaatgtgtgcattcttgaaggtggggcacatatttgtaaggcttcctttcaattcccccactcaacagagggatgtcaaggcgaccgactcgaccaacactggggctggcatgaagctggccatcaagacattggaggagtgtgaggcctgtttgtctgcagaccctaatgagtgggagaaccggatcgtcctaatgactggggagatgggacaaacggggctgaaaaggtgtatgaatttggagcgactggtaagctcagcctctgcgaaaccccttgtgcgcgggaggcccctctcaccaaacacaagagtacttgcccacaagcataccagcaaacatcctgcagatgcgcaaaccaacgaaggcgccgtggaagattcggagctgaagagcattctggaggatgccgctgccaagggcatctacttcacgatcgtcggcatcggccttgacttccagaccaccctggtggagctcatcacccaagtcagcggcgccaactacttctccgtgcactctcctggtgaggggttgcgaacatgggcgagcttacggtcatgggctgcactgcttcctcacccctcattcgcgcctccattcctgcaccccaagcccatcatcccaccccagtctctgaaccttcttttccccctactatcctgtccctactcatctccaggggagttccagaagcgcctggtgtcccaatttnnnnnnnnnncggcgaacatgggcgagcttgcggtcatgtgctgcactgcttcctcacctctcattcgcgcctccattcctgcatcccaagcccatcatcccaccccagtctctgaaccttctttccccaccactatcctgtccctactcgtctccaggagagttccagaagcgcctggtgtcccaatttaa

SEQ ID NO: 3037 - DNA, 1320 bp, Chlorella protothecoides
  modified_base (12)..(21): a, c, t, g, unknown or other
atggcgtgcacnnnnnnnnnntctgccctgtgtaagcctgcccgaggcgctgggaggcgaggcttggggtgtgagccggaatcccgacggcgttgccccatgcaaggccgcatgcccagcctctcatcgcagtcccccagccgccttgtgactatcattcacgagaacggcaccccctccaacaaaacaaaacatcctacagggtctgtggatggcgtgcacccgcgatcctcggtcctgcatgagccacgggtggccaacgtctcgcgcctgctcctggtcttctccctggcggccccgccctttgaccccgggccggccacgcggtacctggtggccggcgaggcggcgggcctggacctgtcggtggtgctgaacaaggccgacctggtggaggctgcggaggcgcaggcgctggtggatgaggtgatcagggtcgtgatgaggggacagaagtgggggccaggtgtgtgtgggatcgagggggggcgcctcgttgggggtcacaggtggtgggtggggtggggggggagcatcggatctcctccgccgtccctggaccagtgtcctcctctgcacggctgtcaaatgcataacacggagacgggcgtggggctggcagaaatggctgacgccatggcggggcacacggcggtgctggccggcccctccggggggggcaagtcctcgctgatcaacgctctggcccggcgtgcgacctcggcggcgggggtggaccccacgcccgtggagcaggcggtgggggaggtgagcccgcgcatcgggcgcgggcggcacaccacgcgcaacgtgacgctgctgcccctgggggccggcgcggtggtggacacgcccgggttcaaccagccggggctggagggcgtcccccccgaccgcctggcctccttcttccccgagatccgggcgcgcggcgagcgggcctgcgcctttgccaactgccgccacctgggtgagccgggatgccgcgtggcgcagccgccctgggcgcggtaccagcactacgtggcgctgctggaggagcgcgtggcggcggagcgggaggaggcggcgcgagccgtggggaagaaggcgcggcagggcacgacgcgggtgaaggctcgggcagggggccggcgtgtgctggaggccaagctggagagcaagacgcaccgccgcacctcacgccgctcgcggcaccagcagctcgcggagctcgccgaggagggcatggaggagggggcacagcacagtcagtcgtcatccacgaagtcgcgcccgtctgtccaccggggtctcctgaacgcagcaatctcctcctga

SEQ ID NO: 3038 - DNA, 540 bp, Chlorella protothecoides
atgttgtgccctggttcgcacgcgtgcttaggggggtcgcctagccaagaggtacgagccacccatatcagagccatatcagatccgggggcgtggcgcagggggatgagaggtcaggttccagcagaggaggggcaggactttaagggcctccagagacagatcacaaatcctttctccaactatacgaggatgttattgtcaacgaaagtgcgagcgggtatcccctgcaatggacgaccatgcggacctgccatgagggcgccttcgttgcaccgatcatggggccatccacgcccgataatgccaccgtgccgcgcgatcaacatcgactttagcgatccggacaccctggttgctgtagggggggctctactgggagtggccctgggggtgggtgtccctgccttttacatctcgcgggaccgccgcgacgagcagcgcctggaggagctccgcgagctgaacaggaacaccaagatgcagactggggagtacatgaccaaggtacatgggcgagtgaggcagtgcatggagtga

SEQ ID NO: 3039 - DNA, 477 bp, Chlorella protothecoides
atggtcctgtgcgctggtagtttgagctgcagggcgccgccttcaggcggtgctaggttggagcgggggtcccccttcgtgcgcctgggccaccatgcccgcccacaagctcgcagacggatgtcagacctcgtaataaggtccatcgcagcccctgctccgcccccgctgcgacctgcatctcagcctcaagccccacctgcatcagagaccttcacggggggccgcgaactggccaaccgccctcccttctccctccaagacatccgcaacgccatcccggcggagtgctggaagaaggacaccttcaagtccttcgcctacctggcgctagatgtaggaatcgttgctgccctggccgtgacagcacatgccgtcaactcgccatggctctggcccttctactggctggcgcaggggaccatgttctgggccctgtttgtcgtcggccacgactggtgcggttggagggggtaa

SEQ ID NO: 3040 - DNA, 1011 bp, Chlorella protothecoides
  modified_base (49)..(58): a, c, t, g, unknown or other
  modified_base (249)..(258): a, c, t, g, unknown or other
  modified_base (348)..(357): a, c, t, g, unknown or other
  modified_base (942)..(951): a, c, t, g, unknown or other
atgaccttggaggctcaattcatgcgccttactcacatgctgatccccnnnnnnnnnngcgagtatcaggttgcagagcacaaatatgaccttggaggctcacttcatgcgccttactcacatgctgatcccctcctcacctcctcctgcagggagacggtgttcgactccctgagcttcacagggaagctgggccgatttgtgttccccatctccctgctggcgtaccccttttacctcctcgcccgnnnnnnnnnncccgagaccgaccttttcacccctcgtgaagccccaatgagtaagacctctgcagctgactatgctgagaaggttctggcgtatgctcannnnnnnnnnataccgagacgagtggtgcgattggttgtgtgcaatctctgtgaggacagagtgagaccactgcagctggctatgctgagaaggttctggcaccctccatgtatgcgctgctcattaaataatgccatgagtacgcattttccctttctcccccagattcgcacctctaatgcggtccagctggcgtttgtcggcgtgctgggcgcctgcacctgggcactgggcctgcccgccatgatcaagctctacttcctgccctacattgtctccgtcatgtggctggacctcgtgacttacctccaccaccacggtccctcaaaccccgaggaggagatgccctggtaccgtggcgaggtgagtcatgggcctgggattgggggtagatgggggcctgcggttgagtgtgacttggaagaaaggtggactggtgtggtggctgattgctttgcagatgctggagacagactgcctttcttttttttgtacacattacaccctctaggccccacctcaatcgcttggtgttggagcgcaccagcccacttattgaccctcaccctcaaccccccctcctccacaggagtnnnnnnnnnncttcttttatgtgtacacattatcccccctaagccccacctcaatcgcttggtgttatag

SEQ ID NO: 3041 - DNA, 507 bp, Chlorella protothecoides
atgtccatcaatgtaggagagcgcgcgggactgcgagggttatttgcagccccgagattcaaagtcagtgccagaggcaggcgcattgcgatgccgagctggggatcccgcatacacatcgacgtcgctttaagatttgggcaggcgaaattccgtgtggcgcccttccatatcgcatcagatcgtgtccgaattgggcgctttgatattccagggctgggctcctcgcctcagagccagcggccccatcacagccccaccatggcaagcaccctacgcctgctccgctcccgcgccctggtgccacgcctggcgggtcctgggcccgaagctagtgctgaggtgcccctgcggcgctgcctcactgtctgggacctcaccttcctgggcatcgggtccatggtgggggctggcatctttgtcatcacgggcgtcgcagcggcgacagtggcaggcacggtctggggtgtgggagaggaatgcgagcgattgatgcccacgcactag

SEQ ID NO: 3042 - DNA, 1425 bp, Chlorella protothecoides
  modified_base (22)..(31): a, c, t, g, unknown or other
  modified_base (413)..(422): a, c, t, g, unknown or other
  modified_base (866)..(875): a, c, t, g, unknown or other
  modified_base (1121)..(1130): a, c, t, g, unknown or other
atgcatggctgtgttgagcttnnnnnnnnnngtgcccacgtactagaccttcctaggcagcactatgtgggttggtggccaatgcatggctgtgttgagcttctagtcctatggcatctcctctccaaccgcgacgtgcacaggcccagccatcatcctgtcctacgtgctcgccgcactggccgctggtctctcggcgctcaactatgccgagttggctgccagcatgccagtgggctggagcatggtactggagactgtgctttcctcggcggccgtggcacggggcctgtccggatacgccgccaccctggcgggggccgacaccagggcgctgctgatcagcatccccgcactcggcctggagctggaccccctggctgccgggctggtgctcgcgctctccggcctgnnnnnnnnnnacccgccctcggcctggagctggaccccctggccgccgggctggtgctcgcgctctccggcctgctcatctggagcgtgaagcaggggatgcttttcaaccgagtcactccacagccggcagcaaatgcctgccacttgacgtccgccaaccccccaattcctccctttcctgaccccgccgcacgcagtggtgtctatcgccaagctcgccgccatcgcgctggtgctgggcatgggcctgccccgcgcctcgctcgccaaccttacgccctttgccccggagggcgtgcgcggcgtcttctccggggccagcctggtctttttctcctacgtcggcttcgagatggtggccaacgccgccgaggaggtggggcgaggctcggtcctgtgctgcggagcgatgcacgggcaccaacaccacagccgcagctgggcagggcgtnnnnnnnnnnaggcggggcgaggctcggtcctgtgctgcggggcgatgcacgggcagcaacaccacagccgcagctgggcagggcgtgtcgtcacctgcatcagcccacctcctcatcatactttccgtgcacccctgaagatcaccctttcttccccatccaagaattgcaccccccccagcatttcaaacccatcgccccctgctcccctcccccaccaggcgctggagccctcccgggacctgcccctggccnnnnnnnnnncgcatcagcccatctcctcatcatacttgccgctctggagccctcccgggacctgcccctggccatcctggggtccctgggtctaacaaccgcgctgtatgtggccgccagcgcctgcatcgtggcgctggtgccgcgcggcaagatcgacacccacgccgccttctccgtcgccttcacgtccgccggactggagtgggtggcgcgtgccgtctccgcgggcgcactggcaggtgaggggtgcaatctacgcgaggatgtgtatgtgcgggcggacaaagctgctgaggagtag

SEQ ID NO: 3043 - DNA, 675 bp, Chlorella protothecoides
atgcccaatcggcaggcacctgctcgcagcctgccagccatagcgtctgagcccagcgtggacagcgtggccgccgagcccagctccctccccgccatgccacacattgtcgtgttcagtgggggcacagccttcaacagcgtcgcggcttacaatatcgcacccccggccccacccacaggccactttaagcagcttacgcacaacgtgacgcatgtgctgcctgtcacagacgacggcggcagcacggctgaggtggtgcgagtgctgggcggccctgccgtgggtgatatccgctcacgctgcctgcgcctggcagaggagggcgatgccgaggtgggtgctgcagggagaagaagggtggcctcgcgccctgcggtcttcgactcgtgtatgctggctgtgcgtagtggcatgacgatgcagctcaggcgtgtcttgtccatcgggcgctgccatatgctggcaaccgagtctggcagaagaaaagtggactggacagtgcatgaccggtctctcgctgccacccactccccactcggccacaccttgctgccccagtcggaggctgtccggcagctgctgggacaccgcctgtcctctaccgatccagaggccgcgcgccaggagtggtaccgcatcgtggagggggagcaccccctctggcaggtatga

SEQ ID NO: 3044 - DNA, 1275 bp, Chlorella protothecoides
atgccagggtcctgcaacatcggcgtccaatgttcctgccttgactgttccagccccatctccaacttcctcaccctccgctgcatctcgtcctgcatcctctgtgctcttacaaattcacacaaacacaattcacaaatcctccccacccccaccccccaggacctgactgagccgtacaagcacaccatccgcgccttcctggtgcacttccaggccaacatcctgcgccacgcctcccgccgtttcaacttccagtccggctcggtgggcaacttcttcttcgccggcgcgcgcatcttcttccgctccctggaggccgccatcttcctcttctcccgcgtcgcgcgcatccctgagggcaccgagaccctgccggcgctgcccagcgagggcgcgctgcgcctcggcgccgagctggctgacggctcctgggtcatcggccaatcagccatctcccacccggccgccgcgggggccgaggcgctgtcggtggacaaggcctgcgcggcgccgctgcccgccgccatccgccgcgccttctacctgtccagcgacggcgacggcgcggagcacgaggtggcgcccgacgccaacccgcgcacgctggctgcgctaggccgggcgcaggccgtgatctacggcatgggctccctctacacctccctggtgccccacctggtgctgcgcggggtggggtcgaaggggggatgtcgggcccaagaggggtggcgcggaagggtagcccgtgccgagctcgatgccagtgagaccccggcagcctgtgcgctgggcactgggcttcactggagcggacaggtgctgccccgcaccaaagctcatggccgccgggtggcatgcgcgatggcctgccgagccacatcccatgcccacccaaaccacacaccccgtccccaccctccccaacccccaacccaccagatcctgatgctcaacggcgcggtggaccgggagacggggcagtgcctgcggcggccgggcgccatggccgcctcggacgtgctcctggccctgaccgacgcgctgaatcggcggggcgggcggcgggaccccggcctggaccacccgccctcggcgtactgcactgcggtgctggcgccgcgcggcggcggcgtggaggtggacgccgacgcgctggccgcgctgggcgtgcgcgtcgtgcgcagcgtgagcgcagagtggagcgccgaggccggcgcggcgcactacgaccccgacgccctcgtggcggcggtcagggacctgcttgcgtga

SEQ ID NO: 3045 - DNA, 573 bp, Chlorella protothecoides
atgcagtcggtggcgggcctgcgatgcaccgcccttcgccccttcattgcatcctcgaggcagcaagccctgctgctggcatgcgtctcccgggcttggggccgggaaagggctggcctgcacagggcaacccccaccatcgccgccctgaagcccagctccgagttcccggccgactaccacatcggccagaccagcagtgtgcccctgacccccctctgccccctgctggccgggacgggccaggtcatggcggcccaggccaactacctgcgcgtgcggcttgaggagctggaggatgccgcaggggaggtggcgtggagggcggggcaggcgccccaggaccccggcatgccactgcccggcccaggggaggacacgctgctctgcaccgccaggggcctgctcaagaagatgcagacccgggtcatggtcggcgacagggtccacctctcgggcatcgactggaccagcctgcgagggcggtgccttgtgggcggtgtgtgtcgtgcgctccatggaggcatcaatgggggggactgtccaggtgtgagagcgggtgcgatggcttga

SEQ ID NO: 3046 - DNA, 378 bp, Chlorella protothecoides
atggcggtggtgactcttgaggtggtggtggtggcgattgccgaggtggtgatggcgagggtggcgagggtggcggtggtggcgattgccgaggtggtgatggcgagggtggcggtggtggcggcggtggcgattggagcggtggtgatggggaggatggcgacggtggcggcggtggcggcggtggcgattggagaggtggtgatggggagggtggcgacggtggcggcggtggcgattggagatgtggtgatggggagggtggcagcggtggcgattggagaggtggtgatggcgagggtgttgatggtggtgagagtgagcttggccgacctggaggaggttggctggaaagttgtgaggcaagtggcgagttga

SEQ ID NO: 3047 - DNA, 441 bp, Chlorella protothecoides
atgcaggtgctgagcttcccagacttcaagccggagaggactatgaagggccacgtctcccgggtctcctgcatgggctttgaccctgggcacacgcgcatggccagcgggggaatggacacggtcaccagcctctgggatctggaggagggcatctgcacacagacgttctacgacttggaccaagccatacgtggcgttgggttcagtcacgatggccagtacctggccattgtgagcgaggagcctgctttggaggtggtgaacctgaggacaggggccaacctggggaggcaggtgctgcgtacctgccccgtggacgttgcctggaatccgaggaggcacatccttgctttcccgggggcctcggagcgggacgggagtggcgcggagcatgggctggtggagctgagatacttgccggagcagggtcaatcctga

SEQ ID NO: 3048 - DNA, 426 bp, Chlorella protothecoides
atggatgacctgaactgggagcgccgcagatatagcgcctggcctgcctacaacgcctccaagctctgcaacctgctgtttgccaaggagctggcgcgcaggactagagaggcgggcgatgacatcgaggtctttgcattgcacccaggtgtcatcggcacgagcctcttcagtggggagtcattgtccaactttgcggtgcgcattgccaaggccatccccttctttccgctgctgaagtcccccgagcagggagctgcaacaagtgtctatgctgccacatcccctgagctcaacggccagagcggagcctacctgtccgattgcaaggtgacagggacgagtgcgctaggccaggatgccaacctggcaaagcagctgtgggagaagacagaagaaatgattgctggcgccctccgttcctga

SEQ ID NO: 3049 - DNA, 663 bp, Chlorella protothecoides
atgtcgcgattcagctccagaagcaccgcacaagatgttgtgcgcggcgtagacctcaccggcaaggtcgcggtcgtgacggggggtaacgccggtataggcgttgaaaccgtgcgtgcgttggcaggagccggcgcagatgtcgtattcacgtcaaggaatgtggaggcgggcaataaagttgtcgatcggctgcaggcggaaggagtgaagggtaagctcacggtaaagcagctagacctggcctccctgaatgacatccagtcgagggtggaggccatccaagccgcagcacctgtcattgactacctgatcctcaacgctggggtgctgagcggccccgcaaagacaaaggaagggtttgaaatgtccattggcactaatcatattgggcactttcacttcaccaagtgtctcctcccaaaattgaagaagcaggtgggctcgggtgaaagttggtctggtgggggcctccgttggcggcggaatttctggagcgttgggggcatacgccaccaggcagtgggcaagggtcaagcaccttgcttccttgccgcggctggccacaaatcatgcgccctgatttatccatgcacaaccattccagggtcgcccagcacgtgtggtggtgctttcttcccgtgctcactttggtgcccgtga

SEQ ID NO: 3050 - DNA, 324 bp, Chlorella protothecoides
atgcggctgagcggcgccaggggtgtgaagcatgcccttgctgccggcccgggccgcatggctgcacacccaccgctccgctgcccctcccccacccatccacagttcaagcaggagatggagatgagggggcaccaggacgccgtctcccgcctggcctggcaccccacacacccagacaagctcgcgtccctgggccagctcactgagcagtcggtcaggtgtgctgggctgtgcgttgccaggattacaatgagagagcggaaacgcgggctgcccttgcgtgcctggctgcaggcttggtccctgtctgcgtggaggtga

SEQ ID NO: 3051 - DNA, 1098 bp, Chlorella protothecoides
  modified_base (390)..(399): a, c, t, g, unknown or other
  modified_base (468)..(477): a, c, t, g, unknown or other
  modified_base (1021)..(1030): a, c, t, g, unknown or other
cagggcggcgggggaggcgcgcgggcccggcggccgcgacgacgacgcgcccgaggacgcgcgcagcggcctggcctcccccgcgctgcaggcgggcagctggggccagatctgcgtggcctgccgcatcgtgcgcccgctgcgcgccaagcactgcggcgtgacggggcgctgcatcgagtgctacgaccactactgcccctgggtggggaacgtgatcgggcgtggcaaccgcgccttcttcctcaccttcctctggctggagctgggggcggtgacggcggcgatggccgtggccgtggcacgcctgcactcgagtgcgcactttggggggagggggggggatccaagtgcaggggagacccctggcgggggggggggctggggcgnnnnnnnnnnaaggggggacaggcggatgtccaagccatggcatcgcacctgcaggactcctcaggcggtatgggtccnnnnnnnnnngttttttggggggggttgtgtgatccaagtgcaggggagatccctggcggggagagggggggggatggactggtgcgcccatcaggcggcaaggggggacaggcggatgtcccagccacggcatcgctcctgcaggactcctcaggcggtatgggtcccaggaagctgttgcactcagggcccacactccccccccatcccccaccaccctccatccctgcagacctggcgcagccccggcccgggcacggccccgcgaccctggtctggcccgtggtgttcgtggtggccgacgccttcctcctgctcagcattgcagccctggcactggcacagaccaaccagatcgccaagaacatcaccaccaacgagctcgccaactggcacaggtgcggggggcaaccaatgggtcggctgcctggcctgagtgcatggggctttgcgacagggaccccagtgtctcctccgccacaccaggatcccacggggcaggccactccccctagagccttactgaagccggcacacctcctcatgctgtccnnnnnnnnnngaccccagtgtcacctccgccataccaggatcccacggggcgggccactccccccaaagccttgctga

SEQ ID NO: 3052 - DNA, 2769 bp, Chlorella protothecoides
  modified_base (1302)..(1311): a, c, t, g, unknown or other
atgccgaaggcattgcagctgcagcatcctggtcgatggcacgggcacgtggtgtttgcaagccgtctgggcgagttcaaccctgaagtttgtatccccgggccccccgccccgccccttccccaatccacaggtgtcatctccaagggagaggacctgccctgcccagtggatgccgctggacgcttcaccgcggaggtgaccgactttgcgggccagtatgtcaagcccttcccgatccttccaagtcccaagccaacccctcaacccccccccccttcctataaaggatgcggaccgtggcatcatcaagtggctcaaggaggctggccgcctggtggatcagggccagctggtgcattcctaccccttctgctggcgctccgacacgccgctcctgtacaaggcggtgccctcctggtttgtgcgcgtggaggagatcaaggaccgcctgctggccaacaaccggcagacgtcctgggtgccggccttcgtgcaggagaagcgcttccacaactggctggagaacgcgcgggactgggccatctcgcgctcccgcttctggggcacccccctgcccatctgggtgtcagaggacttctccgaggtcgtggtcatcggctccatcgacgagctggaggcgcgcactggcgagaaggtgggccggagcttttcagttggggtgggcgaggggattcgggccggcttgtgctggtggcgctggagtcgctgtgtccctacccctgctcccacgagtcagcccagccttggatccccccttttccaccttgcatcgtccagtccacccattcatggagccccccctgccccgcctcccaaccctcactctgcccaggtgacggacctgcaccgccacttcatcgaccacctgaccatccccgccgccgacggccggggcgtgctgcggcgcgtggacgaagggctcgaccagacccggggctggttctacaccctcatggtcctctccaccgccctcttcgacaagcccgcgttcaagaacctgatctgcagcggcctggtgttggccgccgacgggaagaagatgagcaagcgcctgaagaactatccggtgtgtgggtgcggatggttgactggttgagcatggggagggcagctacggcttggatgtcgtgggtgcgacaggagccagggagtgcaaggccgtggggtccgggaagaggcctgtgcacatggagttggttctgggcatgtcaagaatggcaagtggggctgctgtcccgacgttgtctcgtctcttcccagcctcatgcatgtctccgnnnnnnnnnncgcacatggagttggttctgggcatatcaggaatggcaagtggggctgctgtcccaatgtacccccgtctcttcccagcctcatgcatgtctccgcccttggtcgctccagcaatcccagcatgggtccctcatccacctccccccctccccaccaccgccaccacgacccttccaggacccgatggaggtggtgcacaagtacggcgcagacgcgctgcgcctctacctgatcaactcccctgtggtgcgcgcggagacgctcaagttccgcgaggacggcgtgtttggcgtggtcaaggacgtcttcctgccctggtacaacgcgtaccgcttcctggtccagaacgtgcggcggtgggagggcgagacgggcgaggcctttgaccctgcctcgcccgactacggcgccgcctcggggtccaccaatgtgctggaccgctggatccgggccgccacgcgctcgctggcagcctacgtgcacgctgagatgggcgcctaccggctctacaccgtggtcccgtaccttgtccgcttcatcgatgacctgaccaacgtgtatgtgcggctcaaccgccggcggctgaagggacgcggcggcacgcgcgacgccgggcaggccctggccgtgctcttcgatgtcctgctggacgtctgctcgatcatgtcccccttcacccccttcttcaccgaggccatgtacggcaacctgcgccgcgcgctggggccggacgcgcccgtctccatccacctccgcgacctgcccaaggtacagagagttggtgggggggggaagggggtggtgtgcagttcagtacacagggcaagacgtgcttgtgtgtatgtcttcgatgccattcgcccaggacgcgcaggagggcgacgcccagattcaggacagcgtgcgccgcatgacgacggtggtggagctggcgcgcaccatccgcgaccgccacgcgcgtggcgtcaaggtccccgtcgcgcggctgacggtggtgcaccccgacgccgacttcctggccgacatctccggcccgctgtccgcctacgtggcggaggagtgcaacgcacgcgccctggaggtctgcgccgacccgctgcgcttctgctcgctgtccgccgcgccggagtggggcgtgctgggccggcgcctgggcaagcgcatgggcgccgtggccgcgggcgtggccgcgctgacccaggaccagatcctggccttcgagctcgaaggggaggtcgtcgtggccggcgagcgcctgggccccggcgacgtcaaaatcgtacgcagcttccgcggcagggcggcgccggccgacggcggcgcgcccaccgaggacgccgcgggcgacggggaagtgctggtggtgctggacctggccagcgacgcggcgctggagggcgcgggcctggcgcgcgaggcggtcaaccgcgtgcagcgcctgcgcaagaaggcggggct

SEQ ID NO: 3053 - DNA, 657 bp, Chlorella protothecoides
atggccggagccccgacctgcgggctgcaggatgtgaaggagggcaaggactaccattttcccacggaggaggaggctgtgctggccttctggaccgagatcgacgccttcagggcccagctggagcgcaccaagggctcccccgaatactccttctacgacggcccccccttcgccacgggcctgccccactacggccacctcctggcaggcaccctgaaggacattgtcacccggtacgccgcctgcacggggcaccacgtggagcgccgcttcggctgggactgccacgggctgcccgtggagcatgagattgacaagcagctgaacatcaccacccgcgacgacgtgctggctatcggcatcgacacctacaacgaggcgtgccgggccatcgtcatgcgctactctggcgagtgggagaaggtggtcacgcgcatggggcgctggatcgacttccggaacgactacaagaccatggacccctccttcatggaaagcgtctggtacgccttcaagcagctctttgacaagggcctggtctaccgcggcttcaaggttgttggtgggcacgcagctacccggggagatgggccggcgtcgcctcccggccagcttgcctgcatacgctgctcctcctgcccccgttcagcttag

SEQ ID NO: 3054 - DNA, 4188 bp, Chlorella protothecoides
  modified_base (134)..(143): a, c, t, g, unknown or other
  modified_base (700)..(709): a, c, t, g, unknown or other
  modified_base (978)..(987): a, c, t, g, unknown or other
  modified_base (1695)..(1704): a, c, t, g, unknown or other
  modified_base (2576)..(2585): a, c, t, g, unknown or other
  modified_base (3337)..(3346): a, c, t, g, unknown or other
  modified_base (3562)..(3571): a, c, t, g, unknown or other
  modified_base (3915)..(3924): a, c, t, g, unknown or other
atgcgcgccatgcgagaccccatctggtgctggcgaggaggtacacatcgcatggcagggattcgaggccctgcgagaatgctgcacgtgcagtgctgctggtcgggcatcgaaatcgtgaggactggagaccnnnnnnnnnnccatgccagggattcgagaccctgcgagtatgctgcacgtgcagtgctgctggccgggcatcgaaatcgtgaggactggagacccgattgtttgaggatggggagtttgatggatgagcgcgctggcgggagggcagcgtagacccctgcatgctcatcaagcatcgtcatcacggtcgtcaccacaatcggatgtggccttcatggcagatggagggtttctgagagagtcctccccccccactggcggagcgctgccgctgtcggggcagggaggtcgggaaaaccccaccctcactgcccctcccccacgcccaccgccaccagactcagtggcagcctctggctgttccaggtgtacgagcctgagcttcaaccaggaatggctcgcagcattccatgtcgcgctgtgcaacacctgcaggcagaacgagaaactcgtcagcaaggtatttgtttgggagggaatcgcacacgtctggcccttttctacgcacgattcgacaacagaattgctatcgcttttttgcagagcacggccaggatccggtacaccnnnnnnnnnnctggttgggagggaatcgcaaacgtctactgtggcccttttctacgcacgattcgacaacataattgttttcgtttattgcagagcacggccaggatccggtacaccctgacagacagtgatctgaaaccgctggggagcctccgcaaggccaatccccaccgcaaggactggcagcccatgcacctatacatgcagtctcagaatagtgctgactgtctgcaagctggttgtgcacatgatgcatgctggcgtgccaccctctcacannnnnnnnnngcgaaggggaggttggttcaggatcccaacgacgtgtatgtttcagttttcttcctcccccaggtggaggaggtcgcgcgctccaagcacggtgatctggaccagatgctggacggtcatgccgccctggcggctgcaaagctcacagatgccatccggaaacgtgaggaatccaagcatgcttcccagaggaaggctgctcgcatcttgagaattagggcagaaattcaggtgcagcggtggcctgcatcgtttggctggacaaggcacatgcccagaccgtgttccagcctggtgaggaggacgttgaggacctgtgatcgctcttgtcgtcaatgccatagtgtgtgggaatacggtcacctgactgagcgcatgatggtctggaagatggcggatgggcccatgcttggcttgcttgacgtgcagccaaaccgggtgcatggtggaataacatgcatggaaattggtttgcaacctggtttgggaattctttgtcgccatgtcacaggacgtccccccagaagagctcccaccacgaaacaagaccttggagagatgcatcctacgcctgcctgctggagctcaggcttctttgaaaagcatcaagacctgaagctgatgtggcaagtgctgcagcctggagggccaacacatactcgtgcctcttgtccgttgtacttacgcaaggccattcagcattctgcnnnnnnnnnnacgtctacacacggacggatagccatctctccctctggcggtagacggcgctgcagcctggagggccagcagatactcatgcatcttgtccgttctacttgtgcaaggccattcagcattctgcaccctgccgctctggccccaggaagaaggtgctgcgcagttgacaaagaccagcacctcgcccatgtatgcacactgcgagggcagagcgtggagtgcgcaatccacatgtcaggcatccgtacccacacatcaggcatccgcgacttcggcctttgccgtcttcgagtcccagtccggcagactcctcgccgcctcgccgatgctagagatgagccgcctgacggccgtgttgttgcagcccttgggtggctgtgggaatccccccatggcaaggacaagtctatagggcccctcctggccgggtcagcaccgcaggggcacgccgtcaatatgcgctgctttgagagcagcagggttgccaggccaccctgggcccgtgtcctctgctcccgcatcattgctgcgtcagcctcgtgtagacaagcccctgcccccctcggcccctgtgctcacataatcgcgcttgtcaaagtgccaggccccgatctttccgggggtgaacgcccccttctccgagaagtcgctgccatagtcgcgcttgtcaaagtgccaggccccgatcttcccgggggtgaacgcccccttttccgagaaatcgttgccatagagcagaggtggcgcaggtcgtctgggtgcggggttcttgcagaggtgatcgccggggtggatgcctctttccaggggttcgacaccggcatggggagccagcccgcaggccaccctcatcacagccccggcccttcctnnnnnnnnnncgagaggggccagagcagaggtggcgcaggacgtctgggtgcggggttcttgcagaggcgatcgccggggtggatgcctcttcccaggggtccgacgccggcatgccgagcaagcccgcatgccaccctcatcacagccccggcccttcctgcgcacctcaaaggagagccggtcgtcccaggggggctgaatcatgagctccttgtgcagatcgtagcggatgggccctccatccgccgtggccgaagcgatgctgtatgcatacctgcagggatggtgcggcaccgggaggggaggggggaagggcttgtgtgggacagcccacctggacctgcggccgtgggtgaagatggcagggcaggggcctggccctgggagggcgcgtgcccagaaagatatcagtggtacaggttttgctggggcgcattggagggcgcgtgcccagaagatatcagtggtacaggttttgctggagcgcattggtcacggggacgcacgggctcagatgggagtgcagtcccctgcctcctcgagagcacgggtatagcaccagatctccccctcgccatgtgcgggatggtcatccgagcggcacaggccggcacacaagcagggcagacacgcagcgatcatcagcttaaagctcgtgggcgtcaggcatggtcagcagggatgccaatggggcatgccacgccaaggagcagcaggcgtctcgcccatggaccgacacccggcgcaggcatgcgcctcnnnnnnnnnntacacaaacagggcagacacgcagcgatcatcagcttgaagctggtgggcgtcaggcacggtcagcagggatgccaatggggcacgccacgcccaggagcagcaggcgtctcgcccacggaccgacacccggcgcaggcatgcgcctcccccgggttccccgccctcgtagcccggccacccgagagctgccccccttccttgtctcacatctccnnnnnnnnnngggttccccgccctcgtaacccagccacccgacagctgccccccttccttgtctcacatctcctggacccagccaaactccttgtcggcctcgtggtctgccttgatggccaggctcgtgttcacccacaggtccacaatggacgcaaactggtccttgtggatcatgaccggcgagttccctgggggtgggcgagcggggggccgggaatgatgtcgccatccagccagtcgtgtgcggcaccgcgcgaatgcaggcagactgggacggtgcctgggtccgagcagaccggccctggcgcacgggtccgagaggaacctggagcacccatctgcccccagctnnnnnnnnnnccgcagctccgccgccaggccggcagcgggggcctggcgcccgcgccgcgcgcgcacggcgtgcacggggtaggggtgggcggccatgatgaccaggcccgccgcgtcgtcgcgatggctgcgcagcagcgtgaggatgccgtactgcgcgtcggtcagcaccacgttgccctgggcaaagaactccaggatgaggtggtgcgcggcctcgcccgtgccaaaggtgagctgcaccatgcggtcgatgcccagctgccggattga

SEQ ID NO: 3055 - DNA, 693 bp, Chlorella protothecoides
atggcaaaattcaggtcggtcggcccacgccacagaggtggggcctatcgacacatcattctatgcacggtgctgttgggaattggtctggcggctctcagcttcgcaccacacggcctacagatgaaggctgtcggaggagccaagcagcaccctgtgtctcccggtagatcatggcttgaatccggagtttgtggagcacagcttcgtcaccggcgctccagaggtgtgcgtggctggctgacggtcaagggtcatagcctgtgcacagtgcaggccctgcagatgcacgccgtcagcacagccggtgaccaggcggatcagcaggctgcgactgagggggccgaggtggtcgagccgaccgagggggccgaggtggacgaggaggcccagcagaaggaggtggacgccgctttggaacgggctgcggcggccgcggcggccgcgcgccgcgagcgtgcggcggcgggcgaccgcccgccggagccgtggatggagaaccctgccgccgactccgggatcccggggctggtggccccctcagggtctgacaagtaccatgtcctggtgacgatgaacggcgggatctacgtcacatggcagagccgcgtgtgctactactggtacaagcgcatgaaggcgctgtacccggacagcgctatgggtggcttcacccgcatcatccacgggtag

SEQ ID NO: 3056 - DNA, 636 bp, Chlorella protothecoides
atgcccgtgaagggcgacaccccctccaacttcaccctgaagctgcgcaagcacatgcgcacgcggcgcgtggcttcaatccggcagctgggcatcgaccgcatggtgcagctcacctttggcacgggcgaggccgcgcaccacctcatcctggagttctttgcccagggcaacgtggtgctgaccgacgcgcagtacggcatcctcacgctgctgcgcagccatcgcgacgacgcggcgggcctggtcatcatggccgcccacccctaccccgtgcacgccgttcctctcggacccgtgcgccagggccggtctgctcggacccaggcaccgtcccagtctgcctgcattcgcgcggtgccgcacacgactggctggatggcgacatcatctggcatttccggggtcaaaggggtgtgtgggactggtgccatgcggagggtcagcattcagatgcctgggacccactcctcccctcactcccggccccccgctcgcccacccccagggaactcgccggtcatgatccacaaggaccagtttgcgtccattgtggacctgtgggtgaacacgagcctggccatcaaggcagaccacgaggccgacaaggagtttggctgggtccaggagatgtga

SEQ ID NO: 3057 - DNA, 363 bp, Chlorella protothecoides
atgatgcgggagcagaggacacgggcccagggtggcctggcaaccctgctgctctcaaagcagcgcatattgacggcgtgcccctgcggtgctgacccggccaggaggggccctatagacttgtccttgccatggggggactgcaaatcaagtacgcaaacgagcactcaagtatcccgcccccccctcctcctcactgccaacctgcagatggcgtattatccgccctcagacttcccacagccacccaagggctgcaacaacacggccgtcaggcggctcatctctagcatcggcgaggcggcgaggagtctgccggactgggactcgaagacggcaaaggccgaagtcgcggatgcctga

SEQ ID NO: 3058 - DNA, 780 bp, Chlorella protothecoides
atggccgtgactagacacgtgcaggcttttcagccctgtgctgtgccctcattccggccaggtaagcgggcgtctcgggaggctgagcgcgtggtcgatggggttgtggtggtgggaccccccgggtccagggcgtggtgcttgggggcgccggcgctcacgcgccccacccgcccccgccggcgcccccgcgccctcccctccgcccggcgttccgaccagggtgaggcccccgacacctcccagcgcgtgacgctgtccagcaagccccagcgcccgctcccgcgccgccccgactccctccagtccttccccggcagcgtccccgtgggcagccgctggcggctggcccacatccccgccgcccccccggtcacgctgctgggcgcggcggggcagcccctgccctcccactccatccccctccccgccacgcccggcccctttgtgctgggcgcggtgatcgacggcgacgccgacgtggtggtcctggaccccaccgtctccggcagccacgcgcggctggaggtgctgacgcgaggcgctggcccggacgcggaggcgcagctggtggtggccgacctgtcctccaccaatggcacctacatcaacggcgcgcgcctgcgcccctggaccgagaccgtgctgcacccaggcgacgtgctgagcctggccgacccccgcgtcagctacgaggtggcggtggacccggtgcgcgtgaggggggacgcgcccggcgcggacgccgcgggcgcgtggtacgacgccgagggcggcgcg

SEQ ID NO: 3059 - DNA, 630 bp, Chlorella protothecoides
  modified_base (256)..(358): a, c, t, g, unknown or other
atggaagcaatgagggagttgccgtggaattcgtggtggtgggtccatgcagcaattgctccccatgcaaaggccctggtttccactgatctcattctgtgcccagcgcgcggaaaacttcttccctcactgactctcttccccttggaaggaagcaacctgccccgttctcctcttggactgcgccgggcacgtgccatgacagcgacgcaagcagcaccatacccacgactggtggcttttgatctggacgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccccctgccatacttcccctccattccaggctgccagagatgtacatgctatcggggccaccattcagggttgaccccgacgaccctcagtgtgtgctggatagaggaggcgagcaggtggaactcatgggctcctcgcgggagatcctggcagagctggccacccagcctcagtggcagaacacggaggtctgtgacatggggtgggagagcagggacacagtcgcctccctctgtgctggactcagaggtgacccctccatggtgtga

SEQ ID NO: 3060 - DNA, 267 bp, Chlorella protothecoides
atgctcctccctcccccccccccacccacccagacctcagatctcctggcccgctccgaggctaacaaggagctgaacgacaagaaacgccttgccacctcctatgccaacctcgccaggagtcgcactgtgtccgacgggacctgcaaattcccaaagaacatcattggttgcgacctgggcccctaccagggagaggtcaaatacattgccgacgatcttgcactggagtgtcagggaaaggccccgggcgagtgcaacaggtag

SEQ ID NO: 3061 - DNA, 1554 bp, Chlorella protothecoides
  modified_base (143)..(152): a, c, t, g, unknown or other
  modified_base (205)..(214): a, c, t, g, unknown or other
  modified_base (1431)..(1440): a, c, t, g, unknown or other
atggagcgtggagatggaggacgccatagcacagcaccacctcctctggcgctacccccggccgcgccacgtggcctgcctcacctttcgggcccaggtgcggctgccacgctgggcgctcctgggtgggggttgaactccannnnnnnnnnctccatctccacgctccatccctggcgaggagtgcaccaggatgccggagcgnnnnnnnnnntgaggggtccctgcacgggatgcacacgtcgggttcaaggtgtggctgcgcgaaaaagatgccggagcaatcttcatgagcactccttccactctcacattccttggcaggcgtcgcacgtggtgcacgccgcctttggcctcaccgccttcgaccccgggcttcccgcgccaagtgaggaaagcaagaatgccatcccgctccgcctggaagccctgggtgacgacggcggctgcagctggagaataatagccgcccaaccagccctgcccgcccagtgccaccagctgtgctggcggggccctctcagcccgcatgccctgctcccctccctgcgcatcaacccgccgagcttcgattcggtggatccactgcccccgctcagcgcgcagacgagcctcgcactgcgagctggccgcctggcagtggcactgcacgagtacggcccggaggggcggcctccactgacttccatctacgcctcgggcttggaggccggctggcacgccttccccgacggcgcctgggcggccaggctgggcggggaggtgagtgtgcacctgacggagccgaccaccctcacacccgcgcccctggtcgaggcctgcatgctgagaatccggctggaccgaggcgcagaggggagcgcatgcggggggagggaagagcaggacgacgtcgacacggatgacggtgtcctcacgccgcgctggcagcagggacccagacgagctccgtcacaggggccgggcgagaggaacaccccctgtacttcacagcccgacgccgccctccccctggacgtgtgcgagctgccgctgtcttgcgaggcgcctcagcaagggcgcaccagcctccacgtctccgccaccaccgccctgcgcgtcaacgcctggcagtggacgccgtcggcgctgagccggctgtcgggcctgcgccgcgccctcccgccggccctggtcctgaccaacgccacgcccgtggctgtggtggtgcggcaggcgggggccgagggtgcacatttactggggagcggggaggaggcgcccttcgcctggcccctgccgcccgcggtggtgccgggcgcccgccgccgactgcagctggccgcggcaggcgcggcgtaccacaagggagccgcgcacgcccctggccctgagaccgcccgctggagcgagcccgtcgatgtgcgtactggttgcaggccggccatgcgnnnnnnnnnnccgccgccgactgcagctggccgcggcaggagcggcgacggccatgcactggctgatggtgggggggtgcgggttccgactgcgcctggtcttgccggtggcgatggctgctga

SEQ ID NO: 3062 - DNA, 702 bp, Chlorella protothecoides
atggcatcggcggtgctgacccccctggtcacccgactgctccggagttttattcgcagctcggcggagagccggggctccaccctgaaggtctccttctcctcgcgaggcaccctgctcctgcacaacctggaactcgatctggatgcattggtgccggggctgagggtgcacaaggccctggctagggccctggagatcactataccctgggcgggcctgtcctcccagcccatccagggcctgcgtcatgcccacccacaggtggtgctcacagctgtggatatcgaggtggggcccgagccggcctctgctgatgcagggcctgagaccaaggcccagcagaccaatctcgcctcccaggcccctcatgagggagggcggggtcctggatggctgggcggggcgctgcagggctggctgctgcgcacgctgtgcaacatgcaggtgacgctgaagcacgtctcgctggcctgggtcggcgcgaatgggtcggtggcggcgcgctgcgctttccagagccttgagttctatacagaccccagcctcgtggccgacatggaggtgagggtggacgggttggcctctggatctggcaagcaggccttcatggaatggggcaggaggggatggcaagacggccgtgtcagcagccttgcacagtgtgggcactgcgtcacaccgctgcattccacagcatga

SEQ ID NO: 3063 - DNA, 1122 bp, Chlorella protothecoides
  modified_base (847)..(856): a, c, t, g, unknown or other
atgggggagctagaagcggtgctggcccctctgcagggccgggctcccttcccggccgacgcggccctgtcctacaccggcccggtcccccgtcgcgccctgcaggctcttgtggcagagctcaccgatcacccacgactgcgctgcctcgccctccagggctgcggcctggacgatgccggggcagacctgctgtcccgggtggtggccttcaaccccaccctcgagcgcctggacctgcgcggcaacgccatcggggcccagggcgcgcagctgctggccaatgcccttcgcacgtacaatgtgggaaccctgcgcgcgctgtgcctggagggtaacccctgcatcacacaggcgccggagctcttccccggcggccagaccgagctgtcggcccaagcaagctccactccccgggccgagaaggggcacgccatgagtgcgccctcccccctgagacccctggacgccaaagtggagcgcaggtgggggctttttgtgttgagaatgaggatggaatcggacatgcaggacatatgccatgtcctgcaccagcactctgagagcttgaaacagtcatggtggaccttgacaacacgattcagtccctgcacatggcttttttgtccaaccccaacaggattccctgcacatggctttttgtccaaccccaacaggatgttgagcctggagcacggcattgaggaggctgccgagcagctgtccagcgtgctgacctggcgcgagcgcttcgacgtggcgtcgggccagatggccgcggtggagcatattgtgtctgcatcactaccaacagagggcgccgaggggatgctccagcacggtgcgnnnnnnnnnnattttgctatcctgggggtgtttttcaggtggagcatgttgtgcctgcatgattaccaacagacggcgccgaggggatgctccagcacggtgcgtgctgacgcactgcctcatcctgccccgacccaccggcaacccacacagcactcggctggagctggtggaaagcgcgtcaccagaggcccagcaggccgtggccgcgctggcgtcccaggtgatgccgcagttgcaggccttgggcgacgcgctgtgcgcactgcgcgatga

SEQ ID NO: 3064 - DNA, 1032 bp, Chlorella protothecoides
atgggcgtgagtggccctgcttctccagctgggctgacacctcctgtcgagtatttggacccaatatccaatgacgtcatgcaggatcccgtggtgctaggagacacgggcaacacctacgagcgaagcaccatatccatgtggctggagcgctgtgcgcgtgcgggccgggccgctacagatccgctcaccggcctcgtcgtgggggatgctcccaagggctgggcctcccgccactacatcgtcgacctggggcgcttcagcaaggcacggaggacgaagcgggccaccccctcaaagcagcctgcaaccgaggcggcgattgggacgagtggcagtccttccaccacaccagcctctcccaggaccgccgagcaccagggctcggactcgcccacccaccgactggagggcggggcatcgaggagtgagggacaccatgccgagccgcctgcccttcccccgcccagccctgccaggccgctctaccctgaccccggcgaccccgcctcggcccgactggggctggacggcgtacccgaggccctggcggccctgcacccctcccgcctcgccgccggcgggtaccccgcgcaggccaaagcggcctacgctgcacgcacgctgagcacgctggcctcccagcgggaggcgcaggatgccatgatggaggtgagggcgcgggtgctatgggtccagtgtgttcgcagaaagcccagattgtgcgggcgtcgctggggcttgacatgttgcatctggaactgggttctggatccgccgacttcctgctcctcgggtgggtggggacgcttgttcctggaattgtacccagctgaatctcttgccccaccttccctctgccccatcctgagcaccgcagcaccaagcagtgccactggccctcgtcctgctgggcaggcggctggcgccagcagacgccacgccccacctcctccgaatcctgcagcggctggcaggtgcgggtggctggccgcggcacctctcgccatcatgtgctggcgggggggatga

SEQ ID NO: 3065 - DNA, 858 bp, Chlorella protothecoides
  modified_base (216)..(225): a, c, t, g, unknown or other
atgcccgacagggttgcatcgtccttttgccgacgcggcactgcactgacacagcggagcggtcgacgccctgccttgccctcttgctcccacctgaacacctccagagcaccatgtttcacccccttccccccatacatatacacccatgcacccacgatcaccccagcctccacaacaacccttacccacccaccacccgcccacccacctccnnnnnnnnnncgcggccgccgcctcgcccctcgccagcgccaggtggcccgggtcggcgcgcggcgcgcggcgcgcggggcccaccctgcgcgccgcggtggacatgctggccgccttccccgccctctacgcgggcaccgtggtggcggtggcccgcaagacggacgccgcgctgtggcccgcgctcttcgcggccgtgggctcgcccttccgcctcgcccagagcctgctggaccagggcgcgccagagggggtgaaacctggtgctctggaggtgttcaggtgggagccagagggcgacgcagggcgtcgaccgctccgctgtgtcagtgcagtgccgcgtcggcaaaaggacgatgcgaccttgtcgggcatacgaagagctttgacagaccattcccccgatggcctaccctcccccaaccccatacccccctcaaccctttgacccccccaaccctttacccccccgtccctttccagaaagcggcggcgtgcctgctggtgatcaaccacctggagggccccggcaccgcccagaacctggcggtgcaggttgtgcgcgaggcggtacgctcgcagcggtacgcgctggccgcagaggccatccgcttcctcacgccgccgggggaggagggcctg

SEQ ID NO: 3066 - DNA, 414 bp, Chlorella protothecoides
atgcgtgcatggcttccggctggcaccgcactcacgtgcccgccaagtgccgcactgcaagcacagggtggcgcatggagcgaggtggcgtccttcctgggaccccccgggcccgatgctgaggtacacgtcctggccatggctgacctgggtcaaaccgaggtggacggcagcgtggaggtggacgccatcgcccctgcctccctgctcacctccctgcggctggcgcaggaggccgccggcgccacgctgatggtgaggcggccgaggagagggatgctgctgcagaggattccctcctgggaggaatgtccggggaagacgagctgcgtggtaggcatgcctactgcgatcgctgctttaaaaagcacagactatggccacagttctgtgcgccgccgtggagatcctcat

SEQ ID NO: 3067 - DNA, 804 bp, Chlorella protothecoides
  modified_base (642)..(651): a, c, t, g, unknown or other
atgatccttcacctgttcaaagtgatccatctcctctgtgccctggccggaggtctggccagaggtcacactcccctgactgacggccatgggcttcccacgaccccacatccgaaatctgcggtcaatgtggctgcagcgagtttggtctgggaaacggcagtgaggctggacctgaacacgagtggcccgcacgtagccggggagtgggtcgaggtccgcatctcgggcgtgatagaccctcgctacgacgacatgatcgctctgtatgctcccgaggacgtcgatccacggactgtggcgcctttgaagtataaattcctggccgctgtccccagctacgttgagcgtggggagggcaccctcagcttccgcctgctgaatctgcgccagccgcagcgcttctacttcctgcgcgacggcctggccctcccggtgtttgcggcgcgttcgcgggccgtagcccccctggaccctggggagcccacccaggtacacctcgcgctgactggacggccatcggaggtcaaggtcctgtgggtcagcgggccggtgggccagccgctcattcgctggggcgccggaccccactctcttgaccgggaggcccccgcggactccaccacctacaccagggaggannnnnnnnnntcaaggtcctgtgggtcagcgggccggtggaccggccgctcattcgctggggcgccgacccccagtatctcgaccgggaggcccccgccgactccaccacctacaccagggaggccatgtgcggggcgcccgccaacagcacaggctggctag

SEQ ID NO: 3068 - DNA, 225 bp, Chlorella protothecoides
atgaacaagaaggagaggcgcctggcgctggccaccgccctgcagtccgccgcacccgacatggtcgtggtggggagcgtcgccgaggcggtgcccgaggtgaagaccaagaacctggtcgccaagctggaaagcattggcgtcttccccatggtgcgcagagtggggtgggagccggccagcgggtgtgcgattgctcgtctttgtcgacgggccggtaactag

SEQ ID NO: 3069 - DNA, 876 bp, Chlorella protothecoides
atgtacatggtgatggctggttggggttgtatgacttgctggaccctgccgggtctccatgcgtttgctcttgggcatcgggttgccacggccattccaggagccgcattgtcatcagtaggaagcccagcctacttggcaggaaaggacactcgacttccatcactgactcccttgatcccacctggagaagcggagctgcagcagcgggtggacgcgctggaagcggagatcctccaggccgcggaccacagcgcgcacgccgcgtcggccctgcgcgccgcccacgagtccctggcgcgcgagcgggagctgggccgcgcgctgcagcgccggctggcagcgggggagcggtcgcgcgagaccatggccgccagctggcgcgagcacaagcgcgtgtcggacgcggcgcgcacagtgcagcgcgcgtaccgtgcgtaccgcctgcgcatcatccgggaccaggcccacgccgggtcgcgggtgcgcacgggggagcgtgggaggggtgtgttggcgatgaggggacgaacagccgcggcgagtgcatcggatgtgcctgcgtgtggacggtcgggagggggccggcgtgcaggggtgtccctggtcggggcggacgaccgccccacccctcctgacgcgctgaccgacgcgcgcagccggctgggcagcctggccgcggagcgggacgcgctggcgcggaagaggcgcgccgacctggccttctccggccagaccctggttcgggagaacctggcggtgctgcaggagggcgtggagagcatcgtggccgccttcctcctgcctgcccgcgacctcaagagcctggcgcgatacgcgcaaaaggtgggctggcgtgtgcggcggcgcttgtga

SEQ ID NO: 3070 - DNA, 363 bp, Chlorella protothecoides
atgtcggtttctgagggggttggaggaatatccggcacgcaaaaccgcacaaatcatcccgtgatgtggggtcgcatcgtgcgagggccctctcacagtgccacgccctctgcatcctcctccaaacaaaatctcatctccgccacccacatccgcgcacaggtgcggtccctggcggccgccgacctgggggccctcacgcgactcagcccccggctggacgcgctgcttgcggacctggcggcctcggcgcgcgcggcggcgcccggcgctgccgaggcgtaccttgtggcgctggccggcgcgctggctgccagcggcgaccgcgcctcccccgacgcgctctcccgggttggcggcgcg

SEQ ID NO: 3071 - DNA, 1368 bp, Chlorella protothecoides
  modified_base (121)..(130): a, c, t, g, unknown or other
  modified_base (646)..(655): a, c, t, g, unknown or other
atgcccaagccagggcatcactccagtctgagctggcccctcccccaacaacgcatgtggccgctgcctgaccacatcatcaccccatcccaccacccccaaacaccccctcgcctttccnnnnnnnnnncaccccggcatgcccaagccagggcatcaccccagtctgagctggcccctcccccaccaacgcatgtggccgctgcccgaccacatcatccccccatcccaccgccccaagcacccctcgcctttcaccaggccgccggcggcgtgttcaacgtgctgttcaagtctggcggcgccgcgtcgctggactccgtggtcccggccctgctggcctcgctggacgcgcccgaggcggagcgccaggcgcaggcgctggagggcctgcgcgtcatcctgggcgtgcggccgagcctgctgggctccatgctgccacgcctgacccgcccaccgcccgtcgcgacgaagctgcgcgcgctgggcacgctgtgcgaggtcgccggcgccgcgctgcacgcgcacctgggctcgctgctgccggcgctgctggcgctgacctcggggcacccggacgtgtcgccggccaccgccgcagcgcacgatgcacaacgcgccgtggttctggccgtgcaggaggatnnnnnnnnnntgctgccggcgctgctggcgctgacctcggagcacccggacgtgtcgccggccaccgccgcggcgcacgatgcacaacgcgccgtggtgctggccgtgcaggaggacgggctgtacctcctcatcgccgagctgctcaaggggctggacgacgacgcgcgccgcgtgggcgccgccgtcggcatcggccagctctgccgcggctcgcgcctcgacttccaagagcacatccccgccctcatcgccggagagacgtggggccatgcggaaggggcggggcagggcccatgtgtggggggtggtaccctccgcgccgggggtgtgcgggggtgcggccaggccccaagcatacatgcgcacgcttctcccatcaggcggcctgatacccacgccttcttcccccgcatgacccctggcaacacgcagtccctggtgccagccctggccgaggagtctgaggaggaggttgtggcctgctgggaggccctggccgccgtcacggggtccattcccaaggagatgcagcccaactatgtgcgctgcctcaaggtgcgatacttgcgttcaggagggaaggggggaaggggacatggggagtctgcgtgcgctggggagcaacaggtggacacccgcgattgtcacctgcaggtggtgtgggaccagggctgtaccccacaccatcgcctgtccagcgctggacccctccatgcctga

SEQ ID NO: 3072 - DNA, 1080 bp, Chlorella protothecoides
atgcccgtggtccagcgcgggctcaaggaccggtccggggacatcaagaaacgcgcggcgcgcatcgtgggcaacctgtcggcgctggccaacgacccgcgcgacatggcgccctacgttgcccgtctgctaccggagctccaggcggcgctggtggacccgctgccggaggtgcgcgccacctcggcgcgcgcggtgggcaccctcgtgcgcggcatgggccccgccgccttctccgacctcgtcccctggctcctgacccgcctcggctcggaggccagcggcgtggagcgctccggcgccgcccagggcctggcagaggtgctggccgtgcagggcgacgcggcggtggaggccctgctgccgaggatcctggagggcgcgagggcgcgctccgctgccgcgcgggagggccacatcacgctgttcaagtatctgcccggctgcatgcccgccgccttccgcgttcacctcgcgcgcgtgctgccggtggtcctgctgggactggccgacgaggcggaaggcgtgcgcgatgccgcgctgtctgccgcgcgcgtggcggtggacctctacgccacctccgccctggagctcctcctgcccgccgtggaggcgggaatcatgaatgccaactggcgcatccgccagtccagcatcgagctcctgggcgacctgctcttcaaggtgggaggcgcgggcgaggggggtggcgggggccacttggtttccgtggccgagtggagaggtcggagccttgtggggtacactgtggcgggatgtgcgggatgcggcacaggaacggtggacgcactttccaagcaccgcgatgtaggatggccgctgacacctcacactgagaccctgacgtctcccactcgcccctctcactcacaggtcgctggcacctcgggccgcatccagcaggacctccagaacgaggaggacgagggcatctccgtcgaggcccacggccgcgccatcgccgaggccctgggcaacgagaggtgggtgggtagtttggcgtgtgtgaggaagaaagctggcggcgggctcggttccggcatgccagtgatagtttga

SEQ ID NO: 3073 - DNA, 354 bp, Chlorella protothecoides
atgattcgcggctcggccgagctgcgggaggtggctgcggagggcctgggccagctggtggagatcacgggggaggaggcgctgcggccctacgtggtgcagagcacggggcccctcatccgcatcatcggcgaccgcttcccctggcaggtcaaggccgccatcctgcgcacgctgggcatcctcatcgccaaggcgggcgccgggctcaagccctttgtgccccagctgcagaccacctttgtcaagtgcctgctggaccccgagcccagggtgaggaggaggggccatgtcggtttccgaggggggtggaggaatagccggcacgcgaaaccgcacacattatccctgtga

SEQ ID NO: 3074 - DNA, 789 bp, Chlorella protothecoides
atgactcgcaaggttagtgctgaggttgacttagttcatcagcaaacgcagaatcagcggtatggctcttctcatattggcgctactgcaaaggatatttctaatgtcgtcactgatgctgcttctggtgtggttgatatttttcatggtattgataaagctgttgccgatacttggaacaatttctggaaagacggtaaagctgatggcttttttatggttcgttcttattacccttctgaatgtcacgctgattattttgactttgagcgtatcgaggctcttaaacctgctattgaggcttgtggcatttctactctttctcaatccccaatgcttggcttccataagcagatggataaccgcatcaagctcttggaagagattctgtcttttcgtatgcagggcgttgagttcgataatggtgatatgtatgttgacggccataaggctgcttctgacgttcgtgatgagtttgtatctgttactgagaagttaatggatgaattggcacaatgctacaatgtgctcccccaacttgatattaataacactatagaccaccgccccgaaggggacgaaaaatggtttttagagaacgagaagacggttacgcagttttgccgcaagctggctgctgaacgccctcttaaggatattcgcgatgagtataattaccccaaaaagaaaggtattaaggatgagtgttcaagattgctggaggcctccactatgaaatcgcgtagaggctttgctattcagcgtttgatgaatgcaatgcgacaggct

SEQ ID NO: 3075 - DNA, 999 bp, Chlorella protothecoides
atggggccccttggttggtggcgcgacgcccctgcgctatgcaggctgtcagcgctcttagacacaacactcatgtcccttagagggaggagtgaggaagcatggggtcccttgggttggaggcgtgacgcccctgcgctatgcaagctgtcagcgctcttagacacaacactcacgtcgcttgggtgtcttgagaggtgcagcgaacgtcgtggtgcccgctccgtacccctattcagtatacatgcccttgacattccccctctccaccaccacaacgacaaccaggccatggatgagatgctggagaagctggtgctcaacagcacggaggggcacatgtacatcgccgagctggatagtcaaggggcccctgctctgctatcatggcgcaacccttccgtcgctgcccttcagcaccgatttgtaccatgtccacccttctgccccgccacctccacaccttcaaaccaggacacacacactcaagcgcccccctcttttctctccccactcccctcatacaggaagacggtgcggcacaagatggaccacctggtgtgctttgtccccggcatgctggccctaggagtgcactccggagcagtgggcggcgagaagggggagcgctacatggcggtggcggcgggggtcaccgagacctgctggcacatgtatgatcgccaggcgtcgggcctgagccccgagatcgtgaccttccgggcagggggcgcgatgcgtgacggcggggcctacaacctactgcgcccggaggcggtggaggccttctggtacatgtggcgtgtgacgcgggactggaagtaccgggactggggctgggccgtcttccagaccatgcagcggcatgggaggaaggaggcagggttctccggggtcaaggacgtgcgcgaggcggagcccacgccggacgatacgcagcagagctttgtgctggcggagaccttcaagtacctctggctgctcttcaggtgtctttga

SEQ ID NO: 3076 - DNA, 825 bp, Chlorella protothecoides
atgctgcacgcttggcagggctacgtgaccttcgcctggggccacgacgagctctgtcctatcagccagacggggaaggatgactttgggggcctgggcgccaccatcgtggactccctggacaccctgcgcatgatgggtgagcgggggtgggatggcattggggtcgatgcctgggaccccgaggtccgagtccgagatccactcttctcatcgcttgggaccagccccagcgcaagcttcactgaggagtatgagcgcgcgctgggctgggtgcgcaccgggctgaacctgaccgtggacttcaacgcctcggtgttcgagaccacgatccgggtggtgggcggcttcctggccgcctacgagctgactggggacgaggtcctgctcaagcgctcgctgcaggtggcagagcgcctgctgccggcctacgacacgccaacaggcatcccatacggcaccatcaacctcaagacgatggcgccgcgcaaccccaagtgggcctccaaggcctccagcctggccgagttcggcacgcaccagctggagtggtacaagctcagcgcgctgagcggggaccggcgcttcgccgacctggcggagcacagcatccgctacctgaacgagcagttcccggggcagggcctgatgcccctgttcctcagcccctccacgggcaagttcacctcccgccgcatctcgctcggcgccctaggcgactcctactacgagtacctgctcaagatgtggctactcaagggcaagacagatgacatgtaccgcgccatgtgggagcaggtgggcttacttgagggggaggagtga

SEQ ID NO: 3077 - DNA, 627 bp, Chlorella protothecoides
atgcgggcccaccccgggccccagcggggcccgaaagcctcgccagacgcccctgcacgcgaggcgcaggcaccgatggagggctctgggcacagaagcaggcgtcagcataagagcctgccccaaccacatgggaatgcgcgggacctgtcgggcccagacctgtgctccccgagggggcatgctccccaccccccccacgcatcgcgaccaccacagctggatgtagcaattcagaggcaccaggagcaggaggcctggctgtcgacgctgcctgatgcccccacgtaccggcccagcgcggaggagtggggcgaccccctagcctacatccgctccatccagcccgaggccagcctggccggcatagccctcatccacgcccccgtggcccccgccctggctcccggccgggtcctggcagacgtcccgggcttccgtttcaccacccgcatccaggccctgggtcgacaacgctggacggcctgggactcggtgcgtttcgaggagggagaccgcgagtacacgctggaggagtttgccgccgaggccgccgcggcagaggccgcgtggtacggcggcctggcggggccgctgccaccccgcaccgctgaggtgaggggttga

SEQ ID NO: 3078 - DNA, 666 bp, Chlorella protothecoides
  modified_base (569)..(578): a, c, t, g, unknown or other
gcggccgccgcggcctggttcctgctcccgcccgcgctgcgcctgctggggtcggggttccgcgggtatgcgggcgagatcgcgcccgccgccgccctcaacgagctgtccggctggcgtgacggcgtgctggtggacctgcgcagcgaccgcgagaagtcggtggcgggcgtcccggacctgcccagcgccgggaagctggtggaggtggagtacgcggagatcggggaccgcagggcgcgcggcgccctgcgcgaccccgggtcgctggaggcagaggtcactgccatgcaggtggcggggctgaagcgcgccaagcgcggctcgcccatctacctgctggacaagaacgggggcgtggccaagacgggtgggtggaggggtgtgaggggtgtggagggaaccggtgcctggcgccatgccgggaaggctcttggagtgatttgtcaggcggtcattatgacaccccagtgcacaatgctgatctcttccagtagccttgccacactgtgctcaccctgcacttcacaacccttgcccccaaacacgcagttgcaaagaacctggcnnnnnnnnnnagcgtggccaagacgggtgggtggagggttgtggggggtgtggagggaaccggtgcctggctccatgccgggaagggtcttggagtga

SEQ ID NO: 3079 - DNA, 462 bp, Chlorella protothecoides
  modified_base (220)..(307): a, c, t, g, unknown or other
gcgccgcacgccgagctggcgctgccgggcgcgccgggcgacctggcgcacccgctggcctgcgtcgcgccccgggcgctcctgtccaagacgctgactgtgtacgacctggcctcggggcgcgtggtgctggcccccggcgacgtggcggccaccgtgcccgaggccccccgcgccggccgcctgacgctggcggcgctggacgaggaggaggtctggnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttcttcgccctccgcgcctggaccagcgtggcggggcggcgcgggtacgtgctggagggctccgaggcggccgcgttcctgtcggaccgcggcgccgcgccgggcgacgagctggtgctctggcgcgacggcgcgtgggagccgccgcgcgtg

SEQ ID NO: 3080 - DNA, 816 bp, Chlorella protothecoides
atgactggcagtccccgttccagaggagggccccaagaagagcgccatggtggagaccctgctgctggggtccctcttcggtctctggtacctcttcaacatctggttcaacatgtgggtgccgggagtggccttgtgtattcgaggggcgtcactggtgggctgcctggcgtgttatgcaggcccatcgccgggggttgggaagcacagcctcagatcaaggcctcccctgccccccctccatccgctccaccccccaactgcagctacaacaagcaggtgctgaagaccttcccccacccgctgaccatcaccgccttccagttcttcatcggctccctggtgtccctcaccatgtggaccctgggcctccacaagaagccccaggccagcactgagaaccccattcagcataccaaatggaccccctctcccgacgagaaccctctgtcgcttgcatcgacaccctcccacggcacaggtgatgggcgtgtcccccctggcggcggtgcacacactgggcaatgcgctgaccaacatctcgctgggggcggtggcggtgtccttcacacacaccatcaaggccctggagcccttcttctccgtcctgctctccgccatgttcctgggcgagtcgcccaccctgcccgtggtcctgtccctcttccccatcatcggcggtgtggcgctggcctccacctccgagctctctttcacctgggtgggcttcctggcggccatgggctccaacctcaccttccagtcgcgcaacgtgctgtccaagaagttcatgggcaagggtgggttggtgggtga

SEQ ID NO: 3081 - DNA, 996 bp, Chlorella protothecoides
atgggcattgtgacatgggactttactggagagttgtgcatggatcgaatggcacgacattctgacgaagaggcgaacgatattcagcgcagcctccacactccgatctctcgctgcaagcgtcgatacatgagcatcctgccccctcttgaccccttccccaccctcacccatgcccaggtttcctacatgatcctccagcgtgtgtcccctgtgacccactccatcggcaactgcgtcaagcgggtggtggtcatcgtggcctcggtgtttgtcttccagaaccccgaggggtgccaggggcagcgatttgttgccgccaacttgacgagaagctgccctgcaccgagcagtgcaaatgctgagaggcagccgagcaaaaattcaccatacatgcaccgtgcaggcacggccattgcgctggcgggcgtgtttgggtactcccagaactctgaaattcaaccattactgcctgtgcctatcctgcaatgtgatgggaacacccagatccggtgtcatgacatggacccctggaggaaggaggattccatggggttggcgcgcgacttcccggaacggatgatgacccggttgcccagggcggagccaggatggccggccctccctcgctcaaaccaggcaaagcttattccgagcgcgctggcatgccctgcattgctttcgctcctatctagtgatatccaggcggcatcgaggagagccaccagggacccgaccttggcacccactcgcacgcccacacccaagcctgcgccctgcggtacctccgagcagaagtgcaccgccgaggaagccttgagccaaagcactcccctttcggatattcgtgcgatcgctctcggcgccacagcccttgtacctccccgcgccgcagtccagcatgtcacagccggtcatctcccacaacctgttctcggcgctttccaagtcgaagaagagcaagacaaaccccaagcagaaggtgaagaaggttaa

SEQ ID NO: 3082 - DNA, 918 bp, Chlorella protothecoides
atggctgaagtgaccgcgccgggtgcgaagactttcgacctcgcagaagtgtcactgcaccagacagaaaaagactgctggatggccatcaatggcaaagtgtacaatgtcacagacttcctggacgagcaccctgggggctacgacatcgtggtctccaactccggtgcagagggcggtgtgggaggcctcggcaaggacgcaacagaggatttcgaggagattggccacagcaagaccgccaaggacatgctcaaggaatactatgtcggcgagtttgtggtagttgcgctgtggatgtctccagagacctgtttcggcatgcggcctggctcccatgaggtgcatggtggcctgacaccttcccctgtctcacagggtggtgaactgccggtcaagaccaagaagcagaatgcatctgcgggtcacccagggcatggccttggcacccctgggccaggttcaggccgttggcgtgccacagagggccccaggtatcatattacccctgtgttagcccttttgtttcccattcagccacacgcactgtgttcagtttgtagaaacgtcacttccttcccaagcatcgacaaggcaaggggacggcctgtgatcagaatcctgccaaggaggcaagcagccacagaggggcaaacacgtgggcagcgacagggggtccagacgcagctgaacaattgccagtcaccagacaggtcaccgcttgggggcttggttgtagcgcgaagtgtccttcttcttcttgtccttagcctttgcactcgcaaccgatgcggccgcggctgtggaaggaggattaagggagctaaagacacaggatgcgtttcgcgggtggggaggggagtggtcatccggtttgccttcagatacaacccaggagtgccagcagatgtcagctaa

SEQ ID NO: 3083 - DNA, 879 bp, Chlorella protothecoides
atgcagatacacctatcccacaaccagctcacaatggtgggggcccgggcgctaatggacagcgtgcagagcacgcagccgcccccagccaagcccctgtggctgcgcctggaatggaatcgcatctccctgaccgacctcgggcaggtgggtgtggtgtgtgtcagctggctcattgagccggcgcccagcttggcaaagagtgggagtcgttggtgggtcacgaccgccttgcaagggcatggctcagtcccacacaaaccttcgccaccaatgcagtacctggaggcacagcatgcggagcggggcctcctggcggacatccccgagggacttgaccctgggtcgacccctgccctgccccacatgccctcctacctggcagcctcgggcggcggccggcccggcccccgccgaccctcaaggggccatcccccgtcgcgcaacaagttgcgcttcctggtccacccctgccacgtgcgactgccctggctggtcagccagttcgagctccccgccgaggccgccgtcctacgcagcgccaagctgcagtggcaggggccgcggggcggggaaggcaacgcgaatgaggtcccggccacggccccacccctcaacgctggggacaagtcgccgtcgccccatccccaccacgcctcctccggcccgctcctcctcttcccggacacctcggccctgctggccatgctgggcgccaggcgcagcgcggtcccgccctgctggctcaccctggagcgactggcagagctgacggagcggggccagtttgggcgcaccctgccctccaatgagcaggtgggtgtgggcaggcagggggagcttgtaatagatggagggtgtgagaatctagtcaggtag

SEQ ID NO: 3084 - DNA, 2298 bp, Chlorella protothecoides
  modified_base (1073)..(1082): a, c, t, g, unknown or other
atgcaatcccctgaccactctactcggctcacacaagccccgccccacctcctccaggccgagatgaaggatcccagccacggccaccgctcccctgtccccgcacttattgtcaaacagccacagcttccgcacagctgcccgcgagcggtgagccaggcaccaggccgccacgcaagcgacctcctcgtcccccagctccaggcgctccaggcggagcgagaggggcgtgggcggggcggggccggccgtcgcagcctcgccagcctcgctgggcgcacccctgagccacaggtccgcaagctccgcagccagggtctcggccgaccaggagcctgcgccctcgccgctccccgaggcttcggccacgtgggtctgcacagagcgcggcccggcgtccgactgccagacagacaggaagtcggccaggccctccaggaaggaggggagcaggaagggagcgtctgggtgaggcgtcacggtgaccagccccccggcatcctcctcccagaccacggcatgggcgcccctgccgtgcacggctgccgagtcggcgacgctgcgatgcagtggggagggggaaaagcgggccttgcgccccctcctcgacttgggcgtgctgtcacggtggtcagccgtggtcctggtggctgctggggtgtaggagctgcctggtggaggagcacgtgggggggtgggggcctccctgccagcccctcttccacgcccattcctgccactagtcccacgcccacgagccgccctcccctgtgtggcggtggtaaatactcagatggaggcatgaagagacgatgtgggcatggtgacaacaagataggatcgagcaccccgctcaccccaattcgtcctccatgtggagtggtgaccatggggtggggagccactgacattcatcaagcaaaagcttccggctcgatggttcgaatgaacccctgcacagagagatctcgcgtctgggcgcggaatcatggacctgttctcagaactttagagttgggaagttgtcccagatctgggtcaccacatcacccatcgggttcggatcaaggtcnnnnnnnnnncaacccctgcaaagagagatctcgcgtcagggcgcggaatcatggacctatcccacaaggagctgcgcggcctctcgctgacaagcgtgtggtggtcgcgagacagtcgtcggaaggaggggcgttgggactggccatgcagtctctgcgcacctggttcggggggtcggctaccgatacagaacccccagcatcagttttggcagagtggaatgcgtacagcgccactcccagttcatcccgagccaccgaccggcttctcacctccgctgaagagggagcggcaggggtgaccaagttcgtgaccgaggcggtgggcgtcttcaacacccgcgtatctggagcagccagggatgtgactacgacagtccagagcgtccagttgactactctcacaggagcctgtcgcacgcaccttaccacaacccatcgacccattccccgcagcataccgagcgccgctcaatggacatactttgcggtgtttgctggcacaggcgtcttgttcctgctggcgtcgctgttcgtcttcctccccctcatcatcctgtcgccctccaagttcgcgctcactttcagcctcggctcaggcctcatcctcgcctcgctgggggccctgaagggctggcgccagatggcggggcacatgacggcaaaggagcgcctgccattcactgctggtgtgctggagggacgcggtgtgcaggacgccctgcacgtcaagctctggaagcacaatcttgtgtttggggtggtcatgattgccgatgctgaagcacgctggggtgtggagtcgaggagccacgccctcacaactcaccccgggtgccacccaccctcacacagcatatctcgggagcctggtggggaccatctatgctgccgtggtcatgcacagctacgtcttttccatcatcttctgcgtgactcaggtgcaccgcgggccgtgggacatatgtcaagatcatcaccttgctctactacctggcctcctacttccctggcggagccacgggggtgcagtaccttgtgggtgggatggggaagggggtgttctccctcggggccgcggcggcccgttctgcattttcgcgatgatccttacttgtgcacagtgtcaacttttcaaagagattgcattgccatcgcaaagccattcattcaaggaagggggtgggggtcgagcatggtcagcacaccgtcgagcaaagagtaa

SEQ ID NO: 3085 - DNA, 1680 bp, Chlorella protothecoides
  modified_base (265)..(274): a, c, t, g, unknown or other
  modified_base (522)..(531): a, c, t, g, unknown or other
  modified_base (848)..(857): a, c, t, g, unknown or other
  modified_base (1154)..(1163): a, c, t, g, unknown or other
  modified_base (1264)..(1273): a, c, t, g, unknown or other
atgcaacctcggccgacggggcgggaccttttagagattacgggaatggcggaagtatgcttcaaatatctttctggtatgctgtgtttctctttccatgctaaaactatacaaggactttgttttccgcgcgcgccttatccctcgcatggcgatttcggtccgggcatgcacagcatgtcacgagagttgctggccactcgaagaccagcagtcggaagagcgatgtcattctttcaattgatgctagtcactggagtggttnnnnnnnnnnatgcacagcatgtcacgagagttgctggcccctcgaagtccaggagtcgcaagagcgacgtcactctttcaattgatgctgggcactggagtggtcagagtcattctcgcaaccataccataacacttgcacatgccgatggctgccatggccgtcaactgccagtcgtcgcggtgccagccgggtctggtacccatcacccacgttgcacccaagacggcctcgcgccagacgcttgcgcgacaacnnnnnnnnnntggtacccatcacccacgttgcacccaagatggcctcgcgccagacacctgcgcggcaatggagcagcatttgtcaccagtcgcgccccgacgtcagaccaacaaggactgcatgccatcgtggtgggtggaggggtgatgggcctgtttgccgctcaagccctcctagataccttcgaccgcgtcactttggttgaacgcaatgaccctctgcgggccaccgtggcaagcgaaagctgggaggaggtgagttggtcatgtatgactaatctgcgtttatgtgacagcctaggcttgacaccagtcttgactgtccnnnnnnnnnncgaaagctgggaggagacatcgaatagaaggtctggagtacctcaaatcaatcagccccacaatttccttgtgggtggagtcatggccatggaggaactcatgcccggctgcaggcagcagctgcttgcaaggggcgctttggagttggatcttggaaaggacgtcgcataccatgactatggtggcctcttcccacgttgcgtgtctggactgaaggggctgggggtgtctcgccgcctgctggaggaggagctgtatgcgtacctcctcagcacaggagggaaacgcctttgcgnnnnnnnnnncgcataccatgactatggtggcctcttcccgcgttacgtgtctggactgaaggtatcaagtctgtcttcagatcaacgtacatcttgcaagctgttgtcannnnnnnnnntcattccccgaacgatggtcactggccttgcgtgggatgcaaaccatcagacagtcgtcgggacaccgtcaatcacctcactgcgtccgctcggcctcacctacccaggcattcactgtggagacgggagtcaactgggggcagaccttgtcgtggaggcgagtgggcgccgctcctccctgcctgagtggctggcggagaaggggtgggccccccctcccgagcgcagggtgcttgccaaggtggtcgccgccagtctgacagtgtcatggccggaagactgggactgccacaaggtgagggtgtgtgggaagcgaggaattatcagggaatgccagtcatcagcagggagctgtgtgcaaggttctgcttgggcacctgcggcttatgttgagcgtggaaagtga

SEQ ID NO: 3086 - DNA, 921 bp, Chlorella protothecoides
atgagtttatggagcgccagcagcatgcagcaagctagcgcgcccctaagctcgagcagcggtagatgttggcagcgagtgtcgtccccacccttcacccagcggctaccacggcatacctgcagaagatgcacgcccagcgtggcccggcatgcaatcaagcaacgtccgctccagacctctaccagcctggaggtcctccaggctctgagcgacgacgactgggaagaggacgatgaggacgttgatgcagcagattttgacctccctgaatcctcatccttccctaccaagcgcctgccggcagaggtccgatgctttgacaccgctaccatcatggtggcggggggcacgggtggccggggctgcgtcgcctttaggcgcgagaagttcgttccgcgcgggggcccctcgggcgggaatgggggcaaggggggcgatgtttacctcgtgggggacgcctcgcaaaattccctgctctccttccggcgctcggtgcacttcaggtgggcatggggtgggggggtggaagcgaatgacgtaaggaaaggtcggctacagctgtctcgcctgaccatcagcttcctcaggagcacccatctcatgggctgcatgccacctggccctcgcttggtatggacttgtctcccaggatgctccgctgttcatgattctatcagcccctcagccccttaccctcccaccctcccatcctcctcaccgtgcagggcggagcatggggagcccggccagggctctgacatgcatggccaggggggcaaggacatctcggtctccgtcccccccggcaccgtggtgtgggcccgggatgccgctgcgggggaccccccccttggcgaggtgctggcgccagcaccccctccctcgctccggctagcttgttgtcaaccccccatctaa

SEQ ID NO: 3087 - DNA, 1629 bp, Chlorella protothecoides
  modified_base (794)..(803): a, c, t, g, unknown or other
atgcccttcatgccatcgttaaacaccccctctcctcatcaaggacgagaatgtggacccaaacagctctggcggcaccgccgctgtcctgtgcgggcaaaaggagatgaccgtggaactgacggcgctgctgaaggagcggggcgtggacgccatcctgctcaacttctgatgccacctgcgttctatgatgggcgctgttctcagcctgaggtgactgctccagcggggagcggcgcaggggtggtcgggccaggaccatggaaaccctggccggcgcagcatggggttgaggaagggcggatgcaagcatccatgcccccgccgtcacccagtggtgtgcggccatcgcgcggacccccgccccacgacgccagcctccttgcgcgcctcgatccaggccccgtacagcgcccccttgccctggtcctcgctgtagttgaactccacctcgcccaccaccaccgtgtcccccggcctgaccccggccctgaccagggccgcctccacgcccgcggccttgagcacgccctggaagcgcgccgcggcctcaaagtaggaccagtcggtcatctgcgcgaagcgctccagcgcctcgccgctgacataccaggtgcgcggacccgccaggtcggagctgatggagaagtcgctgaggcgcgcggtgttgaccgccgcgggcggcggcgccagcgccacgacctccggctcgagagtggcgtcggcgcccgggcggagcggggtcgcggccggacccgcggctcccgccccggcgacgttccagccccagccannnnnnnnnngcggcgccagcgccacgacctccggctcgacggtggcgtcggcgccggggcggagcggggtcgccgccggccccgcggcccccgccccggcgacgttccagccccagccgtcggcacgggggccggtgcggtcgggccgaacctcccccggctcctcccagctccccgaagcccctgcgccatccagcaggcggcgcacgcggcggaccagggcgggcacccccgtccccgccgccgccgagacggccaggacgtcctcgtcggccaggccgtgctcctcgcacaacgtcgcgcgcacgtcgggccagtaatcggaggaggcgggcgtgtccatcttgttgtaggccagcacgaagggcttggccgccaggccggggtcaaacagctccagctcgcggcgcacggccaggaagtcggcgcaggggtcggggccggagccgtcgacgacgtggaccagcaccgagcagcggcggcagtggcgcaggaactcgtggccgaggcccgtgcccgcgtgcgcgccctccaccagccccggcacgtctgtgtgtgtttggtggtgggcggatcagtgggtgggtcgagaaggagggagggggcggggcggggggggaatgtgcgatgggatggccccacctgcaaacacggtgctcctgccgtccatgccgcagacaccgagattgggcgtcagggtggtgaaggggtagtcggccaccttgggccgggccgcgctgagcacccgcagcagcgtggacttgcccgcattgggtgcgccgatgatgccggcgtccgccaccagctgcatctccagcctcagccacgtctctga

SEQ ID NO: 3088 - DNA, 900 bp, Chlorella protothecoides
atgaagcatcatgcaactctcaccatgatactcatcgactggaagatcgcaaacccctttatccaaaattaccattggttgcatatagagagcgatcggatggtgctcgctctgcccctggtgttcagttgtgtgcacacttcccagtcctgccgacacggtgtccaggcattccgctcactgcgtcccttcgcggccacgccggcatccttagcaagttcaaaattcagttccgttctcaaccctcagaatgccaggtgcgctgcggggtgcgactctgcctggcatagtttttggcatatgtcttggcgactccaagcctccaccgccgccctccccctcagaacacccgggatccccgtgctgagacttaggccgggcaggagcggcctcgttcgtgctgcctggggggcagatgtcgagttccatcccgccaaggtcacgagcaacaaggaggaagcactgaaggtagttggctgggaagattggaatggtgtgcgtgcaagcctgcatgtgcgactgggaattcctctagacatcatttacagctccgctggctgcaaacccttctgcccctccattccacgctcgcagcaacacaggctggtcattgaagtgggcaagctggcggcagagtactctacaccggggcagtttgtgcaggccaagcgccgggcggaggacaaggccggcttcttcgccatcgcctccccgccggatctggattcggggcgcctggagctcctgctgaaggcctcgggcgcgactgccgaggagctgtgcgccttgaaaccgggtacggggctgtggagactggtgccattcccacatgcgcccaggcacggcagactctctgcaggagcgggcgttttagactggagtgggagcccacctgtttga

SEQ ID NO: 3089 - DNA, 336 bp, Chlorella protothecoides
atggcggagacatcgacatccggagcgtcactccccgagctggtacccaaagcctccttcatcgaggatgtcagtgaataccttcaaggtgcatcagtcgatgatgcattgaatgagctgcggggggcccaccaaaagtacaagtacatcgagcaggagattgtgcagcggaagcagcgtctagcatttaagcaaccagagatcgagaagtgcctggctagcgtcaagctgctggccgctcaaaaggaagagggaacagaggtgtgcggtggggttggtggtgggtatttaggtcgagtgggcttggcggggaggtcgagtgggcttggcgggtag

SEQ ID NO: 3090 - DNA, 345 bp, Chlorella protothecoides
atggttgcgctgggacccctgcctggcatccacataccaggacactctctgaatggagtgaggaacatgttgccctgtgatacaatggcattgccagcattgccgggcatgcctcaacccctggccatgactgatgggtacattcggtgcgccccattactacttgaatcgcaggcggtgctggactttgcgctgtccgaccaggtatttgccaaggcgcggctggcgaatgtggaggcggtgaacctgtggctgggagcaggcgtcatgctggagtactcgctgccagacgcgcagcagctcctggtgaggccgggcgcaggcgtgcggcatggagttgcctga

SEQ ID NO: 3091 - DNA, 225 bp, Chlorella protothecoides
atgcggcaggggtccgatgcatcggatgtgccctgtggcatcggcgatcgctgtgccaatctgccctcactgcctgtactgtgctccacagggtctgagatcagggtggacatgtggaggtgcgacggcaaccacaaggtctggtacgaatggtcggtgtcctgcggcaccctgaggggagccatccacaacccaaacggccgatcctacgcagtggggctttga

SEQ ID NO: 3092 - DNA, 393 bp, Chlorella protothecoides
atggacgacgattgtgcgcacgactacttcgacaggaccacggcggcggtcgtaatgcgggtactcacagcccaggcaaccaagcgtgtgctgcatcagctgcaggagtctgacctcatcatcgcacagtggctcaaccacttttgcgcagagcaccctcccctggatggcaataagggaggtggctgtgtctggggcggcagcagggtgggacctgccagggtccttgttattcaaccaggcgtgcaccagccagcccatttgccccttgcccccggtgatctgcccttgtcgggggggccccgggctggtggccacaatccatttgctgattcagaagttttgactgttcacacggtgcccatgtgttactctggtcttaccaccatctga

SEQ ID NO: 3093 - DNA, 489 bp, Chlorella protothecoides
atgggcaagggcttccggatcgacaccatcccagtggagcagtacccatcgatcctgctctttgccacgggatcagccctcagcccggcaggagctggctggtccagcatgcatgggaccgcagcgcagccctggctgccagatccacccggtgtcccctgccagccacggccgtggacccccgctcaccctcccgtgcatcaccccctccacccaggcatctcccccatcaaggcgctcatagagtcgggggcgctggccggccggaggagtgtccggctgtactacgggacgcgcactcccgagcacatggcctttgcccagagcatcgaggcctggagcagcgagcacggcgtcaccgtgctccccgtcttctcctcctccgacgacggctacgtgcaggatgcctttgcccgggatgcctttgccagggtgagcggtgagaggagtggccagggggcttgctgggcggcaggcggacggacgtga

SEQ ID NO: 3094 - DNA, 1005 bp, Chlorella protothecoides
atgccttcccaccagccgaccctgaacgcatcactcccgctgcgcaggctggttcaggcacacggcgagggctcctggtccaccatcgcccgcgccttcgagggtcggaccgggaagcagtgccgcgaacggtgggccaaccacctgcgccccaacatccggcgcggggcctggcgggaggaggaggagctgcgctttgtggactgccaccgcacggtgggcaaccgctgggccgacatcgccaagcgcatccccgggcgcacggagaacgcggtgaagaaccactggaacgccaccctgcgccggaagccgtgcagtgcccccggcgggcgggacaccctactcaagcgctacatggtggagcaggggctgtgccccggtccccccgccctgccgccagactccgggcgaagcaagagatcacggcggcacgtgcgccagggggcacccccagggctggccgatgcgggccccggcgccgcccgcctgtgtcggcccctggaccctggggccttgccctccccagagcccatggtgtccacaacccacccgcccctgccgacgcgtggagcccatgatgtccacaacccacccgcccctgccgatgcgtgggtcgggcctcatcactcgcagcatggcctggagggaggggcaggcgggggtccaccctgggcccgtctccccatgcaggcgcaagccaccgccgcagccgccgttctgcacgcccgccggcgcgggtggtggtgccgcgcccatgctcgacggggtccagcgccccaccccatccacccccgacctggagttggatgggatcctggagtggctgggttccagcagggccaccacgccgtctgtccgctctgtggtgcgtgcgaggggtggaggatacttggattcggaaaggcaatccttctgccacttgcccccgtgcttggtcaggcgcggtccccatctcatccaaacaaaactcaagccagtcctggcccacttgctgtctgtccatag

SEQ ID NO: 3095 - DNA, 663 bp, Chlorella protothecoides
atgctcaagctgggggtgcaggtcgtgctgcgaggtgccccccgccatacgcccccgggaggcgatgaatctgatgctggcttgaagcttcccagcaacccactgcggccatactgggagtacctgtccttcctgttcaggaagggggaaatagcagctgagcagcagcctgcagagctggcgtaccgcgacttcctccaagtaggaggaatgcatatggacaacctggagagccagacgtatgaggtgttcgagcgggatgccaccaagtacaacacctacgaggaagctgtgtattgtgcgctcctagaccgagtgccagcagggagtgaggagggcactgccacggtgagtgcacagatgaaacacaggggtcaagaggggcatggaagtgggtggccgctgcacttcagcctggcgagcccggccgctgagggcctatcttcgagtgcacagattgacgcacgtgcgtgtctcgccctcccaggttgtgatggtggtgggagccgggcgcggacccatcgtggcagcgtgcctggctgcggcgcagcgtgcaaagcgtgccgtgcgtatgtatgccgtggagaaaaaccccaacgccatcgtcaccctgagccacagagtcgaaacagagtgcggcgggatgggatgtggggggactga

SEQ ID NO: 3096 - DNA, 525 bp, Chlorella protothecoides
atgcagcgctcgctgctctgcggcttcgactttgtcctggcccccctggtgcatccccggttccgaagaggtccagactaccccggtgccttcacgcgctccgacctcctcctcacggccagccaatggagcgggcaggtggtgggcagcacgagcccctggatcaaccccgacgcgcctcaggataccgccctgcgctcccagagcgaggctgccctgcgccaggagctgcactgggcggcccacctgtccctgcaggcctgcatcctgccaggggctgggggccccaaccaggcccgcatcctgaaccaggccctgctcaccctgacgggcatggccctctgggtcagggtcaggctgggtgggcccgaggacgcgtgggaggagtggaacactctccgctttgcctgcgcccacagcacccgactgggggccgtgctggagggatggcaggggatgaagggtcccgctcttcacacctggctgcaggggccggtgtttggtgcgatggtgtcggggctgtaa

SEQ ID NO: 3097 - DNA, 840 bp, Chlorella protothecoides
atggtcaccactccacatggaggacgaattggggggagggcggctcgtgggcgtgggactagtggcaggaatgggcgtggaagaggggctggcagggaggcccccacccccccacgtgctcctccaccaggcagctcctacaccccagcagccaccaggaccacggctgaccaccgtgacagcacgcccaagtcgaggagggggcgcaaggcccgcttttccccctccccactgcatcgcagcgtcgccgactcggcagccgtgcacggcaggggcgcccatgccgtggtctgggaggaggatgccggggggctggtcaccgtgacgcctcacccagacgctcccttcctgctcccctccttcctggagggcctggccgacttcctgtctgtctggcagtcggacgccgggccgcgctctgtgcagacccacgtggccgaagcctcggggagcggcgagggcgcaggctcctggtcggccgagaccctggctgcggagcttgcggacctgtggctcaggggtgcgcccagcgaggctggcgaggctgcgacggccggccccgccccgcccacgcccctctcgctccgcctggagcgcctggagctgggggacgaggaggtcgcttgcgtggcggcctggtgcctggctcaccgctcgcgggcagctgtgcggaagctgtggctgtttgacaataagtgcggggacaggggagcggtggccgtggctgggatccttcatctcggcctggaggaggtggggcggggcttgtgtgagccgagtagagtggtcaggggattgcatgggggacgtttgggaacaggggagggctgcgacgcgtaa

SEQ ID NO: 3098 - DNA, 339 bp, Chlorella protothecoides
  modified_base (35)..(44): a, c, t, g, unknown or other
atgcaggcacatccagcctctgcacaccctggttnnnnnnnnnnctgtgcgtttgccctcatctctccctcgcttgtcccgtgggcagcgcggcacggtgaacccaacgcccttccatctgaggcccccccccaaaaccccctcccaacaaccgccaggcacatcgagatgcagttcatgaccgaggcccggaccaccgtggtgtacgacatgccgctcgcggaggtggtgatggacctgtttgacgcgctgaagtcgcggtcccgaggctacgcctccatggagtactccatcacaggtgtggatgggtgtgggtgccctatgtggaggtcgatgtaa

SEQ ID NO: 3099 - DNA, 2067 bp, Chlorella protothecoides
  modified_base (536)..(545): a, c, t, g, unknown or other
  modified_base (822)..(831): a, c, t, g, unknown or other
  modified_base (1876)..(1885): a, c, t, g, unknown or other
atggtgtggcggcatggaacgccacgtgtatggttgtgcgctcgtgcgcatgctggagacatggcgacgtcccatcccccaccgcgcccccctcgtgcagtggtgcagcgcatcccgccacccagggacacgcggggggacccgctacgggcgctcatcttcgactcctactacgacccgtacaaggtgtgcgaggttcgagtgccccatgtccccgtgcctgtcgccaggaatgagcaaggggcggatgagcaaggggcgtgggcgtgggtcgccgagcggggcgaccgtccggtcatcccacctcgacaagccttggccccctcctctaactggaggctggacgttctcccccttccctcactacagggcgtggtggcccagttccgggtgatggacggcgagttgcggaggggcgacgtcgtgcgcttcatgaacacgcggtgcgagcatcccgtggccgagctgggggtgctggcgcccaaggccgtcgaggtgggtcccttgggtgtttggcatgtgggtgggggggggtnnnnnnnnnnctggcgcccaaggccgtcgaggtgggtcccctgggtgtgtggcatgtggggtgggggggggtatttgaaggggcgtgttgcgagcagggggcagttgggatcatctcggtgcttgggaggggtctgcggtgggtgtgaggatgggcagcggggatcgggggggggcaggcagcgccgccctttcttctgcaagcctcctgggcggcacatgtacccctgtggatggggcccccgcctctccacaatcatcaccacaccacaccacacccactcaaannnnnnnnnnctcctgggcggcacatgtacccctgtggattgggcccccgcctctccaccatcatcaccacaccacaccccacccactcaaccatttgcaggtggagagcctgcatgctggggaggtgggctacctggcggctgccatcaagtcggtggccgacgctcgcgtgggcgacacggtgacgctgaagcgcgagcccgcgaccgaggcgctgccgggatacacggaggtcaagcccatggtcttctgcggcatgttcaccatcgacgccgaccagtacgggggcttgcgcgaggcgctgaccaagctgcagctgagcgacgccgcgctgtccttcgagcccgaggtgtcctccgccatgggcttcggcttccgctgcggcttcctgggcctgctacacctggagatcgtgcaggagcggctggagcgggagtacggcctggacctcatcaccaccgcgcccactgtggtcttccgcgcgcgcaccagcgatggcgcggagcacgtcgtggactgccccagcaagctgccgcccgccgccacgctgtcggctgtgctggagccctacgtcaggtgagggcaggcatggaagtgtatgggaggtgtggggggccggggcggagatcaccccaagtggggatggggtggggtggcataaggagctggcatggtgggatggacatgccatggcaggacagaagcgcggcacgctttgcaggggtccaggcattgggattggagaagggggaaatggccactgatgcagtccagatgcaggggtggggaccaatgcaggcacatccagcctctgcacatcctcgtcgggagatcgccactcgacctcgccgagctcacatccctatccccgttgacccgccattttcaatccttcacaccaagcagactggaggtcatcacgcccaaggagtatgtggggcccatcctggacctgctccagacccggcgcggagagtgagcgcgcccttttgggggcctgtcgtgcggatggtggggtggggctgttgcgctcacatccccgggtgggaggccnnnnnnnnnncaggcatggaagtgtatgggaggtgtggggccccggggcggagatcacccccagtgggggatggggtggggtggcacaaggagctggcacggtgggatggacatgccatggcaggacagaggcgcggcacgctttgcaggggtccaggccttgggattggagaagggggacatggccactga

SEQ ID NO: 3100 - DNA, 993 bp, Chlorella protothecoides
atgcgcacgagcgcacaaccctgcacgtggcgttccatgccgcaactccatttcctgaaaaaactgctcctcctttccaatatatgcccagccctttcacacccctcaccggcctccaggacctccgcgatgccgatgccctgcttggcagacacgaggagggcgtcggaggcgtccagcccgaccacgtcggtgatctcctggcgcacccgctccacgtcagcacctgcatcaccgcgagaaggtaggatggcgggtggggggatgggtcgtggcgccaaggcccagcgccaagggtctccagagtggggcgagcacgacggcgggtggggggatgggtcgcggcgccaaggcccagcgccaagggtctccagagtggggcaagcacgtcggtcaagctattcaatcagcccgcttccttacatcctcagcctcccagctcctgcgctccaacccccaacatcaaccaacccccctctctctctccccggacccccaacacaacacacacgccgcgccatcccccttaccgggcaggtctatcttgttcagcacggggatgatggtgaggtcggactccagcgcaaggtagacgttggccagggtctgggcctccacgccctggctggcgtccaccaccaggaggcagccctcgcaggcggccagcgagcgcgacacctcgtacgcaaagtcgacgtgccccggggtgtctatcaggttgagcgcgtactgctggccgtcggccgcgccgcggtagcgcatgcgcgccgcacacagcttgatggtgatgccccgctcccgctcgaggtccatgccgtccaggtactgggcctgcatgtcacgctgggccacgctgtgcgtggccagcagcagctggtcggccagtgtggacttgccgtggtcgatatgggcaatgatgcagaagttgcggatgtgggagggggggacctgcaggtgggggtggggtgggggagatggggccctgatgggtga

SEQ ID NO: 3101 - DNA, 420 bp, Chlorella protothecoides
atggcatgtccatcccaccatgccagctccttatgccaccccaccccatccccacttggggtgatctccgccccggccccccacacctcccatacacttccatgcctgccctcacctgacgtagggctccagcacagccgacagcgtggcggcgggcggcagcttgctggggcagtccacgacgtgctccgcgccatcgctggtgcgcgcgcggaagaccacagtgggcgcggtggtgatgaggtccaggccgtactcccgctccagccgctcctgcacgatctccaggcccaggaagccgcagcggaagccgaagcccatggcggaggacacctcgggctcgaaggacagcgcggcgtcgctcagctgcagcttggtcagcgcctcgcgcaagcccccgtactggtcggcgtctgttga

SEQ ID NO: 3102 - DNA, 627 bp, Chlorella protothecoides
atggcatcgcgggccgttgtgtggcgtcgagccctccatgtttgctgcgcccatccggggccactggacaggaaccgccccgcaactcctgccccgatgtcagaggggcttcgcatggacaggaggcgggtcatgacctcgctcggtctgtcgacaggcctgctcacgggcctcccgaatgatgctggggcggtccagggctctatcgctgggcgcctccccggggcaggcgagcctgacgacgaaggattcctgcactacacccggccagagggaaagtccggcggccatggtgtgggctggagcgagatgccccgctactccctggtcatcccctcgggctgggaggagcagcccgtgtccatcgccgaccttgggggcaccgagatcgacatgcgctactccagcccggatgagggggcgctgtctgtggtggtggcccccatcctgcgcttcctcgacgtgggcttcaatgccaacgtcacgctgagcgacatcgggagccccgagaaggtgatgcggggagggcagagggtgggggggacactcgtgcgtggcctggtaaccctgcacggcgcttcctccgctgggtccctcccggcgcaccctgcctccccacacctttga

SEQ ID NO: 3103 - DNA, 828 bp, Chlorella protothecoides
atggagagcagggggagcggcggctccctggagaaccgcgaggaagctcagctggccctgaagctgtgcacaggcaagctggtggggcgaggtgggacggtgcaggcagccccgcatgctggctacgctggaccgattggacgggtatcgctcagcaagctctggccctgcaggggcttgctgcatgcaagcagcaggcgacccctggcagcacccccaccttccacacacacacacacccgtcttcccactgccaccccgccttgctccgcagagctgctgggctcgtacggcggcgaggtcgagtcgctggtgctgctcgctccctactccgcgcaagtgtcggcattcaagcgccatgtatcagcgaatgcagcgctgaagggccgggtggagtgctcgacggttgacggctaccaggggcgggaggcggacgtggtcatattctccagcgtcaggtgggatctgggactggggtgcgattctcgcgaggcgggcttccatgcccggctgtcggcaaccaaacagcaagccacccaccaaccccagacgtatggtgcgcctcggggccggggcccccagtcatcactcgacgcctgccacacagcgccagccaccccctcgctgcagggcgcgcgggcagtactcgaggggaggtgttggcttcctggcggacgcccgacggcagaacgttgccctcacgcgtgccaagcgagcgctgtgggtggtgggacgggccaccacgctgcagtgctcggaaccttgggcggcattcatcgaccactgtcgggcgcaggggtgcgtcattcctgtgctggggtcacatga

SEQ ID NO: 3104 - DNA, 1653 bp, Chlorella protothecoides
  modified_base (162)..(171): a, c, t, g, unknown or other
  modified_base (875)..(884): a, c, t, g, unknown or other
  modified_base (1128)..(1137): a, c, t, g, unknown or other
atgggtctcaccttccggcatgaccgaatctcgagcacgttgacctcgccagcgtgcgcacggggccttcagatccgtgccatccccgcaggccatggacctagtgccggcgacgcactcatccctcctgcctggtcaggtgtcacgttgcatgctgtccannnnnnnnnnctccgtgccatccccgcaggccatggaccaagtgccggcgacgcactcatctctcctgtctggtcaggaaagcacgggaaggcgctctgttcccgtcagtgcgcttggcctcgcacgtttccagtcacgagcattgctggggcgcgggatggccctcctacattctctctatcctttacccccctgccactctgttacccgacccctggggcatgggacacggagtcgtcttctgaccgacaccccattgtcaattcctctccaaatactgcggtaatgcattgttcaacccctccctcccctcctctcacccttgggtttgtccctgcagctgcgatggcgcgccccgtattcggccagagacagagcatggctggcgtgagcctggcccccgcccgcgccatggctgcccgcccccagcgggctgcccgccgggccgtgaccacccaggccaagctgaacaagtccaagatcaacaaggtggtgctggcctactctggtggcttggacaccagcgtcatcctgcagtggctgaaggagacatacgactgcgaggtggtcaccttcaccgccgacctgggacaggtgagggcctggttggaggaggggtttgggggtatgggggggtggggagcagtggtggggacctccctcgtccaggaccgatgggccgccccttccccacacccaccccctcgcgcccnnnnnnnnnnttgggagcagtggtgggaacctccctcctccaggaccgacgggccaccccttccccacacccaccccctcgcgcccagggcgaggagctggagcccgcgcggcagaaggcggaggccgcgggggtcaaggagatcttcatcgacgacctgcgcgaggagttcgtgcgcgactacgtgttccccatgttccgcgccaatgcactgtacgagggcacctacctgctgggcacctccatcgcgcgcnnnnnnnnnntgtgcgcgactacgtgttccccatgttccgtgccaatgcgctgtacgaggggacctacctgctgggcacctccatcgcgcgcccgctcatcgccaagcgccagatcgagatcgcgcgcgcggtgggcgccgacgccgtctcccacggcgccacgggcaagggcaacgaccaggtgcgcttcgagctgggctacctgggcctgcagcccgacatcaacgtcatcgcgccgtggcgcgagtgggacctcaactcccgctccaagctgatcgagtatgcggagagccgcggcatcgccgtgccccagggcaagcgcaacgagccgcccttctccatggacgccaacctcctgcacatctcctacgagggcaacgcgctggaggacccctggcaggagcccagcgagagcatgttcacccgctccgtgtcccccgagcaggtgcctttcattcttcatctcttcttgaagggggagggggggtccatgctgggtcgatcctgggtgcccagtgggagtga

SEQ ID NO: 3105 - DNA, 741 bp, Chlorella protothecoides
atgaagacaatgcaggagatgttgagggggacgcaaagctcccttgccagcctgaaccacgagaagagggagctgctggaaaggaagaagcaggctgaggcccggatgaagtccagcaaggaatcagcgtcgagcaggaggcctgatctgagggcccatgcgctcaaccaggcggaggtggtggctggcacgctgagcgcgctgggggccgacatcttccccccggatctggccttccatgccattatctgcgacgaggcggcgcaggcggtggagccggcgagcctcgtgcccctgcacctgttggcgcccggagggaagctggtactggtgggtgaccccaagcagctccccgccacggtgatcagctgtggtgctgctgcggggatgctgtcgcaaagcctgtttgagaggtgccagaaggcccgccgcggcactctgaggtatctgcagcgctgccagccccactcctgggaaggtctcggacccggtgtctgctgcactccatgcagtccacccggccgtgccctcgcccgccctccacaggctgggaccccggtggagatgctgacggagcagtaccgcatgcaccccgccatctcggcctggccagccagattcttctatgatgcagagctggtggatggcccaggtgtccacacccttgctgcccccttccatgcccaccgctgcttccctcccctggccttcttcgattgcatggaggtgaagaggccgtga

SEQ ID NO: 3106 - DNA, 372 bp, Chlorella protothecoides
atggtggcggccttcctgggctgcgcgccgggtgcccggggccgggcgggcggcaagtttgcgcccccttgctcggactcccggccggcgtcgggtgaggccgtccgcgtgctcctgtgcgcgcagtccaacgccgcggtcgacgagctggtggggcggctgtgccagcggggcatcctggacagttacgggaaggcacgtgctgtgagggtgcttcggctgggcacgctggagtccgccgcccctcgggcctccaccacacacattgatgccatcgtggcggaaatggaaagggcggaggcaggcggcgcagggcatggctgtgagtggctgcagctgggggaggggccttgcggggttggccctgtttga

SEQ ID NO: 3107 - DNA, 279 bp, Chlorella protothecoides
atgacccctctcccacccgcagggcacctcatcaacctcatcgactcccccggccacatcgacttttgcagcgaggtctccacggccgtccgcctgtcagacggcgcgctggtggtcgtggatgccgtcgagggggtctgcatccaaacgcacgccgtgcttcgacaggcctgggaggagcgggtgaggcttcgccgtgcgtgttggcctcggtgggggcgggttaccctacccttgcagctccaggcatgcacagcaactcgcgggatggtcgactga

SEQ ID NO: 3108 - DNA, 825 bp, Chlorella protothecoides
atggtgctggtgatcaacaagatcgaccgcctggccctggagctgcgactgggtcccgaggaagcatacgcacggctgcgggcggtggtggaccacgtcaacctggtggtctcctccttccactccgagcagttcatcagcgaggccgatgcggtgctggcgcacgaaaacacgcgcagccaggcgctgcaggcgcgcgccggcggcggcgcgggggagggtgcggaggacgatgccggggcggaggacgtgttctcgccctccaagggcaacgtcgtcttcggcagcgcgggcgacggctgggcctttggcctggccgactttgccggcctgtatgctggtgagcggggaggcagaggtctcgggctgccaacaggctggggaaggtcaattcagtgcttgctgtcccatcacaacactcaccacccaggcctcgcctcctcgaatcgccaccgcccacaccccccgccccaacacctcccccttccctgtggcgcagccaagctggggtgcaaggccttggcgctggagcgggcgctgtggggcgactacgccttccagcccaagacaaagcgcatcctgcccatccgccccggctccggcggcaagcccctcttcgtccagtttgcgctggagccggtgtggcgggtgtacgcctgctgcgaggcggccgaccccgccgcagagctctcgcgcctggccgccggcctggggctgggcgagcgcctgcacccccgtgcgctggccgctgccgacccccgtgccgcggcgcgggcgctgatgcaggcctggctgcccctggccgaagcggtgctgggcgccgcg

SEQ ID NO: 3109 - DNA, 1779 bp, Chlorella protothecoides
  modified_base (1048)..(1057): a, c, t, g, unknown or other
  modified_base (1254)..(1263): a, c, t, g, unknown or other
  modified_base (1412)..(1421): a, c, t, g, unknown or other
gcggcggcgcgcgcgggcgcggaccgcgtcccgggggtcgcggccctgacgcccccgcctgcccgcgccgacccgctgcgtctgaccctgggcgtggaggccctgggcctggatggacctgcagccgccgcctggctggaggccgaggccggcgtcgtgctggagatgagcacgccccgcaccgtggtggccgcctttggcatcggcagcgccgcgggcgacggcaacgcgctcgtggaggggctgtgggcgctgtcgcgcgcgcgctgggacccaggaagagcggcgaggtgtgctgccggcacgggaagaccggcgaggtgtgcttccggcacgggtccctccgagcccggcctgaccccgccgccgctgccagaggtggtgctggcgccgcgtgaggcgctggcgcgccgcaccaccgccgtgcccctcgtcgcgtccctgggcagggtggcggccgaggcggtgtgcccctacccccccggcatcccggtgctggtgccgggggagagggtggacagggccacgctgcgcgcgctgcgcgacgccgcggccgcagggcgccgggtcaccgggtgcgccgacgcctcgctccgcaccctcagggtcgtggaggagggccactcaccactcctccctgccgtcgaccatgtgtcacgctcagacagctgcagcggggccaggctcgggcttgatccggctcgctgtttactcacatgcctctcccatcggctcagctcctgctgtcacaccctgggtcccaccccagaccctggctcgcagacctacacgctcatgtacaacatgggtgaagcaatgcaatggggccccggcaccgcacgtcacagccgcttcaggctccgcttcttctccggcgccgcctttcgtacccctggggccgccgagaggctgcgcggggcgggctttcctgcatcatccccacagccctctgcgttcacggtgtttgccccgcctgtcgccgtcagcggcgtttgcctgggcatgtcgggggggggagggatggtgggcgcttgcctcgaggctactnnnnnnnnnncgtttgccccgcctgtcgccgtcagtggcgtttgcctgggcatgtcgggaggggaggggatggtgggcgcttgcctcgaggctactttgcggcctgagcgccgttgctctgcgcgtcgagctgtgggtgagcgaagcctcgagtcggactccacatcgatgcaccacctgtggtctgctggaccgactcacaccagnnnnnnnnnnttgagcgccgttgctcggcgcgttgagctagcatccggtgcgcacatcggcgcgaattatctgatcataagatcgccctctgcggctcgcacgcacccgtcgcggcgcccagcccctgctccacctgcctcctggcacctccccgcgcnnnnnnnnnntgcgcccgtagcggcgcccagcccctcctccacctgcctcctggcacctccccgcgcccgcccacctcgtggcgtgtacgctggtgatgagcgcggccttccgcgcaaactcggggaagccctccagcaggaggcgcccggcctcctcgttcagcgccgactcggggttgggctccaccagcaggcagcggatgacggtcaggatgtgcctcaggcccaggtccggtgtccagtcccgcttcagggtgttgacgcagatgtcgccggaggtggagacgttggggtggaagatgcgggtcaggaagtagcctgtgtgtgtcgaggaggaaggagaggtgaagggtgcctgagtcagtga

SEQ ID NO: 3110 - DNA, 1005 bp, Chlorella protothecoides
  modified_base (57)..(66): a, c, t, g, unknown or other
  modified_base (568)..(618): a, c, t, g, unknown or other
atggagagacacaagcattgcccatctctcaccacgcaccctgcagcacttgaagcnnnnnnnnnngcatggagagacacaagcattgcccatctcgcaccgcgtaccctgcagcacttgaggtctagaccacccagctctaacccagagccgagctttccccctccttgcacacacacaagcacaaaagaaaaccgcaataccacggcagcgcacctggatctcgatgtccaccgcctggccactggcgccgcccaggggctgatggatcatgatgcgggcgttgggcatggagtagcgcttgcccttggcgcccgtgcagagcaggaaggcgcccatggaggctgccaggccgaagcagtaggtctggatgtcggcacggcaaagctgcatggcgtcgtagatgcccatgcccgccgtcacggagccgccgggggagttgatgaagagcttgatgtcgcgcgtcgcgtcctgcgcgtccagcagcagcagctggctcacaatggcatccgcggcgaaatcggtgacctcgccgcccaggaagatgatgcgctggcgcaggagcagnnnnnnnnnnnnnnnnnnnnnnnnnnnnnnnnnnnnnnnnnnnnnnnnnnnatctccgcgatggggaccgggagggagagggggtgcgggaccaccccctatcaggaggatccctgtggccaggcatgggtcccccgccatgtcctgtgttctgcacgcagcgcagggagcatgatagcattccagaccaccccaagggggttgcacgcaccggggggtcatgaggggctgactggcggagaccagcagggacgaggaccgggatgcgcgctgcctgggacgcgaggcaggccggctaccaaagtcgcagcgcgaacggcgactgctgggctgccatgccgcccggcaggggaccacgggggtccgtgcggtgcacgccgaagcgttggccatgcgaggtcccgaggctgctcagaggtgggcagacggcagcgatga

SEQ ID NO: 3111 - DNA, 1269 bp, Chlorella protothecoides
  modified_base (461)..(470): a, c, t, g, unknown or other
  modified_base (835)..(844): a, c, t, g, unknown or other
  modified_base (1108)..(1117): a, c, t, g, unknown or other
atgtaccacaaggccaacctgaaccgcatcatgtcggatgccacggggcagcccatcgagacgatcgaggaggacaccgaccgagatcggtacatgtctcccctggaggccaagaactacggcctcatcgaccacatcgtgggaggggaggaggtgggtccgagattgtgggggcggtgttcaagatcgtgggcaacaccaagaacttccccaagacgcggcgggagtacatcgcgtggggcgacgaggacaacgatggctcacggtctgagcgcttcctgcgccccgccgaaccctacacccagccccatagcctcggcagggcttgccttactgaagtcatcgaatcaagctggaagcatcatcttgttgacaagatctgtgtgggaagggtataatcaggcgacgcgcccctcgcaacccctccagaggttgaggcctgagattgggcgggaaagcannnnnnnnnnctcaagctgggagcatcatcttgttgacaagctctgtatgggaaggggagtgacctgtcggctccggcccccacccgagcgccgaatgcttatggtcggtgcaggaacacatgcatgcaaacaagcgaacgaccacagcgtcgtcccactatattctaaggaccaggcgctgttcatcagtgactgcccggctgggaagtgctgcacacccgtacacagcgcaatggctttcggcgatagaggcgggcgtggaggcaggggtgggcgcagccctggaggccgcggaggaggtgcgagaggtgattgcatatggtactcgtccggcccggccttgccatggatcgctgactcttccccgtttgccnnnnnnnnnnctcattgcatatggcactcgtccggcccggccttaccatggatcgctgactcttccccgtttgcccgcgcgccggcgtgctttgcaactggggatgctcggcccaccgccatccctgctgtattgtggtttcctcacaacattactgtcccttcgtggatgtcaacaacaacccaccgggttgctgcgctgtgcgcgacacggattttctgcatcgcaagcccctcccaccgccctcctctcacccctgccctctgtcccaggnnnnnnnnnnttgcgctgtgcgcgacacggaatttctgcatcgcaagcccctcccaccaacctcctctcacccctgccctctgtcccaggtcgcttcggcccccccggaggccggggcggcggtcgcggcgccccacgcggcggacgcggtggtgtgtctaa

SEQ ID NO: 3112 - DNA, 753 bp, Chlorella protothecoides
cttccccgacgtgcacctgctggtgggggtctgcaacgacgaggtgacccaccggaacaagggcaagactgtgatgacggagggcgagcggtacgaggcgctgcgccactgccgctgggtggacgaggtggtccccgacgcaccgtggcacatcaccgaggagttccttgacgcgcacgccatcgactttgtggctcacgacgcgctgccctacgcggacgtgacgggggcctcggacgacgtgtacggtttcgtcaagcgcctggggcggttcaaggagacgcagcgcaccgagggcgtgtccacctctgacctcatcctgcgcatagtcaaggactacaacgagtacgtgctgcgcaacttgtcgcgtggctactcgcgcaaggacctgggcgtgagcctgctcaaggagaaacgcatcaaggcctccgcctccatgcgcgacttctcggcgcgcatgcgcgacggccgcctgcgcgttgctgacggcatccgcaagcacatgaacccgcgcctccgcgtgctccctgccgaggtggagcgcaacgtcaaggactttgccaccagcgtggagagcctggtggacaaggtggcctccggcgacctgggcgtggagctgatcgagaacatggaccgcctggtcagcggcttcatcggcaactttgagcgccgctactcgcgcttcgagaagagcatcaagtcgctggggcggaacatgcgccgcaactcccaacccctcctccagagcccatg

SEQ ID NO: 3113 - DNA, 1191 bp, Chlorella protothecoides
  modified_base (122)..(131): a, c, t, g, unknown or other
atgttgagagttgcagggacagtacctaagatgcaagctctgctgtgccgatggtactaccatcccttgcggggaggggccccagcatattttatttcctctgatgtccctcccgggcatcnnnnnnnnnngttgcggggaggggccccagcatgtcttatttcctctgatgtccctcccgggcatcacagatccagtcactcgcgcggatccctcccaaaaccttttgcaggatgtccagagacgcaccccccggtaccaaggtgtacgtcggcaaccttgagccggacacgcaggagtcggtgctgtcggatgaggtgtgtgcgccaagagatttcgcccgtccagcccctgctccgacccctgtgtgacggccatcatcccatcttcatgactcctcgcgtctcctggtcctcatcgagcgacaccctgccccctgtcggtctccacgccctcctgccgccttctgacgctgtgcctctcctcctcagttctccaagtacggacgcatctccagctgctggttggcccgcaacccttctggtgagcgttgcatggagggttgcggctgtggccttgcgatcgccgctgcgctgcgtccctgcacctcgatcactggccagtcatccccccgagacaacgatgcccatccctgcaggcttcgccttcgtccagttcgaggaccctcgtgatgcggaggacgcagtcaccggactggccggcaagaacgggtggcgcgttgaggtagcgcgcccaccccgtgcccgtgatgaccgcttcggtggtggtccccccggtggtggcgaccgcaggtgggccgggattctattaacatggctgagaagggtgcgggaacgatgggtgtccaattccacggctctctgctgctcagttaacaagcccctggcgcgatatccaccctcacaggctctccaccccttctccatcacaggtgctaccagtgcaatgagccagggcactttgcgcgtgagtgccctcgtgggcccggcggcggcggcggcggtggcggcggttacggcgaccgcgaccgtggttacggcgaccgcgaacgcagctacggcgaccgcgaccgtggctatggcggcgacagatcccgtgacgacaggcgcgacgacaggcgctccgaccgctacagcgatcgcgacaggtgcgcgagcggctggcatttaa

SEQ ID NO: 3114 - DNA, 2799 bp, Chlorella protothecoides
  modified_base (237)..(246): a, c, t, g, unknown or other
  modified_base (832)..(841): a, c, t, g, unknown or other
  modified_base (1187)..(1196): a, c, t, g, unknown or other
  modified_base (2723)..(2732): a, c, t, g, unknown or other
atgcgcgacgccgacgctgggcgctacgcccgcctcgagcgcctggccgccgcgccgtcgccagacgcgcgggacctctacggtgcgacaccgcgcgacgcgcgccgcggcgccctggccgccaggctggcggtggaggtgacctcggtgccgccctcccgcctgatggccgtcatcggccaggccctcaagtgctgcccgtgtgttgtccctccatatgactcctttgaggactcnnnnnnnnnngtcatcggccaggccctcaagtggactttacgccacgaccaaccttccagatatcctgcccgcccctctgaaaagaatacagagcaccctacgatacccaaacacaggcagcagcaccagggcctgctggcgccgggcgccacattcgacctgttccgcgggtcggcggcaggggcccgcgatgaggtggagcgttgccccacagctctggaccgcaccatcaagtttgggaccaagtcacacccggagaccgccgccttctcgcccgacggcctgctcctggtcaccggcagtgtcgacggcttcatcgaggtgtgggaccacgtcagcggcaagctgaagaaggatcttgcctaccaggccgaggagcggttcatgatgcatgaccaggcggtgctggcgctggcctggtcctccgactccgagctcctggcatcaggctccatggtgggcgcatttgtggagtgttcattctggggggaagtatcaggcttgtggcattggggttggatggggagggaagggtgggaaggtcctagagaacgggcaggcagggattcatgccgacatcgaggctgctgcgcgnnnnnnnnnnggagggaagggtgggaaggtcctagagaacaggcaggcagggattcatgtcgacatcgaggctcctgcgctgcattggccaatgttggtggcagacatgctgatggggaattgaaatggagaagggaggaagtccgggcggcaagcaaggcagcgaaatgcttgcgtgatgacggcaagatcaaggtctggcgggtggcaaccggccagtgcgtccgcaggtttgactcggcccacacccaaggcgtgacaagcctggccctcagcgccgactccagccatgtgctcagcaccagctatgacggcctcatccggtgggtggctgttcgtttaagggggggggtgtnnnnnnnnnnggtggcaaccggccagtgcgtccgcaggttcgactcggcccacacccaaggcgtgacgagcctggccctcagcgcagactccagccatgtgctcagcaccagctacgacggcctcatccggtgggtggctgttcgtgtaagggaggggggtgcaggatctcaggctgacacctcctcacccacctactcctcacccaccacctcctccccctgttcactcacccgtctccccacccccgttcagggtgcatggcatcaagagcgggcgcatgctcaaggagttccggggccacacctccttcgtcaactgcgcggtgtacgtggtgcagggctcgcgcgtgctctccgcctccgccgacggcagcgtccggctgtgggatgcgcgctcctgcgagtgcctggccagcttccggccgccgccgcccggcgcgcgcgtgggcgacgtggcgctggaccgcctgctccccgaccccgccaacccgggccaggtctacgtggcggggcggtgcagcacgctgtacctcatgacgctgacggggcaggtgctgcgcagcttccagtcgggcagggcggagggcggcgacttcgttgccgccgcgctgtcgccgcgcggcgagtgggcgcactgcctcggcgaggacggcgtgctgtacagcttcgccacgggggcgggggggaggctggagggcacccagcgcgtcaccgacaaggggcccatcggcgtggcgcaccacccccaccgcaacctgctggccacctggtcggatgcggggctgctcagcacgtggaaggcggtgtgagggacagcgtggcagtgagcatagggactacagctcatagacggcccgcattcacagacccgctgccggccggggcggcgggtggagggtccacgctgctggaccttgttgccaagcccccaggactgaacacccctcgcatgcagcgacgctgtgcatgctggcgggaagccaacccccctctctccctgacaatttccacgccttgcacaattattgctgaccacctctttgctgtgagtccttccgtcacagagcgtcaggcagggccagggcatggcgtttggcgggaaagaacaatcctgccatacttgcgcgaggcaccagggcaaagcccagcccacgccctcccatcgtcgggctcagtactcgggggagccacggcggtcgcggtccaccgccgcaggggggctcctgtccctgcggtcccgctcgccggccgggctgcgctcgcgcctgcgctcggggacggggctccgttccctgcgatcccggtcgtcgcggcgctcgtagtccctatgcatgggtgggggcccgcaggagagcatagtgaggtacgggtggtgtaccaacgctccgcaaggatgtccagggggtcagcagggggcactcggagcgcaatcagcacagcccgtgtggcgcccttgtccctggagctacagcaggccaggatcgcagaggcacagcacacagcattgacgagcgggcctgcaccaggaagtcctgnnnnnnnnnnagctacagcaggccaggatcgcagaggcacggcacccagcattgacgaacgggcctgcaccaggtag

SEQ ID NO: 3115 - DNA, 915 bp, Chlorella protothecoides
atgatgcactcccagaatcaccccgctgagctgaatctcccgcccaatcaatactacacacagggccagtggctaccatggcggggttggcacgacagagagttaccccaacatccagcgcctgtggtactttccattcagcataaatgtgctgcgattggatgcagaggtgccatgcacgacctgcgagtggctgaccatcctggaatgcgtgccgcacggccgagagccatgcttggccgacgtgaacttcaacggtcgttgaacattgggaccggcaacaccggcacccacaaccttggcaagtgctggtggaagagttggctcatgaaggaggatatggatttggaaaagggggatcaaggggtgggggagtttgctgcgacgctgttgggtcgtggacatggcaacagcgcaccagtcaggagctgtgtggaagaaatggagcctgagaccccacctcctttcccacttcatgcaggtaacaacaatcgtgggggcaacaacgttgggagcaacaacacgggcaacttcatcttctgcaacaacatgaagacctctgctgtgcagtgcgagaagtcctcactcttgacctctgagacgctgaagtctccgccgcctccacagaagaagcatccacctccctctaaaagacacccaccgccgcccaagaagaaaaccccgccgcctccagcaaggaggcatccaccgccccctaagaagaagtctccgccgccatccaagaagaagcctcctccacctgcaaaaaagaagcctcctccacctgcaaaaaggaagcctcctccacccacaaagaagaaggccccaccgcccaccaaaaggaggcctccaccgcccagcaagaagcactatcccccgcctccaaaaaagaggagccctccaccaaagaagtag

SEQ ID NO: 3116 - DNA, 390 bp, Chlorella protothecoides
atggatggatggatgcttcagatccatagaggatcagaaagcagtgcagcaaaccctacgccattcagcacaggccgctgtgcagcgctgcgcctggtccggggcttcagaggcctctctcgcccagctcatctagccccgccccctccctccctctgccatgccctccaggacaccaccctggccgggctgcagatgggcatgcggacgctgcaggcgcagctggaggagcactcggcggcgctccgcggcctggtccgcgacaacttcggccgcttcatctccagcaagagcaccatcgacgacatccaggcacgcctgcgcagcattgaggccggcggcgccgccagcggcgcgccctcggccgccgtgctggcgggcgtgtcgcgc

SEQ ID NO: 3117 - DNA, 1224 bp, Chlorella protothecoides
atgggcctgcgcgagggcatcagcgccgtgctgggcggcggggtctccgacaccgccgccgcagcgcccgcgacggggagcggcggtgccagagccggggcccacagtgccgcggtggctccggcggccctgctggaggacccctccggcagcccccagttccaggcctggctgggcgaggggcgcatggaggcccggcgctccgccgcgcaggcctccgacccggggctggccggcctgctggcgagcctcgtccccggccgactgtcggaggaggcgttctggcagcggtacctgtacgcgcggtactgcgcggaggagcggcgccgggcgctgcgggagctgacgcagcgctcgcgacgcgtggaggaggtggactgggactgcgaggacgaggaggaggaggaggacgaggcggtggcgggcggccccggtgaggtcgggccaccggcagcaggggcgggggcggcgagcccgggggcggcggggaagggactggcgcagggaacagcaccaggggcaggggacgaggcccgggcggcagcactcggtcggaagtctgtcacggagagcctgggtgccggggaaccagtcgcggcgctggcagttccctgtgcatcaggagcagcggccgaaggcagctcggtggcgcatggcgtgccgagccgggaccagccggcagccggtgggtcggcctggcccggcgaggaagtcggcagcccggcagtgggtgggtcggcctgccccggcgaggaagtcggcagcgtggcgcaggcgcgggtcctgctggccgagccgggcgcggtgagcgccgctgccgccgccagcaccggcccgggcgagggcaccgcaggtcgcagcgccgagggggaaccggaggccgaggaagttgcagcccccacggcagcggtcacggcttgcggaggaggacccagctcgccggacggagccgacacagcgcctgaccccgcgggccgggagcaagccctcgcagacgccctgctagcctcgcccggcccgctgcccgccagccccggcagcagcgggcgagcgggcgaggacgcggccagcaccgcctcccgccacggccccagcacctcgtggtcggtgatcagcgatggcccgtcgggggagtcaacgcccatggccccccccctggcgcccgcggtggggaaggcctccaaggcggccagcgacgacgactggggcgacgactgggagtga

SEQ ID NO: 3118 - DNA, 927 bp, Chlorella protothecoides
atgcgcgatctggcctccgcggcggggcggcggctggaggacacccatgccgaggtggagcccgagcggcgcgaggaggcggccgccgacgcggccgtgcagcgccggctgacggagcgcgtgcgccagcttgaggcggaggtggcgggcggcgtgggcgcgggcggtctcgccgcgccggccagcgaggacggcggcgaggctgagggcgaggacgggagtgagggcgaggagtttgacatcgattctggcgaggaggaggagggggctggcgacaaggtggccggggacggggaggaggaggaagacgccagcgcctccgacccggagagcgaggaccttgagggaggcagcgagagcggagaggaggaggaagagagtgtggacgagggcgactctgacgggggagccgacgcaggatctgcagacgaggccctggccggctcctatgcccccggcctgctggtggaccccgacgacgagacggcggtgtgcgccacgctcttccgcggcctggtcttcttcctggggcgggaggtcccgcgcgagctgctcctgctcaccatccggtcggcggggggcgaggccacctgggacgggccgggggccacgatggcggagggcgacgagcgcatcactcaccaggtcgtggaccgcccgcgccagggccaccgccacctcacccgcgcctacgtccagccgcagtgggtgtgggactcgctgaacgcgcgtgtgcacgcgccggtggagcgctacgcccccggcctggccccgcccccgcacctctccccattcgtggacgcggaggaggaggggtacgtgcccgagtacgggcgcacgctgcgcgcgctgcgcgaggccaccgtggccgcgcagcgccgcgccctgggcgccggcttcgtcgccgacctggaggagggcgcggcg

SEQ ID NO: 3119 - DNA, 1779 bp, Chlorella protothecoides
  modified_base (569)..(578): a, c, t, g, unknown or other
  modified_base (1681)..(1690): a, c, t, g, unknown or other
ggggatcccgggggcggagggggcttggatcccgggggcggagggggcttggaccccgacgccggcagcgccggctgcacggacggcgccagctcctcgccgacgcccagcgctagcaggtctgcgccgggctccgtcgcggtgggcaagcccagcacctcccgcgcaaaagcgtcctcgttgggcaccagcgtccccgtggcgccgttgggcagcaccaggccgccttcctccctttcctccagccgcgtgagggggatgccgatgggcgggcgcacccgcttgcggtcgaatgccgggtcgccctgggtggggcagttctgcacccagtgggccccggccacctcacacctgcagcaacagggggggaggaaagtccacacgtctgagcagagcaggcaaggggaagcaggtttgtggggggcatttcgggtaactaagagcccctggaagggcaagccagaacacggaggcaggaaattgcaagggtatttgtgcgggagatgccctttccctgccacgcttgagcacggggtccggtgtcgcgtaaaacttcccagcagacttgnnnnnnnnnngctggagggcccctgttgctgtggacagtttcctgccccgcttgagcacggggtctggtgtcgcgtcaaacttcccggcagactttgggggcaggtgctccatacatccacccgcaccgcaatcgaccccagtggaactggcatacagcaggaggtgcgcgaggatgcaggcaggggggtggacaggaaaattgccatcacacaacaggggaactgcacaccgctccgcgacctcgtatccccacctcgggcagcggtactccagcggcacggatccacgcccgccccgcccgcgccctctgccgcgcgcggcgccctgccggacctcacgctgccaggtggcggctgtgccggccagcaggctctgcagtgcggcctcctcctcgccaatgccagtgggagggacgtcggagtacaggtccccgccaaactcatccgcggccccgccggcgtcgacggcgtggtcggtgggcagggactgcccagcgacaggggtggacgctggcgctgtggcggcgctcaacggcttgaagctggtgatgggggcccgcttcaccagcaccagcgaggagcgggggatgagtttcgcctcgtccgtcagctcctcggaggtgctcgaatcgtagagggtgagctcctgggcgccctccgggcccaagccgcgcttgacagcgatcaggcgcttgatgtcccccacctggatgacggagccatcgaaactcacggagtcctgctgcaaggcattcttgaacctgaagttgattacactcgtcattcagttccagggggcacggcgtgctcggctagccagggacacacggcgggagttgctgcgccacctccgctccccagctaccctcggctcccgctcccgcaggctcccgctccaataaacacgcttgaaggtgccagatgccagagcttgatccctagagaagtgtgggaactccgtggtgcggcaggtcatcatgacggggattcagggaggagaagtcagggtttgttaaaccctcgtgcgatcttccgttcgctgattctgcatgttcgcgccctggggtgcgcagtggggactggggaaggatactgccgctgccttcagcccnnnnnnnnnngcgccctggggtgcgcagtggggactgggggaggatactgccgctgccttcagccacttgctgaggttcagcacgcatgctatatgtaa

SEQ ID NO: 3120 - DNA, 570 bp, Chlorella protothecoides
atgacgagtgtaatcaacttcaggttcaagaatgccttgcagcaggactccgtgagtttcgatggctccgtcatccaggtgggggacatcaagcgcctgatcgctgtcaagcgcggcttgggcccggagggcgcccaggagctcaccctctacgattcgagcacctccgaggagctgacggacgaggcgaaactcatcccccgctcctcgctggtgctggtgaagcgggcccccatcaccagcttcaagccgttgagcgccgccacagcgccagcgtccacccctgtcgctgggcagtccctgcccaccgaccacgccgtcgacgccggcggggccgcggatgagtttggcggggacctgtactccgacgtccctcccactggcattggcgaggaggaggccgcactgcagagcctgctggccggcacagccgccacctggcagcgtgaggtccggcagggcgccgcgcgcggcagagggcgcgggcggggcgggcgtggatccgtgccgctggagtaccgctgcccgaggtggggatacgaggtcgcggagcgttcccctgttgtgtga

SEQ ID NO: 3121 - DNA, 642 bp, Chlorella protothecoides
atgacccgcaaccaggccctgaagaaactgcagctgaagctgggcgaattccggcgcctgtgcatcctcaagggcgtgcacccacgtgagccacggcgcaagacccagggcgcgcacaagacctactaccacgccaaggacatcgccttcctcctgcacgagcccctgctggccaagatgcgcgagctgcacgcgtacgagaagaaggtgcggcgcgcgcgcgcaaagaagaacgccgcggccgcggcgcgcctggccgcccgccgcccgcgctacgcgctcgaccacctggtccgagagcgctacccctccttcgtggacgcgctgcgcgacctggatgacccgttgaccatggcccacctgttcgcagtgttgcccgccgagggcggcgccggcatccccgcccgcgtcgtgcgcgtcgcgcgccagctggcgctggagtggcaggcctgggtggtgcgtgcacacgccctgcgccgcgtctttgtctcggtcaagggcttctacctgcaggccgaggtgcagggccaggcggtgacctggctggtgccgcacagcctgtcccaggtgctgccgcaggacgtggactaccgcgtcatgctcaccttcctggagttctaccagaccctcctacaggtttga

SEQ ID NO: 3122 - DNA, 1698 bp, Chlorella protothecoides
  modified_base (1199)..(1208): a, c, t, g, unknown or other
atgagcctggatttgccgacacacaggccacgccccagtggagtcgcagacaccaacgatgacgcccaagctagcaagctgtacgtcaagattccttggagcatatggtgtggctgcagaagctgtgtcggagactacgcaaacctcccatcccaatgcaggtcatgcgttcagcttgggtacttccaagacgagtttgtgcaccacttcgtgaaggcccccgtccgacgcgcgcccctgatcaacagaggtgccgctccttgggctcggtcgcttgtcgttggatgttgtagggcgcgcctgggctgttggactttacctcatggtgcacccgatcgaggacacctacatgcctacctgccagcatgttcacccactgaacccccaacccctccaactcacaggctactatgccaggcaggcatccctgcgccagcttgtcacaaggttcctcgcctgcctgcatccggggcctgtgcaggttgtgagcctgggggccggcttcgacacgctctactggcaactggtgcaggagggtgcgcccatctcgcgctacatcgagctggacatgccgcaggtctggaattgtggggtgggatggtgggtgggtgggtaacgtggagtgcctctgatgatcagtggggatcgtgccagcaaacaaacaccccccgtacagcagcccctccatcgcaccccccacaaccatcaggtctgcatggagaaggcgggcgtcgtggcgaggacgcccgccctgctccgcctggtgggcggcagccccgccgacgcgccgggccacgacccggcggcggggcggtggctgggcggggcataccgcctggcccccgccgacctccgcagcgtgggccaggtggtgagcgcgctgggcctggcggggctcgaccccggcgcgcccaccctggtcctggcggagtgcgtgctggtgtacctggagcgggaggaaagcgacgccctgctccgccagctcagcgccatgctcagcaccgccgcgatgctgcgggagggcgccgcgctggggcgtgccacgcgggccagtaccacgcgggatgccttgttggctgcatccctccagtctgggcctgggtgcggcggcgcctgctcttcacctccccttcacccacaggcatgcacaccgatgataccaccgcgccccaccgcagccacccctactcctcacccannnnnnnnnnatgcggcggcgcctgctcacctcccctccacccacagtcatgcacaccgatgataccatcgcgtcccaccgcagccacccctactcctcacccacaccaggtccggcccgacgatgcgtttggcaagcagatgctgctgaacctgagcctgcgggggtgcccgctgctgggcatctgccgggacgtggacgagcaggcggcccggctgaggcaggccgggtgggagcgagccgaggcagcgcccatggatgccatgtacaggccgggtgggaacgagccgaggcagcgcccatggacgccatgtacaggtgagggttccaggggataccactccatcgcaatgtcgctgggctgcagggagacggcgaggcgcctgtctggcactctggaaactgcaagaaacctacaggcctcgaccggtcatctgcaaacgcagaggcctggagccgcgggatcgccgtcgcatcgaaaccctggagatcttcgatga

SEQ ID NO: 3123 - DNA, 903 bp, Chlorella protothecoides
  modified_base (711)..(720): a, c, t, g, unknown or other
atgcgctcgcaaggagggtgctgtgcctgggtgcgctggcgtgcaagggatgatccacgtgtgcgacgcagggtgaccccgtgtcacacatggaggcccaccgggcgaaagcatctcgcctgtgctgtgccaggcatgcgctcgcacggccagccagtaccaccgactccaagcaacatacgatcactgtcttgcacatgcttgagaaccccccctcaccccttcaccccctcacggcagatcatggtgcgcatgggcgccatcatggccgccggcatcctggacgcgggcggccgcaacgcgaccctgggcctgcagtcgcgcacgggaccgtaccgccgcactgcggtggtgggcctggccctgttcctgcagtactggtactggcacccgctggcgtacagcctgtccctggcgctgcagcccaccgccatcatcggcgtggatgccagcctgcgtgcccccgctgacttcaaggtgggcctcgtggttgcggtgttggggttggagaggaggggtggtagcatgctgtgtgggccaatgcctggtcagcgcgggtgggacacggcaagctgcatgctccatgcgcagatgggcgatgggtttggggaagagcctcgttgcccgccccaaaacatactggtctatgacaggcagagacaagctgcaaatctcttacattcccgggcacatggagggtggcacagcccnnnnnnnnnncgacttcaaggtgggcctcgggcttgcggtgttgggggtggagaggaggggtggcagcatgctgtgtgggccaatgcctggtcggcgcgggtgggacacggcaagctacatgctccatgcgcagatgggcgatggctttggggaagagcctcgttgcccgccccaaaccataccggtctgtga

SEQ ID NO: 3124 - DNA, 1203 bp, Chlorella protothecoides
  modified_base (424)..(433): a, c, t, g, unknown or other
atggagggtggcacagccccagcaacaccagcacgcacccatccatgcacctcccctcacggcgctgccacaggtgatcagccgatgcaagccctcgctgttcgcctacccaccccccgtcgccatggaggacaagcgcagcaaggagaaggtgtcatccccaccgctcctcctgccgaccgtccgttgccctttgccacagtcacagggcgtgatcctgagctgcgaccacgctcctgctcgatgctcgacctcaccatgcccacgaccaccccctcacaggtcccaaccgccgtgctttccacgacggtgcgctccaaggcccgtgcggccgccaagaaggaggagcagggcaaggagatgggggccctggtccccacgacctctgaccctgaggccatgcagacggagggcggcgaggcgnnnnnnnnnncggaatggaaagttgtcatccccaccgctcctcctgccaaacgtccgctgccctttgccacagttacagagcgtgatcctgatctgcgaccacgctcctgctcgatgctcgtcctcaccacgcccacgatcaccccctcacaggtcccaaccgccgtgctttccacgacggtgcgctccaaggcccgtgcggccgccaagaaggaagagcagggcaaggaggtgggggtcctggtccccacgacctctgagcccgaggccatgcagacggagggcggcgaggcggcgcaggcaggtggcgaggcgggaaagggcggcgaggcggggaaggcagcggatggtggcgaggaggcggcgcctgcggaacccccgacgcccgcggagccctccagttacgtgctgagcaacccggcgcgcgtggtgcctgcacagcgccgcttcgtggccttcgagcgggaccagcgctggcagccggtcaaggccgtgacgggaggtgtgtgtttgtcggcacaggggggcagggggaaggccggcatgcatcctggcggcgcggggggagcgggcgaacgagctttgggctgcattgtggtgctgcaggacgtccggcctggagaggggcctgcagagtacctgttccaggaagccgcagcgggggccaccagcgccggccccgccgcgaggggcgctgcgccgcccgcccaggcgcccgccgtgccgagcgctgcggaggagccgcaaccgccggcgccctttgagtacattccgtcctga

SEQ ID NO: 3125 - DNA, 933 bp, Chlorella protothecoides
atgcgctctgtactcgagcaagctggtgtctgcacctgggcgccactccctgctggaggtgcgctccgccagagggcatgcggcgcccattcgggggccacaggacccaggaatgggctcctcaggggtcacaatattctggcaagaagttttcagggcaccctggatgatgcagaccctcaccagcaccatgctgaccaccaggaaccggtgcacagctttgtggctgttccgccccaagccccagtccctgagcatcctgccctccagccgccccttgggatggcatgggacgcaggggtttggaccctggcaggcgccttcctcttggctgctcgcatatcgcggacggtgcacgaggagtctgtttcaacgccgcgagggctgagggtaggcatggctgttgaggcagcggctcgggagctggccgccttccaactcagcacggcgacgcgcagcgggcgggagatggtggtcgcccaggaggcggccgccgccgacaccgctcgggtctctgcggctgcgcagcgtgctcagcaggaggagagggaggagagggagcggcaggcggcgtacagccgtgccgctgcgcagcaggcagcccagctgcgtgaggagagggagaggtcccggcaggagtacgacgcgcgacaggcccggctcgaggccgagatggtggagcgggaggccgcggagcgggcgaccatcgccgcgcagcgcgctgaagccgccgcgcaagccgcccgggctcagaggtgtggggctggcggccggatgcgttcctgcgtgcagtccgtcgttcggggtgggcgatgtacggggatgatcgtgggccagacattcgcagcgcaggctggctctggcgctctctgcttctgccatcctgcccgaccaaagcgccccaaatccacgatcattcatcagggaggctga

SEQ ID NO: 3126 - DNA, 1197 bp, Chlorella protothecoides
atggcgctcaacatccgccagaagcaggctggtgagtcgtggcaggaggggagcgatcgggcgactccgctcgaaccacagagtcactctcctggggttcccccacacgctgaagcagccgctctcacgcccatgcagatgcggtggtgcgcatgctgcacctcaactcctcgccccagagcaccgggcggggcggggaggatctgtacaaagtgctcatcctcgatgcagccacccaggtggggtgccaggggcgggggaagccctgagtgggaggaccaggacgtgctggccccgctgctccgcgtcaaggacctgcgccggcacggcgtcaccctgcacctccccctggactccaaccgccagccaatccccgacgtccctgccgtatactttgtggcccccagcccgcacagcaccgcccgcatcgtggccgacctggcggcctccctgtatgactcctaccacctcaacttctccacccagctgccgcgcaaggagctggaggcgctggccgagggcgcggcgcgggagggctccgccgcgcgcgtggcccgcgtgcatgaccagtacctgcagtacattgcgctggaggcggggctgttcagcctgggcctgcccgccacctacgtcgacctcaacgacccctccgcccaggacgcccagatccagggtgcagtcggcctcgtcgtggagcgcctcttctgcgtcctggccagcactggtacggtgcccatcatccgctgccccagggtgaggtggtgctggaaggtggaacttgtgagaggcaggagggtgggtggggggaggtggcgacctctaagggcgggcatccctgcagaacaagggggcggaggacagcactcctgggctcccatgggcgcctgtgcctgtcgatggattgccgcgcccctacgatgccacgcctgtcgctccagtgtggccccgcaggacagcgtgccgccggctgcgccatggatcagcccaaccccatgcctgacaccagcccctattccaccccactcgccaaccacagggcggcgccgcggagcacgtcgcctcgctgctagatgcccaaataagggaggccctgcatcagcgcggcagcgtctttgccgacggggccggcgcggccggcgcaggcttggccgccagcctacaccgccccctgctggcgatcttcgaccgcaactttga

SEQ ID NO: 3127 - DNA, 624 bp, Chlorella protothecoides
atgacaggcagccgcgccgggcccaatatcctcataacaggcactcctgggacagggaagaccaccacagcggagcttgtggccggcgccaccggcctgcgccacctgaacgtcggcgccctggtgaaggagcaggagctgcattcgggatgggacgaagagttcgactgccatgtcatcgacgaggacaaggagccgcaattggtgggcggtgtcggggatgtcgtccgcctctccctctccgacactcggcctccccacccaactccctcccaggtgtgcgacgcactggaggacatcatgacggcgggtgccaacatcgtggatcaccacggatgcgacttcttcccggaacgctggtttgacctcgtggttgtcctgcaggccgacaacaccatcctttgggagcggctagaaaaacggaagtacgggctgaacaagatccaggagaatgtgcagtgcgagatcatgcatgtcatcgtggaagaggcgctggaatcataccggcaggacatcgttcaggtgctgcccagcaacaccgtgcccgagatggagtccaacgtcgatcggatctgcgcctgggtggctgcctggaagcaggccgcccaggctggcccggcatga

SEQ ID NO: 3128 - DNA, 1113 bp, Chlorella protothecoides
atggggaggatcgtaggccagacattcgcagcgcaggctggttctggcgctctctgcttctgccatcctgcccgaccaacgcgcccgaatccacgatcatcgatcagggaggctgaggctgctgcggagctggaggctaaggagcgtgcagagcgtgctgcggccgagctggctgcggcgcaggccgccgagaggcaagctgcggaggagcggcagaggctgcgcaggtccatgcaaacgttttcctacaggctggatggggaggtcacgctccagcgcccgcccaaggggacaacggtgatgcgtggcccgctggtgcaggaggccaccctgagggtggccacctcttgcggcagcatcctgggcggccccgggtccgacctgccctggaccgccgactttgccgctgcggtcgaggcgggggaccccaccctggcggtgcccgggctggccggctgctaccgggaggccgccgagggggcgctgggcgcgctgcggctgcaggcctccacagggtcaggcggtccgctgggccacagcggcgtggaccctgcgctgatagagcagtgggtcacgctgggcacgctgcgggcctgcgtcgccgcgctgggcgtgctgcgccccctggtggaggcctttgtgaggggcggggagccagcccccgcccgcttctccgtgaaggccggcatccgggcgctgccggccgaccaccccggggctgcgagcttggcggtgcatcgcgcggtccaggcgctgggggcgcaggactcggaagcgctgcgcgcctcgctggcgctgctggcggaggaggagctagccctggcggcggaggacctgcagagcgtggaggacggggtgttcaacgcctgcttcacaggtcagcccggacgattcgtgggcctggccctggctgtggccagggtgctggccatggtggagctggtgcaggagggcgatgaggacaaggaagccgcgtggaaggcgctgcgcggggcgctgcgctgcggggcgcagaccgcagccagcgacacgctgcaggtactgggcgggaggaggtgttcacgtgcatgctgccctgggctgctgctgcgcgccatcatgtcccctcaatga

SEQ ID NO: 3129 - DNA, 609 bp, Chlorella protothecoides
atgcgcgacacggctctcggacgccctcccccctgcccgaaacttgtggaacaggtcatccagcacggcgcgtgcctgggcctgggcattgcctgcctgggctccgagaacgccgaggcctttgaggacgtgaagaacgtgctgtacacggacagcgccggcacgatcgccggtgggcgaggcgggggtcatgcttgtccccctcccggtcatgctgcatgcccgagccccaccctgccacccccccgcctcggtgcagtggccggcgaggcggccgggtatgcactgggcctgctgtgcgccgggtccgggcgggaggagcgtagcgacgagatgctggcttacgcccacgacacccagcacgagaagatcgtgcgcgccctcgccgtcggcgtcgcctttgtgcacgtcgagcagcctgctgccgaggagcacgcgcgtgccgggcagacgcccgcgcctgctcacggccgatggatggatggcgaccccggcgagcggctccacccctttctgcatggcgccttccgcgacctcggggtttgccacccttgccgtcgccaggggctgtgtcgaggcctggtgagagtacccctccaaatctcctga

SEQ ID NO: 3130 - DNA, 996 bp, Chlorella protothecoides
atggcacggctcaggctccccatcgaccgattccctctcacgacgcaaactccagagctgacggagcgcaagcgttccatagacaagcacaccaacctggcaactcacctgctgggggccatcaaggagcggggcctggaccggtattatgcgctggaggaggaactcaccgcgggcaaggagcatgtggaagcagtgctcaaacacctccaggtagagggttgtggtggaggggggtgctgtggaggctcagcgctctgcagggacattgtatttggggagttgtttcttgtcgatagggggccgcggggcatggaggatgcagctggctgtatgcaggcaatgggctcgcaaggcactgtcaccgataggctgcgcctggccctggtctggctgctcacctgccccacggcgccgctggaggcggaatgcgagagggtggagaccgcgctcgcggctgcaggggcggatgtgcgggcgtgggcatatgcccgccgcatgcgccgcatgaacctcaccggcaaatcacaggtgggaggatttgtgattatgagaggacgcgtgggtcaaagatcttgtgctgcgcctccgtcgtgggtgtttgagaccgtgggtggcggcgtcctggcttatgatgcgcttcagccaccaccagtcacgcctggaaaccgtcgctgtgcctcgtctgccgccctggcggacggccgtggcgtgtttggaggcgccgcccaggcgcagcttacgaccctgctgggcagctcctttgggcagggcttgtcctccctgaccaagggcgtgaagaacctgcttgcaggggagcagcaggcggccgtcacagtggccgtggaggccctcatggagggccggcccaacccagacgtcgatgggtacgcttactttgaccccaagaggcgctactcttccacactacacgccaagacaatgggtcaaaccaagaccctgcactccctgcaccagtattgctttctctgctga

SEQ ID NO: 3131 - DNA, 222 bp, Chlorella protothecoides
atgcgcaacaccaagaccgactacgtgtcctgcccctcctgtggccgcaccctgtttgacctgcaggaggtgacagaccagatccggcagaagacggggcacctgcccggtgggtttgagtggttgcgctccggtgtggagcaagcgagttttgctgatttgctttgcgaggaggagaagcgagtgtgctgttatcccccggcctggtcacgagccaactag

SEQ ID NO: 3132 - DNA, 714 bp, Chlorella protothecoides
atgagccaccccttcctccctccccacccggcatctccagaggaggactgggtggacgaggctgccgttaaggccacccgcattgcggaacagcagaagcaggttccgtatgcggagaggatctgggccctgaccaacgtcgccggcactctggccatggggggcccgggggagacggagcaggcccggcgcctggctgagcaggcggtgtccctgaagcaggagtggatcggcgcacctcgacatccatgtgcgtacgagggggcagtggtttggccaggcctgctccccgagttcctgttgctggtggacatcctgtccaggaacctggaatgggagcgggacgcggcagggctggcaggggtcatcctcaggatcgtgattgaggtggccgatgcgtacgcggaggcccaggacccactctcgggggtgatcctgctggaaggcgcgcagcagaggttggccgagatcgcgggcctgaggaatccggccctgaaggcggcctcccgggcctcggagcggctccaagtccagctgacccccgcccagctggaggcgctggtggggttgagaaagcgcgtcgcgccgcgcgcccttcagcgcgtggcaggcgcgctggccgagaagctgggcgttcagggccccatcgtacagcgcagcaagatcgaggagtgggcacgcaggggggtcgccctcctggggcccctgacttag

SEQ ID NO: 3133 - DNA, 204 bp, Chlorella protothecoides
atgggctgcattgtgaacggtcctggggagatggcagacgctgactttgggtatgttggcggtgcccccgggaagatcgacctgtatgtgggcaaggaggttgtcaggagagccatccccatggagtccgcctgtgaccagctcgtggagctcatcaaggtgaggcggtttgatgtaatgccgcactggggcccaacgctgtga

SEQ ID NO: 3134 - DNA, 258 bp, Chlorella protothecoides
atgagcaccgccatgctttcctccagcgtgcggggttcccctccaaacacaacctacgagttcgagtacgaggtggactccacccgcggcaagaagcgtctgctggctgcggtgacggtggcgggcagcaagctgcacatcctgaatgccagcgtggggtgtgggaagggggagaccgccacctgcgctcccctggaagccgacctgcagcgactgcggcgtgccattgcctcctttgatgtggatcgaggcgcatga

SEQ ID NO: 3135 - DNA, 987 bp, Chlorella protothecoides
atgcccttcaaggtcggtggggggatcgaggctggtggggcatcttgctgggcgtgtgcgcgtgtggccaggggcactcgcgtgccttgctgcaggagtgggactgaagcacagctgtgcaggtgtccccgtggcttttgcagcaccctctggatgccccctcccacccatgcaaccttacacgtcccacctcctcaggacattgccacctccgactccatcttcctgagggaggtccccgccgaggatgatgcccaggcccggcgcgccctgcgccgcttgcaagaggtgaggggcgaagggtgggggggtgggaagaatcaaggcatgggtggggcaatgagcgagtgcctgggtggggaatcgaggtcgctgcctgcatggtccccccctcgcgaccatcgttgcgcctcgtcccctcatgccctgggcacattgacgcccttcctccccacgccatccaacgccttcccatcatctcaccggcccccctcagttcacgtgctggcggaggccgaggcgctggccgcctcccccctccctgactccgtggccgtgatctcgctcgcggccgccctggccgcccgtgccgaaggccgctcgccgctgccggcgggggcagtgcgcctggcgctggccgtggatggcaccgagcccgacgcggacgtcgaggccgcgggcgggctggacgcgacgctggtcctgctgcgcgtcgcgcccggcgtgtcgcgcgtgcacgcctcgcgtcgtgtgtttgaggcgctgacgcgcgcgcgctgccacctccccgtcgtgcatgcgctggagtttgcaccgggcaccgggcgcgaggagctggtgctctccgccggcgcgctggtgggcgcgctcatggtggacgggcgcggcgacggcgtcatgctgtcggcgccgggccaggacctggcctacctcaggaccacctcctttggcctgctccaggtgcgtgagggttggtttcgggagtga

SEQ ID NO: 3136 - DNA, 1683 bp, Chlorella protothecoides
atggcccaggctatccccgccatcaacacggcggagggggtgctggccctgctggcggaggacgatgatgccctgaaggtgtacgccctgcagcagatcaacgccagcatccaccagttttggcaccaggcctcgggctccatcgccaccatcgaggccctgtttgaggacgaggaatttagccaccgggagctcgcggccttagtcgcctccaaggcacggcgccttgttgactgtccttgtgaccgccccgatccacaccctacttaccccctaccgcagatcttctactacctgggcgacctgcaggaggcgcaggcctacgcgctgggcgccggcgcgctcttcgacgtcgactccccctcagccttcgagcgcaccatcctggactcctgcctggacgcgtatgtggcggcgcgcgcgggtctggccggcgacgagcccggcgatgcgcccgcctcgctggacccacgcctcgccgcgaccgtgcagcgcgtgctggaccgatgcctggccgacggccagcacgagcaggcggtgggcatcgcgttggaggcgcggcgcctggacgtgctggccgctgccgtgctggcggcggccgacccacccacgctgctggcgcacgcgctggacgccgcggcgcgcacggtggtggagcgcggcttccggcgctgcgcgctggccacgctggtggggctgtataagcgggctgcgccggacgacgcgccggggctcgcccgcggcctggccgcgctggaggacgcggagggcgtggccgccctggcccacgccctcctgcgccagggtggcaagcaggcgctgctggcgtaccacattggcttcgacctggtggatgcccagctgcacgagttcacgcgggacgtgcatgcgcgcgtgctggcgctggcgcgcgccagcgcgccggccgccggggcgcctgccgaggcgcgggagggggagggggacgcggccgaagaggcgggcctggagacgccgctgctgggcgaggacgacaagactgacgccggcggcgccacccccgcccccgagctggccccggagctggacgctttcctgcgcatcctgtccgggtcgcgtggagctggagcgccagttcctggcacgggcgtgccatgcggacctccagatcctgaagaacatcaaggcgggggtggaggccaggaacagggttgctgccgggttgtttgggctgggagatcgcaaagaaggaggggcggcagggaatgggtgacagcgcagagccctggtgcccggcgtgctgtccgccttgatgccgggagccaatctgccctcttgccgggcctggatcccgcacctgctgggcctgggtgccggcctcccgagtgttgtggcccaggcctccatgctttcccccctttccctgtcccctcacacccctcccctccccctccccgtccccccccccttccacgcagcgtgtgccactcggcgacgcgcggcagcgtggccgacgggcgctcgcgctcgctgctctcgccctacctccccgccgcgccgggcagctccacggggtcgccctactccgagggcggcgcgctctacgcgctgggcctcatccacgtcaacagcggcgcgggggcggcgcagctgctcaccgactccctccgcgccacgcagcacgaggtggggctgggggtctga

SEQ ID NO: 3137 - DNA, 777 bp, Chlorella protothecoides
atgccccctgatctcaaccactctgccaggtacgacaccccattggtggccgacatccacttccagcccaccgtggcgatgatggtggccgacgcctttgagaagatccgcatcaaccctggcaactttgccgacgggcgcaaatccttcgaggagatcaactacgacgaccccgcccagtttgcgcgtgagcgtgagtccttccgcgagaccttcatgcccctggtggagaagtgcaaggccctggggcgggccatgcgcatcggcaccaaccacggctccctctccgcccgcatcctgtcctactacggcgacaccccccgtggcatggtggagtcggcctttgagtttgccgacatgtgccgcgacgccgactaccacaacttcctcttctccatgaaggccagcaacccgctggtcatggtgcaggcctaccgcctgctgtcggaggagatgtatgccaagggctgggactaccccctgcatctgggggtcacggaagcaggcgagggtgaggacggccggatgaagagcgctatcggcatcggcgccctgctcatggatgggctgggggacaccatccgcgtctccctgaccgaggaccccgagttcgagatcgtgccctgcggcgccctggccgccctcggcacccgcgcccaaacggagcggtggggtgtggagccttttgaggagcaccgcgacacccacctcttcaaccgcaggcgagcgctcatggctgggttggctacgtgtttcgggggaagaggggtgggttga

SEQ ID NO: 3138 - DNA, 525 bp, Chlorella protothecoides
atggcacgaggatgcgcagggacgaactccccttcccggggtggtggaggggctcgccgtctcgggcaccgtcacctcgcagatgaggtacctgggcgtgctgagtacgacggcctcattcccctgaacgacgaggcgacctgggacgccctgggcaaccgcctgcgggttgggtcgtgcgtggaggctcgggtgcatcgcgtgagggacgcgcgcctcttcaggtaccccgtccagctggcgccccgcgtgagggacgcgcgcctcttccgctaccccgtccagctggcgcccgtggaccccgccctccaggccctcctgccgcggcccgagagtcacatgggccccatggaccttcgggacggagggacgcagatggttgggcgcatgcaagctgagctgtggatgcaagggacaccaaaggcctctggtacaggcgactccggcacctatcgccaacatgccccgcttccccttccccagggacctggaaaccctggcacgcgtcagtggcaggccgtatga

SEQ ID NO: 3139 - DNA, 1539 bp, Chlorella protothecoides
  modified_base (1474)..(1483): a, c, t, g, unknown or other
atgccgtggcttcctcgccgtcccggatggaccagcgcacgtctctattcggcgcaccaaacactatggcctgctggattcacaccaacccacaccctcccacccaccaactccctcctcccccccccaaatccccctcctccccagggggccgaggccttcagctgcgaggtttgcaaggccaaaacccccgccaccaagcacctgcgcctgcagcgcctgccccagatcctggtgctgcacatcaagcgcttcaagtaccgcggcttcttcaccgacaagctgacggcctccgtgtcctacccgctggcgggcctgtccctggacacctacctctcgcctgaggcgctggtggcgggggagggcggcgcgctgtacgacctctacgccgtgtccaaccactacggcaacctgtcgggggggcactacaccgccatgtgccgcgtgcagagcccccaggcgcccgagggcgagtggtattgcttcaacgacgaccttgtgaatcgcgtgtcggaggaccagggtcttcccttttgggaggggagggtagttgaagagactcccagggatgagcagcgcgagggaatgaggggcggtggcaaggtaggagcctggacatgtccagtcggggccctcctcctgctcatcaggaccctacccctccacaccaccactgcaggtcatgtcacagtacgcctacatcctcttctacgcacgccgacccagggcggcagccgcatgaggagttttttccgcgtgcaagcttgggagtccccccctcatgaagaaaccttccctcgcaataagccgccacattcgcccccgctgtctcgccctcgacgacagcggcgacccccctggcaatcccccccttgcgcttgttcacacttgcctgctctcgctcacgcgtcacactgctgcactcccctcgagtctgcccctgcccttctcctcgaccttgttggcacgccggcgtgcccagccgcgtcccacttttgcaaggcacaacgccatctggctgggcgcgtcgggccctgtggtgctccggccaaaggcgccggcccccgaggcagggaccaccagcatgcgcgacctcttgcgccccgccgcagccttggccaccgcggcggcgagcgccgcttgtcgcggatccacgccgaccttcttcttcctcttcgcccggggcgggcccgccgcggccgcacaggccgcggcgcggctgtcggcgagggactgcgccagcgccacggaggaggtggtcacgctgtgcgcgctgggctgcccggcgtgcgccgccacggccgaggcctggccagcggtgaagtagcgctggctaaacgcgggctgcagcggctccgcaagcagcgcgcccagctcggcgcgcagcctctgcgttttttagtgatggtggggggtgggcgtaaggcctggcaggcgcactcaaaccggtcatgccaatgtcctggtgtgcgtnnnnnnnnnncccagctcggcgcgcagcctctgcgtttttcaagtgatggtggggggggggcgtaa

SEQ ID NO: 3140 - DNA, 1479 bp, Chlorella protothecoides
atggaccgtgtgcctttccgcgggcgcaagcccgcggtggtggacctgaccacgggcatgcgcgtcgcggcgcgtgtctccgaggcccacctttcctgccctgaggctgagcgtgacgagtacctgtactgcctcctgtcctgccacccgggccgcaccatcgtgttcgtgaacgcggtgtcggcggtgcgccgcctggcggccatcctcaagctgctggccctgcccgtgcaggcgctgcacgcgggcatgcagcagcggcagcgcctcaaggccctcgaccgcttccgcgccgacgcggcgggggtgctggtggccaccgacgtcgcggcgcgcggtctggacgtgcgggatgtccgctgcgtggtgcactaccagctccccgcctcgctggacacctacgtgcaccggtccgggcggacggggcgggccagcgcagagggactcagcttggccatggtcacgcccaaggagcaggcgcgcttcctggccctctaccgcggcctgggcagggaagtgcccccggagttccccatcgtgagcgtggaggagggggctggcaatgattcgggaagggaaggaggaggggggtgggaaaaggacgcggaggggtggggtgggaaaaggacgcggtgggcagccgaacactgggcctggggattcgggcacggagggcgggcaacggcaagcagcagcctgctgctcaacgctggcggtcaccaacccccgcgcatgtctgcgcaccccacctccgcacctcccctttgcgtgggtacccagcgtctaccactcacccaacgtccctcctccaccacaccaccccccatccaggacctgtcgctgctgcccgccgtgcgcaagcgggtcaggctggcagtcaggctggacgcccacgagcgcaagcactccaagagctgcgcggaggccgcctggcggagccagcatgcggaggagctgggcatcgagctgagcgacgaggagctgagcgaggacgaggcggccgcgactgggcgcaggggcgggcggagagggcaggcactggaggcgggggaccgcggggttgacggcgtgatcgccgcacagaggctgcgcgccgagctgggcgcgctgcttgcggagccgctgcagcccgcgtttagccagcgctacttcaccgctggccaggcctcggccgtggcggcgcacgccgggcagcccagcgcgcacagcgtgaccacctcctccgtggcgctggcgcagtccctcgccgacagccgcgccgcggcctgtgcggccgcggcgggcccgccccgggcgaagaggaagaagaaggtcggcgtggatccgcgacaagcggcgctcgccgccgcggtggccaaggctgcggcggggcgcaagaggtcgcgcatgctggtggtccctgcctcgggggccggcgcctttggccggagcaccacagggcccgacgcgctgcaggcgctgcgtgcctcgcggcagtga

SEQ ID NO: 3141 - DNA, 1329 bp, Chlorella protothecoides
atgtctaagaacaaggggctgtggggcagcaaaggctggaagcgcgtgaatgtggcggatgctctcctggacacggacgaggacggcttcgtggagctggagcaactcgacggggcatacatgggcaaaatcttccaggcacccagcggcccagatgtcctcatcccgccggaggcgccggccctggggaccagcaagaagcggaaggcatcgttggcgaccaccaccactgccttgccggtggaggacatgcgtgcccagctgcggcggctgaggcaagagcaacgcgccctgtctgcgcagctgaagcaggccacccgggcagtgggcggcgccgggtctgaggctggcgccgaggcggggagcccagaggggccgagcggcaatgacgacgctacggcgctggcggccgcgaagcctgtcgccttgccgtcatcctcggacaagaagaaaaaagcaaagaagacaaagaagaaggccacttctgcagaggctgtggcgccgtcctcccagaccaccacacccactcccccagtggacaccagggcctgggaaggcctgggcctgcacgaagaaatcctcggcgttctcagcacctgcggcttctcggcccccaccgcggtgcaggtggcctgcctgccgtccgcgctgcgcgatcgccgggatatcatcggcgcggcgcagaccgggtcggggaagacgctggccttcggcctgccaatcatgcaggccctgctgaatgagcggcacatgcagacgccagctgcggcggaggagggtcccagcgaggggccgagcgaggagggccacggagacgaagctccggcccccgccgccacgggtggaaagcgccgcggcgcactgcgcgccctcatcctggcgccgacgcgcgagctggcgctgcaggtctgcagccacctggaggtggttggccgggcactgggcgtgcgtgttgcgcccatcgtcggcggcatctcctcccagaagcaggagcgcctgctggcgcacgcgcccgaggtcgtggtggccacccccggccggctgtgggaccagatgcagtcgggcgccgcccacctcaccgacttctcgcgcctcgctttcctggtggtcgacgaggcggaccgcatggtgcagcagggccattactcggaactgggcgagatcttggggcgggtggacggcggctcgggcgaggacggcggccccgcccccggcgcgccgcgttccatgcagacgatgatcttctcggccaccctcaccctgcctgccaacctgcgccaccgcctgaaaaaggtgaggcgcgccgaggaggctttggaggggggatga

SEQ ID NO: 3142 - DNA, 948 bp, Chlorella protothecoides
atgacattgcagcctcgaagggccagtttaatttggaagactgtagaagctgaagttgtgttctgcaacaaaaatctcaaagagtgcaacctgaacttcgctaggggtccgagtgcccgagcatatgatgaagccatggatgactctcatcgtctgtgctcttatcaccttcatgctggtaactgtacgtctcttgtgagggacatgttcactgcggcattgttttgggggtctgatgagataaacgaggatggagctgcgcgtcagactgactcgattccctcctgccgtccgtcaggctgcagcgggcatgatgcgcgacagcgcgatcaacctggaagttgccaaggtcttgacttcccgaatcgggatggacatcgccagctccaacaggcatcatgccctgcacccaaccttccttccttcatttacaatggatatgtcgagtcttattttgtccctcctgatccctcctactggaagagcttcccatcctacatcaacgttgccctcctcttcttcttcacaccagatagccagtacactgctggacaaacagatcttgcgaacacaggcttactcttcgagggcacctcggcggcacagctcacggccggcatacaagcgctgcagagcaagggcaccaaggttatgctttccatcggaggggcatccaatgctgaccgaccggtggagtgggaatcatggaatgtcaaggctgcaaccgactttgtccaagatttcggactggatgggatcgacatcgattttgagccgcgcgagccaggtgagaggggctcttacatcacatgtcatgccctccatttccactctgggcttgaggatcccttttcagctgcaaacccctcggtgtctccccctttggctacaaagctcgtagccatcatcgctcacgacgcgctgcaagcaggaagaaggtcccactag

SEQ ID NO: 3143 - DNA, 801 bp, Chlorella protothecoides
  modified_base (50)..(59): a, c, t, g, unknown or other
atggcgtgtaacactgatgagaaattcgagaacatcatctctgggtaccnnnnnnnnnntggtctcactagttccttactaccatcactgccacacgtaggctgcaaggtatctcaagacacggggaacatggcgtgtaacactgataagaaattcgagaacatcatctctgggtaccgtgctggactggataccctaggttctggcaagctgctctctgcagctctgtggagctctggcgcctggggccaggccccttggacaggactggggatcggatcgccacagacagggctatccattaacatgctgaaggctaccggatgtgctctggacttcattcacgttatgagctatgacgctggtccaaattttccgtatcgggatgcataccaggcatacagatccttctacccaggtgagggcccgggtaagggttgcccttgcatgctgacattccccccagcctcgcatagtactgctgatttcgtattccgggcagattccagaggacattttagccctagagttcccagccgctatcattctcctcatacacgtcgcattcttctcggcatggaagttgcacctgaagcattcgggggaaatgttctgaccattgatactgtctatgacctgggcaacactgtcaaggagctgggcggagctgggctcttcctattttctttcacaaagcggtctgagggaggagcaactgccactgagatctcccaagccgtgtgcaaccaatttcgactgggtgactgtacaggaacgatcccaccgtccaaagttcagtga

SEQ ID NO: 3144 - DNA, 1374 bp, Chlorella protothecoides
atgttctccgaggcgtactttgtgttctccgtgggtaacctgaagcccatcttcaaggtcttgtaccccgactgctgggtcaccttccagacgtgcagcagcaacctgtcggactccatcaactactcccaagtctccggtatcattgccggccagctattcattggattctttgcggaccgcatcggacgcaagtacggctccatcctgaccgcctccatcatgctcctgttcggtatcctgatcaccgcctcctcgggctccaactccggcaacctgttcatcatgttcaccgtggtccaggctctgtttggcgtcggcgtcggcggagagtaccccgtggcctccacctccgctaatgagcgcgccgagcagaccaagcacctgcagaaccgtcgtggcgagaccgtggtctgcgtcttctccatgcagggctggggcaactggttcaacaccatgatcatcctggccatcatggccggcttcaaccagcgcggcgcgccctacgatgactacgcactggaggtgacctggcgcctgtcctacgcgctgggcctgctccccctgctcttcatcttctactggcgtgtgttccagctgcgcgagtctgcggtctggcgccagaaacgcgagtcgctgcggtccatgggcaagggcacgcgcttcggtgctcgcaagatgcgcctgctcctcttctactactggcaccgcatcgctggcacctccctctcctggtttgtctgggactttgccttctacggaaacaagctcttccagtccaccttcatcaaggtcatcaaccccaaggcgggcctgctggaggtgctggagtggaccctgctcaacagctcggtcgccctcgtcatgggctttgcctgggtgggcgtcctcttcctgatctgcgcgggggcctaccacaagctgctggagccctccaacatccaggtcttccagttcctctactacttctcctccttctggggccagtttggccccaacgccaccacctggctcctccccgccgagaccatccccaccgaggcgcgctccatgtgccacggcttcgccgccgccgtcggcaaggccggcgccctcgtcgccggcgtcgtctttggcctcgtggacgaccgcgtcaagttctggatctccggcgtctgcggcgccgtgggcgtggtcctcaccctcctcgtcatccctgacctgacagggctggacctgaaggagggcgacaagcgctggctcgccattgtcgatggtaaccacgacgagtacacgggccctgccatcaaccccaggcacctctctgccatggagaagtttatctaccgcttccagaagaactatgtggctggctcggaggaggagtccaagtag

SEQ ID NO: 3145 - DNA, 489 bp, Chlorella protothecoides
atggtggcggtgcaggggacggtcgtcgcggccacgcccatccaccccgtggccacctccctggagttcaggtgccgaaagtgcaactcacgcacgcgcctgctccagctggagacgggggtgaggcagcggccggagcactgcgcgtcccgagcgtgccgcgctcgctccatggacccagtggcatccagcgcccaggccgtgctctggcgctccgtctgggtcaagccagaggtgggagggaagcatgtaccagctgcgtggggactggaagggcatggagaggggatgagggggtccgacacggctgagccgggcctgcctgggcaggccatccaggtgcacctggtgggggaactggcggaggtgggctgcctgggtcggcgcattcatgtttcgggcatcgtgaggccgggccatggaggggcagcaggtgggcgggtggtgtgggtagggcgttgggcctccaaaggttggggtctggattga

SEQ ID NO: 3146 - DNA, 501 bp, Chlorella protothecoides
atgccatgtggtggatcaggcctcctcccctccccaccttcctccaggcgcctgcaccccaactacagcctgaacaagctgctgaacggcaacctgaggctgttcgggggcagtgatcggcgcctcctccgcaccctggcctcctcgtccgacaggcgatacctactgcagcactggccccgtccagggaccaaggacgccgccaagcgcgacctggtggcggcggctgcgggtgcgcaaggcgatgctcctggcagcctggagcccctgcgccaggcggtgctcaccgcccccgtggccgagcgccgaccccaccgcctggtggcacacggcgacgtgagggtggacgactactactggctgcgggacgacgatcgcagcgaccccagagtcctggcgcacctccaggcgaggcgtgcgccgcgggggacgggggtgcgggcgcgaagcgtgggcaggagcaggggctcacagccctgcacatccatgttgccgcaatga

SEQ ID NO: 3147 - DNA, 447 bp, Chlorella protothecoides
atgctggccgatacggaggcgctgcaggaggcgctgaccgccgagatgaggggcaggatccaggaggcggacgagggcgtgcccaccaggccagtccgggctggggggctgtttgtgcgcaatggatggcctgaccgaggggaggccgcctgcccatttctctgctgcggccgccggcctgaggcgagccggacgctggagggccagcagtactcggtgcactgccggcggcggctggggccgggcgcgggcgcccggccgtcggagacggatgccctggaccccagccagccggaggaggtcctgctggacgagaatgccgaggcccgggcgcacgctttctacatggttggcggcttcgaggtgtcccccaaccacgagtgcgttgctgggcttaattttgggagatggtgggttcttggcgcatgcgtacgggtcgtggcctga

SEQ ID NO: 3148 - DNA, 471 bp, Chlorella protothecoides
atgacctgtgccgttgacgagcagttccagaatattgtccttcagtaccgttctagcctggccgccacgggatgcaaactgctgtctgcagccctgtggagctctggcgcctggggccaagccccctatgagaacctgggggttggatcgccacagacaggcctgtccataaacatgctgaaggcggtcggaagtaaccttgacttcatcaacgtactgagctacaacggagggattgtgttgcttggcatgcaagttgcacccgagtacgatggcactgcgcttcaaatcagcggcgtcaatgcgctcagcagcactgttaggggactcggcggggctgggttgttcctcttctccttttccaagggcgctgtgggaggagcatctgccactgacacttcccaagccgtgtgcaggaatttccaactgggtgactgcacagcctcaatacccagatccactgttcagtaa

SEQ ID NO: 3149 - DNA, 1629 bp, Chlorella protothecoides
  modified_base (554)..(708): a, c, t, g, unknown or other
  modified_base (905)..(914): a, c, t, g, unknown or other
  modified_base (1156)..(1165): a, c, t, g, unknown or other
gccctggccgccaccgcagacccggcctccggcgtggaggccgacgtcgacgtgcgcagtgcggcggtcgccgcgctggccgacctggcgggggcctgcgtcgcggcgcagtccgcgcccgccctcacgctgtgcgcgctgggcctgggcgccgcgctggccgcgctgggggactacacggtggacaatcgcggcgatgtggggagctgggcacgggaggccgcgctgcgcgcgctgcccggcatgcttcggtgccgggcggggctgggggggcccgattgcaaggatgggggggacgcgatacgcggcgacggcgaggacggggcggtgtttgagcgcagagactgccatggcgatgcagcctcagggcctcgcgccatggagcgcttcgctttcgagtgcgtcgccgcggcctgcaagcagggggtggagcgcatcgggcgcgtgcgcagggcggcgcgcgacgcgctgcgtgagctggcggacggcgagctgctgccgcactccgcggcgccggcaatctgcgccgcggtggcgcacgccgtcgacgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggctggtgcacagcgtgggcgggcgcgacgcgcaggtggcagccgcggcggccgacgcgctggcgggcgcgtgctgtgaggcaggggcggcaagtgggcgggcggtgggcggcgccttcctccgcctgtgggacgcggaggcggggggggcgcaaggccggagaagcccggagtcaggagcgccgtgcggtgcnnnnnnnnnnagaggcgggtggggcgcagggccggataagcccggagtcaggagcgccgtgcggtgctccagaggcctcggtcagcggatcagccaacaaagcgcgtagagcgcatgtgcagcggctcgccggcgtccccctgctcgccagcgcagaggtactgctggcccggacgccactggcgggcgacgacgccttccagctcggcttgctggaacggttgcgtgttgaagttgcccggcggggtgccnnnnnnnnnngctggcgggcgacgccgccttccagctcggcttgctggagcgattgcgtgttgaagttgcccggcggggtgccgacctgccccggctccaggcggccgccgcgctgctgggcgcgctgggctcgggggaagcctgcgcgcagccggcgcgccgcctgctgtgggccatgctgggctcgcgcttcccggcagtgcgccgcagcgcggccgagtacctgtacctggccctgctttccagccccgacgaggcagaggatggaatggaggccgaggagcaggcgctggagctgctgggggagaggaactgggccggcccggctggggaggttgccgacctggcagtccaggtggctgccctgctcaaactacaagacgcctgagagtgtatggcagaggacgtgctcccgagtggctgtcgctgggactttgatcaactgtgatccagcttgttgcaagtgctcatag

SEQ ID NO: 3150 - DNA, 2397 bp, Chlorella protothecoides
atgatgctgcggggcgtacgcatcccagggcaatccagaacttctcaatcatgggttgtgacgagctcagacgggcaccgcgtggcgagacggcagcgtccggcgcagggtccccgatgcgaggcggtcaagcgatcgaggaagcgtcccacagcgagcccggcccctgccagcgatgagatcgccaagctgatccgatcgccagaaaccgcgactgaaaatctcaagaagaccactcttgagcctatccgtcagcatcgcagcgtgttaccctgcagatctggtggccagatcgccaagccgatccgatcgccagaacctgcgactgaaaatcccaagaagaccactctcgagcctatccgtcagcatcgcagcgtgttgccctgcagatctggtggccaggcagtccgactgcctgcgacctgccctcctacttccccccaccttggcgtcccccaggcaacggtatcggtgacagaggatgaggagaccatcgccgtcaccatccagctcagcggcggcccactctccggtcttgcccgcccgcccaccctgctctggggcgtgtaccgcggctcctcccggcgctggcagcaccccgcgggctgctcacccccccgcagcaccctggacgagcgcagcggggcgatgcggtccccctttgacatgcacggcagcatcacgctgcgctttccggcccgcctggcgcccctgaccctggcctgggtgggcgcggcggcggggcggccggtgctgcccctggtcgcccgccactttgcggtccccctgggcacgctgccggggaccccggtgccgctggggccctccctggcggggcggccgggagcggagcggggcgccaacttcgcgctggcctcccgctcggcgcatggcgcctgcctcctgctcttccgccgcggcggggacggggcctgggccaaagccctggagctggagctggacccggccgtgaacaggacgggggacgtctggcacgtcacgctgcccacgctgagccgccgcgaggggctggcctacgcgtggcggatcgatggggaggtggcctgggacggcgggaaccgcacgcagccaggtgtctgggggattgagggttgggaggtgtgtaggaatgcagggaaagggacctgggcaagcaggggagtagggttggtgccatgccactttgacatgcccttccttggcatctccattgctgagctgcgatggatggagaccatgtacctacaaaccaaggtgacccagccgagccgaaggcgcgccacagtgcatccccaaacacccaaacccctgcaccccacccccccacgatgcgacagaccgtctgctgctggatccgatggcgtcgtcgttggtgctgacgcgggaggcggtgcggggcctgggccccctcaaggctcccagcatctcgttgcaggagggggaggtccccgcattcctgctttccgggctggacgtgctgggcgccgacgtggccgccggcaggcccgcaggcaggagccaggccgtgcctcccactcaccagcgctgcatggtggccgtggatgtgcggggcgccggcgatgggacgctgctgggcacgctggacttgatcccggagatccaggccctcggcccatcgggtcccgctccccgtgccctcccccatcccggcctgctccaaccccctcctccaccaccagggacccccctggacaggggcagggcggcggtgtcgtactgggcgccggaccccacgctggcatcctcgcccgaggcggcctccagagaggtgcagcggctggtggcaggcctgcatgccgccggcctggcggtgctcatgcaggtccgcgcctcgaggatgggaaaggaaacgctgctcgtgcgctgtgcaggcgccccatgggtgtgaacttccgtcacctcacccgccgcacccgcgcgcaggtcgacttcaccttcacggccgagggcggcgacgacagtccgtgcccgctctctttccgcggcctggaccacgcggtgtactaccgccgagcaggcgtcctgaacgccgggcacgcggtggtgcggcagtacatgatcgacgtgctgcggcactgggcgctggactacggcatggacggcttcaacttcatgggcgccgagaacctggtgcaggggtggcttagctgccctggggcaggaatctgggaggatggcagcacggcagggcttgctctgtgtcctcatgatgacccccctacaccaaacgtgtcgttggatctgcgagacctggtgccgggacacctgctcacgccttcgccctcccctccccagatcgcaatggcgtcatactggatgcgccgcccctggccgccgccatcgcctacgaccctgtcctcgctgggctgcagatga

SEQ ID NO: 3151 - DNA, 867 bp, Chlorella protothecoides
atgtacacacattcgcagtgcgcggacctgggcgcgtacaaggccgccctgccctggtggaagatcgtgctggcgggcgccatggcgggcatgtatgtctccctgggcggcatgctgctgctcaccgtaggccccaactgcgtggccatggccggggacaaccccgggctggcccggtacatcaccggcgccatcggcttcccctacgccctgctcaccatcctgacctgcggcgcggagctgttcacagggaacactgcggtggtcaccgcagccgtttacgagggcaaggccgacctccggtccctggctaagtcctggatctgctcctatgccggcaacatcttgggcgccgcagcgggggtgggcctggccgtggcttcggggctgctgccgcagctcacacgtggcgccaccgccctggccatctataagacgggggcgccggtgggcgtgaccctggcgcgcgccatcggcgccaactggctggtttgcatcgccgtctggcagtgcaccgcggcgcagacctacggcggcaagttcattgcctgcctgggcccaatctccgcctttgtcaccatcggtctggagcactgcatcgccaacatgttcttcgttcccctcggcatcctggcgggtgcgggctgcacacctgcatctcccatctcatcagcttctttccctgtcctctcgcacctcgctgcctcaggcgcggatgtcaacatgcgcgattttgtgctgcgcaacttgatcccggtgacgctgggcaacatcttcgcgggggtggtgtgcgtcgccaccctctactcgctgctgtacggagcgctgggcgaccgcatcatgggcaagaagccagccaccgcatga

SEQ ID NO: 3152 - DNA, 1194 bp, Chlorella protothecoides
  modified_base (218)..(227): a, c, t, g, unknown or other
  modified_base (334)..(343): a, c, t, g, unknown or other
  modified_base (435)..(444): a, c, t, g, unknown or other
  modified_base (903)..(912): a, c, t, g, unknown or other
atgcccgagcgaggggccaccgtgcgctcccgtccccagccctccactctccagcgtcgacctgtggtcacccttactttcccctcctccgaaacaccccgtccccatcaggtcaccacggccacatcactgccctccagcgccaccccgcctttcccaagttcttcctctcctgcggcgactggagcgcgcgagtgtggagcgaggacgtgggccannnnnnnnnntccagcgtcgacctgtggtcacccttacttccccctcctccggaacaccccctcccgatcaggtcaccacgaccacataaccgccctccagcgccaccccgccttcnnnnnnnnnnccagccctggaggtgggtgggtgggaagaagggagtggggccagggaacggtggacaacctcggcagggactgtggcaggctgcctgcctgnnnnnnnnnnggggcctggagccccacccgcgccggcatggccctcaccctggacggaggcggcaggctcgcggcctgggactgggtgcaccgccaggacgcgccagccctggaggtgggtgggtgggaagaaaggaatggggtcagggaacggtggacagccttggcagggacttggccgcccactgcgccctcgtcgccaggtgccggtgagcaagcacggcctcactgcgctagccttcccacccggcacggggcaccccagccttgtggcggtggcggccgccgacggctgcacccacctgctccagctctgcgagggactggtcacgcagggcagcggcgagaaggcagccatgggcgcggtgggtgggtcagatccaatcttcagacgggcatgcagctctggatggttgccaggcaggccacagtgctgaagaatgcacctgactccggtcgaggacgactnnnnnnnnnntggatggttgccaggcaggccacagtgctggagaatgcgcctgactccggtcgaggaggatggctcacaaggacccccaccatcacacctcccaccacccaacctcgccaggtcctggaccgtggcaacaaccgggagaagcacctcgagaaggctgcacgagatgccaagctgagggggaggagggctgtaggggaggatgtgggcgaccagtcactccctgcagcgacgggcaggaacgacagccttgcggccagcgagttccgagaggtgagtttttga

SEQ ID NO: 3153 - DNA, 189 bp, Chlorella protothecoides
cctctgcgtgaccctgggtttggcgcccgcccttcggccacggtgctggagtacagcgccgctgcggggcccacgcgcttcatggtgggcacggggcagggcaccatcctggcgggcaaccggcgggccaagagccaggacgacaagatcacggcctcctttgcgggtgggcgaggcgcaaggggctga

SEQ ID NO: 3154 - DNA, 738 bp, Chlorella protothecoides
gacctggcggaccgcctgacgctgggcgcgccgctgggcgcggggtccttcggccgcgtctaccgcggcgcgctgcagggccgccccgtggcggtcaaggtactgcccgtctccgacgaggccagccgtgcactgggcctggccgaggcggcggtggggcgccgcctggaccaccccgcgctggtgcgcacgctggagtgcagcgtggcggagggcgcgggcgaggccgaccccagcctctggatcgttcaggagttctgcgacggcgggaccctgtacgacgccatcgacaggtggacagaggggctctggggggtgaaaggcatggtccagagggagggaggggaggggtgcgggccagccggcgggagtggggctgggcctggctgtggcctgtgccagggtgcctgtgcatggactgcagggttcgcctcatgcacgggcctggtccacacgggacctggagatcgaggggatcagaggaacaggggctggctgcggcaggggtacgacggcttcgctccggccgacgtgcgggccgtgctgcgcacgctgtgcgaggtggcgtcggccctggcgcacctgcacgccctgggcgtcgtgcacggcgacctcacggggtcaaacgtgctcctctgctccgcggcgcgcgcgcccgacgacggccggggctggcacgccaaggtgtccgactttgggctggcgcgggagctgccggcaggcggggtgctgtccaat

SEQ ID NO: 3155 - DNA, 1179 bp, Chlorella protothecoides
  modified_base (154)..(163): a, c, t, g, unknown or other
  modified_base (686)..(695): a, c, t, g, unknown or other
  modified_base (778)..(787): a, c, t, g, unknown or other
  modified_base (1037)..(1046): a, c, t, g, unknown or other
  modified_base (1103)..(1112): a, c, t, g, unknown or other
atgggggagacaccgctgatcagggcggcacacaatggccacctggcaaccgtccagtacctgatcgacaagggagcggaagtcaactccatcgacatggtgagggactggtttgcgtgcattcatttcatggatgagtgtcccactctgcgcnnnnnnnnnnaagggactgggttacgtgcattccatttcatggatgagtgtcccactctgcgcgctgcatcagctcagaaacaccccttctcatcaacctctgccatcgctccttcttcccccccgcagggcgacaacaccgccctgcactgggcctccatgcgcgggcacgtggagatcgtcaagtacctgctggcgcagggcgcggatcgcacgctgcgcaacaagcaggagaagatccccatcgacctctgccagccctgctggtccaactcctaccgctttgcccgccagctcttgtccgccccagggattggcagggaccagttcgatgagactgttccagcctgtgcaggcactcagtgggatcaggcactgagactgtgcactgacttcgtattggaaggccgggcaccctcgaaaggccaggttccaggactgcggggccggtggggtctagcggtgcagcacgacagtggcacaacctccgctccttcttcaacgatgggtgtgcatgccagggcgcgaggcgnnnnnnnnnncgtgcaggctggcactcagtgggatcaggcactgagacagtgcactgactttgtattggaaggccgggcaccctcgaaaggcnnnnnnnnnncgtgcacgcccctgcccccggtcctgacatccctcaggcggtggccgaggcttgctgggtcgcggctgcgctgccgcacccccctgcgcccgcctcttggaagacggccgagctggcggcgcccgaggcgtagggcaggaaggcgggccggctcttcaggcccagcaggtcgaacagctgctcgtcctcgccccggtcgttgttgggcgtggtcagcagcttgtcgccgtcgaagatgctgttggcgccnnnnnnnnnntgtgcacggccctgcccccagtcctaacatccctcaggcggtggccgaggcttgctnnnnnnnnnnagccaggaagcacagcgcctggcggggggggtgggggggggcgggggtcgtgtctgccgttgtttga

SEQ ID NO: 3156 - DNA, 1374 bp, Chlorella protothecoides
  modified_base (226)..(271): a, c, t, g, unknown or other
  modified_base (578)..(587): a, c, t, g, unknown or other
  modified_base (1002)..(1011): a, c, t, g, unknown or other
  modified_base (1077)..(1086): a, c, t, g, unknown or other
atgacacctggttctactggacgcaccgtctgctccactggaagcccctgtatcgccacattcactacatccaccacaagtgaggctcgtgatgggtggtgttggggtgtcggagggggcagtgcagcaccctcagggtccttgcctcatgctggaatcaatcgaaaatctttcccaccggcggctcattacttggcacgttgtcaccaggccatgcacaattccnnnnnnnnnnnnnnnnnnnnnnnnnnnnnnnnnnnnnnnnnnnnnnacactcccacacaggtccactgtacccaccccttttgcgggctactccttccatgtggtcgaagccctcattgtctttgccaacgagatcatcgtctgcttcctcttccccatccacgcgtcactccaccgcatctaccaccttttcaccaccctcatccacatcggtgtgtggggtttgcagccgtggggcaatgcttgggggagggagagtggcccccgtcactggaagggtgcttggtgtctaagaggggggctccccagccctggccgatagatcggcgctgtgcctgcctcctgtataccannnnnnnnnnagggtttgcagccgtggggcaaggcttgggggagggagagtggccccgtcactggaagggtgattggtgtctaagagggggggtccccagccctgaccgacacatcggcgctgtgcctgcctcctgcgggcacgccgggtacgagatggcgccccttatccccagcgtggagcaggcgctgagctggctggtccaggggcccaggccctgcggtgccctgaacacggttgtgcggcacagagcacccggcgtaccggggctatgcccggaaactggcggcccagggccaggaggagagctgagagtctgcgtggctgtgcatgaacgccggtctgttgagcttggaggcatgccaggggcgcgcttgcccgtactgttaccctggcccctcatcccctggctcgggaaggcacannnnnnnnnncctttctcctcactgttctccatacttccgattgtcatccgattgctcgaaactgcgagaggtacnnnnnnnnnnccaagggcagatgttgcaggagccggcctcatgttgcggcactcttccacacttgagcgttggaacaagggcattccgacctttccccctcggcctcctccattcccgcactgccccccagctctttgttggcagtcagacgcttctcataccaccccccctcccccgacttcttttctgctatctgtgctctgtacacggttggctgatcttataacgctgggcgggagggggggcaggggcaagaggaggactgggcaaaggtggttccattcagggatcctgtga

SEQ ID NO: 3157 - DNA, 453 bp, Chlorella protothecoides
atggaggtgtgcaccacgctgggcatgctgacccccgaccaggcggccgcgctgcgcgaggcggggctcaccgcctacaaccacaacctggacacctcgcgcgagtactacggcaaggtcaccacctcccgcagctaccaggatcggctggacaccatcgacacggtgcgccaggcaggcatctcggtctgcgccggcggcatcatcgggctgggcgaggcacacctcgaccgcgtgggcctgctgcaccagctggccaccctgcccgcccaccccgagtcggtgcccatcaacgcactggtggcagtggcggggacgccctttgccgggcatgcgccgcccagcggcctggacatggtgcgctgcgtggccaccgcccgcgtgctcatgccacgcacggtggtgcggctgtctgcaggccgcctcacgctgtcctttgccgaccaggtgtga

SEQ ID NO: 3158 - DNA, 588 bp, Chlorella protothecoides
atgcaggtccagcgacacgcccgcgcggcggtccgcgccctctgctcccagtggcaaactggcacgcccgcccagctcggcctgcggggcgtagcgggatccagcgcggggcgtaatgctgagcccgcccctcagcccgaatcgggaccatccgccttgccggactggcggtcgcgcctgggcgtcgtgcgcacagactggaggtacagggggggacggtgggtgccaacaccacactcacctggccgcattggcttgctgcctgccgccgctgggcccgaggctgccttgggcctgacacatcacggcaggagccgtgaggaggtcggggaggtgtacaacacccccctgctggacctggtgcacaccgccgcggtggtgcaccgtgccaacaacgaccccgccatggtccagcgctgcacactgctatccatcaagacggggggctgccccgagacctgcaactactgcagccagtccagctcgtggagcaaggagaccgggactaaggccgagaagctgatggacctggacgccgtgtacgagccttccccccatactccccttcccccacctcctcctttctaa

SEQ ID NO: 3159 - DNA, 522 bp, Chlorella protothecoides
atgctgactgggacggccctgggtgtgctcacctggggcggtggcgcgtcatgcttgtttggcgggttcctggccgtggttgcggccagcaagtcccgtgcagcccaggacctgggctccgtgcgtgaggttgagagcctttccgacctaaaggagctggcgtccctggtccccctgctggtggcggtgagcgggcgcgtttggtgcgcgcgcccgctcacctgcgagctgtccgccggcgaggccgcgatcgtggaggtccaggaggagaagcgcaccgagcgccgcttcggcgcggtgtgggtgggcgagaccacgcccctccgcgcctcggtgcgcgagacggagtggtgcctggcggagggcgagggcggggccggggcgcaggtgccggtgctgggcggcgccggcgcgcgtggcgacgcgctgcagcccacgggcgacgtcttcctgccggcccaagaaggcgcgctgggcgcgctggtgggcgagctggcggggcaccgcgcgctgggcacgcgc

SEQ ID NO: 3160 - DNA, 987 bp, Chlorella protothecoides
atgccgcgcgacggcatcctgtccctgcactccggctgcaacgtgggcaaggccggcgacgtgaccctcttcttcggcctgtcagggaccggcaagaccacgctgtcggccgaccccgcgcgcgagctcatcggcgacgacgagcactgctggggcgaggacggcgtgttcaacatcgagggcgggtgctacgccaaggccatcggcctgaagaaggagaacgagcccgacatctacaacgccatccgcttcggcacggtgctggagaacgtcatcttcgacgaggagacgcgcgaggtggacttcgactcggccaagatcacggagaacacgcgcgcgtcctaccccatcgagtacatcgccaacgcgcgcatcccctgcgtgggcgggcaccccagcaacatcatcatgctgtgctgcgacgcatttggcgtcctcccccccgtctcccgcctgaccaaggagcaggccatgtactacttcatctccggctacaccgccaaggtggcgggcacggagcagggcgtgaccgagccggaggccaccttctccgcctgcttcggctccgccttcctggtctggcaccccaccaagtacgccagcatgctggccgagaagatggagcgccacgacaccaaggtctggctcatcaacacggggtggacggccgggtcatacggcgtcggctaccgcttcaagctgcgccacacgcgcgccatcgtggacgccatccactcgggcgagctggggcgcgcggagtacgagcccatccccgtgtttgggctgcaggtgcccaaggccgtctcgggggtgccctccgagctcctgatgccctcccgctcctgggccgaccaggacgggtacgacgccacgctgcgcaacctgggcgagctcttccgcgccaactttgagaagtacgccgacggcggcggcttcgtcacgcccgaggtcgcggccgagatcgtcaagtcggggcccaaggcctga

SEQ ID NO: 3161 - DNA, 1101 bp, Chlorella protothecoides
atgcttgggcgtctccagactctcaagtgccctccccttcattcaatcccatcctgtatcctcttccatccgccaccccgcaatccccagcaccaccgtccctcgcccagcagcccaaagccactcacaccaccgcccccactctcgtgttccccatcccaacgttcccacctcaatgcaacccatccacccaccccccctttccaccccaaccacctggcagagactgtgcatgccgcgcacctcgagtcgctgtcggagacgctgcgctccaacgcgcgccagacggggccgcgcgtggttaagggcgagcccaagcacgcctacatccccggctccccgcgctccctggcagccagcgggtcggccttcgcccagcacgtgtccgacacggggctgaagccggtggtggtgtaccacaacctgacccccgcggagctgtacgagaaggcgctggcgcacgagccgtcgacccacatcgtggccagcggcgcgctggccacgctgtccggcgcgaagaccgggcgcagccccaaggacaagcgcgtggtgcgcgaatctgagacctcggcgcacgtttggtggggcgagggcagccccaactacgagatggacgagcacacctttgtgctgaaccgcgagcgcgcggtggactacctcaacatgctggaccggctctacgtcttcgacggcttcgcgggctgggacccggccgcgcgccggaagatccgcgtcgtctgcggccgcccttaccacgcgctgttcatgcacaacatgctcatccggccgaccgaggaggagctggccaactttggcaagcccgacttcaccatctacaatgcggggggcttccccgccaaccgccacaccagctacatgacctcctccacctccgtggacatcaacttcaaggcgcgggagatggtcatcctgggcaccaactacgcagggtgcatgaagaagggtgagttagggccggggggaaaggacatacaactgattggctcatggagcgatgcagggcggggtcacctgcttgacattcgcaccgggcacttacccctgaacaatcttggtccctccgtgacacccgggctctga

SEQ ID NO: 3162 - DNA, 1110 bp, Chlorella protothecoides
atgggacactccagaagccggagcaggtctcctcgcaggacccataggtctcggagtcggtctgcggatcgctacaggcaccgctcaagcagggaaaaagactgtgatgaagaggcggataggcgtaagtatgctggatctacaccagcccagcaccagcaccagagcacaggtggcactgcggcgagcagtgatgcagagaagaaagcggctcgcctggccaagctccaggcgtggaagctgcagcaggcgggaggtgtatccagtgctcagcatccggcccctccagtgaccatggtggtgcaccaggcccaccccatttctcctcccactgccctgccattgcctgcccaaggcggcggtcagggagacgaggacgcggtggaccctctggatgccttcatggcagcagaggtacgggtagcaatacatcggttttctttccataagtctggtggctacttgccaacagatcctctggtcatatcatctgttgggttgcaacacgaccagcgcaaactgtacctgcaggtactcccggaggtcgctgcacgtgaagctgaggagaaaaagcgtgccgaagatgagcgtgccaagctgaaagaactcttggcgaagggcaagctgccaaaggcactggaagagttgatccaggacgatcaggaggagactcctgatgagatcatcgaggcaagtggtcggctatggtcaggacttcagtgcgagggtgtgttgcatgcaatgtgcttcataccctccaacaaagtgaagctggtggtcggcccggcaggagagaagatcaaattcatccagcgaaagagcaagtgccgcatccaacacgcaaaggaagaacaggaactggaagttggcttcggcttgggacctctgtacaatctccccatcaagaccaatgaccccaatgcacctcccaagatgaccaagctcctcttatttggtgattccaccgcggtggaggctgcgagagtgctgatcatggaggccatcgacaaccgggaacagaaagtcaagcagcgccaaaaggaatacgataagaagaaggacgtgagttgtgttcttgagttcccttccgtacgcagggatccttgctga

SEQ ID NO: 3163 - DNA, 279 bp, Chlorella protothecoides
atgctgtccgctcgatatctgctccaacaggcaaagaggctgcagcggcaactgtaccacatgaggcatgcccttgactatgagacgctgggcctcccactgggagcatccaaagctgactgcaaagccgcctatcgcaagctggccctgcagtggcatcccgacaagaacatggaccggcgagaagaggcagagaagatgttccagaacatctccaaggcctacgaatcactcatgtccactgacgaggatgccaccatccaacaacttgcacattga

SEQ ID NO: 3164 - DNA, 1200 bp, Chlorella protothecoides
atgggtggcacctgcggtcagaaggaggaggagcctgctgagccagtcgccaagccgctgagcaagtcgcagaagcgcaaggcccggcgcgtgcaggaggagaaggagcgccgcagcgcgcgtgacaacgtgctgcaatccctctcccagaccgccctggacccggagacgctgcaggccctgcggcccctcgctgcacgcggccagaaggagaccaggaaggaggtgtcggcgcgcaggcaggccctgcgcgccgcaggtcaccacgtggaggacgacgacgtccccaccccgcggcacaaccccaactcggaatcggaggacggcagcagcgacgacagcagcagcgaggaggaggcgacaccccggccctccagcgcccccgcgcgcacgcagtttgcgccgcgccggtgggacgagccccagtctcctcaggaagaggcgcagccggccctcaagaaggcccgcacaggtggtgaggagtccgggagtgacaccgctccccacccgctcctggcccaggcgctggcgcaggccaggcagcagctgggcctgggcgacgggctgggcggtgctgacgaggaggaggggcccgcgcgcctggcgcccagcgtgccccgcgagaaccttccccacccccgctcagtctcggttgagcgcaggcccgagatccaggctgccagagagggcctgcccatcctgggcatggagcaggagatcatggagctgctggccgagcacgacgtggtcgtgctctccggggagacggggtgtggcaagaccacccaggtgggcgaggacggtggcaggatcatgatgggggttgttgtgcgccgaggtggccatcaccttccacgctgtcctgctgcagggaacgttttccaatgcaatgtatgggtcccgaagcagtgcatatgtcctgtcgcgttcatcctctattgcatcaaggcccattaccgcatgcctctcacccatcccccttggcaacaggtgccccagtttctgctcgaggccggcttcggctgctcccgcttcccggaacgggctggcacggtcgggatcacccagccccggcgtattggcgccatctccacagcagagcgcgtcgcggacgagctgggcagccgactgggggacgtggttgggtaccaggtgagtggagggcggtggggtttgctgctggtgcaaggggcctcatga

SEQ ID NO: 3165 - DNA, 756 bp, Chlorella protothecoides
atgcactcgcagcagcagcaaggccctggtggggttccggtgtggcctctgaagctggtgatcatgagcgccaccctgagggtggaggactttgtcggaaaccagcgcctgttcccgcgcccgccgcccctgatcaccgtgccggcgaggcagtaccctgtgacggtgcacttcagccgtcgaacggagatgaacgactacgtgggtgcagcgcatcgcaaggccgaggtcaagcagctgtgcaagcagctcgagaccaccttcaaggcccaaagacgaaaccagccggcgttgccagcctctgcgccgccggaggaggccggcgacatcgtgtctggaggcgatgcggcagaggaagggtttggcgcggatgccatcgacttcctggatgccgagctcgagagcaccttcaagggccgaaggcgaaaccagccggcgtcgccagcctctgcgccgccggaggaggccggcgacgttgtgtccggaggcgacgcggcagaggaagggtttggcgcagatgccatcgacttcctagatgccgaggcagaggacctggacgactttgacgatggagaagcttcggcaaaaacctcattcccatctcccctgcctctcatagatgaagaggaggaggaggaagtcgatgtcatgggtggagcgggcttcacgccggagcagatagccctggctgaagccgagttcgaaaagagactggtgagcgaggatgggggcggtctgcgctccctgccatcctga

SEQ ID NO: 3166 - DNA, 738 bp, Chlorella protothecoides
atgggcgacgtccctagcctggcactgatatgggagcagactgctcccaatcccacctcgcgagcagagatagaatcatgcaaccccaggacaccattcggcactgtgcagctggatcgcctccccgacgtggagcagatcctgctcctggctgatgagttcaagatcgacgagctggaggcactgaacctgattcagcgcggctatgagcaggtcggggaggtgtcggcggcagcaggtgctgggcagcttgttgaggcccgctccagtgccattcagacactctttgctgtactggaggctctttccacaggcaccccgcccccttcctgggtccctgccgcggacattgactatgtgcgggaacgactggatcggggccagccttgtcaggacctggcggccctgctgttgcagcgcctggcctccccagccattccagccccagcagatgggtctcgtctggtctcactggtcaacagcgccggccaggccgcagagcggtccctcgcagccgcgcaggaggatctgctcctctgccagtgcctgagcctgaccctgactctgctgtccagccaggccgaaccgcccgccaaacacctccctcagctcctccagctactcagaggtgatgggggagggatgggagccgggaaggacaatgcgcagggatgggaggtggccgggttggccgggcggacttggtgtggacctagcgttgcacagagcccggactga

SEQ ID NO: 3167 - DNA, 489 bp, Chlorella protothecoides
atgcacctgccccaccttcccccttcccccctttccacccaacccctgcaggtgtggggccacagcgtgagcgaggatctcatccactggcgccagctgccgcccgcgctggtgcccacgcccggcggcctcgacgccgacggctgcttttccggctgctgcgtcctggacccggcctccggcctccccgccctgctctacaccggcgtgcgcctgcgctccaatgctgcctcaggcccgcccccaccccccgagcacgacctgggcctggtgtggattgagtcccagatcgtggcggtgccggccgaccccgccgacgacctgctggtggagtgggtgaagcatgagcgccccttcctggacctgccgccaaaccacgtgcagctgacagggtggcgtgaccccttcatctacaccgccaacaccgccggcgtcctgggtgggtgggtgggggtgtttactgagggaagggtcgggggtgctttctga

SEQ ID NO: 3168 - DNA, 2268 bp, Chlorella protothecoides
atgcgtcctccaaccaccgcgcctccgcgaggacctgatggtacccggcgcccacccacctcttgccaagccccacctgccgcctcggcggcgctgcgtgcagagatgcgggccaaccacgcggagggccacgtgtgctgggacgaccgcgacctcatgcacggcaagccgacgggggcggtgcgggcgtcgctgggctacgcctcgcgcgcttcggacgtggaccgcatcggtgtgtggctcgcggcgccgctgggagcaggggctgcccagggctgcgccgtgttaacgaactcgagggcctcgtcccgtcctcgtcatccttgcatggcgcatgcgacgctgcaggatgccagccctgatgcaggcgccatccacggcacggcgacgccccccacgcccctccccctgcacgcagtgcacttcctggaggagtttttcgtggaaaaggctgaggcgccagagtccccgcggcccgcgtccacggcgccccgatcctcggccctcgtcgtgacggcgctgacgctgtaccccgtcaagtcctgccggggcatccctgccaccgagtggccgctggcacctccacaccccagtgcacagacactcacgtcccctccacgccgcacaccgccaggaccctccggcctgctgcacgatcgggcctgggtcgtcctggatggcgctggcaagcccctgtcccccaagcggtgccccggcctcctctccatccagccgcgcctcgactggaggcggggggcgctggtcctggagtgggtgggaggggtggctcagatgcccggcctggccaggctctcgccggagatgcccctcgggcctggcgctgcaggcgcggggtcctgtcctgaagccgctgggccccaggcgcgcagcgagaccctcgccgcctggctcagcgccaccctgcgacagcctgcgcggctggaggcgagcgtggccaggcggcgacccgcctccaagccgcagagtcgggtccctgaggaggggccgagggccgcagctggagcgaaggcagccggcgcagagaccgagggcgccaccctcgggggttcgggaggcgcacgcagcatcatcactcttggcccgcattccctgcacagcagcgccactcccaacacatcacctgctgacggcaggcagggcatggccgccctgccgactcgcttcgccaccagcggggacctcctcctggtcacgcgggccagcctggagctcctgagcgagcacgctgtgcacgctgtggacctgatcagacccaccgcccgggctggccgcggaggcgtccctgcatgcccaacacccatgggggaatcattcgcagcccgcttccgcccaaacatcgtggtcgacggaccggcggggggggtgcccttcgcagaggacagctggaccgagatcagggcgggggagttgggtctgcgggtcgcaggcgcctgcccacgctgcgaccgcatctgtgtggaccccggggatggcaggtggggcccgggtctatgcatggcatcgccctggctcatctgctgccacagaccaggcatcgccctgcatggctgtccaatgttttctgtcttttgtgaaacccaccatgcaggtgggtggggccggaacccctgctcagccttgcaaagctgcgtcgccgcaggggcaaggtctgctttggcatccttttggatgtgcagcagcccttgctgccagtcgatgcccccgccaacacccctgctctgccgctgctgcgtgtcggcatggcgctggagtgcctggtgtaagcacacactgaacgatgtgcacttcccatgctccgagatcctggggggggcaagatgccaactgtgtacttacatctcgagggcaagagcgattggaacagagagtgtcctgtgggaatgtgccacaagttggcccactgatgacttggaaaaggggtgggcgcaaatgctactgtatcgcgctgctcaaagggttcagcccctagggtgggcatggaagatgcctggcccgggatacttgggaataacaagtgagtacaagagagtcaccacacaggggcgatggcaagacccagtccggaaacgggtggggcaagctgtatatggcggggcaaagctccagacaggttttaagaagcaggatcggtggctacctacatcgcggctgtggcaggggcagccggaggcggaacaggcacacgtgcagaggggggttgaacgagccggtgggcccgtacatcgaaacaatggaagcgcgctctaa

SEQ ID NO: 3169 - DNA, 582 bp, Chlorella protothecoides
atgaccgaggccctgcgcgtgcgcttgctgcagcgcgtgacggcctacggctccggctccgcgctgcgcacgctggcgctggcctgccggccctggcgcgaggcgcgtggcgaggtgctggccggggacgaggcggggctgaccttcctgggcctggcggggatgcaagacccgccgcgccccgccgtggcgcgcgccgtggcggcctgcgcggccgccggcatccgtgtggtcatggtcacgggcgacaacaaggccaccgccggctccgtggccgcccagatcgggctgctggggccgggggaggcggagggcggaccctcgaccgggaccagcctggcggggctggagttcgacgagctgagcggggaggaacgcgagcgcgccgccgccagcctggtggtgtttgcgcgcgtggaacccaaccacaagaccgcactggtggacctgctcagggcacaggcgagtgagagtgacggggtgtttggggctggagggggagttgaggaccacactatgcagtggggggaggaggctgggggcagaaataaagggggcccccagcagatgccagggcggtga

SEQ ID NO: 3170 - DNA, 333 bp, Chlorella protothecoides
atgccactgcagtccatcttgacgggggagtcgggaagcgttcccaagtctgtcgagcccgtggctgcagggaaggccgtctaccaggacaagaccaacatcctgttttctgtgcgtgggtgcagggacggcttgggcttcgggctggggctggtggatggttgggtgggcaccgtcgtcaccgcaggcaggtgccagggcattgtcacgggaacgggcgcggccaccgccatcggcaagatccgcgacgccatggcgggactggaggatgcagagacgccgctgcgcaagaagctggacgagctgggctccctgctcagcaaggtttgttaa

SEQ ID NO: 3171 - DNA, 456 bp, Chlorella protothecoides
atggcgtctgaggcaggagcgcagctgtacgcgtcggatttgcacttcgtgaaacatgtgaagttccctcccatcccactcggcacagccacggtgggagtgttgacggagaccaatgctgacagggccatagaggagctcaaggcctacgaggccgacgtggcgaccgtgctgcgggaggggcgctggactgtgaccccggcggtcgagatcgtgccgggggacatcgtcgaggtggcagtggggggcaaggtgccggccgatgtgcgcgtggccgccatcctttcctctggcctccgcatcgaccaggtgagggttcctttcacctctgcatgggcacagctgcacgctgtgttgggggatttgggagtgggactctcccataggaatgaacggccagacaccctctgctgcggcacaaggaggcccactgtgtggcgacgccctcccctttag

SEQ ID NO: 3172 - DNA, 792 bp, Chlorella protothecoides
  modified_base (500)..(509): a, c, t, g, unknown or other
  modified_base (724)..(733): a, c, t, g, unknown or other
atgcgcggcatcaacgacgccatgtggaagtttacagatgactttgtcgtcgcctacctggacgacatcctagtctactcccgggacatggagacccatctgatccacctgcgcgcggtgctggacacgttgcaagacaaccgcctctacgccaaccccaggaagtgcgtcttcgcccagcccagcgtcagcttcctgggccacgtcatcagcgccgacggcatccggatggaggaggataagctgcaggctgtccgcgagtggcccgctccgtccaacgtgagagagctgcgtggcttcttgggcctaacaaattattaccgccgcttcgtcaaacgatacgcgcacctggcgcaccccctgaccgagctgctcaaggacaacgccccttggaactggggcaagctggagcaggaggcctttgcagggctgcgcgactgcttgctgtccgcgcccattgtcgcctgcccagacttctcaagggacttcaccatcatgtnnnnnnnnnnactgcgcgactgtttgctgtccgtgcccattgtcgcctgttcagacttctcaagggacttcaccatcatgtgcgatgcctccgactacgccatcggcgccatgctctgccaacatgacgacgcaggcaacctgagggtcatcgcctacgagtcctggaagctgcggccggcggagtgcaactatcccgcgcacgagaaggaactgctgggcatgnnnnnnnnnncgcctccgactacgccatcggcgccgtgctctgccaacatgacgacgcgggcaacctga

SEQ ID NO: 3173 - DNA, 1938 bp, Chlorella protothecoides
  modified_base (458)..(467): a, c, t, g, unknown or other
  modified_base (725)..(734): a, c, t, g, unknown or other
atgatctacgccctagcaaagtggaagcactatgtgcttggcggcaaggtaaacgtgaagaccgacaaccgcgccctgcaattcctgcagagccaccagcagctgtccagccgccaggcccgctggcttgacttcatcgccgagcttgatctacacatcgaccacatccccggcaccagcaacggcgtagcagatgccctgagccgacatccgctgcgcgtggccggcactcgcctcgtcctcacatcagagcccatgcgcgaccggctgcgccgagccgccgccgaagacgcggccgtcgctgagctcaacgcaaccctggacggagggcccgtcgacggctacagcaagcgggacggtctcgtgtacaagcaccaccccaagggtgaccggctcctcatcccggcagattccacactccgacgacagttgctgcaggaggtgcaccacagcgtggnnnnnnnnnntaccaccccaagggttaccggctcctcatcccggcagatctcacactccaacaatagttgctgcaggaggtgcaccacagcgtgggccacggtggacagcgacgcaccctggcggccatgcaacgcacctacatctggcacggcatggacacagacatcaagctcttcgtctgcacctgcgacgcgtgtcagcggaacaagccgcgccagggcccaggcccggactgctgcagcccctgcctacgccagactaccctnnnnnnnnnngcgcacctacatctggcacggcatggacaaggacatcaagctctccgtccgtacctgcgacgcgtgtcagcgaaacaagccgcgccagggcatcaggcccggactactgcagcccctgcctacgccagtctacccttggcagcacatgaccctggacctcgtcactggcctcccgattatgccccgcggacacaacgccgtcgtcgtcttcgtggaccgctattccaaactggtgcactacgtgcccaccaccaagaccgtcaccgccagccagctcgcagaggtattcatcgaccgcgtctacaagcatcacggcctgcccagcgtcatcatcagcgaccgcgacccgcgcttcaatggcaaattttggagacaactgtttggcgccctgaagacagaactgcgcatgagcacggccaaccatcccgagacggacggtcaaactgagcgcgccaaccgcaccctggaagagatcctccgtggcctggtggacccctgtgagaccgactgggacatacaccttccggcggcggagtttgcggccaactccgccatcagcgccgccacgggggccagccccttccagacgttgtatggcttcacgccgccggcccccgcccagctggtctcccactacccagccgttctgggcgccactacggcaccggctcgcgccgcggaattccaagctacgcagacgcgcatgcgggagaccatggccaagtacaaccagcgcatggctgcacaagccaaccgctcgcgccaggaccacgaattcaaggtgggcgaccgcgtccttctcagcagcgcccacctccgcattgcgacccccaatagtcgcaagctggcggctcccttcgtcggacctttcaccatcctggacatgcgcaacaagggcgctgctcgcctggacctccccgccgacatgcgcgtcaacccggtggtcaacgtgagccacctcaaggcctacaactacaactcacacgggcgtcctccacccctgtacattgatggagacgaggagacgtacgaagtcgagagcattctggcccgcaagcctgctggccaagagcatcagtacctcttcaagtggcgcggctacccagaggacgaagctacctgggaaccgctccgcaacctggcccacctgcccatgttgcatgagttccttgcacagcagcacgaggacgtgcctgcttcttag

SEQ ID NO: 3174 - DNA, 2346 bp, Chlorella protothecoides
atgacgcagtcgaaggccaaggcgggctgtgacatcgactgcccttttaccccgggcgtaacatcgccgtttgactggcttgcccgcatcgaccgcaaaatgcggctcaagggcgtggtcgacgaggagacgcggctaaacatatatgtcgccaacctggacggcccggtcctctccttcgccactgccctcgtcgacggcgtcaacggcgcgctacccgcggtgaccacacccgcggagttcaaggagaagttcatggcgcatcacagccgcatacaaggccgccgacccgggcgcatcgagctgtaccagctccagcaggcgggcaccgtggcggagtacgcccaggagcatcgggagacggcgtcctggattggggaccttacaccggaggacttccaggcgtccttcttcctcggcctgaagcccgacatcaagctgaaggacagcgtgcggttcgccgccaactacgaggagatgctggagagggctcagtggcaggagcagaaggccgcgctccgcgccgccgagaagagtgtcgccgcgcggaccctgccctcacggggcagcgggggcgcggacgcaactcgtgcgggccataccatgtcggccgcgtcctcgttccgcccgaggaactcccggccgtcccaatcgacgggacaaaggtcggcgactgcgccggtcacttgctacacctgtggcgctcccgggcacatcacccccaactgcccccagcgcgccgcctcctctacgtcatccgcagtgcggggtgcccgaggcggaggtgcgcgggagagcaaggaccacaccgcctctgtccgttttggtgtcgcactaacgggagccgcaccacttcaacaccaggcattgacgacggttgccaggataggcagggctgagctgacctgcctcatcgacagcggcgctgagcgctgcatcatggacgacaaagaggctgcgcgcctcgggctgaagctttcgcccgtgagaagacacctgctcctagcctgcggcgaccagcgcgtccgaggagatcgagaagcccgcgacgtggcggtagacatccgagggcatacctttacgctggacttcctcatcactcccctgactggcacggatgcttatctgggcatgccgtggctctgtaacgcaaacccggtcatccagtggggagcatgccagtggggatatgctcagcaggacgtccctccacgggtgggcactgagccccgcgtggcggacctggaggtccacgcggcagcacctggaggctacgccatcggaacggtcggccatcaaactggctacagcgcggcgggctgcccgggcctgcaaggacgacaacctctccctggtgttcgtgcgtgccatcacggtggaccaggcatcacggtggaccagacagaggagactagtggagccgaggttccccgcgttgcgcggtttgtcgaggagtatgccgacctcttcccagcagagcttccgacggagctgccgcccaagcgcggcatcgagcacaccatcgagctgaaggaggggactctacccatcgcacgcgcgccctacaggaccgcgccgccggcggcgcacgccgttcgggcgcaagtggaggagatgacgcggcaggggctgatccggccgtccacgtccccctgggcatcgccggtgctgctggtgggcaagaaggatgggtcgcagcgcatgtgcgtggactaccgagcgctcaacaagacgaccatcaagaatcgctacctgctgccgcgggctgacgacctgatggacagggttggcggcgcccgcgtcatctcgaagctggacctgcgcagcggataccaccaggtccgggacatccccaagaccgcgttcaccacacgccacgggctgtttgaatttgcggtgctgccctttggcctctgcagcgcacccgccaccttcatgcgcggcatcaacgacgccatgcgggactacaccgacaagtatgtcgtcgcttacctggacgacatcctggtctactcccccgacatggagacccatctgacgcacctgcgcgcggtgctggacgcgctgcaagacaaccgcctctacgccaaccccaagaagtgtgtcttcgcgcagcccagcgtcagcttcctggggcacgtcatcagcgccgacggcatccgcatggaggatgataagctgcgcgccgtccgggactggcctgcaccctgcaacgtcagggagctgcgcggcttcctgggcctgaccaattactaccgccgcttcatcagacactacgcgcgtttggcgcatctcctgaccgagctgctcaagaccgacgacaagctgcgcgcagtttgggactga

SEQ ID NO: 3175 - DNA, 201 bp, Chlorella protothecoides
atggccaagcttctccccgacacctccttcctggccaagtggaaggacaagattgaagcggtgttcatcactcatgggcacgaggaccacattggcgccctgccctgggtcatccccgccctggaccccaacacccccatctttgcccccggcttccccatgcgcctcgtggaaagaaggctcaaggtggggctgacttga

SEQ ID NO: 3176 - DNA, 360 bp, Chlorella protothecoides
atgcagacagtgcaccctctgcgtgcacctgcgccatttgtgtgtgatgcggggtacatcggaaagacccggaggcccaacctctgtgcgcgagccgagcaaacgggagggggaccacgccagcgtcgctccgggccctccactcgcgtgcggctgaggggcaacggcaccgatcacctgggatcctccctcaccctccccgggacgggggcgagtttcccgggcccaccaggcactgagggccccccgctgcgtgtgctccccatcggcggcctgggggagattggcatgaactgcatgctcattggcgtgggggaccgctacgtcctcctggatgctggcctcatgtttcccgagtga

SEQ ID NO: 3177 - DNA, 1188 bp, Chlorella protothecoides
atgcgctttgatcgcctcctcaacgagtctgatgtgcgaggtgggcggtcgtgtctgccacccttagcggcttcaggcctcagcggcattctccttcagcccatcgggtcctccaaactcacagcctcacactcacacccacaccccagggcgtccggctacccatcggtgcccgggatttggacccaggagcaggtggagggctggaagcccgtgaccgccgcagtgcaccagctgggctccaccttcttctgccagctgtggcacgtgggcagggcctctgcgccttgctaccagcccgacgggggccttcccctggccccctccgtgctccccatcccaccagagtgggagtactttgacacgaagctgggcaagccacagaagtaccccctgccgcgcgagctggccgccgaggagctgcccgggatcgtggagcagtaccgtgtggcggcccggaacgccattgccgctggtttcgacggcgtggagatccacgccgccaatggtgagcctgggtgtggggagcctggccttgcttcatccgtcagcttgaacccccctccacaccccaacccacccactccaggctacctgatccacgagttcctgagcgagagctccaaccaccgcaccgacgcctacggcggccccatcgagaatcgggcccggttggcactggagatcgtgcgagccgtggtggaggaggtgggcgccgagcgcaccggcatccgcttctcccccttcaacgagttcctgggcatgcacgacgcacacccctttgccctctacacctacctgctggaggagctggcggcctgggatctggcctacgtccacatggtcacccccatcgtgaaagggaacgtggaccacccggagggggagggctcgctggagcccttccgcgcggtctggaagggcaccttcctcgtcgccggcgggttcaagcgcgactccgcggtggcggcggtgcgtgaacaccacgctgacctcgtcaccgtgggtcgccacttcctagccaacccggacctgccccggcgctgggcactgaacgcgcccctgaacaagtacgatcgctccaccttctacacgcccggcgtgaagggctacctggactaccccttcctggaagacaccgaggaggggaaagagttcttggcaagcttgaagcccgaggccaattga

SEQ ID NO: 3178 - DNA, 690 bp, Chlorella protothecoides
atggcaaacgcccaagcatcagctcgccagggcagagtgactttccacgtcttgttgcagcaaggcacagagagtggcgaggctggggtggctggtcttccacactcgcgatccatcggatctgagcggggcagtgagcccgctccggagcagtatgtatatgctggccggggtcacaaggccgactacctcttcaaatcactgcccaaacctgacccgcctctaaaagtccaggactcaagtggcggggcgagtggccttaagtggagacaatcagctgctcaaagccccgatcgtctcaagggcgtacgcgtctactgcgcagcaacgagggtcgtcccccgcatcatggctcacacaatccccacccccacgtacgatgcttattcacttgtttctgtaggtaaagcacaccatttttgtagcctggcaatgaatagaaaaggtggcaccagcgtgtgcaagggagctgcaacgtgcgcctggcagaataggacccagtgggctagagtgtcgcagggcatgctcgacatgggcagctgcagatggcaatccaacccccaacccacacttctcactgtcagggccccggacaacatccccctcgacatccatgtggagtactacacgcaacgtgccaccaagggaggcctgcttatcagcgaaggcaccatcatcagcgacaggtga

SEQ ID NO: 3179 - DNA, 201 bp, Chlorella protothecoides
atgatcacagtctcgaaacctgggagtcgacactgccaggtgctccaacccgcggatgcgattgtgcccggccccttccacatcgacggcatcccatgcctcctcccaaccagggtctgcggtgataaatttgcagaagtcccctttgtggccaccagagaagggtacaggcgggcggggttatgcaaggtcctgatcaag

SEQ ID NO: 3180 - DNA, 1620 bp, Chlorella protothecoides
atgttgcctagaacgagagataccctgcatcttgagcaagcacacactcagtgcgccggcctcgagactcctagctttgaaaactcgcctccctctctcacagagagctactcatactcaaagctccctgataggcatccgaaatattcggctgcatgcgagcggctgagcaatgccccaatctcggtgtcgaggactacgagtcgccgtgttactttccaagaggagggtatccatcagtggaaggatgtcaacatgatggaaccagaattctactcatctgaatctgtctcggaatctgtaggtcagctgctttgttcctgcagttgggtgatgggtggagcgctcatctgcagggcgcgcgacgaccacccttcgtctgatactgctcaccactgtgacccaaagaggatgatggtcggcgacgatgccttctccgccgtgcgctctgcactggcgaatgtgtcagacagcagtccatgggacatccatcacatcgatatcacttgcgatgggaaacgaaagagacccagctcgagacctgggctcgacgcatacacgccacagacaaatatgccccccaaccaccactataggtataaatgcagcgtgtgcgaggaccgagacctgtgtcaaccctgctttcgtgccctggtggccgctcgagctcgttgcctggaggagacggggaactgcccacccagcacctccacaccgggtcgcacaacagccaagggcacctttattctcctctcaatcccccacacctctccctcctgcctccccttcccccctcagcactcgaggctcaccgactgggcacgctccctgcatgccgcctccgggcctgccgagcgctgggcggagctggcagctgcagtcccttgtctggacccctcgcacgtcctggccgcggtcacagcgggggcagagcgtgccgtggtcctccgtctttcgcccggtgccggcgctgaccaccccgacctcgcgcgcttcctggacgccttccccccctcacgcgcgtcctgcgccgacgtggcttggatcgggctggaggcagcggcggacgccccggccccggccacaccgaggcccgggcccggtgccgggccgcagcggccggagcgccgggtggaggcggccgtgtctgcgtgggagtccctggccgctcggcggccgcccacccacgcggacgcggccgtgctggcggtgcgcttcgacctgcgccgcggcaagtggatgctcttccccagcgcggggcgggaggccgacgccgcgtggcgggcggtggcggccgcggcggccaccggccggctaggcgacgaggtgaagatcagcggggtggcccccgcccgcgccgaccacgtgctctgcgtgtacacccgcgactacctggacgagggcgacgtggggcgtgtgcgcgatgcgctgtgcgcgctgggcctgcgcctgcgccgccggcgcatgttgtacaagccggacatccacacccacctccagctgtacagccgggggcagggcagcctgaggcccagtgtgtatgaggccgagctgccagccgcccgtactgcagcgtggagaagggaggggagggccgcccaggctgatgtccctcgatga

SEQ ID NO: 3181 - DNA, 1080 bp, Chlorella protothecoides
atgcgcgatgccgagggagcccagccgctcagccctagggtgctgggcgaggatcgggcgacccgatcctacatcctggcccccgagaccagctgccccgacgtccccgccttgctggaggtgtcctccgagccaggcagtcccctcgcacgttgcaacagcgagccggagctggcagacctggggcaccccttcctgacggccgccgcactgccaggcttggcccgcacgcacacggaggtgggctccaggatggccagcctggcgaccggcgaggcgcggcccacctccctgcccccgccccgccccacctccgcgcagtcgccccgccccgcgcccagccaaccccccgagccgccggaggtcaggctgccgaccgccaacacccgacccccctccgcctccacggcgttctgggcctacgtggggtcggagctgcggcccgccagcgcacagggcctgccggacgacgtctggggtcagacggagcgggacagagtgtacaatgccatcctggcggtgccgtaccagctcgagcgcttccagatggcaggcgtgctggtgtgcctggactccttcctttccatcttcaccctggtccccctgcgcctggccctggccctcggcgcgggggtgcggcgatccgtcgggaaccggcgtggcagagaggctgaggcaaccgcgcgcaggcaccgcggggctggggtggcgccgcttggcgctgggtcacaggggctcggtgtccggccatccaagtccaagcaggccccgcacggcgacaagcccccccaggccccccaccggccgcagccgctcaccgggccccagctctacgacctgctgctgctgggcatgtttgggtgcatgatggctttcatcaccagcctgaacgtgggctccatctactactggctcaaggacctcacccacgagttcctcaagctctccgtcctctacaccgccctggagctcagcgacaaggtgctctgcgcgctggccggggtgcctggtctttcttctgctcaccaatcaggcccctggacactatgtacctggctccctccacttgatgcacattag

SEQ ID NO: 3182 - DNA, 1515 bp, Chlorella protothecoides
  modified_base (946)..(955): a, c, t, g, unknown or other
atggacaacaggaatgggagagctcgctgccaagtggcagcttcagaggctgtgttgcctctggacgcaaggaccacatggtggtgtaatcttgcatcatgcctgcttcctttgtgtgattcatccagtcttggccaccccactcccccaggcgcattctacatgcggctcgtcggccgtcctgtcgacgtatatcagtatctggaacccctgtacaacgacttccggaaggtccgggtccgagagtccaagggcgcctttgcgctaagctatgtcgaccaggggcgtcctgggcaaggagctgcgctgcagcagactactgacttctaccttgagccgagcctttccacttgccatgccatacccatcgcactcccatggcaggtcatcgacgacatgctcacccgcgactactgcttcgacatcgcgctgcctcgtcttccggctcgcaaggtcctagaggaggcggggcagctgcagccccgggtctcggtgctggacgaggagtttgatgagcaggccctggcggtgagccatggggataggcagagagtgggggaaagggcgcgcgggcgcgagcggagtgtggagggatgggaaaccaaaatgagtacagctacagattgccactggtttcaaccacgctatcatatgcaagtaggagggcagagtagcttcagatgctcccttgctggtccaacgttgcaggaggagcaggcggaggcggcagccgctgccacgtccgccgcagctgcactgaagctgcaggaaagcgcggctttagagaccgccacgcccacagagcctgccgcgcctgcagatgcggtcagagcacgggatggcgaggcttccatcggcccggccgctggtggagagcagcggcgcgatcgtccgcgggaccctagcccttggcggcttagtaagaaagaaaggagggccgatagannnnnnnnnntccgcgggaccctagcccttggcggcttagcaagaaagaaaggaaggctgatagggagaggaggaggagccggacgcgcagccccagccgcgataggcgcaggcgggacgaccacagtcccagccgggagggacggggagggccctggggagcccgcgaggctcgggggaggagtaggtcccctcgcagcaggcacagcgtggatcaggggcgacgagagcggcgtgggagggacagtcgatcatgctccccggctccccggagtcgtagcaggtgaggatgctgacgtcgtggagggcgaggctggattggtgaagaaattgatgagaagcaggagccctcatcgcgaggatgcctgccatgccctgatgccatgctcaggcctgctctccgcatcaccagggacaggcacagggagcgtcataggagggagcgcaggagccccgaccccagagacaccaggtatggggatggtggagtcgggtgccgtgcacatgcctggcgatgtgaccctctcgccacactctttgcccagcccgccggtcctgatgggccactga

SEQ ID NO: 3183 - DNA, 294 bp, Chlorella protothecoides
atgtacgttgtcaggctcagtgatgcttttgagctctggaatgctgctgcgccatgcagggttcaaaatgctcaagggtatgcactccccctgcaggctggtgggatgtacggcgagccgcagcggccttcagagttcctctgcctcatcctgaagatgctccagatccagcccgacaaggacatcatcgtggagttcatcaaggatgatgccttcaagtacctgcgactcctgggtgaggaagggaggcccaagaggcgcagagccgggttgctgccattgttggtggtttga

SEQ ID NO: 3184 - DNA, 1170 bp, Chlorella protothecoides
  modified_base (481)..(534): a, c, t, g, unknown or other
  modified_base (600)..(609): a, c, t, g, unknown or other
atgttaacagcaagtcacaggaatgtttcatgtgcccttggtcggccgagtgccaggcgctctaggaccatgaggacagcagcatccatgcgggatgtggcgggtggctggatagaggagcacatggcgaagggccatgtgaccggctggagatccctgggaggcagcgggtggagcagtgccatgcaggccacaacatcgcagggcgccaaatattttgtcaagaccagtggtagcaatgcagcggaaatgtttcagggcgaggccttgggtctccaggctatgtatggggcacatcacccctcatgggaatcatgttgcccatcgcaaaccctctcatccccaatgcctgcagccacgaaaactctgcgtgtccctgccgtccatcactggggtgatggaccagaggcaatgggcagctttatcatcatggaattcatcgaaagggctgggcctgtggatcagggacagctgggtgtcnnnnnnnnnnnnnnnnnnnnnnnnnnnnnnnnnnnnnnnnnnnnnnnnnnnnnnaatacgggtgctgggaagccatgcattgcacagatcacatccctgggaccgtcaaggccgcaagannnnnnnnnnaatctggccgccatgcacgaagccacccccatggacgagaaagccgcagcagggttctttgggtttgcggtggacaacagcatagggggaaccccgcagcgcaacacttggactcaaagttggccggagttcttcagagagcaccgcttgcggccacagttggaggccagtggcagcgcagagctgcagcgaatggcagagcccctgctggagtccctggacaggctctttgccggggtcacgccacgccctgctctcctgcacggcgacctctggtcaggcaacgttgccgggtccagggaggggcccgtggtgtttgacccggcgacgtactacggccatgcagaggcggagtttgggatggtctggtgttcgggctttggcagggacttctgggagggctaccatgccgtcctgcctcgtgaccctggctgggagggacgacaggagctctacacgctctaccacaagctggtgagtgatcaggcatgcgtgacgggtgggcggtgtcctgctgatggcatgggcactgcactgaaaatggggaagaagaggtgttga

SEQ ID NO: 3185 - DNA, 606 bp, Chlorella protothecoides
atgcacatcagatcacactccagacctcccccaccccaccccgaaactctcaagatatgttgctcctttggcgtggatgtgttggaggccctggccgccagctgcacgcgcgccgtggcgggcccggtgcgcgcgcccggcgccgccctggcgctggccgccgacgtggtggtgaccctggcgctgctgctgacgcactgcggcgtgctgctgggccaggccatggtcttctccgtggcgctgaacagcaagaagaacgcgctggtgggcctgctcatcgctgccaactttggcgagatcaaggaccgcgagccgcccaggaaaccgtttgcacctccgaacccctcagtccgcacccaccgagcaggcaccgtgttcaagcgcttcgacgccggcaagctgtacaacctgacctgccaggacgtggtggagcgcttccacctcatcctcatcctcgcctttgtggtggtggaggagatggggaacagcgggcacgccgcgcccaatgcggggctgctggcgcagtgcgccgagatcttcgcggccgaggccgccattgacgtggtcaagcacgccgtgctgggcaagtttaacgagatcaggtag

SEQ ID NO: 3186 - DNA, 291 bp, Chlorella protothecoides
atgcatgcccctccatcgcgtcatcaccgacgcttcccttcaaaaccccaattccaggtggggtgtgacgggggcgccgagcacccgttgctgaggccctggtggcgaggacgccggggactgacccgggaggagtgtgtcgcactgtttgatcgggggggcggggtggaggaagtcggcgccctggagctcgagggtgccgaggaagaggacgactggggggcgggacaggactgggatcaggaaggcggggaggggacctcgcctgggggaggcacgcagggcacatga

SEQ ID NO: 3187 - DNA, 423 bp, Chlorella protothecoides
atgggggctgggggaagggggtggacgctgcgcgtgaccaatcttggtggggcgcagggagctgcactgctcttcttccaactgactctgccccaaggtcaattccttccctccctccctcccccatcagccgtgcgtgaggctgtggaggaagtgggcgtcctgccgcccttcaccatctcgggcgagatcaagacggtgcggggcaagcggggacagaagcacttcactgttttcatcgccactctgctgcccgaggatcgccaggcgtggacgccggtgctcaaccacgagcacagcgagttccagtggtaccccgtgcctgggctgtgcgccggcaccctacccctgcaccccgtggtggacaaactcttcaggcagggggagctcccactcggcctggtgggcgtcgccccgccctga

SEQ ID NO: 3188 - DNA, 822 bp, Chlorella protothecoides
ggcgggggtgctgccgccggctcgggagcccccaccagcagcacccctctgaccaccgcccggcgctccgccttccagctcagcacggtggccagccgcttccggaagcagctggcggtgctgatgggcacgctggacgcgtgccacccgcactacatccgctgcatcaagcccaacccggggagcgtgcccgggacgctggccgcggggtacgtgctggagcagctgcgggcggggggcgtgctggaggcggtgcgcatcgcctgcgcggggtttcccacgcgcaaggccttcctgcccttcgcgcagcgctatgcgctcacgctgcccgacggctggcgcgagcgcctggagctgcccctcaccccgcgcggcttcgtggactgcacatgctccctggggttcccagccccacccacctgcaccccactcctctacatatcaacaacacatctccaggtggtggcggtggtgcgacgcatcctggccacctccggcatggagggctggcagctgggccgtactcgcgtcttcctgcgcgccggtcagctggcgcagctggaggtgtcgcactgctggagatcaaacaacagagggagcgcagggtgtctgagagggattcgagaggcctcacgtggcagtggtgggaatcactgtggcggcgcgacagatcgcctccagcatgtcgccccccccaaacacacacacacacctctctcaaagggcgcgcgcgggcggcggctggcggggtcggcgctgcgcatccagtcggcctttcggggcatggccgcgcgtggcgagctgcgccgcgcgcgcgccgcc

SEQ ID NO: 3189 - DNA, 288 bp, Chlorella protothecoides
atggccatgcttgtggaggctcccgccgccgtggatgacgcgctggcctccctgctggaccacccggacccccgccgcgcgctgagcacgtacatcaagcgcatctatttcccttccatgctgcacgagcccgagctgacgggcctgggcgctcgcgggtcgctggccgcggtctgggcgcatgcctgtgcggttcccggcgcggccgccggcccgcgcgccgagcgtcacggcgcggcgctggtggtccccggcctggccgacctggccgaggcgctggccgaggcg

SEQ ID NO: 3190 - DNA, 1620 bp, Chlorella protothecoides
  modified_base (404)..(413): a, c, t, g, unknown or other
cctggacccggcccggcgccggcacatgaggaccgtgcgcgccgaggcctcggccgtgctgcgcgcgctgtgcgaggccgcacggggctccgggcgagtgctgcgcgagctggatccccaggcattctcgttgacggtcgagggcgcgagcgtgggcggggactttgcggaactggtgtcggccatgtgggcggccctggacgggctgtgatggagtgttttttgtgcccggccggcgacagttctggaccggcgccgaccaggctgccgcacctggtctcctcgcagccgggcggcatgcaccgctggagtgcttggcacccaccactggtgctgctgcaacatggagcccaggacacagaggagggcatccaatgctccagaggctcaaccagaggtgaccnnnnnnnnnngacccaccattggtgctgctgcaacatggaacccaggacacagaggagggcatccaatgccccggaggctcacccagagggacgggctccgttcccctctgttgaggtgccggacaggaagcctgccacccgaatgccacgcacacacattggagacccacaccatgctctggccgaatccctgctagggtcacccataagccctgctcagctgtcttccaggctgcagcgggccatcagcccccagctctgcgagcatctgaccaggaagggctgggcggtggccgacggggtgttcggcagtgacgtgacctcagccttgcggaccgagcttgcgtccctggcgccctccatgcagcacaacagcacggttcttgtgcatcccgggtcggggaccagcctcctccccaagctggccatcaatgaagccgagctccgagacccggccacatgcgccgccgctcccttgtgctcggcgctgcaggaggacgccaccctccgggtcatgctgtcgctcttcctccccggtttgcgcctcgagtcccaggccatcaaggcacagcacaacacggggggctgcttccccatccacactgacagcgactttggggtggacgggcggtgcattactgcgatcgcatacctgaaccctgggtggcaaccctggcagggaggggagctgaggctctacccctggccctcggaggcggtggacatcgcacccctggacgacaggctgggcctgttcagctccaagaccatgctgcacaggtgcagctgggggctggcgagtggaaggagtggggtgagaggatttgttgctctgggactcacactttcagcctgccacacggagcttggaggtcagcaagggctctctcttgggtgcgaactccatcatcacaacgtctgctcccacttctggcaccccctccagggtcttgccatcacgggcagcagaccgctactgcttcaccatgtggctgtcagaggggcggagccaggcccgacccccgaccccactccagcccgaggtggggacgagcgaggaggcatggaggcgcctcgtccacccatcgctgaggaagcacgcggcacggtggtggctgagggacgagtgggccgccagcctggagcaggcgcacccaccctcccctgcccgcgatgccttgctggaggggttctggggggaagtgggcattattga

SEQ ID NO: 3191 - DNA, 3408 bp, Chlorella protothecoides
  modified_base (474)..(483): a, c, t, g, unknown or other
  modified_base (661)..(670): a, c, t, g, unknown or other
  modified_base (740)..(749): a, c, t, g, unknown or other
  modified_base (1036)..(1045): a, c, t, g, unknown or other
  modified_base (1177)..(1186): a, c, t, g, unknown or other
  modified_base (1448)..(1457): a, c, t, g, unknown or other
  modified_base (1595)..(1604): a, c, t, g, unknown or other
  modified_base (2095)..(2104): a, c, t, g, unknown or other
  modified_base (2453)..(2462): a, c, t, g, unknown or other
  modified_base (2890)..(2899): a, c, t, g, unknown or other
atgagctcgacaccctcctccgccgagaggaaaggcatgacgactgtcgcacaggcgtccacgacggggccggagccggcagccgaggacgagaatgcgacctacaagtcggacgcctttcgcatgcagtgtatgaaggcgacgtgcgcggtggcgttaacacagcctccctctgctcctgtccccccccaccaggtgctgccatgttccaagcggtacgtgcacgactggacggagtgcccttttgcgcacccgcaagaaaaggctcgacgccgggacccgcgggtattctcgtacacaggcatagcctgccctaacatgaagaaggtgggcctgccggatgtgatctctgttctatttgggctcgacctgcagcatgtggtccttgttctgtgtctgcctcacttgagttgcctaatgcacgtccctgtggcatcagctgacctacccactggcctgtgccagcggctgctnnnnnnnnnntacaggcatagcctgccccaacatgaagaaggtgggcctgttgggtgtgatctctgttctatttgggctcgacctgcagcaggtgctccttgttctgtgtctgacacgcttgagttgcccaatgcacgtccctgtggcatcagctggcctacccactggcctgtgccagcggctgctnnnnnnnnnncgtgcatgttcctcctttccaacctcccccccccccttcccgtccatcgcaggacgggcagtgccccatnnnnnnnnnncggggcaaggggtcccggctcccatgcctgtcctttgcagcccgctagcagcgctgccccgccacctggcccccgcactgtgcatgttcctcctttccaacctctcagcccccccctttccgtccatcgcaggacgggcactgtgcaacgatggcgggagctgccggcgcaagatctgcttcttcgctcactccctggacgagctgcgcgtgccggccgtgaagcccttcgtctcgcccgaggcgttggccgccgccgcctccgcggccgggccgggcgacagccgnnnnnnnnnnacagcaggccggccgggccgggacgcccagggcggcgtcatggggaggcgaggaggcgggcggcggtgcgggcaggcaaccccgcgctgaccctgggctcgccgcggcgctgggcgcgctgcagggcagccnnnnnnnnnnacagcagcgggcgcccctccctggactccgccgccagcgtcgccagcggccagcaggcgggcggcagcgcgggccctgcgggcgcgcagtcgctgccgtcgctggtagccgtgctggacgccgcgcggggccagcaggccggccggggtgggacgcctagggcggcgtcatggggaggcgaggaggcgggcggcggcgcgggcaggcaaccccgcgctgaccccgggctctccgcggcgctgggcgcgctgcagggcagccnnnnnnnnnncaagggtttagattcgctgaaaggccgaccaaccgacgtgccaccgctcgcgtggcactgccagtgggtgagccacttcctcccaaaccttgctgactcccatgcgcaccatcacgatggatcgcctggcccccgccnnnnnnnnnnacatgggggagagggggggggcgcgcgcgcgcgtgcgcaagggtttagtttcgctgcaaggccgaccaaccgacgtgccactgctcccgtggcactgctagtgggagagccacttcctccccaaccttgctgcctcccatgcacaccatcacgatggtgcccgcctgttccaccccccacctccacccaaacgaatcctgcacaggcccgcggcgtggttgaagtggtggcgtcactcctggcgcaggatcgcctggcccccgcccaggcctccatcatcctgcagcagatgctgccctcatcaacgctggagctgctgcacaacgcgctggcggccacaggcgcggcggccgtgcaggcgccggcctacgcgccgcgcgccgccagcctgggtagctaccaggctgcgcaggaggcgcaggcgcgggccgctgcgggcggcgccgcggagcaggcgcgaagatccatggaggactcgcgctatgccagcnnnnnnnnnntgctgggggcggcgcctcggagcaggcgcggagatccatggaggactcgcgctatgccagcctgctgcaggcctacaactccgtggagcgcgcctaccaggtgggtggaatgggcatggagaggggtggagggcagcagcagcagcagcagcagcagcaacaacaacaacagcagcagcggatgggtgagatatgatgctgggggagggtggtgcttgcccctccctcactggccatcttgtcaatgcggagctgacgcactctgggggtgtcgggacggatgtgtggacgcttgtgcttgccgtcgctgtgccaatgttgcagacttgcagcactgtccaccctgcgnnnnnnnnnngcagcagcagcgaatgggtgagatacgatgctgtgggagggggtgcttgcccctccctcgctggccgccttgtcaatgtggagctgacgaactctgggggtgtcgggacggacttgtggacggttgtgcctgccgtcgccgtgccaatcttgcagacttgcagcactgtccaccctgcgttgcgtgctcttgcccaaggtcaccccaccacggctccatgcccttgggccccccccctcccctcccctttgttcccagaatactccaccgcccacccctctctaacacacacacacacgcaccaccaccaccagggtacgcgccattcctgtaccagcagcagggctcagatgcggtgcccatggaccgtgactcctgggagtcatcacgcacctcttacgaccaggcgcgcgcgcgcatgagcctgnnnnnnnnnnaaatcacaccaccaccaccagggtacgcgccgttcctgtaccagcagcagggctcggatgcggtgcccatggaccgcgactcctgggagtcatcacgcacctcctacgaccaggcgcgcgcgcgcatgagcctggacgagctggacgtggtggggcagctgaactacggcgccgcgctgagcatgctgcagcagcagaacgcggccgccgcggccgcgctggctgccgcgcagtttggcggcggcggtgcgtccgtgccgccgctgtcgcccgtgccggagggctaccccattgtgacgcgcgagtcggaccccggcgcgtttgcaggcgcgcgtggcgatggcgtggagcgtctgagcgctgagatgcagggcctggacttcgggcccccggcgccgcagctggtcaatgcctttagctcatcgctgttttccgggcagaccgaggacttgcacaacaagggcagggacctcaagagggaggggaaagaagagaggggtatgacatag

SEQ ID NO: 3192 - DNA, 741 bp, Chlorella protothecoides
atgggtggtggtcggcatggattggctccctggggcgccacttggtggagttgcggcaaggggactgcacacaggggcacgccccattctttcatcccctttgcgcccctaccggcaagctggtgcctgccacattacccgcctgcttgccacaaaccagctgcatgcatgtcctggttaagcccaaaaacgccacacctcaatggcggggcacaggaaggtggacgcgatcagtgccattgcatggaagagcgccgccgtccagacggcgcaccccagcaggaccaggggccatgcgctgcgaggcgagcacaggacccactcctggtgcctggagtgccggcacccacccggacatggatggccagaggggccggggccgcacctgcagaagggacacagggtagcctcgttttggggggcaggggtgcggagggggtgtgcatgaagatgtgggcgggtcatggtttaaacccggggtgtttgcacgctgctgtccacgccgtgtccaacacggacgctcatttggtatcgtcacctcctgggccctggctttcctgctggacagtgtcggcttgcggaggtcgccggggtgggaggagagggcgaggcagagggtatcccctggactacagggctcggcaactccggatgctggggcgtcgcgtgatgccaatattgccttcgcaaggagcgcaaggcacagcacgacgatgcctagcctgtggcggaagtgcatga

SEQ ID NO: 3193 - DNA, 1737 bp, Chlorella protothecoides
  modified_base (187)..(196): a, c, t, g, unknown or other
  modified_base (814)..(823): a, c, t, g, unknown or other
  modified_base (1131)..(1140): a, c, t, g, unknown or other
atgagcagcagtgacgatgagcagcctctggccgcccgtccaggtgcagcccggctgatccgcaagtccttggcgctggacactgcctttcggtccaccaggagtcctcgaggatctctgggaggccgtcggcgcagttctgcgcatggggtcacggtgcccggtgcggcaccccaccccccagctnnnnnnnnnnttcggtccaccaggagtcctcgaggatctccgggaggccgtcggcgcagttctgcgcagggggtcacggcgcccggtgcggcaccccaccccccagcaggcgatccgagggccgcagccatggatgcgtcgcaaggggaggttccaccccatcagcgcgctgattcagaccccacctcccaatgcgcggcggagcctgccgtgcccatcacccaggcctccttggacccctccacccaggcctcccaggagccaggcccctcctcctgccccagccccggcggtggcgccgccatccccgcccacctacccctcctcctccccgaccgcccgcccacaaacaagttcctgctggagctgggccccgtgaagggccgtgccggcaacctccgcgccaccgacctgtcgggcgactccggcgccattgggcggctgaacgcggtcggccccaaggacgagccccgcctccagatcgacctcaagggggtgctgtacgatgccggggtcgtggcctgccccatgacgctggccgtgctgaatgttggcagcgccgacgccaggctggagtgcctgttccaggagtgcatccagatgcgaggggacacggcgcagggaactnnnnnnnnnntgaatcatgaggggcagtgtgggtgtggatttgtgtgtgggtgtgatgggagaggggacaaggtgaagggaaccatgtctgcagtgccctgggggtcggcttcatgtggcagggttggccggtatcgtgtgggaatctcgtggcaagctgttcgtcgagcaggaagaggcatggagactggtgaggtggctgggacaagctccctgttcgaggacgaggacgggcatcatgccgctgggggtgcggccccggcggcaggagaggatccagcaggcggcaagctgccaggtggggagaagcctgctgtnnnnnnnnnncgaggacgggcatcatgccgctgggggtgcagccccagcggcaggagaggacccagcaggcggcaagcagccaggtggggagaagcctgctgcgtgggcgctacctttgtgcattttatctactgtagggacgcagagggcaacgagaaatacatgaattacaggcgggcctgccacgtggttcctcacaggtgttggatctgggtccaggaaaaacaagggacttggcctggcattgaccaagcagtccacttccaagctcaagcccaagcccaggacaaaaccacggagtacaaaggccaaaaaaccaaagggataagcgggcaggccgcggctgttgtaactgatggctacatatcaaggcagtgtgtaatgaaagctgtggatgcgtgggggcaggtggcaggactctgccactctaagaaaacttttggtaaaaatgcctccatgagtcttgggagcagccatggctgggcatgttcggcatgtgctgctgcacattcagtggtcggtttcctcttccagatccaccagcatctgcgaagggacagcagaggagacaccagtcttcataagcatggcagatccttatgctaa

SEQ ID NO: 3194 - DNA, 2430 bp, Chlorella protothecoides
  modified_base (250)..(259): a, c, t, g, unknown or other
  modified_base (752)..(761): a, c, t, g, unknown or other
  modified_base (1938)..(1947): a, c, t, g, unknown or other
atgacggtgcacaccgtcggtggggcgttagcccccgacccagctcacccagttccgttgccacgcgctcgtggccagcatcatgtggatagccaaggtgagcgtggtgtgctccgtgatggtgccggcgcagctccggtagctgctgtgaggcccagctgctcagtgtgtgtgggggtctttccccctcgttgggtccgttcgtggacgcagggaaggcccctgcggcaagctctgccaccgttccccnnnnnnnnnnggggggtcctttccccctcgttggatccgttcgtggacgcagggaagacccctgcggcaagctctgccaccgttcccccgccctccccgcctctggcagtcgtggtacttcatctacttcagcgcggggggttgcctgaaccccttcctgacgctcctctaccgcgagaaagggctgtcagaggcccggatcggggagctcgccgcgctgcgccccctggtctccctccccgccggctacgcctggtcggcgctggccgaccgccggggctggcaccggcgcatcatgctgggcacgctgtgcgccgcgacgctcttcaagctgtcgcagtggggcctgggagggttgtggcccctggccctggcgatcgccctgggccaggcgttcgacgcccccgtgacggccctggtggacgccagcgtcgtggcggcctgcgcggtggaggaggtgcggccatcatcgctcccccgtcacatgccctgcttcctctccnnnnnnnnnncgcacggaccatctgctgcaagccagaacagcacatcccttccgatggcgactacagccgcgtgaggctgtttggggccgtgggctggggcatctgggcggcggcggggggcggcctgctgggcacgctgggctggccctcgctcttcctctgccacgcgctcctcacctgcctcctggcctggcccagcgctcacctctccttcgacctgctgcggggggggcccgggcacgttggaggtgcgctgaaaggctcaggcacgggagcagggcgggggggagatcaggagagaggcggcgcgagtgctgtcgggacgcggcgacaggtgttcgtgctggcagatgtggaggaggcggtgtccctcgtcggcaaggccagcgagggcggcgagggcggtgtggatgacggaggctcccagtgcgcaagcatcgcctgcgatacccagccggccggcgccggccagtccgcgcccgtgggtcagccctcgccctctggccgcctcacgggtgccccggaccccccctcgcccgggcagccgccggcctggcgcctgttgatccacccccccatcctcgccttcctggccagtgtggcggtgatgggctatgccatgggcgccattgagagcttcctcttcctggccctgcgcgacctgggcggcccgcctgccctggcggggctgacgctgacggtgacgtgcgtggcggagcccatcgtgttctggcacgcgcggcgcctgcaggccgcgctggggcggcgcggctgcctgcacctcgtcttcgccgccttcctggcgcgcctggcgtgctatgccacgctgcggggctggccctcgccctggctggtcctgcccgtggagctcctgcacggcttcacctttgggctggcctgggcgacggggacggcctgggcggcggccgaggcaccgccggggaggaaggccggcatgcaggcggccttccagggcagctacatgggggaggggggaaaggggtgggatgatggaggggagagggagacagggtggagagtgaaggtggagagtggcggtgggggagggcggcctgcagggtggcagcaggcggcgcgggaggggtgtttggggcggtgggcgctggcagcatgggggccggcaggcacgaccagtccttcaccactccaggaagcgcacgcatgnnnnnnnnnngggcctgcagggtggcagcaggcgtcacgggaggggtgttcgagggagtgggcgctggaagcatgggggccggcagccacaaccactccttcaccactccaggaagcgcacgcatgcatccccctgaatgttccggcatccccaccctcgcaagctcctgcccctgcagggctgggctacggcctcggcagcctgatcagcggcgccatctacagccgcagcggcgccacctcggtctttgcctgggcgtttgcggtggtggcctgcggctggggggcaagcaccgtcgcctttaccgcgctggatgcggtcgcggcgcggcgcggtggcggcagcgtggcataccgaggggtcgagctggcgcccagggaagggctaggggtcgaggacccttgtgggcgtgctgacacgctgcgaacccccagtcccgtgcctattgctgttgagaggggcgggcggcatgcacgccactctgtacgctga

SEQ ID NO: 3195 - DNA, 180 bp, Chlorella protothecoides
atgccgaccaccacccattccaaccaccacgcgcagtgcctggcggccgtcctgggcatggacgcggggctggcgggcatcacgctcttcgccctggccaatggggcgccagacctgctgacccaggtggcggccctgctgtccagcaaccaggtcgatgtcggcctggccgccaggtga

SEQ ID NO: 3196 - DNA, 1176 bp, Chlorella protothecoides
  modified_base (547)..(556): a, c, t, g, unknown or other
  modified_base (971)..(980): a, c, t, g, unknown or other
atgattcttcctccctcctttcctccggggcctgcccaggcccactgtggccctggccatgccggaatccccacacttcaatccccaccgatcccatccccagcgccattacctcaaccccagccagcctatgatcggctgagacgattttgcaatagcaccctgcctccagagggtccgtggcgagcaaggactccttccaagggcaggcgtcgtgggctccgtgggccggccctggccccatccgccgccatgcatcgatccgatacgtcggggaagaaggtggaggccactcctcccgtgaaggtggtcggtttccacgtcgaaggcgcctccccctctccccgcaacaccctccttggcagcgagagcctggtccacgccagctccctctcccccgtcatcattccccctgccttccaggtccgtgccttggtgtgcaccgtatcactctctctgaaagttcttggccctgctactgcctgtgctgcgagcaacactaacttgatctgggggcccgcctggcggcagatggatcgatgcatcnnnnnnnnnnccttccaggtccgtgccttggtgtgcaccggattactctctctgaaagttctgggccctgctactgcctgtgctgcaaccaacgctaatttgatccgggggcccgcctggcggcagacggatcgatgcattgtgtgcccgtgtgacgcccacgtttgcatctgtgaatatgctgccacgatgtgtgcccgcagcgtgcctccacccctcccatgcacaagtgtgcggtgctcaaatccctgttccgttcccacaccctgcgcagggccagcgggggacgggggacatttccccacaccaggtcatggcagcggcggctgccgcctttggcactgggccggaggccgcgcccgccggggcggcccagggcgtggcccccacctcgttcccgctgcgcccggtgcgcaccgccagtnnnnnnnnnncggggcggcccagggcgtggcccccacctcctcgtccccgctgcgcccggtgcgcaccgccagcgacaccgacgcgctgggcgcccccggcacgcccagcaggcgcagcgcggccctgcccctcacgcccgtggcctccgcccccgcctcggcggcctccactgtcccctctgcgtcgcccttccagatggcggcg

SEQ ID NO: 3197 - DNA, 1032 bp, Chlorella protothecoides
  modified_base (874)..(883): a, c, t, g, unknown or other
atgttcaaggtgtgcacggcagcagggtcagctcgacgaggcctggccccctcccaatggccgtaccgtgtggcgtgcggcagtaccctcccgactgcctccgacgtcccaatatataatgccgttccgggcgtcatgtgcgcgcagatgcccatagcacctcgcatccctcgccaggccccacccagtccagatcccgaccccagcacccacgatctagccagctggtacgccatggccccccatgcagcgcatgcacaaggccccgccggcgacgccgggagcacacggaaggggaaccccggcccctcccggaaggtgatagacaccatcaaagaggcgacgggggcatccgaggaggatgtggtggcagtactggcggaatgcgggggggacgcgaacgaagccacgtcgcgactgatcgagaaccccttctgccaggtggtacacaagaaggagcggcggaaagaggtgagggtgggcttcaggttgcgccgtgttaccccgggagtgatgcaagcagcggcactcaatcccgcggcaatgcgcgattgtctgaggagccgggatggtgcggttggagcattgcatggcgagcctcactgcactgccgagccgcccctggccccatgcccctgccaacaatgcagaggccgccggtggccgagaggcggggcgagaggcgggatgacttccgggacgagcggttccgggacgagcgacgcggtgagggccggcgcggaggtcctggcggccaggccggacgtggcggcggccgcttcgctggcggcagaggtgcgtgggggctttggatggggatggagctcctggggcggggacgacgggggggttatggctgttgcggatgcgcagnnnnnnnnnnttcgctggcggcagaggtgcgtgggggcttgtgatggggatgaagctcctggggcggggaagacgggggtttatgggtgttgcggatgcgcaaaattgcctgccgctgcagctttgtatcgaggtatgtgctgcgacatttggaactga

SEQ ID NO: 3198 - DNA, 2184 bp, Chlorella protothecoides
  modified_base (237)..(246): a, c, t, g, unknown or other
  modified_base (859)..(868): a, c, t, g, unknown or other
  modified_base (2063)..(2173): a, c, t, g, unknown or other
atgctgacctccaccgcctcccgcctcgcctcccgtcttggacgcgccggccaggccaatgcagcggcttctgtcggcgcgttccgcggaatggccgggtcgtcccatgatctggaccccgccccgacccccgcccagcaaaaagtgcgtgcgaccgttgcgttcgggtccatcccacgtccgcatggccccatcttgatgaatggaattattttggatgtcgagaggggttcattnnnnnnnnnngacccccgcccagcaaaaagtgcgtgcgacgcttgtgttcgggtccatcccacgtccgcatggacccatctggatgaatgggaattattttggatgtcgggagcggttcatgtgggatgccatcccccccgcggcccgcaccagtcggtgccaaagtcctgcacgccccaccgctgggactcgacccctcctgccgtccactgcttgattcacagcatcatcgacctggagaacaagcacggcgcccacaactaccaccccatccccgtggtgcagacccgcggcgagggcgttttcatgtgggacgtggagggcaagcgctactacgacttcctggcaggctactcggcggtgaaccaggggcactgccaccccaagatcatccgtgccctgatcgaccaggcccagaagctgacgctcacctcccgcgccttcttcaatgactgcctgggcgagtacgaggagtacatcaccggcctgctgggctatgacaaggtcctgcccatgaacacgggggtggagggcggcgaaaccgccgtcaagctggccaggtgggggttgcgaggatggtgtggctgtgtatgccagggggggtgtgcatggtgtgtgtgtnnnnnnnnnncgaaaccgccgtcaagctggccaggtggggtccgcaaggatgatgtggctgtgtatgccaggggagggaatgcatggcgctgggggtacagcgtgaagggcgtgcccaagaaccaggccaagatcctgtttgcgcgcgagaacttctggggccgcaccaccactgccatctcctcctccaccgacccggagagctacgagggcttcggcccctacatgcctggctttgagatcatcccctacaacgacctgggtgccctggaggctgcgctggaggctgaccccaacatcgtggccttcatggtggagcccatccaggtgtgggtggtgcagggggtggacagggggaacaggggatgcattgtgggcgacgcgatcctcaaaggcgcaggggcatggggatgccaaaggtgcggcgagtgggaggcaggaggtgcgcctcccccgccaggccacccatccctggttttcagctcggtaggcgagctggcgctggctgcgaagggttcatgctcccctcccacagcaccatccccagcccccactcagccattccacctctcacacccgcgtgcagggcgaggccggcgtggttgtccccgaccccggctacctggccaaggccaaggccctgctgcagaagcaccgcgccctgctgatcgcggacgaggtccagacggggctgtgccgcacgggcaagatgatggcctaccagcacgacgacgtccgccccgacatgctcatcctgggcaaggcgctgtcgggcgggaccatgcccatctccgccgtcctggcggacgacgaggtgatgctgagcatcgggcgagggcagcacggctccacctttggcggcaaccccctggccgccaaggtggccgtcgcctcgctccgcgtgctggtggacgagggcctggcagaggcctcggcgcgtctgggcgagtccttccgcgcccagctgcgcgccatcgacaccccgctgctggagtcggtgcgcggcaagggcctgctcaacgccatcgtcatcgacgagagcaagggctgctccgcctgggagctgtgcctggacctggcgcgccgcggcttcctcaccaagcccacgcacggcaacatcatccgcctcgcccccccgctcgtcatctccgaggagcagctgaaggaggcggccggcatcctgcgcgaggcactgctcgccaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccaccctga

SEQ ID NO: 3199 - DNA, 360 bp, Chlorella protothecoides
atggtcccgagcggccggatagaggccctgcgcgtccctgctcactgccccccagcaccccaccgcccaggccacgatctgcgtccatcgacaggcgggcagatggagcttctaaacatggcggacgatgggctggcccagtcctccctgccggtgttccacccattggaggcacgcgctcccccgctacgggggacctccatctcccgcatggaggaactgcaacagtacctacgccagtgcgacgatcgccagtgtttcaagatgtatttcaaggcaagttggggacgttctaattggctgtgccaaggtgacccggtggacggcttcacctgtcggtggagtgtccagcacccctga

SEQ ID NO: 3200 - DNA, 1644 bp, Chlorella protothecoides
  modified_base (279)..(288): a, c, t, g, unknown or other
  modified_base (983)..(992): a, c, t, g, unknown or other
atgctggccggcgccaacagcatctcggccgctgccgtaggcctcgtgtacctggctgccgtgggcccggccatcatcgtcaaggcctcaggcccctactggtttcatgtggtggggtatcctccccgcatggccgccgccgcggccctcatgtcaggctccttctgcctggttgccctcagcgcctcccgccccctccagctcctgggagtggcactggcctccttccagacccatctgccacccaagcgtttggagcgggggcagtttcctcgatannnnnnnnnncggccgcccagacccatctgccacccaggcgtttggagcgggggcagtttcctcgatatccaacccgacccattccctcgcgcccctgccctccatccaggggggcctgggggaggcctcgtgcctcgccctcagcgcacgctacggctccgaccgcggccccatcacgctgtggagcagcggcaccggtttcgccggggtggcggggtacgcctgggtggcggcgctgcatgtctgggcgggcctcagcttcaggaccaccctcctggccggcaatgtgctggccggcgcctggctggccaccttcttcctgctcctgcggcccccgcccccgcggccagtgcccctgcctacttcagacggcgaggaggacgacgacacggcggccagcgccggcccggcgccgatcgaccccgagagggtgcccctccggcccgcggcagcagtcgggctgctgccgcgctccggcagccgctcggcgctggccgtggaggccggcggcagccatgcagcaacggggcggggcgccggcgccggcccaggcaagccaaagccaggtggacgcacagcagcggcgctgagcatccaggagaggcggccggcgggggcgggcaggggcggcgagaccggccccggcgccgcggcgagtctcccgccctctgctctggggcccttgggccggctgtgcttgaccnnnnnnnnnnggggggcgggcaggggcggcgagaccggcctcggcgccgcggcgagcctcccgccctctgccctggggcccttgggccggctgtgcttgaccctggggctctggcccttcacggtgcccctcttcaccgtctacctggccgagtactccatgcagagcggtgcctggaccgccatcggtgggccggttgtatcagaggggtatggaacagtctcctggtgctcttcgtcagtctgagtgtctgttgccggagggtgcagggggcctggaccctgtttgcagggcgcatgcctgtggaaggcttggcatcgcctgccctgcgggtctcgcgtccagaggctgagatcaggaccccctgtaccacccactcaccgcccctgctaccaacaatcaggtttccctgtgacggacgctgcggcccgccacgccttttacatctacgccaactggtgctaccaggccggcgtttttgtgagccggtccagcggcatggtgtggcagccgggcatggcagcgctgtgggccatgccggccttgcaggcgggcctcctcttcttcttcctgcacgatgccgtggtgcactggtggtacggctggacgctcctcctcccctgcttcctcacaggtgggtgtgcgaagtctgtatggggtag

SEQ ID NO: 3201 - DNA, 543 bp, Chlorella protothecoides
atgctggcgggtcgggggtgtcaagcgagcctgagagcccaggcggcatgtgcggatcctctcctcctcacacgcacacaccatgcattccctcccctggcatacacagccacatcatccttgcggaccccacctggccagcttgacggcgccacaccatcctcgcaacccccacctggccagcttgacggcggtttcgccgccctccacccccgtgttcatgggcaggaccttgtcatagcccagcaggccggtgatgtactcctcgtactcgcccaggcagtcattgaagaaggcgcgggaggtgagcgtcagcttctgggcctggtcgatcagggcacggatgatcttggggtggcagtgcccctggttcaccgccgagtagcctgccaggaagtcgtagtagcgcttgccctccacgtcccacatgaaaacgccctcgccgcgggtctgcaccacggggatggggtggtagttgtgggcgccgtgcttgttctccaggtcgatgatctggggagggaaggcgggggatgggtgggctga

SEQ ID NO: 3202 - DNA, 1161 bp, Chlorella protothecoides
gtgcaaaggaggggcaaaggaggggctccaccgacaagccgcgccgccgagcgctgcggctgcacatttttgccggccatccggcgacaggcgccgcgcagctctccaccctcgcgacaaaagcccccgtcgatgccggccgcctccttcagctgctcctcggagatgacgagcgggggggcgaggcggatgatgttgccgtgcgtgggcttggtgaggaagccgcggcgcgccaggtccaggcacagctcccaggcggagcagcccttgctctcgtcgatgacgatggcgttgagcaggcccttgccgcgcaccgactccagcagcggggtgtcgatggcgcgcagctgggcgcggaaggactcgcccagacgcgccgaggcctctgccaggccctcgtccaccagcacgcggagcgaggcgacggccaccttggcggccagggggttgccgccaaaggtggagccgtgctgccctcgcccgatgctcagcatcacctcgtcgtccgccaggacggcggagatgggcatggtcccgcccgacagcgccttgcccaggatgagcatgtcggggcggacgtcgtcgtgctggtaggccatcatcttgcccgtgcggcacagccccgtctggacctcgtccgcgatcagcagggcgcggtgcttctgcagcagggccttggccttggccaggtagccggggtcggggacaaccacgccggcctcgccctgcacgcgggtcgccagctcgcctaccgagctgaaaaccagggatgggtggcctggcgggggaggcgcacctcctgcctcccactcgccgcacctttggcatccccatgcccctgcgcctttgaggatcgcgtcgcccacaatgcatcccctgttccccctgtccaccccctgcaccacccacacctggatgggctccaccatgaaggccacgatgttggggtcagcctccagcgcagcctccagggcacccaggtcgttgtaggggatgatctcaaagccaggcatgtaggggccgaagccctcgtagctctccgggtcggtggaggaggagatggcagtggtggtgcggccccagaagttctcgcgcgcaaacaggatcttggcctggttcttgggcacgcccttcacgctgtacccccagcgcctgcgcagt

SEQ ID NO: 3203 - DNA, 654 bp, Chlorella protothecoides
atggtggcgacatacccagggcacaacatcgccgcgatcgtcatcgccatcatcgcctcctgcgggggcggcatgatcgtggacgcgctggatatcggcgctgggtactccaaaggccctgctgagctggcgacgcctggattcgtgctgcgctccggcgccttcctggccatcttccacctcgccagcgtgcacctcctggggctgctcagctcccgcgcctcgttgggcgtcatcaccaccctgtttgtcgcacacacgctggcctctgccatcctgcaggcccccctggactacacccggcccctgggcatcctgctccacaaggtcggtggcaggcatggtggagtgggtgcacagaggatgtcgcagtggacacatactcaggtggtggtgggagagggtcctcgtgcaaagtcttccctgctccgctgtttgctttttaaaccctcccctccttgcatctatgaaaaggtgaccaatatccctgtgccggtcgggggaaagaccaaggccccgccgagcaagccggtgacgcggagccaggcagcgctgagcaaggaggtggacgggcaccaggagcagtacccatccacgccctcgtcgagcaagcagacaccgcggcgtaggaccaccgccgggaagcgggagtga

SEQ ID NO: 3204 - DNA, 1998 bp, Chlorella protothecoides
  modified_base (1467)..(1476): a, c, t, g, unknown or other
atgctgtcagtgcaacctatgaagctggattcactccgccctcacactccaccacaccctcatgcctctgcttgtccaatcaggccgaggtccctcttctggtccctgacatcctggtgtgctctgttggcaccgagatcctgttccagggtgagatataaggcctgggacgtcgggcatttccactctctctcatttgctctgggtgggttccactgtcactattccaatgcagccgtggcatcagcctcccacagcatgtcgcaccctcgacaacatgccagccctgccctttcaggtgtgccgcacaagccgtggtctgatttcctggacaggggatgggaccgcgagaaaactctggagattgcacaggccgagcctgcccttactcttcaggtgcacgcaggactggtgccatgccgggttagcttacatcacccaacacaggatgccagcgagcagcggccgcacaaaatcagcttcaaggtgtcctccggctcggatgcggtggtccaggagctcactgccaagctgaagcaggcagggctggaggtgaacgtcatctactctgcaggcgtcgacctcgacctcctcccggcagccgccagcaagggcaaggccctggctttcctcctagaggagcctgcggcgaatgacgctccctcagtccctggtgccagtacccgtgcgctgggttgtaacccacgcctgcctcctggcatggtccaatgggaccccagccactcctcaccgccgccccgcacccggctccgacagccccgcgccccacccccaaaccccatgcactcatttgcatcccccgaatgcggcagatggacgggggcgctgggcggccgcgcgatggcgtgctggtggcgggggactccggcaacgacatcgagctgtttgccgttgccggcgtgcatgggtgcatggtggctaacgcccacccggagctcagggcctggtgcgacgcccatgcatcgagcaccctcttccaggtgttggtgccgggggagggtgcgctgcgtgccgggcggggtccccggctgtcgttcgagggggcccaggggccgcacactgtctgcgcggcgcgtggcgtggtaccctcggggagcgtggggcacctcgggcagggacccaggcagccagtttccacggcctccagtgcatgcactgcatcgcccgcccgccgtactccaccctcacccatccgcccctggcacaccgtcctgccaggcctcggaggacggccctggcggcatcttccaggccctggagcactttgagttcgtcaagcacgccgagccgcgccccgcgggcgtggccgtccggcgtgcggtggtgggcatgaccaccgccgccgccgagctgttctgcgggatcgccccccagcccccgaccgatacggtcgcgcggctgggagagggttgctcgcatcccgcgccgcgcttggatgcccctgannnnnnnnnnccagagtgtcgggagccatctgtatcgagtcgggtgaaagggttcctctcatcccgcgacgtgcttgcatgcccctgcaacaccttttgcccaggcaccgggcactacatggtcatggacatgacaccctccagccttcccacccacacttcacacgcacatacgcctccacgggcacagtttctgtcggacgacttcttctacaagcatgagggggtggagtgcgggaagcaggagtacctggactaccttggggggccggggtacggcggcatggcccaggtggctgccgggcgcggcgagtggcgggagtggctgggcgcaatcgtggtccgggagggggtggccaacacctggaaggtggaggcggtggagcgagtccagcccttcaaagccggtgagcatgagcgtgtgggggaagggtggcggggcggtgagggggtcccgggggatgagcatgacgggaagatttggcacccagtgctggatggattccctcctgcctgcccatttgcttggtga

SEQ ID NO: 3205 - DNA, 1140 bp, Chlorella protothecoides
  modified_base (980)..(989): a, c, t, g, unknown or other
ggcgctgcgccggcgccgcgccgccccaaggaggccgaggagccggagagcgaagaggacgaggaggggaagacgcggttcggcgcggggcgcggcgagcacgccacctacgacgctggggacgaggacgacgcggccctggccgcgcaggcgcagcgccaggccgctgagcgcgagggcctggcggaggaggaggagggaggggaggagacggggccgggtgcggatgaagaatcgcggggcgccactgcctcggcggatgcagaggcggaggagggctgggcggccgcccccagccccgccgttccgcgctccgccgcatccgtatctggcgccgtccgccgcacctccgcctccgcctcgtcgcgcgtcgagctggagggcggggtgtgggtggatgcggcgacctcctcctgcggactggccctgcacctggccctggactgccccaagctgctgctgcaggaggtggcggagcgcgtggctgcggccgccctcctgcgcggcacgcccggcgtgtcacgctgctacgtgctggaggcggcgcgcggcgcagccgcctgcgtgcagaccgacggcatcaacctgcgggccgccgccgcctcggccgacctggtggacgtggacggcctggccgccaactcgccctacgccatgctggagacgtacggcgtggaggccgcgcgcgccaccatcgtgcgtgaggccgcctcggtcttcggcgcctacggcatcggcgtcgacccgcgccacctggccctcatcgccgactacatgacgcacctggtgagggttgtgggggtggggcgggggaaacctcggatcgcaggctctgaggtgggtgtacatgggaggtggcctgttggaagtgagcaggcaagggggacgtcccttgaacgactacactctgcgggcactgctgacaacagaagcgcctttactcgaccgaggatcatcccgctgcgatgctggtcctcttnnnnnnnnnngcctgttggaagtgagcaggcaagggggacaccccttgaacgactacactctgagggcactgctgacaacagaagcgcctctactcaaccgaggatcatcccgcttcgatgctggttctctcggagggcggtgcacgaatgcacccaggaa

SEQ ID NO: 3206 - DNA, 1065 bp, Chlorella protothecoides
  modified_base (1022)..(1031): a, c, t, g, unknown or other
atgccgcagtcgacgcaccccccgacccccgtgtggctagactgcgacccggggcacgatgacgccatcgccatcctacttgctggttacagtccccagctgcacctcctgggtattagcaccgttgcagggaaccagagcgtggagaaagtgacggaaaatgccaggagggtcctgtacgctgccgggctggcaggggtggaggtggtccagggccagggccggcccgtcatgcgggaccccgtggcctgcgccgagatccacggcgactcgggcctggacggccctagtggcgggccactgcttcctcctgtgcctgaaggggccgggatcggcccccacagcacaggccccacgggcgcccgctgcaccgacaccgacatcagtgctccagctgctgcagggccgctgcagccgcgtggcgttgtcgtcatggcagagcgcatcgccgcagcagcggcgcagcgtgcacagcgcgtgcatgtcgtcgccactggggcgctgaccaacgtggccctcctgctgaccctgttccccgaaatcgtggaccgaatcgagatcgtgttcatggggggcgccctcggaactgggaatacaggtgaggaggggtctcgggtggcattccagagctggcgctcacaatgccgggcaagcaggcagcagcgccggctgtgccgccgctgggagatgtgcgaggcccgtcaccctggcactgtgtccgccccccccctcaagggcgcccggcaagaacctccccacgccgtcccacccctcacccacgcctctacgctccacacgacaccgctcaggcccctccacggagttcaacatccaggtcgaccccgaggccgccgccatggttatgcgcagcggcgcccgcatcaccatggtccctctggaggtgacgcatacggcactggttggcccagaggtggcgacagcggtgctgggagcagcccccggcggcgccacccccttccgccaggccatgcacgacctgctgcacttctttgccaagacgnnnnnnnnnnaagcaggcagcagcgccggctgtgccgccgttga

SEQ ID NO: 3207 - DNA, 948 bp, Chlorella protothecoides
  modified_base (79)..(88): a, c, t, g, unknown or other
atgcccgcgactcggaccctgtcatcatggcccgctcacagcatctgcgacagcacaggcacctcaccccctcgccccnnnnnnnnnnggccagcaagcattggggcgtcggtcaggatgcccgcgactcggaccccgtcatcatggcccgctcacagcatctgtgacagcacaggcacctcaccccctcgcccccttgctccctcaccacccctccccctcgccccctcgctccctcaccacccctcccccctcgccccccccttgccacagtccacgcggcaccgctccgtgcccgagtcgcggagctggggctggaacgcccccgtgcgcgtgggcgtgcaggccgcggggttcaccgtggcgccgctgctgcccaagtaccacactgagggcgagtcgcgcgagtgcctgctgaccatggtgctcaaggccgactttggcggcgtggtcagcgagcgctcccgcctcgcgcgcttgtttggtccgctggccggcgtcggcctgcgcggcctgctggagcccgtggtcagctccgtcatcgtcctgcgggacaaggtggagcaggacaggttcgtgctgcgcccgctctcctcgtcggaccccaccgccgcggtgggggctgctgagcccctggccctcggcccggcggaggaggcggcgcggcggcgcgccgcggtccagaagcgcagcgcctccacgctggcctaccgccgcgagccgctcctcctcgcccagcgcgccgtggcggcggagcaggtgggagagccgtgctgtgatgggcttgtcgttgggatggtggtggacgggggtgatgggaacttcaggagcaagggctggtttgcatgtgaccccggtacagcggcggtctctgttgtttttggtgagtgggctacgtcgagtgacgcggggtcgagtgagggaaggccaggggctggagcgctgtag

SEQ ID NO: 3208 - DNA, 2217 bp, Chlorella protothecoides
atgcttgagccggctcatccgccccctcccaccttgacgcgcaatatcaaccccttgcgacggttgtctacccctcttgcagctctgtcaaggctgtccatgctgccgcctggggctgtgccgggagcgctgggatcaggcccctcggtctccggcccaagcagcacgggcgcggcggcccctgctgcagacgctgcgccggcggccgaggcgggcgacgctgccgccgcagagagggtggaggaggacgcctgggccatcggcgggacctgcccccgccagttctggtcctgccccggcgatgcagggttcaaggggcagagggattcgcgcctgatgggcggaagaatgggcagtggtatgggctcaagtggagagaggatggagaaaggcagtcctgtgagcgtctcatattgttttgtatcagaagcgcagcgacccaaacaggatggctacctttgcgacctgagccaatgccttgccgaaatctcccactcaatgccagccatccagatgcccgcccgccccatccgtgcgtggcccgagttacctggccgacaagcgcaaggtccctgccggcccgcccgtcttcgagctggtggcggtggacctgctggagctggaggagcccatgctgcatgtcgcgcggcacctgccctcggtgcgcaacgcgcccgcgccgttcctcttctgcgtccagatgatggtgccctgcaagccccctgtggccctggtggccagctgggcggcgccggtggccgtgctggacgtggcagaggccgacctcgtcgcggcctacgaggcgcacagcggcaagctgacgccaggggacgcggccttcctcaaggccctcgccgcgtgagctgggcggtgtgtgtgtggggagggggtgaggtggggtgggtgctgaggtcgtgcggaagggggaaggtagggccgggacgaggggtgatgacggcggggcgcatagccgactgggaagttgttgctcagggtgccccttcacatgcccaaccagtgccaatcctgtgtcgagcgcattccaactcctcatccgagctgcgcagcttcatcaacggcgagggtcctgaggccgatcgggcacgcaacaagcagttcaagctcatcccccacatctccaagggcgcctggatcatgcagaagtctgtgggcacgacgcccgtgatcctgggacagaagctgactaccaagtacttcaagggaagcaattactttgaggtggatgtagacattggcgcgagctccgtcgcggcgtccatcacaaacatggtggttggggcgacaaagtccttgaccctggacatgggcgtcttgctagagggacagaccccggccacactgccggagcagctcctggggaccatcaggcacgtgccacaacaaggcatgactccacagtggctcatctcaaccctcacatgccgaaaaaccacacatctcacccccctcagactcgcggcactggacatgaagaccgccgcctactttgatgagggggcggggcgcatcatccagcccgaacagctcaatcaatgcgatgatagcctcgctgacatgggcttggcatttggggggcaggtttcgcattccaggtttccaccacacgaccgtgcgcgacagctggtccgatggggggatgccactgcctccggcgtcgatgatcggaggaggacagggcgtcggtcggcaatcatggtgtcgaatccccgtcgccacctccagatcctggtcgtgagctgcgcgctgccctgcctcctggcctttgcgcgcattgaggacgacaggacctggtactccattgccctgagcgcagtggtcagctatgcggggctggtggccaccaaggccctcgtcccgatcgtcaaggccttcaacctgcgcgcggggctttcagggctggacatcaataagaagggaagcccagcgggagagaagaagataccagagtccctcggcctggcgtccggggtagtcttcctgcaccgatctctatcccagcacgccatcacaggtgtgcatcatattgtttcagcagctgcactactacgacgccgcctccttcgtgcggtggttgacgcatggcgggagctggtgggagctgaagagcgtggtggtggagcaggccagcgacgcatggtgggtgccactgcctgctgctggggatctgataccgacgcatacctcctggctggttga

SEQ ID NO: 3209 - DNA, 753 bp, Chlorella protothecoides
  modified_base (476)..(485): a, c, t, g, unknown or other
atgcctgtgtcagtactccctgcctctgtgtcaatgccagttcctcagatctccaatcctcgacatgaccctcacacactatctcccgacaaccccccaaaccctttctcaccccatattgtctccactcgccaggctggtggactacaacgcagccctcgccaccatctgcttcatgctcttcctgggctttgcggacgatgtgctggacattccctggcgagtgaagctggccctgccctgcgtcgccagcctgcccctcatcatcgcgtacgcagggggcaccggggtcgtggtcccgcgacccctgcgcgccctctgcttcggcctggggccccgcctggagctggggccgctctattacatctacatggtggccctggtcatcttctgtgccaactccatcaacatcctggccggggtcaatgggctggaggttgggcaaactgtggtcatcgcctcggcggtgctatccnnnnnnnnnnctacatctacatggtagccctggtcatcttctgcgccaactccatcaacatcctggctggggtcaatgggctggaggttgggcagactgtggtcatcgcctcggcggtgctatcccacaacctcatgcagctggcagggaacatcccagacgaaggtgggaatggcaaacggcacagagtgtggggagggagggaggggggggggttaatgcacaatggttggtttatggaggggaagggtatgggatatgccatggcctttgcttga

SEQ ID NO: 3210 - DNA, 411 bp, Chlorella protothecoides
  modified_base (335)..(344): a, c, t, g, unknown or other
atgacttctgtgcagtcggaatcgttgcctggaggagccccgcccttgcattcgccacactatctgacacataggactggtgaagcctctcttctcttcactgttcacccccctaatcgccaggttcgggcgatgagtggcgagcccaagtggcaggatgtgctgcagctgcgcaaggtcaaggaccacttcatcttcaccatcgagtcgacgggggcatggaggccgcacgagatattcgagtatgcggtcaagctcatgatggccaagtgcgacaaggtgctggaggggctgcagaagtacccgccgccttccgacttcggagcagaggaggnnnnnnnnnngctggaggggctgcagaagtacccgccgccctccgacctcggagcagaggagtggatggaggattag

SEQ ID NO: 3211 - DNA, 687 bp, Chlorella protothecoides
atgttctgtgcacgagccactgctacatcatctgaagatcctcccccccccccgccccccgagtacaggggagccattgctgacctggcaggttgtcaagaaggttgctggagagttcaagcgatcttaggagcagcaactcctcccagggacccatgttctacaagtgaggatgaatggcacccattcccgggatactttctgttcaagctgacactgcaagggggacccttgacgcgccaggccctgccttcaacaagcagacgggccaaatggccgacacctacctctctgtccgcggctggtccaagggcatcgcctggatcaatggattcaaccttggctggtgcgggtcggggccagagcctggggagggtgttagaatatctggtcctcctgcctgtggcccacaccatgccgcaatgccctgtgccccatcccgcccctcacaggcactgggcctcccagggaccgcaggtcaccctctatgttccgggcccactgctccatgccggcgacaatgagattgtcctgttggagctggaggacaccgctgaacgcgaccatgcggcagtcagctttgtcgatgaaccagacttctacggccccgcttcgcagggcatggcaggggcaggagtcagcatagcaggcgcgcctggccgacgcacagcccatggccctgtttaa

SEQ ID NO: 3212 - DNA, 588 bp, Chlorella protothecoides
  modified_base (515)..(524): a, c, t, g, unknown or other
atggtgcgtcacggcgcgttccatgggatcggcatgggcagccgacggcctcctgtgcctttccgaggccggcgactggtgccgcacgccctgtcgcgaccggacaccgcggcggcggccattgcccagggcatagagctgtgtcgagagaaaaagtacgatgcggcacaaggattgtttgaagcagcgctcgaactgccgggaacaggcacaaaaagatttcggaacaagcctccccagatcagcaacagcgagcgcatcgctgccctgtacaacatcgcctgttgccagggccagctaggaaacatccaaaacggcatgatagccctggctggggctctagaaagcggtgagcggcgtggcatggagcagtgtagtggggagcaaaggatgatgcatggaaaggattgctgtggcggcatggtgatcgtgtgggggggaaaaggtccagtccgcacttgctggactcccagacaccttcagccagtgatccacaaccccaccccccaccaaannnnnnnnnnggactcccagacaccttcagtcagtgatccacaaccccaccccccaccaaacaggctacgctga

SEQ ID NO: 3213 - DNA, 438 bp, Chlorella protothecoides
atgcagcgaggtgtactgccagggcggtggctagacatagcgagcgcgtgtggccaccttcacccacccatgccctctaccttccctgaagggccatacaatgatgctgacacagcgaggctcgacatcctggtggaagccatgggacggcgcaattttggctgcgaggagggtggctgggatctcaaggggctgcagtcgtctctggtgacattgaacggtgagtcagcgggagccaagcacgcacccagggagactggtggggagggctggtggcaaacgtgcattctaccagggcctgggtggggacggccccgtcttcatctcttgaagcgctcgaggaaccccttgggctgtgccccgccaaagcgctgcagcagtccctcaaactttgggctctcccgcagcggggcaaggtcggggtcattcctcatctga

SEQ ID NO: 3214 - DNA, 1338 bp, Chlorella protothecoides
  modified_base (1107)..(1116): a, c, t, g, unknown or other
atggcttttgtgggagcgacaaggagtacctccgtcacctggtgggcctggcccggcagcatcttggcgagactgcagtcctcttcaccacagttcgtgagagtccccacctcgctccctttccctaccagatccaccccatgtggcctccgatggaaccttgcccgggagcgagatattcacgtatggtcaactcgggaggggggcgttgggcgtatgagtgggtgtttttccattctacacccttgcatgctccaaggcacacctgctgtgaccatcacaagccggcacggcatcatccccttccctgtcctcagggccgtcgactttggcccaggctggttcaacccggaggcagactttgctgttcagaagtccctcaacgcgcctggattgtcaccacccttcaattctgagttctactccggatggctgacgcactggggagaaagcatggcaaacaccagctccagcgtcctggcagctgacacccaggtcctcctgcgctgggcccggaacaccacctccctctccttctacatggtgcatgggggctccaactttggatttaaccagggggccaacgtggatggatcaaactatcagccgcacatcacatcgtatgactacgacgccccgatcagcgaggcaggggactactgccagcccggcatcggcggggagtgcaagtaccatgtgagtgggctggggcctgcaggcaggcgcacaaggtctatgtcccctggcagacgagagtgccgtcgtgagagcctgccatgcggggactgtgcgttttgcactcagcctacacccacggctcgcctgttgccagcccaagggacggcgagcatgctgccccttccctttcgcaggcaatccgagaggtcattgcgcagcacacggggatcaccccgcctcccattccgccccgacctcgcatccacgcctacggcgagatgtcatggaggaatatgcccagcggtgagggcatccaagggtggggggtttgccgccaggacactcgctcaatccctacgcctgggtgccagtcatgcacacatcttcttccatgaatctggggctgtatgctttgccacctttccacannnnnnnnnnatatgcccagcggtgagggcatccaagggtagggggtttgcagccaggacactcactcaatccctatgtctgagtgccagtcatgcacacatcttcttccatgaacctggggccgtacgctttgtcaccttgccacgcacccttccatgtgtgcagaagtggcctcatcctctaccggcacatcatcccccgcaagcagctgagcaagagctcggagcttga

SEQ ID NO: 3215 - DNA, 2067 bp, Chlorella protothecoides
  modified_base (1014)..(1023): a, c, t, g, unknown or other
  modified_base (1514)..(1523): a, c, t, g, unknown or other
atgctggcgcgtgcggcagcatgctgcctgacgatgtctccaccctggcccccttcccatcctcctgccaggcgacgcggtgaggaggagcccatggtaatcaacggcggcagcctgcccgaccacatcctggaggcgctgggcctcacggccgagtccggggtgtccatccgcctggtgcggaatggggcccggggcctcatggtggaggggctgaccgaggacgaggaggatgaggaggctgcggcgggggagggggacagcgaggagagcacggcggccagcagtgaggaggaggcggtggcggccgtgcccggcttggcgggggtcgagggtgacggcggggagggtcccctgagcagccaggacgccgccaaggtcaaggcgaagcgaaagcgggtggaggccgccgccgcagcagccctgcggaggtcggggcccagcgcggcccaggatgggcgcggtggggccgatgagttgctggaaggcggctgtgcgggtggggcagtgcgtgcgccaagcacctcccatgtggcagcagatcctcgaccacggcgctcctccgtccgcaccccccctactgcagcggagacctcctcgggcgacaccggcgccgtggggtcgccctttgacgccgatgccgacgcgctgcccgtgctcgccccctctgccgcggaggaggagctgcgcgtcgcggcggtggtcgaggacggcgcctccccgcagcccgacacgccctccgagcaaggggagggcgagtacctgggccccaccgccggctgcaccgccgtttgcgccctggtaaaggccggcgtgctcacggtcgccaacgccggcgactcgcgctgcgtgctctcacgggggggggtggcgctggccatgacccaggaccacaagccggacgaccccgccgagtacgcccgcatcatcaatgtgaggcggcgtcggcggcgcagggggtggtgtagggggggccgcagactgctgggagggagtgtgggtgggtctgattgnnnnnnnnnncgtgaggcggcgccggcggcgcagggggtggtgtgggggggggccgcagacagctgggagggagtgtgggtgggtctgattgggagcacgtacttgggccaggatgatgggggattgcggtgtgggctggctgctcccaaacttctgccgcccagcatcctcgaggacccgagctgcactccgatcccagcccctgatcatgccccctcactccaccatgcaggccggaggctttgtggccgacgggcgggtgaatgggtccctgaacctgtcccgcgccctgggcgacatggagtacaaacagagcaaggagatgggtccggaacaccaggtgagatggcggcccaggctgggcacaggcatgtggagagactcgctgcacgcgcttgcttcatgagagggagggtggggcggtgcttcgccatgatagcgtgtggagatggtgctcccgacatactcgaggctgggttgctggcatcccgtgggcacgnnnnnnnnnnagggcggtgctttgccatgacagcctgtggagatgaggtgaggacggagaccctgcaggctggggacgagttcctcatcctggcttgcgatggcatctgggacgtcctcaccgtgcaagaggtcggcaaggggtgggggcgcgcatggaagggagggagtgaggagtggataggggtcactgctgacaggttccccagggccgtcgacttcgcgcgagagcggctcttgagtgggaagacacccagggaggtgtgcgaggcgatgtgcgatcattgcctggcccccgacactgacaattgcggcaaggtaggcaggcaggaggcttggttgcatgcagctgggagctgcataccgcggcgggaggctcgcttgatgtgtcattatatgttaatggtagggaatggtgattgtgaaggtgccgaggaatccctggttgaagaaagtgctggtgtctgcaagccaagtatgactcttgttgactcccatttactttgctcagctcccaccccgctgtgccgcgacctcagggatgcgacaacatga

SEQ ID NO: 3216 - DNA, 906 bp, Chlorella protothecoides
atgatcctaatcctgtgcccgctctgtgagcatcctaattgtgcaaacctaggcgctgctgcagggtggatgacgctggctgctgcaatgcctcccaccgtatacttcaccacgggaaacaaaaacaagctagcagaggtgagggcaatccttggagagcaagggcagcttcccttcaacgttgaggccgtgtctgtggacatgccagaactgcagggtgaaccagaggagatcgcaaaggagaaatgtcgccttgcagcccttcaagtcaagggtccagtttttgtcgaggacacatgcctttgcttcaatgcctacaaggggctacctggtccttatgtcaaatggtttctggagaagctggggcacgatggtttaaaccgaatgctgcacggctttgatgacaagacagggtatgccctgtgcacctttgcctacagcgacggtgagcctgcgagggtggaagccggcctggcacagagcggagcagagttgctgtctgcaatgccatccttcgcccctgagcatcccgatttgctctacacctgtgttctcgccctggcaaccgcatctggtccctctacccttgcaggacccgatgctgagccgcacgtcttcatggggaggacagacggtactatcgtcccagccaggggcccaaccacgtttgggtgggaccccatttttcaaccctccggctttgaccaggtgacaccagtgtgcagcatcaaattggcattcctttgtcccaccagagccactctccctggcctcacaccaggcttggcactccattcgatgcagacatatgcggaaatggagaaggctgcgaagaatgcaatctcacacaggcggcgggctctggacaaactcaggcatcacctcgtccagcgctacgccacctga

SEQ ID NO: 3217 - DNA, 267 bp, Chlorella protothecoides
atgtggatgacggcgaggaacaatgacggcctgcaaacctcgacagtgagtagcctcagtcaggtcctgcaacccctttctccacaggtcacaggcacaggcgccggggcggttgtcgtggctgcagtgctggccaacctcctggagagtgtgctaggggccaccatacaatccaaaacgggctggctcacaaatgatgtcatgaatgtcatccagatatcctgcgcagccaccgcagccatggcgtttgcctgcagactggcgtga

SEQ ID NO: 3218 - DNA, 912 bp, Chlorella protothecoides
atgacggtgcaggccgggcttgctgtgcagtgcgttgccccggggcgggcgtacgggcacccagccagcccatcaccccagcgatggcgagatcagcatggagggtcatgccgggcacaggctccgacccggcctccatccaccactataagcactgtgctgcacacggaagagctgtccatgcgggcgcgggcggcggttcaggggaatgactctgcccagaccaccacgatgggctgtcgggctggcattgcagcgcaggggtcaggctggcccggtgcatgcgcagatctcttgagacccagcccgggcctcctcgccggcctggtggtcaacagtctggtctacctgctgggcatcagaatcctgcgcaagggactcacctgggtcggatactcttcttcgtgggtcctgggcacactgtcctatgcagcgtttggctacaagggttacctcattgtgtgcctctacttcatccttggaaccctggtcaccaaagtgaggatgaagcagaaggaggcagaaggcatagctgagaagcgttcaggtcatcgatccctgggcagcgtctgtggctcaggctttgctggcattgtgtgcgcaatcgggcacctacttgcaccgcaggcgctcccatggcaggtgagggcatgggcactccagggcatgacagagcttcctttaccagctgagattcggcccaagacccgtgatcgatccagtgcggcaggtgggctttgtggcctcattctgcagcaaggcagcagacacagtgtccagcgagattggcaaagcgtatggcagccaggcataccttgtcagcacctttcgccgggtcccacgcggcaccgagggggctgtgagcttagagggctccctcgcggggctggcagccgtaattgggattgctga

SEQ ID NO: 3219 - DNA, 1272 bp, Chlorella protothecoides
  modified_base (295)..(304): a, c, t, g, unknown or other
  modified_base (1061)..(1070): a, c, t, g, unknown or other
atgaccgtacagcctgacacggtatggacatgctcgctcacccatccccatttaatgtcaatcgccgcaggggctgtctatacgctctacaatggtgtcagactgacaggccgcccagccccaagcgtccgtactggcctgcacctcatggatggcttcatcattcgagctcggggcgacggccagatctacacgctcaccatcgcaacaggtgggagcactcccttgggtgcacacccagcctgctgtgcacaaatccctgcacacctcttcgtgaagcgccccgactccttgnnnnnnnnnnctcaccatcgcaacaggtgggagcactcccaagggtgcacacccagcctgctgtgcacaaattcctgcacaccttttcaggaagcgccccaactccttgttccccccccagaagcgggcgaagagtacactgcagagtgggttccgccaccgtcgtacaagtctgtccgcgtcgccctcaccagcttcaagccagctctggagagcctcaatgtctctgacatcacgtccatctccattgggtacaatgcctcagaccagacagagaggagcagcggacggtcagagttctcttgcagcattgactggatcaagtgcatgcctggcggcctggagccagacttcatcctggtatcctgctctggtgcaaccaaggttttgcgtctctcggatgcaaagatcggacaccgctccgatgctctttgccatccaggtctggacgagaccgcgcgggaacgggtaatagctgccaagcgccgcggcgagcgtgcgctaagggccagtggactcggttacaccattgtccgtcctggtgctctggtggaggagacgggagggtacaaggctttggtgtttgaccaaggtacacgcatctctcaggggatcagctgcgcagatgttgcggatgtcagtctgagggcactgcactgtcctgaagcccgcaacaagacatttgctgtatgctgggagtatgcgcacgacaatgatgatgggctgtatgagctcgtcgcccacgtcccagacagaccttcattgannnnnnnnnntgtccacaatgcagagcaattcctgaagatgctgtgtctccctgcatgcaaacctccattagatgggccggcctttgtcctcctcagcactgctctgtttggaaccctcgccaccataaacgacgaagatcatgctgcgcgtgttctgatcgggaagcattatccccacgtggagcatgggcaccctcccaatcctgagtaa

SEQ ID NO: 3220 - DNA, 900 bp, Chlorella protothecoides
atgtcgctgatgatccccaccagcctgtcgtaccatgcgactcacaggcggcccgctgtgcctttcaacggaagaaagaatgttggtgctaggaagagctgcggcattcccgcacagcacagggaaggtggcccccaaacgccccgtgagggggtgggcgacggtaatgaagggcggcccgcagagtcgttcaatatagacgacctcaaccccatcagcatcggaagaaagtcaagggaggtgtttgacgatgtttgggcccagcttcagcgcatcagctcccccaccaagagaggggacctgccgggccggtacctcaggccagagtttgagacgccgggcgccaagggaaccaaggtcctggtgacaggggtcacgggcagggtgggccgcgtgttgctgcgaaagctgctcctccgagggtacactgtcacggcactggtccggcagcgtggcggcgaggagcgccagacgctgccgccgagcgtgaggcttgtcactggagacattggtaattatgaggactgcagggaggctgtgaaggacgtggacaaagttatatgctgtgcaactgcccggacaagcatcgtctctgacttggagagggtggacgtggagggtgtgtccaacatcgtccgggcatggcaggggagaacctggggagaggctcggctcaagcacaggctatctcgatttgccaagctagaactcgtacacttcaagaagccctacgtaggagatgactggaaggtccaagcagctcccgagaggtcaacttctgcaggtggcactggtctgagccgggtcatgcggacggctggacccaaggatgtggctgatatggagatcaacgaggagggagtcatgacattttcaggtggggctgttgtgatcaaatga

SEQ ID NO: 3221 - DNA, 732 bp, Chlorella protothecoides
atgtgggttccgcacggcccgtacagcgtcggcgtcaccgaccttgagtgggaggcgcatccagggcgtccattcaatgacctcgtccgggctgagcatttgtcggctcgcatcttctaccccaccgccaagcggtcgcctcggccatggagctggggggtatcatggctcccacactacaactatgccaaaggtagtccgctgttccctcttcgtctttaccagaaaatgtttgtaccgcctgcaaagggaacgtttcgacccatgctccgcccccacatcccacgccacaggcctcggcgcattcttcttcttccgccggcccctctccctgatcaatgtgctggcgcgggtggtcctgcaggccttcgtccttgtcctgggctggctgcagcgcctgtggatgatcccaggagcgccgctggcgcccgccctggacgtaggcggccgtccagccgtcatcttcagccatgggcttggcggcttccgcagcatgtacagcgtcccctgcgccgagctggccagccagggctacgtcgtcctggccgtggagcatgcagacgggtccagcagcgccgcccgtgtggccggtgccaaggtgggacgggtgctggggaagggggaggtcaggtcgagcttggaccccaagaggattgtgaccctcgtggggtccaggccgtcgatcccatgcagagcatctgctcgaatactctcgagcaactggacacatag

SEQ ID NO: 3222 - DNA, 900 bp, Chlorella protothecoides
atgagtactgtgggaactcctcacaaaagggggcatgcccgctctcggtccagtgtggcgggcgaggagactcccattctccagggctggcttgcgagggagtcgggtgtggtcagcgcgctgctgaacaagcggtttggagccctgtacccaacggcgctggtgacctacaggaaggagactgacgaggcaagcagcgggggtatgaccccgtccaaggtctggtccctgagccgggacgtctcgctcaccccagtggaccgccacacgttcaagctgcgccatgccaagaccagcacgttgtgggcggttaccgccaaggcctacgatgctaaggacatgtggggcttctcggtcaagtggcccaactccggcatcatcgggcaggaccacctggtgctggcgtttgaggaggaaagagaggcggagctgtggcaccgggcgctcagtgacgtcattgcccgcctccccgcccgcaccgtctccggcatcggggacctgcactcccgccaggcctctttgacctccgaggctgatgcaggggaaggctccccgccccccagccccatgaagagcgggctgggagctgagctgggcgctgagcgtggcgcggtggcgacgggcgctgagggttccgccgccgccgccgccgccgccgccctccccgccacggcggtgccgatgcgtcacgtgcgtgcggcgtcggaggactccacggcgcgcccgcgcccgcgctcctgggcctcggtcatgcacatcaacggcgtggcgctgtttgtggaggactcggatgccgacgggtcggggggcgccatcatggtgtctgccgtggtgaaggcgcccccgcacgacgtcttcagagtgagtggggtgggtggagaagtgtgtgtgctcgagtag

SEQ ID NO: 3223 - DNA, 282 bp, Chlorella protothecoides
atgcgcgcgacggagcggaagaggtgcccagggcctgcctaccccattcactgccattccaaaaacgcccgtgttccgcaggaggatgcgcactccaccgtcctgagggtggagccgagcagcgatgctgggatctttgcggtgtttgatggacatggtggcaaggaagtcgcaaagtatgcggcagtgcacgtggtaggcgaagggttggtgattacgcatcgggaggcgcaacggattggaaaaggggtggaatggggtttcttcaagccgccgcagtga

SEQ ID NO: 3224 - DNA, 507 bp, Chlorella protothecoides
atggcctgcgcttgtgccctgggtcctcggcgcggccccaaggcgagtgggcgggctgaccgcatcgtggaggagggccgcgccacggccatcctctccctccagtccgacgcctgcctggaggccctgggcatcgactactccgccctgcacgcccgcgcatgcgctcgcggcctgctggcggcgcgcgtcgccgtccgcgactttgaccacgacgaccaggcggccatgctgccggaggcggtccgcgcgctgcacacgctgctggccatggggcaccgcgtctacgtgcactgcaccgccgggatcaatcgcgcgacgctgaccaccgtgggctacctcaccttcgtccaggggctggggctggaggaggcgctgcgcgccgtgcgcgaggccaggccccaggcccacccgtacgttgactgctggaggacggtgcgtcggcgcctggtggagggacggggtgacgaggtaggccacgcggcccgggccatattcaacacgtga

SEQ ID NO: 3225 - DNA, 1356 bp, Chlorella protothecoides
atggccacaaaggcgtatgcggcaggcgacctgggcgccgcggttgcggaggcatatttggagctggaccagctgatggatgcccctgcgggtcaggaggagctcgaccagctagctgcaccagtacagaagagggccagggcgccccttcctccaccccatgctcctcgccaccctcggcactgcgccagccctcctccaccctggcccgccacccccaggacgcccctgacgctcttctctgacgtggacacgagcgcgacgagcaacaccagcctcgactccggcagggtcagcgcgcccgaggaggaggcggaggaggcggccccctccgcccccggcgtcgaccgccggctgcgcaagatgaacagcagttcggaattcctggccagccacctgcagcgcgccagcatcgtgactccccgcgcctcgcccgagggcccctcgacggcgctggcggagcacggcagccttggccgcaccgatacgcggcgcgaggcctcggccctcgccggcgaggagggcgaggaggttgcggaggacccggcatccctcttcggcatcctggagggcgcctccgtccccgcgctggccgcggcggcgccggcggagagcacggagcagcggccgcgcgcagagggcgcgggctgcaccgcgctgaccgcgctggtccgcggcgggcgcctggtggtggccaacaccggcgactcgcgcgcggtgctgagccggcgcggcgtggcggtggcgctgacgctggaccacaagcccatcctgttcgaggaggcgcggcgcatcatccgcgccggcggcttcgtccgcgacaaccgcatcaacggctccctgaacgtcagccgcgcgctgggcgacctggacttcaagcgcaatgccgcgctggggccgcacgagcagatggcagcccctcgtggccttggatcccaagccttctctccttcttccctccacacctctgttacaccctgcccctggaacacccacccacggcgccctcaccatgtttcgctccctcgccccgcgcaggtggtggtcacgcccgacatcgaggtggtgaacctgagcgagggcgacgagttcatgatcatggcctgcgacggcatctgggacgtgctgagcaaccaggaggcggtggactacgtgcggcgccgcatcaagaatgggacctcgctccaggccatctgcgagtccatgtgcgaccactgcctggcgccagacctgaccggcatgtgccgcggcgcggacaacatgagcgtcgtggtcgtgctgttcaagcgcaccgcgcgcctggacggcatctgggggcgcatgtggtctggcctctgggggtccatggccaagtag

SEQ ID NO: 3226 - DNA, 225 bp, Chlorella protothecoides
atgcagctggccctggatgtgctgacggccatggcccagggctcccgcctccccggccgcatgacgctgtcccacgggctgcaggccagcaggttccttcgcggcagcgtggacctgggttgcgtggcggcggcggggcacagctacgggggggccacggttgccatgctcgccgcggaggacgcccgcttcaaggccgccatcgcctttgacccctggtggtga

SEQ ID NO: 3227 - DNA, 270 bp, Chlorella protothecoides
atggccatcgctgctcgtgtgcgtctggcctccaggtgccggccgccgatgtggtctacctgcccatcacgcgcacctcatccccttcaacccctttctttcatgcagccccaactggtggtagagtcagaggggtacagagggggtcagactgccctcgcactctcccaagccttcctcgcggtggatgacctcctggtgctgccagagcacagggaggagctcaaggcactgcggggtggcgacaaggaggagaagcagaaaacgtga

SEQ ID NO: 3228 - DNA, 324 bp, Chlorella protothecoides
atgactctggcagtggcaggcatcctgggccacttctctgagacgctgctcatgttcttcatcccccagatcatcaactttgtgtacagcattccccagctcttcaagtgggtgccctgcccccgccaccgcctgcccaggtacgacactgccacggggctactccaccccacaccaaactggaatctggtgaacgccttcctttccatctttgggccctgcaccgagctagtgctgtgctcacggctgctggcattccagggcctctgctgtggggtggccttctgggcgcggcacgtcctcgccggggtgtacaaggagtga

SEQ ID NO: 3229 - DNA, 699 bp, Chlorella protothecoides
atgcaaccaggcaagcacacccacctgcttggtgacctcacgcaggccctcgaggaactcctgggtgggctcgatgtacccggcgttacccaccaccggctccaggatgaccccagcgatctcgcccttgtttgcctcgaagatggccttcaccgcctccaagccggcagacgacgtgcctcgcgcgtgcacacacacagcccggcagacacctgtcagcgtggccgcggcagtggaggccataacgcccggcgagtcggcgaggcccagggtaatcaccccagacccagcctggaccaggaactggtcggcgtggccgtggtagcaccccacaaacttcaggatcttctcgcgcttggtgtaagcgcgcatgaggcgcaccaccgacaggcacgcctcagtgccggagttgacgaagcggaccatctccacggacggcacccggtccacgaccatcctggccagcacgttctcgagctcgcatggtgcgccaaaggaggtgcccttgtccagctgcgcatgcagggcggcggtcacctcgtcgtgggcggccccgacaatggccgggccccagctgccgatgtagtcaatgtacttgttgccgtccacgtcccagcagtaggcaccctgtggcttgtgggtagggagggcgttacggcaaatgggggcactcagaaaggtcattctggggtgccgtga

SEQ ID NO: 3230 - DNA, 357 bp, Chlorella protothecoides
atggaccgtgcccagtacgtacgagagagccggggctgcatgcgccagctggaggcggcgacgagggggctgggcaccagtggtgcccagcacccggttctggtggcgcagcagcacgagcgcgtggccgcgctggcctactccctcgagcgcctggccaacgtcaaggagttccggacgccccagggcgcacgcagcgtggcccggctctacgtgggcctcatcatccccatctttttcgggccctactggggctgggggggtgaagggagttgggacaggagagggggagggcatgtgctggcacgcctggcagagtgtggcctgcttgacgacgagctccttcacgccagctga

SEQ ID NO: 3231 - DNA, 501 bp, Chlorella protothecoides
atgtccgagggcatctccatggacaagcagcaggagaaggcggctgtgggccggggcaccctggccggccgcagcgtcatgctcgtgaagccccagaccttcatgaaccgcagcggacagagcgtgggcgccctcgcgaggtactacaaggtgccgctggagcgcgtcctggtcgtcgccgacgacctggacacgccgctgggcgcgctgcgcctgagagccaagggcagcaacgcggggcacaacggcatgcgcagcgtgcagagcgcgatgggggggtccaccgccttcccgcgcctgcgcctgggcataggccgccccgccggcggccgcgatgtcgccgactttgtgctgcaggtaggcgcggcaggagcggcggggggggcggggcctgggggttggacccgcattcctgtgcggatgttgttgacactgtggtggggccgttgtttttcaaccaccccggcccggtaccagcctccgtgctcccatagacgctga

SEQ ID NO: 3232 - DNA, 444 bp, Chlorella protothecoides
atgagtgagaacgccctcgatggaatatgcctcgcatcaaagggatggcaggagagcttcggtgtccgtctcgccggccttgctcgctcgccgaattcgcaagactgcaccgccttggatcctccgacgtgcatcctcggtgtgtcgtggccagggcaaatgggggaggcagcagcatgcaaccccacttcgtccgactcgccctcggcaactgaggaagacttgctcgcccagctcacgtactttgaggcgcgcgccgacccccaggatcctgagcaggcagccatgctggacaagatgcgggagcatgttcgcaggctgcgatacgcccggggggactggaacaagcccagctgcaaccgggactggaacgaccccaccccgcccagctccgcgactgctcccatggccatcgactcctacaggtgcggaatgttcatgtaa

SEQ ID NO: 3233 - DNA, 2157 bp, Chlorella protothecoides
  modified_base (2102)..(2111): a, c, t, g, unknown or other
ggcacgggcgtcgtggagctgctgggcggcgggcggggcctacatacggccgggcagccggtcccgctggtcgcagcgacgcaggacgggcgcctgctggtgcacgcgccggggtccggcgtggccgcccccccccgccagctggtgggcaacaacgacgaggtgaccgacgtgcgcttcgtggagcggcgcgccagcggcgccggcgccggcccctcccccgcctgcgtggcggtggccaccaactcccccgtcatccgcgtcttctccaccccccgtttcgactgcctggccagcctggcggggcactcggccgccgtgctggccctggacgcagcgctgctggcggcccccccgggagtaaatgacggcgaaagcaaccgctctgccctccagctgctggcctcggggtcaaaggactgcggggtgcgggtgtgggatgtgagcgccgggacctgcctggcgctgggcgagggccatgtcggcgcggtggcgggtgtggccttctcgcgccgccgccccgccgccttcctcgtctccggcggctccgaccgcctgctcaaggtctgggacaccagcgccgtcgtcggagcgacggccggcggggctggcggtgacggcgacggcaccacctccgaccgacccctgcgcctacgcaccgtggcggccgtggcggcgcacgaccgcgacgtcaacgcggtggccgtctcccccgacgacgcgctggtggccagtgcctcgcaggaccgcaccgccaagctgtggcgcgccgccgacctggtgctggtcgccacgctgcgcgggcaccgccgcggcgtctggtccgtggccttctcgcccgtggaccgcctggtggcgacggccagcgccgacgccagcctgcgcatctggtccgcggccgacggcgcctgcctgcgcgcgctggagggccacgccgcctccgcgctgcgcttgtgctgggtcagcctgggcgcgcagctggtctccgccggcgccgacggcctggtcaagctctggggtgcgcgcgcgggggaggccgcggccacgctggatgccgcggaggacaaggtctgggcgctggacgcgcgcggcgacggcgcgcagctggtgtctggcggtggcgacggcaggctcgtgctgtgggctgacgccactgccgaagatcgtggggaggccgccgccgcgggggcggcggccgtggcggccgaccaggcctacgccaacgcgctggccgaccgcgattggacggcggcggccaagaccgcgctggagcgggaccagccgcgccgcctgctggcggtggtcaacaacgtgctggagggcgcagacgagcccgctgatgcagaggtgggctgggtattgtggtggaggcggaggcggaggcacttgtgctctgggatcgggccatgtgctcattcttcgagcattttccggtgccacaaatcgctgattctgcggcgcggatctccacgctcccgcatcgtccgccgagacccctcgccctcgtgcaaacgccatgcaggcgatgctgcgcccgctggtggcgccgctgcggggcgaggcgctgcggcgcctgctggagaccgtgcgcgactggaatacacacacgcgcagctgccacgcggctgccgcgctgctgcgcgccgtgctgtgcagccacgcgccgggcgagctgtgcgcgctgccgggcgtggccggcatcgtggacgccctggcgccctacacccagcgccacgccgcgcgcctggaccgcctggcgcgctccgctttcctcctggaccacgtgctggacagcatgagcatgctggagccggtggacgaggccgcccagaacggacacgccaagccagacggcgtgctggcaggctgacgcaggagggcgtgtcgacatgcgggcaaggggagacatcactgtcagtgggtatagggcgggtgcttgggtatcactgtgatgtgtgcaggagggtcaaagcgatggcgccatgcgatcccttcaaagggatgcttggcgtagcagggggaccgcctggtcgctcccaatgtgcttcttgtaggccctgcaatcacgagatgggggtgtgccgggatgacaacctccactnnnnnnnnnncgcctggtcgctcccaatgtgcttcttgtacgccctgcaatcatga

SEQ ID NO: 3234 - DNA, 192 bp, Chlorella protothecoides
atgctggcgggcagggcgggcgacatcaagcgccacgcctggttcgagggcttcgactgggatgcgctggaggcgcgcaagatggaccctccgcgccgccccaaaggccaggatgccaccaagcgcattcaggagctgacggcggatggggggggaaaggcgggggaatgctccctgtacctgagactatga

SEQ ID NO: 3235 - DNA, 351 bp, Chlorella protothecoides
atgcaccctcaggcgcgcggcggccccacccgcatccccgcggaggtggtggtgcggcgcaagcagcacggcagcggggagtgggatgtggtgcgcacgcgcggccacgccgacgaggtggaggagctggggggcacctcggtcgccgaggccggtggtgagcggggtgggggaagtgggggaggcatgtcggcgtgtcgctccccgcctgcggccctggcgcccacgccctcggcaccgcaccatgccggtctgggcgcggtcgatcgcccgcgccgccgtccagctccagccgaccccccccccccgcaacccatgcctcaggcacgccgcgccgacagctggtggtga

SEQ ID NO: 3236 - DNA, 369 bp, Chlorella protothecoides
atgacgcatcccaaccccgtgcacgcgcagccgctggagaacgggcgcaagacctacaccttctgcggcaccccgggctacgtggcccccgagaacgtgctggcccagggctacaacttctccgtggactggtggggcctgggcgtgctcatgtacgtgctgctgacggggcgccagcccttcacctcgcccaagaccgacgaccccatggtggtcatgcggcgcatcgtggacgagaagttccgcatcgccttcccgccctacgtccaccccgtcgccagggtgaggggttccgtcgtgctttcgtggggggggttgctggcgcgggggtccgatggaaggagtccgtgcgcatgtcgccacgagtag

SEQ ID NO: 3237 - DNA, 192 bp, Chlorella protothecoides
atggtgctggggacgggggccttctcccgcgtctgcgtcgcgcgtgacgaggccaagggccgcacctttgccctcaagcgcatgcgcaagtctggcgtggtgcagtgccctgagcatgtcttctgcgagcagaccatcacgcgcaacctgacccaccccttctgcattcggcagccctccttcgccgcatga

SEQ ID NO: 3238 - DNA, 300 bp, Chlorella protothecoides
atgcgggacatcgcagttcaccacaatcaccctcactccaacccccggccaacccaggccgtggaggagagagtgagcgggccgggcggccgcccgctgctgctgcgccagctggcggcagaccacgcacacgtggcgcgcgccacgcgccgcgacaacgcctacctccaggacgtgctgctggactgggcgcgctggagatcccccgccgacgacttcatccaggtgcccgcgccggcctacaccgccgcgcgccccgtcggttccgcgcgcacgcgccgcggccgcgagggcggcgcc

SEQ ID NO: 3239 - DNA, 939 bp, Chlorella protothecoides
gggcccgcggcggggccgctgctgcacagcgcgcgtcgctaccatgaccccaagaagggcgtgctggggtgcaggcactaccgccgcgccgcgcagctggtggcgccctgctgcgaccgcgcctacgtctgccgcttctgccacgacgaggccacggaccacgtcctggatcggtatgcggtgtgcgaaatggtgtgcatggagtgcagcctgcgccagcctgtggcaggtgcggtgcggtgtgggcgcggggagagggggcgacggcagagtggggcgtcgtggaagcatgagaaatgtgtgacccctgctctgggggataccatggacacatctgtgggccaccgcccccaagtcgccctttctcgaagcgttcaccctgccctttctacacactcaggctcgtgctcggggtgcggcacctgcatgtcacgctactactgcaaggtgtgccacctgtttgacgacgacccgggcaaggccatctaccactgccccttttgcaacttctgccgccaggtgcgtgggtctggggccgtctgtggcttgaagtggattcagggggccatggaggaggggggttgcatgggctcctgtttacggtccaccacgcctgcgggggcaacctctttacatcctggggcggatctcaaccatccgtctttgctcgtcagatgcagcccaaactgcccccgtttgagaatggacccccgccccctctctccctgtcttccacccgcagggcaagggcccgggcatcgactccttccactgcatgtcctgcaacgcgtgcatgagcctggagctgttcaacaagcacgtgtgcaaggagcagagcctgaagcgggattgcccagtatgctccgacatgctgttcgaatccaagcaccccgtcaaggtgggtttgcttggttgttgttgggagtgtgtgctagttga

SEQ ID NO: 3240 - DNA, 1149 bp, Chlorella protothecoides
  modified_base (123)..(183): a, c, t, g, unknown or other
cgcgacgcgcgcgcggcgacggccgcggcggccgacgcgttgggcggcgacgaggccttcgaccccttcctggtcatgtccacgggcgtgatcgggcggcgcgtggacgccgacgcgctgtcnnnnnnnnnnnnnnnnnnnnnnnnnnnnnnnnnnnnnnnnnnnnnnnnnnnnnnnnnnnnncgcactgcccgtgctggcggcgggcctgggcgctggcgcggggcacgcgctgcgcgccgcggtggccatcaccaccaccgacctggccagcaaatcagcggcgctggaggtggagctggcgcccgggcgcacggtgcgcctgggcggcatgtgcaaggggtcgggcatgatccaccccaacatggccaccatgctgggcgtggtcacctgcgacgcgcccgtggccgccgccgtttggcgccccgcgctggccgccgcctgcgccgcctccttcaaccagatcaccgtggacggcgacacctccaccaacgacaccgtgctgggcctggccaacggcgcggcggggggggcggcaataggggaccccaactcgcccgaggcgcgtgcgctgggcgccgcgctgaccgtccttctccagggcctagccaagtccattgcctgggacggggagggggcgaccatgctgctggagtgcacggcgcggggggcgcggagcgacgcagacgcgcgccgcgtcgcgcgcagcgtggtcggcagctccctggtcaagagcgccatgttcggccacgacccgaactgggggcgcatcgccgcagccgccgggagaaaggagctgcgtgtgactgttccctcgcccgccgcgcaccaccgccaagcggcagaggagggaggcagtgctggcagtactcaggggtggactaccggcaggaggacgttcggatcagcctgggggacacggagctcatgcgcggcggccagccgctggactttgacgcggcggccgccagcgcatacatgaaggcggcggccgccgcccatggcaccgtcaccatcgaggtcagcattggggatgggcccggcgtgggccaggcctggggctgcgacctgtcgtacgactacgtgaagatcaacgcgggtgagggggcatggagggcttgggggcatgggtggggcagtgccatgtga

SEQ ID NO: 3241 - DNA, 1839 bp, Chlorella protothecoides
  modified_base (98)..(107): a, c, t, g, unknown or other
  modified_base (336)..(345): a, c, t, g, unknown or other
  modified_base (1033)..(1042): a, c, t, g, unknown or other
  modified_base (1721)..(1730): a, c, t, g, unknown or other
atgtgcccatgtacagatggtggtgtgcgggggagtccaaatccatcagatcccaaccttcccgctgcacggatgagcatggactggaggggggacgnnnnnnnnnntatcagatctcaagcttcccgctacacggatgagcatggactggaggggggacgatgcagatgttcaccagtacacgacatgagctgcgaggatgggcatgcagggatagtgcgatgggtggaagctgcccgtcatgctcaggtgcggggagggggtgcaccgccttttgagccccgaggaattggcggatatgtacactcaccacgccccggacccttaccgcaggannnnnnnnnnacagcaccagaggacgtggcctcgatactggacgaatccgagcaggatgcggtgattcaggagctggcggcccaatccgcccgagcacggcgccagacccagctctgcgtgaccccgctgggcgcctgcctcgccctcctctacctctacttcgcggggcaggccctggttgatccatggtccatacgccaccacgccgagctccgagacgtgctgcgtcccctagccatcgcggcgggggacctgggcagcagcattgccgtggctgccggcacctgggccgtggcggcatactgcaaccagtcggagcaccagggccgcgccatcctgcgcccggtcgtggtcctggccacgctcatggccgtcttctggtccctgggcatcctgaagatgctgcgcctgcgcggcttcgtcctggacggcgcctggcgcatgttctggctccccgccgcccctgccgtctggaccctcatcacactctccgtcatcaacactgtgggggcagtcgagcgggacctcagagcgctgagggctgcccggtacagtggtcctcccaatccaaacgaggatgccaggatatctgtaggtggtctcgtaggacctcagcatatcctgggatctctgccgccctgctctatatgcttgcccttgttttttgcatggtccctgccactcctcatcctggcannnnnnnnnnggggacagggtcctaaactgagattggggcctcaaatcccccagagtggtcctcccaacccaaacgaggatgccaggatatttgtgggtggtctcgtaggactccagcatatcctgggacctctgctgctctgctctatatgcttacccctattttccgcatggtccctgccactcctcatcctggcaagtcacgctcgaggtggacaggactctccattgtttcgtggctccccttttgttgccttcaccaggacttataggcctattagccgcggcttttacagagacgagactcatgctggtgtcggtgtgcgttcagacccgtcgagccagaggctctgggtgggagatgtgagggggaggaaaatcgatgccatgcccgatcgggtggcaggggctgacgaatggcaatggtggagggaacgtgtggagggggacccgtggacgccgctgcctggaaatacatcacgccaagcccacggcctggcggacctcatcgctgagcgggacgtgcaacgtcttgcagtatgcctccagcttggccgcgccgtcctcgaaggaatcgagcaccgtgtacgtcttctggtacctggggatcggattgggggaagaggcgggaagggttcacactctgccattcaagatgtgaggatggtgtgggtcctccatgggcatgnnnnnnnnnnaagaggggggaagggttcaaactctgacatcaaagatttgaggatggtgtgggtcctccatgggcatgacgaggatggcgagcaatgcatccgcatcgcatctggatga

SEQ ID NO: 3242 - DNA, 1686 bp, Chlorella protothecoides
  modified_base (812)..(821): a, c, t, g, unknown or other
atgtaccttcaagatggcgtaggggtcggccttccccagccaggtggggtcggtcaggttgtgggcgctcttgatgttcacaatcagcttggcgttgaaaagggtctgtatcgatgctgtaatgggtcacgcaaaggtaaagaccacttcagcttctccttaccgcccacatggtgcgcagcttccatcaaacgaacgaaggcgcgggcgggagcggtaagtttttcagtccacgtcgcacgcggcccgacaggagccttgaacgagggaggcaacgatgtggcagggatgtgccgcgcaagtgtggtaaatgaactgaaattagaaagtaacctcaagatggctgttctcacccggtgtgatctgacgatctcggcactctcctcctctcagtcgtttcgtggaggacgctgctcgacatggcccactcaacgaaggaggatccaattacaggctggacgaggtgtgtgggatccttggaggcatgtcgaatgtccttattctgcagaaaagccttcgtgcatcgcagcgacttttggcccatgcccagtggcgtcagcagggacagtgtcggagaccccccccgcggcctcgatgccacagaaggcacagcccgcccccttcaagattccaaaatccctcagtgaggtcgataatggaaagatcctaggctttggcgcagagttggcggaaggacaccccggctttgccgacgaggcatacaagcagcgacgagtcgacatctgtaaaatcgccagcaagcatgagatgacgcctgcgtgtggttcaatgcgccagcttggctggtggtnnnnnnnnnngggctgtggcatgatgtggagtgaaggacggctgcgtgtgcttcaatgcgccagctgggctggcgggagagggtgtgccagtcaccactccatcaggagcatgatcggatgcccatgtatgtcaggctcagaccagtgtctgcacaggcgcccccatccccgccatcgagtacacggcggaggagacggcggtgtggtcctacgtcatgaacgagctggcggagctcttccccgcccacgcctgctccgagttcctggcctcctggcgggagctgggcttcagcccccgccgcgtgccccagctgcaggaggtctccgagttcctgcaggcccgcagcggctggcagatccggcccgtggcgggcctgctccacccccgcgacttcctcaacggcctggccttccgcaccttccacagcacgcagtacatgcggcatggggccgacccgtgctggaccccggagccggacatcgtgcacgagatgatcgggcacgtgccgatgctggcgcaccccgccttctgccagctggcgcacgccatcggcgtggcgtccctgggcgcggacgaggcccagatctggcacctcaccaagtgctactggtacaccgtggagtttggcgtggtgcgcgaaggagacggggtcaaggccttcggcgcgggcgtactgtccagctacggcgagatgaagaacatggcctcaggccgggccggcctgcgcgagttcgaccccttccagaagcagcccaagatgagctacagcgacgggtgcggcggaggaggggcgatggaggaggaatgggggtgcatgaacgtcgctgggggggactgcagggccgcatgccacgctggaagtgggggctgtga

SEQ ID NO: 3243 - DNA, 1005 bp, Chlorella protothecoides
  modified_base (423)..(432): a, c, t, g, unknown or other
atgggaggttgggacttcccaaatccgtgttccagcttgttgcctgcatggatgctcacaatcttcttgccatcttccatgatgcaggtggctggcgctgagatccagacccatcacatcaagaacgccggcgagaatgccacctgggacgagacgcacaccatccattccacacttcctcccacacctgcacactccctcagctttgccttcaacaatgtggccatcgaggacatcctggagctgagtgtgtacgactacaacaaggtccgcaaggacggcattatgggcacggggtccctggcgcttcgcgaggccttcgaggaggggcgtatcgacacgcgcatcccgctgtccaacaagaccggctccaaggatgctggggaggtgtggatcaacatccgcacggagggggtcatccgnnnnnnnnnnaaccggctccaaggatgctggggaggtctggatcaacatccgcacggagggggtgagacctgggcggtccttgtgttccccggaggggaagagggcgacatcgttgctgcaatgaggcctgctccaggtcatccgtcactcaatctcctgcctgtcgtgctgggagcagttgtccctggcctgccctcaacctggagtcctcggaggtccttccttctgcattgctccagtcgcccaacggtggcccaggccgccgggctggagaccgacttcaaacccctggacatggacacctcccgagaggcgcactccgcggcagacaggcagggcgtggatgacgctagcggtggccagagcggcgccgcgtggcagtcgtcgcagacgggccaggtggccggcgttgaggggttgaccaagaagaccgagggcctggggctgggcgacggcggcaatgtgcgcaagggcgaggaggtcgtcctgggccaggacaagtacaccacggtgagagtggggtctttgttaaatgctgtgcacgactggcatcagcagcaacctgttaagagcactcagtga

SEQ ID NO: 3244 - DNA, 441 bp, Chlorella protothecoides
atgcattatggggtggcccctcccctaaatctctttcggcttggtctctctcgctcaccctgccaccccctctacacatatacctccacagaccgaggaccggtcggtggtgaaggagcgggtggaccacttccgcgagcaccgccccgtggagaaggagtttgtggtggagacgcgcgccacgggccaagagcgcgacctggtggaccaacgcgaggtggagtccctgggcgtgaaggagcggatcctgaacgaggagcccatcctctctggcaaggagaccagcagaagcaccaccacgaggaccgagcagagcaagtgaatcttgagtggataggacaggtacgctccccttatgcatcaccactccttgcactacgccatgccggcatggctaccgtcctgattgcactagtcaacccctgcctacatgttgcatga

SEQ ID NO: 3245 - DNA, 918 bp, Chlorella protothecoides
  modified_base (197)..(206): a, c, t, g, unknown or other
  modified_base (756)..(814): a, c, t, g, unknown or other
atgatggtgtgctgcacagcatgtcacgatcgggcgaccaagccctggccggccagctcattgatggctacccagatgggagcctgctctgatattacttgcacaaagtatatctccaatgtcgcatcttcactcgatgcttggtcgaggcatgacgcctgccccatcattgtccgggcggtgcatcatgaagggtnnnnnnnnnnagagcctgctctggtattccttgcacaagatatatctccaatgttgcatcttcactcgatgcttgggcgaggcatgacgcctgccccgtcattgtccgggcggtgcatcatgaagggttgcgctgtgtcaacaacggcaccaatccactcattagcgccccaaaggcctgcaacaaggtatcaactgtacttgaacacatcgcatgagaagctcggacggtccagccgtgcgcaggcggccgataaccaccggaaccccgcagagtcggacccacgcagcagggtgtcatggagcatggcggacagcgatggcatccgatcagcggtcgtcatgctgggcgcggcagcgctcctcctgggagcctcggatgcctcgctggcatcggaggctccccatcaacacccggccctgaacatggtggtgggcaacctggcagacaacgatgctttctggccgaatgtcctacgatacatcagcttcttcttctccgtgctgctgggcacggcctacgtcgccatccagcccatcatcaaactgctcaagaaaccnnnnnnnnnnnnnnnnnnnnnnnnnnnnnnnnnnnnnnnnnnnnnnnnnnnnnnnnnnnctcgcctttgccctcttcctgctcaaggggacggtgtcagcgatgctgggggtggggacggcccaggatctccctcccctctgaaaggcatccctcttatgtga

SEQ ID NO: 3246 - DNA, 891 bp, Chlorella protothecoides
  modified_base (156)..(165): a, c, t, g, unknown or other
atggtgcaagccgggcgtttgcttggagcgtatggcctcgctgcctcgactttcccgtccatgaaatgcagcatcaactccacactgcaagctcaacactgcgcaaaatgcctttgccacaggatgcggaggcccacctggcgcaccactttgacnnnnnnnnnngtgcagcatcaactccactctgcaagctcaacactgcgcaaaatgccttcgccacaggacgcggaggcccacctggcgcaccactttgacagcatccaggacatcgcggacaccaccaccatgccgtccctcctgcctgcgcttggggcggcggtgacccgcagcaccggggtccagcccttgctggagcgcttgcgggcaggggtctccggggacggcgccccgctctccgcggctgacaagctgggcgtttgggaggagctgaaggtggcctccctggcgcagctcctgctcaccacccgcctgctcccactgctggcgctgacggtgcgctgccagctcaacgtgctggggcgctacctctacctcgagtccgcgctggaagagcgcgggcccggggccgtgggcgtggcggtgccccgcctctccacgccctcgcaggagcgcttcctgtccttcgccgaccacctggcgcgggagggccacgcgcgcctgctgccggcggcccggcgcgcggcggctgcagcgctggcgggcctgcagctccacgccgggctggacggcgccgaggtgctgcggcgcctgtccgccgccctggaagccatgtctgccagcgaggaggacgcgggtgaggggctgttcctgtttgtgtgtgccactgccggatgctgcggcgtgtggcttggggagggccagggtgcctgtcagccggctccagagtcgtag

SEQ ID NO: 3247 - DNA, 465 bp, Chlorella protothecoides
atgcgtggtcacctttggtacattccccctccctcgcccactccagcctggagggagatggtgctgccctcgccggcggcggtggcggcggcgctgactgtctcggcgccggatgacagggcattgctgccggggtcggaggggctgcttgtggatgctgagaccgtggaaggcatgctgggggaggtgcggaggacactggacagcgcatgctttgcgagagtcgcccaggtgtgcaggggtccgcccggggctggaggggaggcagaggcccttgcttgtgggtggggagtggtcaggcggagaatgtgctttggggaactggttgtcatggacacgcgtcgctcatggtttgggggttggagacctcagggaggcgcggcgagggatgtcacaccagtcgtcacgctctctggaccgccgactgccaggatgcgaggcgccggccggccgggtgctctttga

SEQ ID NO: 3248 - DNA, 444 bp, Chlorella protothecoides
atggagctccgggacctggccagcggcgccaagcaccccgccaagttccgcccctcggagagcgtggaggtggtgcacctggagagcaggcggtacacgtgcctgtatcgcgagggcagcctactgcacgccatggatgccgccacgtacgagcaggtggcagtggaggccagcctgtttgacccgggctcggcctacctggtggagggcatggaggtcagcatggctttccacgacggccggcccatcgtgggcgaggtgcccgccaccgtgaccctggaggtgagggaggcggccccgaccatgaggggcgagaccgcggcgccgtcctacaagcccgcagtgctcgaaaatggggtcaggatcacggtgcccccctttgtggtggccggggacaaggtggtggtcgacacacgggaggggacctttgtgaagcgggcgtga

SEQ ID NO: 3249 - DNA, 1218 bp, Chlorella protothecoides
atggacgaggccctgacgcacaaagccgggcccagcctgcggccattcgagggcccaaccacccgctcccgcaagcgacgactctctcagcaagctgttgacgcagaagatgcagcccgtcgccaggtgtgcagcggcagcttgggaaggggggccaattggtatgtgcaggtgcttctgcagcccaaaggtgtacggcatcctcctcgccagacggctgggtcgcgaagatgcttctcattcaccattcaaacccggcgtgccccctcatgctgcacctcaggtacgctgccccagcctgggggactggagcctgtgcctgtacatccgctggacgacgctgtgcggggacagcaaggtcacgcggctgcccctgcgcctgatctcctccatcgagcagctgcagggcctgttcaggtgcgtgctggggttgcgctagtgggcgtgtggggtttgaggtccagccgcctcgtctggctgcctgggaggcagcaagtctgtgatccctccgcccctccagcaaaatctcacagcttcttccccccacacaaatgcagccgcctgatccggcacgcctacgacggcagcgatctgcccgacttcctcacctcccccgccttcctcatgtgcacgcccctggaggagtttgtcagcgtgcccagcgccctcggctccacccacttccggctggtgctgctggcgcaggacgggtgggagtacaccgtggcagagcgcgacctgtcttcccaccccgaccccgccgccgacctcatggtcacggtgagtgctgtggttgggcatgtgggcggtgttgtgggagggaattcagctgcgcatccgggctgtcccagttcaggactgtcaggaggcgcagccgctcaggccacaattccagccacaataccagccacaatgcagcagagcagtgctgggaggccggtcaggcattcagtttccagctgccaatgtccctgcaagggagggggagcgcagcgtccccatgcagcccatcgcagcgctcgaacccccccgctcccacccaggctcacccccgccttcacccccctcatcacacagatggcggagttccagagcaatgccctggacctgggggaccacgaggtggtcttcaacatggtcagctaccccacggtgtgcgtgcagcgagaggtcgtggagcgcatgatcgcgcgctgcgctgaggacccgtccgcctaa

SEQ ID NO: 3250 - DNA, 366 bp, Chlorella protothecoides
atgccctgttcctctcgccccccttgcagcctgtatgtggagtccatcgacctgggagaggaagggggccctcgcacaatcgtcagcggcctggtcaagtttgttccgcgggaggaactggagggacggcaggtggtagtccttgccaacctgaagccgagaaacatgcgaggcatcaagtcggccggcatgctcctctgcgcctcgaactcggagcacacggaggtggagccgctcctgccccccgaaggagcccaagtgggagagcgagtgtggtttggggatgccagcgagcaagcagaggcagcacagccaaaccaggtgcgaatggtgttggcaatgttggccaggccgtatagggcctga

SEQ ID NO: 3251 - DNA, 1998 bp, Chlorella protothecoides
  modified_base (173)..(182): a, c, t, g, unknown or other
  modified_base (984)..(993): a, c, t, g, unknown or other
  modified_base (1794)..(1803): a, c, t, g, unknown or other
atggtgagccccgggactgtggcgggagggtggccatgcgtgcgcagcctgccatgcacacggtgcatgaagcccgctccagctgcactcggccagctgcagcgcacattgccagggtctgccatcccagaaagcacgccagggtctacctcccattctcctcgacacagctnnnnnnnnnnaggactgtggcgggaggatggcaatgcatgcgtagcctgccatgcacacgctgacttgtacgatgtcgtcgactggatggaccccagccagcgcccttcctggtccgagggcgccagctccgacccacatgaggacgaggcagggcaaaagggcatgggaaggcgacacaggcgtgactctgtgcgtgcgtccaagcctgcatcacaggctgcagccgagcgactattcaaccaggcctgcctggaggcgtcgtggtggcagcaaatttgccggcattgtgccagccatgtcctcaccccaaccatcaccctctctgcctgttgtggtgcagctggccacgacgggaaagtgctcggccctgatcaagctggcgccagacctctccgaaatctactttgggcactccacgtgggacacatatacgtaggcaatgggctggaatgggcaggcttgcggactggcctgccagggtgtgcaccagagacatcgtcccctctgtgcacccatgtgccacctgacccacctcccgccgcccccccatccgcgcatagtgcaatgctgcgcatctacaagcactacaacttcaacctgaccgagctccgccctgctgccgatcggatgtccttctccagctaccctggggagctgttctcggacgacgacttttacctcctcagctcagggctggtgatgctgcaggtggcaagatgggatttgctggggattggggtggcttggcggggcagtggcaaggtgcggtcagagacgtgggacaccactttgcaagatgctcgcctgctnnnnnnnnnntttcccatggcgaggagtgatagctgccatccttgtgaagagtgggaaggtcggagacataggacaccactttgcaagatgctcgcctgcttccagccgtctccaggttcccctccacccgggtttcccgccctccctcagaccacgaacaagatcttcaacgacgagcttttcgagctcttgagcccgagcaccgtgctgagctggcagcgcatccgcgccgccaactggctggcgagcagcggcgaggggcggcgcggggccaccctccccgaccttgctgtcctatgttctctcctgccctctctcatgcggcccgcccacgctctccaagcctcccaccctccaggagtgggccgcccacctggcccgccacaacagcggcacctacaacaaccagtacatggtggtggacctggccaggttcaaggccggccaggtcctcatgcccggcctgctggtggtggtggagcagatccctggcctggtggaaagcgcggacgagaccgacatcctggcgggcgggcactgggcctcctacaacgtgcccttcttccccagagtgagtcgacggtgcacctgtcggagggggccctgccgagtctcaataccatcaggcacttcgtcaccacttgcatcccccccggccactcagatctacaacctgtctggctaccccgacatggtctccaaggccgacgcccatgggcagcacttctccaaggtgggtggggactggtgaagtgggttgccgcgcagctgaaaagggtgctgtggggatcctcgtgcatagccgccccnnnnnnnnnncggcgggggctggtgcagtgggttgctgcgcagctgaaaagggcgctgtggggatcctcgtgcatagccgccccttgctgctgtggccacacaggtcacctgccccgccctagcaccctgttgcaatgcagccccagcccccgcaggcgggccacgggtgacgccatttcgtcagatcctccccaatgccccccc

SEQ ID NO: 3252 - DNA, 1398 bp, Chlorella protothecoides
atgaagacggggcgcgacatcgtcgtggccgcgctcctgggcgcggaggagtttgggttcgccaccgcccccctcatcgcgctggggtgcatcatgatgcgcaagtgccacaccaacacctgccccgtgggcatcgctacgcaggaccctgtcctgcgcgccaagttcgcgggccagcccgagcacgtcatcaacttcctgttcatggtggcagaggaggcacgcacctacatggccgacatgggcttcaggagcgtgcaggagatggtgggccgcgccgacatgctggaggtggaccccgaggtggtggccgccaaccccaagcttgccaacatcgacctgtcccgcctgctgctccccgccgccagcctgcgccccggcgcggcccagacctgcagcgagaagcaggaccacgggctggaggcggggctggacgcggagctgatcccgctgtgctccgccgcgctgcgcccgcggcgcgaccaggcacggcacgtcttcctggaggcagcggtttgcaacacgcaccgcgccacgggcaccactctgtcgcacgaggtgaccaagcgctacggcgcggagggcctgccggagggcaccatccacctggccctgtccgggcacggcgggcagagcctgggcgcgtggctctgccccggcatcacgctggagctggagggcgactccaacgactacgtgggcaagggcctgtccggcggcatcattgccgtctacccgcccgccgtctccgacttcgagccgggggagaacatcatcgtgggcaacgtctgcctctacggcgccgtctctggcgaggcctacttcgcgggcatggctgcggagcgcttctgcgtgcgcaactccggcgcgcgcgccgtggtggagggtgtgggcgatcacggctgcgagtacatgacgggcggcaccgtggtggtcctgggcggcacgggcaagaactttggcgcggggatgtcgggcggcgtggccttcgtgtacgaccccgaggcgcgcctgcaggcgcgctgcaacccggatgtcgccggcgacctgttccccgtggaggacgaggaggacgtggccgcgctgcgcagcctgatccagcggcatgtgcgcttcacgcgatccgcgaagggccgagcgctgctggccgactgggacgcggcggtgcagggcttcgtcaaagtgttcccgccggactaccgccgcgcgctggccgagcaggccaagctggccgcggcccagcgcgggcaggaggaggtgctggccggcgccagcaccgacgatgcgtttgagagcctgaagcgcatggcgctggaggtggtgcgccgcggcgcgcaggtcgtggacaccacggcggcgccggtgccggcgcgcgcgcctgccccggccggcgccgcc

SEQ ID NO: 3253 - DNA, 1305 bp, Chlorella protothecoides
  modified_base (156)..(165): a, c, t, g, unknown or other
  modified_base (1034)..(1085): a, c, t, g, unknown or other
atgaagccaactcgacagggtctgggggaggatggtgcgccaccccaaggaagtgcaaacggcccgcacctgcaaacctggtcagggcaccccttaaccacccagcacaaccaatacgcccaccaactcacccgcagcacggtcggacagcacgannnnnnnnnnaccgcaccggctcgcgtctgcgtggcgtgccaaggcgagggggtgagttccggaagtaggcaggggtttgagggggtcacccttgcatacatgaagccaactcgacaggatctgggggaggatggcgcgccaccccaaggaggtgcaaacggcccgcacctgcaaacctggtcagggcacctcccaatcacccagcacaaccaatacgcactcacccgcagcacggtcggacagcacgatgaagtcgacgccggcctcaatggcggcggcggcctcgtcgcagatgcgcgccagggcggcctccaggccacctggcccctcggcgacaggccaggtggcgtccaccagccgcgtctcccagccgctgtaggtcatgtgcttcatggcctgcatctccaagggccgcagcagcggctgctccagctccaggcggtgggcctgggactgcccggtctccgtcaggtcgccctccggcccgatcatggcccgggtggaggtgacgaggcgctcgcgcagcgggtcgatcgccgggttggtcacctgggcgaacagctgcttgaagtactcggacagcagcttggggcgctggctgatggcggccaggggcgagtcgttgcccatggagcccagcggctccgccccagacttggccatgggcagcagcagcacctccatcgcgaggactgggtgccgaggagtgggaacgcccaccccggaaaacatgcatgcactgttctggccccattctttggcctgccagcgaggtgcaaggggcacaagagggctgagcggctcccgactcacggtatagccaaaggctgtgaggggcttaagcaggcggtggatgccggagacaccgtcggagggcnnnnnnnnnnnnnnnnnnnnnnnnnnnnnnnnnnnnnnnnnnnnnnnnnnnncacccttcacggttggcagctccagcaccgctgggtccaccgactccacgatgcggtccagggtgaccacctcatcctccagccacttgccgtaggggcgcgcagaggcgtacttgtgcttcatctgcaggtcgggagtgggaaggagaggagggggccgtcaggcacttcaggatggcaacccatcggccaagaggagggtcggtgggcgcagtcgtga

SEQ ID NO: 3254 - DNA, 2070 bp, Chlorella protothecoides
  modified_base (73)..(82): a, c, t, g, unknown or other
  modified_base (1378)..(1387): a, c, t, g, unknown or other
  modified_base (1984)..(1993): a, c, t, g, unknown or other
ttccccccacccccaccccccggttcgccatttgaggcaatcaactgcgccagagattatccagctctcgaannnnnnnnnntcgcccccttccccccacccccaccccccggttcggcatttgaggcaatcaactgcgccagcgattatccaactctcgggaataagctatttgcaaccggcgcaagcccggtaggggaacaagggtattcccgtgcattgcaatcaattgctgacggcatagccaggaggctgacttcggctccatccaaggccggaacactcaaccctagtccgctcggggcggaccgccccccgcagcatcatgcagcaagcgcgactacagggctgtcgcctgcagtcgggctcgccatgcatgcccaatgcgcagggtgtggcacccctgcgcaccttcacagggttccgctcggcgcaaggggcccgaaacgtgaccgaactcccctcatcgccgccgccgtcaaccaccctgtgccctccccctcttccccgcaggtggtctccaagcacagcgccatccccgaggcccagggcctgttcgaccccgccaacgaccgggatgcctgcggcgtgggcttcgtggccgagctgtccaagaagccctcccgtgccacggtggaggacgcgctggagatgctggtgcgcatgacccaccgcggcgcctgcggctgcgaggagaacacgggcgacggcgcgggcatcctggtggccattccccaccccttcttcgccgaggtgatggccgacgaggcctgcttcgacctccccccgcccggcgactacggcatcggtcaggtgttcctgccccgcgacatcgaggaggccaaggccatccgcgacatcatcggcaacgtggcggagcgcctgggcaaccacgtgctgggctggcgccgcgtccccaccgaccccgccggcctgggcccctccgcgctgtccaccgagccggtggtggagcagtttgtggtgtcccgcgccgcgcccggcgcgggccgccgctcgcgcggcatcgagcagcagatgtacctcctgcgcaagctgatcgagtccaagctgcgcctgcagcacctgggcgacgacgacgtgtacatctgctcactgtcttcgcgcaccatcgtgtacaaggggcagctgacgccggcccaggttcccggctactaccgtgacctgcaggacccgcgcttcacctcctacatggcgctggtgcactcccgcttctccaccaacaccttcccctcctggcaccgcgcgcagcccatgcgcatgctgggccacaatggcgagatcaacacgctgcgcgggaacgttaactggatgcgcgcgcggcagggcgtcatgcgctgcgaggcgctgggcctgcccnnnnnnnnnntggggcacaacggcgagatcaacacgctgcgcgggaatgttaactggatgcgctcgcggcagggcgtcatgcactgcgaggcgctgggcctgccggagcgcacgctgcagaagctgctgccggtggtgccgccggggcagtccgactccggctccttcgacgctgtgctggagctgctggtgcggtcggggcgcgacctgcccgaggccatgctcatgatggtgcccgaggcctggcagaacgacgcgctgatgagcgaggagaagaaggacttttaccgcttccactcggccatcatggagccgtgggacggccccgcgctcctctccttcaccgacgggcgctacatcggggccacccttgaccgcaacgggctgcgcccggggcgctactacatcaccaagagcggccgcgtcatcatggcctccgaggtgggcaccgtggatgtggaccccacggacgtcgcgaagaaggggcgcctcatgccgggcaacatcttcctggtcgactttgaccgccactgcgtcgtggacgacgaggcggtgagccggaggggggcgggtggtttgggtttgggaggaagcacgctgagaaggnnnnnnnnnncactgcgtcgtggacgacgaggcggtgagctggaggggggggggtggtttgggtttgggaggaagcatgctgagtag

SEQ ID NO: 3255 - DNA, 504 bp, Chlorella protothecoides
atggaggtgctgctgctgcccatggccaagtctggggcggagccgctgggctccatgggcaacgactcgcccctggccgccatcagccagcgccccaagctgctgtccgagtacttcaagcagctgttcgcccaggtgaccaacccggcgatcgacccgctgcgcgagcgcctcgtcacctccacccgggccatgatcgggccggagggcgacctgacggagaccgggcagtcccaggcccaccgcctggagctggagcagccgctgctgcggcccttggagatgcaggccatgaagcacatgacctacagcggctgggagacgcggctggtggacgccacctggcctgtcgccgaggggccaggtggcctggaggccgccctggcgcgcatctgcgacgaggccgccgccgccattgaggccggcgtcgacttcatcgtgctgtccgaccgtgctgcgggtgagtgcgtattggttgtgctgggtgattgggaggtgccctga

SEQ ID NO: 3256 - DNA, 1473 bp, Chlorella protothecoides
atgaggcgccccttcttcgcgacgtccgtggggtccacatccacggtgcccacctcggaggccatgatgacgcggccgctcttgcccgttgcggtcaagggtggccccgatgtagcgcccgtcggtgaaggagaggagcgcggggccgtcccacggctccatgatggccgagtggaagcggtaaaagtccttcttctcctcgctcatcagcgcgtcgttctgccaggcctcgggcaccatcatgagcatggcctcgggcaggtcgcgccccgaccgcaccagcagctccagcacagcgtcgaaggagccggagtcggactgccccggcggcaccaccggcagcagcttctgcagcgtgcgctccggcaggcccagcgcctcgcagtgcatgacgccctgccgcgagcgcatccagttaacattcccgcgcagcgtgttgatctcgccgttcgcctcgcagcgcatgacgccctgccgcgcgcgcatccagttaacgttcccgcgcagcgtgttgatctcgccattgtggcccagcatgcgcatgggctgcgcgcggtgccaggaggggaaggtgttggtggagaagcgggagtgcaccagcgccatgtaggaggtgaagcgcgggtcctgcaggtcacggtagtagccgggaacctgggccggcgtcagctgccccttgtacacgatgatgtacacgtcgtcgtcgcccaggtgctgcaggcgcagcttggactcgatcagcttgcgcaggaggtacatctgctgctcgatgccgcgcgagcggcggcccgcgccgggcgcggcgcgggacaccacaaactgctccaccaccggctcggtggacagcgcggaggggcccaggccggcggggtcggtggggacgcggcgccagcccagcacgtggttgcccaggcgctccgccacgttgccgatgatgtcgcggatggccttggcctcctcgatgtcgcggggcaggaacacctgaccgatgccgtagtcgccgggcggggggaggtcgaagcaggcctcgtcggccatcacctcggcgaagaaggggtggggaatggccaccaggatgcccgcgccgtcgcccgtgttctcctcgcagccgcaggcgccgcggtgggtcatgcgcaccagcatctccagcgcgtcctccaccgtggcacgggagggcttcttggacagctcggccacgaagcccacgccgcaggcatcccggtcgttggcggggtcgaacaggccctgggcctcggggatggcgctgtgcttggagaccacctgcggggaagagggggagggcacagggtggttgacggcggcggcgatgaggggagttcggtcacgtttcgggccccttgcgctgtgaattcagaaaaatcaaccccatccagacccacctggagtgctccgccgcgaccgaccctgctgggggtgacgcgcagggtggggatcgcccgaccgtgcctctga

SEQ ID NO: 3257 - DNA, 1356 bp, Chlorella protothecoides
atgcccatcccgctcccgcctggagacccttccgccgtggaatggtcgccctcgaggtcatgtccgaagcgggcccggtcggagcgcctgctcccacccagaccctcagggcaccccgcccatgaggaggtgagtgcggcagcagtcctgctgggcatcgcagtctcctcggacgagggcggcgacggggcggaggcagaaggccccaacggcgaggcgcccacccccaccagttccccccccaagctcgagccggcagcagaggcgcagccgcccgcccctgccccggcaacagaggcgacgccgcccgcccctgccgcggcagcagaggcgacgccgcccgccccgcccgcggcagcagaggcgacgttacccgctgctctcgtggcagaggaggcgacgccgcctgcgccgcccgtggcagcaggggaggagaacgcgatccccacctttgagcccatggaggaggacgccgtggcggtcgcgcccccctccgcccccacccctgctctgcctgaggagtcagagcctgggccattcgcggccgaggcctccctgccacctcaggaagaggtgcctgccctggccatgcctggcgccgatctggcggcctcccccacgcccgaggccaacccggcggaggatggggaggccggcgcgacccgcggccagcgacgcaagcgcgagtccaaccccccgcccgaggacaccccgcccttgctggacggcgcgcgcccgctgaccagcgacggctacgaggacgaggaggaagagggcgagaaggttgattgcggtgtctccaagggtcatggagccttaggtcaagggcgtcttggggccgctgcggcgcgcggcgagggtgccgcccccatccccccatccggtggctggtccgcggcggcggctgcgccgccgaagtccgagctgaccctgctctgcgagcgcttccagcgcaagtacgggcgcctgggccccggcggcgaaccgcgcgtgctgctgctcaacgacgtggccgccagcctggacgtgccgcgccgccgtctgtacgacgtgatcaatgtgtttgagtccatcgaggtgatgcgtcgcgtcggcaagctgacctacgagttcgcgggcttccagcacctccccgccctgctggcccagctcctggacgaggagatgaagggtgaggagggtggtcttgcatcgcgggtgtctctccgaggggggtggtttggaggagggttggctcggtggcgtgccagtgcaggggcgacggctgcggtggggggctgttccctccatgccatggtggcatgcctgcgcatgcacgctcagggggtcagaggcacagcgccaggcctcggcacg

SEQ ID NO: 3258 - DNA, 501 bp, Chlorella protothecoides
atgcggcagctggacgccgactgcgcgctgctggagcgcctgaacgtgatggactactccttgctcctgggcgtgcactttgtgcgctggggcaacgagcgctggtcgccgccctttggcgactggggtgcggctgaggccgaaccccccgccccggacgggcacacctggggacgcggctgcgacgcgcggtccctggccgccatcctgcgctccgcggaggaggagagcgggctgggcgaggcagtgcgcagcgcggccagcatgctgacgcgcgtggggcgcaccagcgtcgccgcctgggagtcggcggtgcgcctgtcgctgccgaagggggacggccccgcgtctgcaccacgaccccaggggagtgtggggcgctactattctggaggggcactgtccaggggtgctgctcctgttcctgtcgtggtaaaggatgctggacatggggtgggggtcctcggcactcggcggatctccctccctcccgaggtttga

SEQ ID NO: 3259 - DNA, 393 bp, Chlorella protothecoides
agtcgtgtagctgctcagggtgggggcggcgcacttggggggaggcgtatactccccggggcagacgcgccgcagatacttctctggtggccggatctcaccccaatatcaccacgcacggcccccagaccaccccacctccagctcgtcgtcaaaggcgcccgccgccacgcccgacttgctactgtgcgtgccggcgccgcccagcgcctcctgcgtcaccacctcccccgtgacagatctcaccacctcgggcccggtgaggaacatgtaggaggagtggcggaccatgaaggtgaagtcggtgagggcgggggagtacacggcgccgccagcgcaggggcccatgatgagcgagatctgtgtgaagtgggggggggaggaagaagatag

SEQ ID NO: 3260 - DNA, 948 bp, Chlorella protothecoides
atgttgcagctggtgcgggccgcgagcagggcgtcccgacacaccaaagcactcctgcccgctctcacgggcgcggcacgctggagcgcaagcttggcggagttcgaggaactccctgtgtacactctggacaacaaaaagtgggagcgcatcgtgactgccaagcaggccgcggaggctgggggcggccaggcccggatcgccaagcagcatgagaagggcaagctcaccgcccgcgagcgcattgctgccttcctggaccccgactccttcgtggaagcgggatccctggtccagcaccgctgcaccgactttgacatggagtcccagcagtactatggtgggttgggtcggtggcggggtgaccccacggcgcccggccgtgatctgacgctcctgatctcgacgcctctaaggttgggtcctccatttgaactcctgccctccgccgcatgcaggcgacggcgtgatcacggggtctggcacggtgtttggccgccccgtcttcgtattcagccaggacttcacggtgcatggcgggtccctgtcagagtcgcacgccctcaagatctgccggctgatggacagggcggtggctgcgggcgcgcccatcgtcggcctgaacgactccggcggcgcgcgcatccaggagggcgtgctgtcgctcggcggctatgccgaggtgttccagcggaatgtggacgcctccggggtcatcccacaggtgccattttggtaattctgtccaggagggttgagagtgcgaggttgcgggtgcccgcctgtggctttgtggcgtttgatgttcgatgctggatccttcgactcgcccctcttgttctggacagggtccagtccgacccgcccttgcgtgtcatggaagggtgtgggaacacttatagatgggaaatgtccaggctgtgcagcccccatcgccattgcacatga

SEQ ID NO: 3261 - DNA, 246 bp, Chlorella protothecoides
atggttggtggcaagggtgatgaaccgccgagggaggctgggtacccagacaagaggcgacgcatgccgaccataggtgccggggagacccgcgcgtgctacaagcatacatgccgcatccaaaagtgcctcagcgagaccaactacgacaacgctgcgtgcagctgggccatcgatgccctgaaggcctgctgcgagaagtatggcaaggacagcatccactgcgcctttcccaaagacgcatga

SEQ ID NO: 3262 - DNA, 582 bp, Chlorella protothecoides
ggcggggcgcgcgggcggcgcggcgctgccgcacgcgcgcgtcgccgcacgctgcatgggccgtctgctggtcgccgcgccgcacttcaactacaccaccgacctgctccaggcgctggtgccggtggccacctcgcgcgatccggagctcaggttcgttccaggggggcgtttccggtgcttgggggctgcaagggaccgactgccagtctcgacggcagttcccctgcacagcaccggtccattccagctggatccggctgccacctgcctcatacaccccatccgctcagctcaacccctgccctcccacccaggcgcatcgtggtggacgccctgcgctccctgctgagcagccagagcgccgacggcggcgtggtcaccgaggcggtccagctgctggcggacctggtgaaggctcgctcctgcgtctgcccgcccgaggtcgtggcggtgctggcctccgttcacaccgccgacatcaccagcgccaaggacttccagggtggggaggcggggtgggttgtgtgggggagtttgggggcgagggccttggggccacacgcgaatgtcgacgagtga

SEQ ID NO: 3263 - DNA, 2220 bp, Chlorella protothecoides
  modified_base (1663)..(1672): a, c, t, g, unknown or other
  modified_base (1776)..(1785): a, c, t, g, unknown or other
ggcggcgcggcggccgccgccgcgccgctgccgccgccgccatcccccgctgcggccgccatgctgtcctggcgtgcaggcgcagccgtgcacgccgcgcgtcgcttcggcgtgggcgtgctggccctccggcccttcgccctggtgccctacaaggccgcagggcgcgcgtggcaaggggctgacgacggactgtgcgaggcggcggccgcctggctggaggcgcggggcgtgcagctgtccgaccacgaatttttcgccagggcgctacgccgcgccaggccggcggcgggtgtggatgcgccccctcttgatctccatcgagtgcccaaagtcttggtatctgatttcatacccaatgtgatagcagcattgtggcgtgatgcgttcgcatgtaagccttccagccgcttccagccgcttccagcgcgcgctcccttgcgggcccccggtgcccggcatccgcccgactgggcggtcatgaggctcgggatccaaggcgagtgcccgcaccctctgccccctctacgacgtgccagggacaggcgcgggtcacgatacgctggagacgccaccatgcccgagaccagggcgcccggtgcccccaagtacgacgatggatgcgatcggacgttccatgggtcgatgctgcgtcgatgtggcctcaggagggctgcccgcctgggaggcatgcacgccaggcgccagcaccgatgcatggcctgggagcggggcatgcctctactcccaggtggtcctggccaggcccaaggcggggggcaaggaggtggccctgaagatcatggacaagcgctacctgatccggtgggtgcctggaggtgtgttgtacgcacctggcttgcagatagagcgccctggggtgggcctgcgggccggctgtcctggcaaacttggtgcttgctgctggcctgctctggtcgggcgtggccccatgtgtacgatagtcccaccttgctttcctccctgcgtgtgggccctggcacccagtttcctctctctccccccttcccccaaaaaccatctctctgcgcctgcaggcacagcatggtggagtacatccgccgcgagcgcgccatcatggaccagctttcgcaccccggcgtggcccgcctctacttcaccttccaggacgcatactccctgtacatgggcattgagcactgccccaacggcgagttgtacgaccaggtgcggctcaagcgcgcgctgggcgaggacaccgcccgcgtctacgccgccgaggtagtggacgtgctggcgcacctgcgcgcgcggggcgtggtgcaccgcgacctgaaacccgagaacctgctgctgacggcggaggggcacctgaagctcatcgactttggcagcgccaaggccctgcccggcggcgcggtggctgccagcggcgccctgtttgccgcgagggagagcggcgagtccggccgcggcacgcccgcgcgcagcgtggccgccacgcccagcgctggctcgctcgccacctcctcctcgggccgtctgccagacctggcgggggtgtcgctctccgcgcgcgcaccgcgggcgccggccgctggcgcggaggcggggccggggcccgcctcctcccagggctccgcacagcgcctagtcagcctggtgggcaccgccgactacnnnnnnnnnnggcggtggctgccagcggcgccctgtttgcagcgagggagagcggcgagtccgggcgcggcacgcccgcgcgaagcgtggccgccacgcccagcgctggctcgnnnnnnnnnngccgcgggcgccggccgccggcgcggaggcggggctggggcccgcctcctcccagggctccgcgcagcggctagtcagcctggtgggcaccgccgactacgtgtcgccggaggtgctgggcaaccgcgccgtgaccccggcggccgacctctgggcactgggctgcgtgctgtaccagatgctggtggggcggccgcccttcaaatcgccctccgagacctcatccgcagcctgctgcgctccgagccggaggagaggctaggtgggggtggaatgggagtgggtggtgtggggaggatgaggggagggcagggggcggatgcccttggagggaggggtgggagcttgtggtgggtgttggaaggatcagagaaatggaggttgacttctgggtctgacacgggagtgatagatcccccagtgcacacgccgtga

SEQ ID NO: 3264 - DNA, 837 bp, Chlorella protothecoides
atggaccgaaaatggcgaacgaaccgggcggccatattcacggtggtgccgtacgccgagtactgctcccgcatactccagtgcaccgcggagtatgatctggccacaccctcagatctgtatgccgtgtacaccgtgctccacatcgagagcaagacgtcagagctgcactggagcgagtctgggggtttctactacttcctggccacctggagccaggctccagaacctgatcaggtggggtatgattgccaccaagcagattgcaccgtacattcccagccatgcacagcaacgaatccgcatccctggcctccggttaccacctcaccgtcgacaagttcccctgaaccctctcagacagcaagtgccgcacagccagtgatgcaggcaggtgcgcctccagcccagggaaaagaggcagcaccgtgcatgagtgcggaccaaggaagtgctggagcccaagcacagtgtgccgtggaggttgccgcacacgatcgcagcagcgaagcaaacggtgcgggcgctgtaggcgcagtggccagcccccttaccagccctgacgcagtgctcgtgggctcgcaggcggcagactctagacccccgcctgccccaatcacgcgctcccagatcatcgtccccgtcggcagcgcctgcaccagcctcacgcccgccctcctgcagcgcttcttctccatccgtggggtggcggcccagcagctgctgctggccctggtggatgggaatggcatggtctcgcggacctgcctcttcaactacatccaggcacccctggagggccccggcacggctgacctcgatctcctggacgactga

SEQ ID NO: 3265 - DNA, 1032 bp, Chlorella protothecoides
  modified_base (598)..(607): a, c, t, g, unknown or other
atggagggtggaaggtcctcattgatggaaacctggggtgagttcatgggtgccggcgagcgcctgaagggtctcggggtcggtctcgttacgggctgcatcatcccggggttgggagtcctgggcatccactcctccttctcccgcgactcatcaagccaccctgatgcccgcccatgccaggagcacactcgtcgagcaccagccaggtgcaactctcgtgggaacggacaagcacgggaatcgcagcgtacagggcttaatgttcttgagctgcttggcaaaccatgttcggcccctcgcataccttcttgcccaggccgcaatcgctgggtggtatatgcaaaggcctcggactatcggggccaggacccagccaacgtccctgccgagtggcacgggtggctgcacgccagcgtggacgtcaaccctgccaatgtgagaggttgccatgtcgagtgtgcgagaagggatggggcagcttctgtctcaaacaggttttgccaaagatgctgggctaactctcttccaaggagtagtcccttgtcaggccagtgcgctcaccctttccacctttccccccttgcaaaacaacccnnnnnnnnnnatgctgggctaactctcttccaaggagtagacgcttgtcagggcagtgcgctcaccctttccaccttttcccccttgcaaaacaacctgtgcagcacgacttcacggcgccgatttatgcgtccaacatcgtgggcaactccaccaccacagtttcgaggtaccagcccaagggctcttggttcaaggagcacaagcgcaactggctcaagtaccagacgtggacaccccccaaggcttgattgcgctgatgtgcatatcttctgcaagattccgactcgtgccgagtatgggtatggtcgagcctggcacgcaggggctgccagccgccactcctcctttggtgcaggactccatgtttgtagtctgaaggttacattgtcagtcaagtggcgctgttcgtatgtcaagggggagctggggtga

SEQ ID NO: 3266 - DNA, 1011 bp, Chlorella protothecoides
  modified_base (174)..(183): a, c, t, g, unknown or other
atgctcctccgccgggccctggccgtgtgccttcccactcaggcccccgtcaccacacagctaggcaatgctagcatggctgccgagctgccgctttcccattccgcggtggtttctcagtgtcgcgtgctgaatcccccgagagcgagtgcggcgtgtccacccgcctgggcnnnnnnnnnnccagtgtcgcgtgctgaatcccccgaaagcgagtgcggcgtgtccacccgcctgggcccgctcgcacacgagcgacaagtccgccccttccaagaagtgctgggactgcaaggtgcccgtggaccagcgcacgcctcacttctgcggcacctgcaagaagatccagccccccacctacagcgccaaccagtttcagatactgggcatgtgagcttctcgttttgtgtgctcagagggggagacactggttgtggtgattgtggatggagggtgcggctgactgctattttcttgaacgaggggcccgcccctctctgcgccaaagatctaacacctgtcttcctcccccccttgcacctggaccgcagccccacgacctttgacgtggacgccgagaagctggaggcacggtacaaggcgctgcagaaggcgctgcaccccgacaagttctccacggcctcgccccgggagcaggccttctcggacgcccaggcctcggccgtgaactcggcctacgacacgctgagaaacccgctgcgccgcgcccgggccctgctgcgcctgcagggcatcgagcccgaggagagcgcgggtgtggacgaccccgagctcctggcctacgtgatggaggcacgggaggaggtggagggtactcgcagccgcgcggggctggagaccttgctgagggacaaccgcgagcgcgaggcggcggcggtggcgcggctgcgcgccgcctttgccgcggcagagtgggctgcggcagcggaggcggtgaaccgcctgcgctacatcgagcgcatccaggaggctatcagggagaagctgtga

SEQ ID NO: 3267 - DNA, 1524 bp, Chlorella protothecoides
atggccgcacagttcgcccaccaagctgaaccgccaagacttggcaccaaggggcatggtactcctgtcccacaatgccggtacgaaagaagtgtcgaggcaagtggattagcaggaagctctttgcaggcttcgagagcagcttttgtagaggtctgccaacctccctggcgtcatgcaccgaggcagcctttcaggtcctgcctcatgatctgggttggccgtccaaccgtgcacctacacaccacagtaacacatgctccaggtcaactccagtacctgaggttcgctcgcctcgactaacgccaagtactatctatttgttacggcgaccaggagccatcgaacgagcttgggttcaggcaaagacggccggagggcacgagcatattcatatcgcggccaggaacagcctcaggttcaacagcccatatgacaggcctggacggcgccgggtctcttgtaccggttgcctttggaaatgtcgaaggacgaaatgattcacgcctgtcgcagaggagcgcgatgtccaataatgaccgcgacttccaggtaggtgcagccgtcacacccccaccaccagccgtgccttgggctcgattcaggtcaaccctcacgcccactgccccccgcacacgcttgcaggccctgaaagagacggctctgagtcagttgaaggccaagcatgccaggaggtctgtcgtcctgaaggatgcggatggccaaggggtcaaggtggtggacgccaagcggctcaccaagatcggctccgtccagctgctggaccagctggtgccgatccagaagcacaacgctgaggtcgacatgatggagggcgtccatgcccgcctcacaaatgcaaggggcactgcagatcccgaccctccctccatggcgccacctgttcacagggtcgaggtgtaccctcccacggtcaccattcggtaccatcacatgtcggtggagaccaatgccctggtgggcgacaaggagctgcccaccctcccccactccgtgtcgcacgccttcctttcctggaccgagcctaagcgccccctgtccatcgtgcacgacgctagcggcatcctgcggcccggcaggctcaccctcatcctcggaccccccagctccggcaagaccaccttcatgaaggcccttgtggggcgctaccgccacagcagcgatctcaaggtgagggcggcaggggagggggaaaatgcgagggtgcatggtggcaggtgtgggcccctgagcagagagagtgatttgccccgcctcgtctcatgcagcctgtcttctccccctggctctcaggtcaccggttccgtgacatacaacggcaagaacttcaatgagttcatgcccgagcgcgttgcctcctatgtcaatcaggtgtgtggtagtgcattgctgggcatggattatgtgtacctccctgcagcattcatccgtggaacggcctcgcagacgatagtgctggctggctgggtcccaggacttgagggttcggggtcagtcttgtag

SEQ ID NO: 3268 - DNA, 2355 bp, Chlorella protothecoides
  modified_base (783)..(792): a, c, t, g, unknown or other
  modified_base (1941)..(1950): a, c, t, g, unknown or other
atgggcgcgtcgggcgcgggcaagacgacgctgatggacgtgctggcggggcggaagacgggtggcacggtgacgggtgaggtgcacgtcaacggctaccccaaggtgcagaagaccttcaaccgcatctccgggtacgtggagcaggaggacatccacctgccccagaccacggtgggcgaggcggtgcgtttcagcgcggccctgcgcctgccgcgcggtgtgtccgccgccacgcgagccgcctttgtgacggagatgatggacctggtggagctggaccgcatggacggcgcgctggtgggcatcctgggcgagagcgggctgagcatccaggcgcgtaagcgcctgaccatcgcggtggagctggtggccaacccctccatcatcttcatggacgagccgaccacgggcctggacgcgcgcgccgcctcggtggtcatggccaccgtgcgcgcggtggtgaacacggggcgcaccgtggtctgcaccatccaccagccctccatcgacatcttcgaggcctttgacgagctgctcctgctcaagccgggcgggcgctgcgtgtttgcagggccggtgggcctggagagcagccagctcatcgactacttcatggccaccccggggggtgatgtgtgcacggcaaggccaccgaggcaggggcccctgggaggtgatgtgtgcatggcaaggcctccgaggcaggggcccctgggaggtgtccccatgtgtcacgcgggcgacgtgccccacgctccgcgctgcgcaccgcctgctgcnnnnnnnnnnagactggcgtgcactgcggggcgcgccacggggccctctgagatgagagtgttcccatgtgtgacgcgggcgacgtgctccacgctccgcgctgcgcaccgcctgctgccagacacccgtctgaggccaggctctgcgtgctggcctttccccttcctcgcccgcgccccctctcagctgccgagtgccgacccccatctgagcccccccatcccacccacccgcctgaaaaaccaggtacaaccctgccaactggatgctggagcagaccaacccgcacaacgagtcgttgctgggcgtagacttcagcgaggtgtttgccggctccaagcaggcgcgggagaacgagaagctgatcgaggccgcgcacgcggtggccccgggcatgcccgacctgcagtatgccgacatggaggtgtctggggcctgggtccagctgggccacctgctgcgccgcaacttcgtcatgtactggcgcgcgccggactacaacatcacgcgcttcggcgtgaccctgctggtggccttcgtcttcgggtcgctggcctgggagcagggcgaggcgcgggacaccacctccggcgtgctgaacattgcgggcctgctctttgcctccaccctcttcatcggcgtcagcaactgcatgtcggtgcagcccatcgcggagtcgcagcgcagcgtcatgtaccgcgagcgcgcggcggggatgtactccgtcgcgccctactccgtggcccaggtggtggtggagctgccctacctggtggtccagaccctgtcctactccgtcatcgtctactggatggtggccttcatcgcctccgcctccaagttcttctactttgtcttcatcttcggcctgaccctcgcctacttcaccgcctacggccagatggtgagctgggatggaggggaagggggggttggggggggatgggacaggggccgagggtcgtacacagatcgacgagggtgctggcgacgagggcgctgcctgcggcgggagcaccacaagtgtacgtgtggctgtggggcgcgcgcccagcgtgccgctcgcgcagcaggtccctggaagggatggtcaccctgccccgcgccgcgacgtccccccctccctcttccccccacctgccccgcagtgcctcaacnnnnnnnnnnaatggtgagctgggatggcggggaaggggggggggattggggtgggatgggacaggggccgaggatcgtacacagatcgacgagggtgctggcgatgtgggcgctgactgcgacgggagcactgcaagtgtatgtgtggctgtggggcgcgcgcccggcgtgccgctcgcgcagcaggtccctggaagggacggtccccctgccccgcgccgcgccgttccccactcccttttccccccacctgccccgcagtgcctcaacctcatgcccgagctggccctggccaatgtcttcacctccttcttcttcggcttctggaacctgatgtgcggcttcctcatccccgcatcggtgcgtgggcttggaggcgagggctgcctgggcgccgccgcggcctcgcccggc

SEQ ID NO: 3269 - DNA, 1539 bp, Chlorella protothecoides
  modified_base (30)..(39): a, c, t, g, unknown or other
atggcttcgacgacccctcacatccgggannnnnnnnnnctcccaagcctgacgtctccagatggtgcatcgaccgcaccacccctccccaatggcttcgacgacccctcacatccgggagtgagagagaggtgcgaggtagcgggaggccctggggcccggacacagtctgaagcggagctcagccccatattctcgtacctgcatgctgatattcctcatacaactcatggtggcacggtggtggaaggactctgtggggtgggggtccccccctcggccccctccccctcccagcaattacctcacgctgatcccactctcggatgcacgattgcaaccgcgggacactcgactcacagtcgttttcctggtgtgtggaccagagagccaagctttgcatgggtcttgatggatggcagcgctgcgcagatgcttcagccctggcggcggtgtcgcactgcaaaggcatatgcaccacggacccacgtccaccgccccatatttacctctctgacctcactccgtaccccttcaaccactacgcagctgggatttgccctggccatcgccggggctgtcttcatcaccgttccgcgtggcgtctccattggggaggtctgtgtccggcccagccgcatgtcctggaacaccacgaagtcgacctaccagctcaagctgctagccatggtccccgtctacaatcccaactacctcaaggtaggagcgcatggtttgttgtttgttttgtcgaggagagcggggcgtgctacaccttgtgcaacagacctcggggtgggaacatgcgggtttgactgtgagcttgagcccaagatcagtcactctcccaaacttctgcctgggcaggcccacattgagggggagctccgggtgctgttctacaacacggaagctggaaagcagagcatgggctccgtcaaactcccagcacgctcctcccctgcggtgggtgctgctctgagggaggtcatcctttcccaaagggggtgctggcgcctgagcgtttaccccagaccgcgcctgcaggaggatctcttacatagagtgggccatcccagcttcgcccggcgcgctcttaagctacgttcctcccctgccattccctgcagatcatcgacgtcacaatcgacgcctcggatgtgccatcggactacatcctggccatcctctcccagtgctccaccttcccagaggtcctcatattcttcctgcagggcaacctcacccctatcctctcagactcctgctccttggtgtcactctcaaggccttggactcgtgggactacacaagtccagcccccaaaacaggcctccactcacctcctcctctcccaatcctgctcccatgcaggctcgatacctattccagcgccagcatttgacggccatcgacacctacttcctcatcgactgtcgcaacggtggcggcatgcagcccgacgatggtccgcccagcgcgacgcccgcgccattggctctggaccgccttcgaggtctggaccccggctggtgctaa

SEQ ID NO: 3270 - DNA, 546 bp, Chlorella protothecoides
  modified_base (38)..(47): a, c, t, g, unknown or other
atgacctctgcccctgcgggtggcgaagcacacaagcnnnnnnnnnngtgtgcagtcactgcagaggggcatacaagtcgctgctgcccacccaacccctctccttttcctactgcccacccggccccttctggcgctgaagtgctgggccgcgcggaaattgcaccctgggatccacccttccccgccgtcctttcctcccaggccgatatctgccagctgggcatggatcagcgcaaggtgaacgtgctagcgcgggagtacgctgacgacgcgcggcccaagcgtatgaagcctgtcatcctgtcccaccccatgatgccggggctgctccagggccaggagaagatgagcaagagcgaccccaactctgccatcttcatggaggacagcgaggtggaggtgcggaccaaaatcaagaaggcgtactgcccgccgggggaggtggagggcaacccctgcctctcctacatccagcacatcgtgctgccctgggccaagcagctcgctgtcgccagggctgaaaaaaatgggggaaatatgtga

SEQ ID NO: 3271 - DNA, 630 bp, Chlorella protothecoides
atgggcggggatctgaagaagatccagacggtgggcaactacatggtggagatctggaaggcggtggggatggacatggaccgcgtcgagttcctgcacgcctcaggtcagcagtgcattgggaatctgatttgtttcttctctttggatgtctggggtgaccaggccgaggaggccaggcctggagtgcagacctgcaggtgccgaagggaggactgggtgccaagctggtcccacgtgccaagacccgcgtgtgtgtatatgttgtgctggacagcaacactgtgccggccccgtaccgggtggcatgattctcactttccatcatccacacccatcctcttcgccctgcccatcctcctcactctcccctcaagaacgccagaggagatcaacaagcgccccgacgagtactggaccctggtgatggacatcgcccgccgcaacaacctgaagcgcatcgtgcgctgcagccagatcatggggcgggcggagggcgatgatctgagcgccgcccagatcttctacccctgcatgcagtgcgccgacattttcttcctcaaggcgagcggggcagagacgcgatgtagggtggatggagggagtgtgcagtcactgcagagggggtga

SEQ ID NO: 3272 - DNA, 939 bp, Chlorella protothecoides
  modified_base (384)..(393): a, c, t, g, unknown or other
  modified_base (789)..(798): a, c, t, g, unknown or other
atggtcacccactcaccccctcatgcagcatctgcacagcttcgtggcgctcttgacttcgtgcggaggagtaaaatccgcggccaagcgtcagctggactgcgcgggggtggtgatcaccgtgtatgccgcgtgcgaggtcctggccgcccgccacggccatgccgacctgtgcggcgtcagggtccaggtgggcctggagggtggtccactcagccatgcactgcgcccgaggtgggtctgcagggtccagcgctcgacgccagcccctgccccatcacccactcggcgctggaatgccgactgtgcgcaaggaatcacccgccgccctcgcccgccaggtgtccgaggaccactgctggctgtcactggacggcagcggcnnnnnnnnnntgccatgcactgagcccgaggtggtctgcagggtccagcgctcaacggcagcccctgcctcatcacccactcggcgctggaatgcggactgtgcgcaaggaaccacccgccaccctcgcccgccaggtgtccgaggatcactgctggctgtcactggacggcagcggccggcgggacgccgcggtggagctcacaactagcaacgccgcgctacgtggcctggcgcccggcgccgaggcttggagcggctggctgtacgccgggggccgggcccacacgctgacgcagcgccaggtcatcgcttcgctggtcgtctccgtggaccccacggttgtgaacgggcgggcgaagaaggtgagcgggcagctggcgggcctgcagctcctcctgctgcgnnnnnnnnnntcagcaggcatggatgaacgggggttggcatggggagttggaggtggcgccagccgctcctcaggcctgtgggcaggcttggccctggccgtggcaccttgtctccgaaggagggacaacattggatcgagagctttgtga

SEQ ID NO: 3273 - DNA, 1224 bp, Chlorella protothecoides
  modified_base (90)..(99): a, c, t, g, unknown or other
  modified_base (729)..(738): a, c, t, g, unknown or other
  modified_base (898)..(907): a, c, t, g, unknown or other
atgccgcaaccgcgccgagggaacaatccaaccatttgtttgcatccccctccccacaaacaggagaggctggacagcgcacttgagaannnnnnnnnngaccgcgctgagggaacaatccaaccattgcatccccctcctcacacacaggagaggctggacagcgcacttgagaaggcgctcgagcggggccagggcgtggctgctttctgcgcccagttcgagcgggagattgctatggcccaatcgagcctggaaggtgccatctatgcctgtgccggggcccctcccagttctgggcttggtaagatgcgcgtggctgatcagagcgcggagctgcaagcaagtgactggatcctggaagcaggagatgccagctggaactggtaccccttcagctgctatgcagaggccagcctgggctacgtggaagccatggcaggcgctgacggcagtgcgctgcaagaaaacgtgccgtcgcacttccagctggggctgtgcgccctggctgcgggggggcgggtgctggccaagtaccgccatgcgcccacaggtcagcctgaggtggtgggcgcattctggaaagtcatgtggaaggaggggcatggtgccattcaagatggtgtgtcctggccaccggcagacctgaccgtgggtacgaggggcgcagcacggtttaacatgcgtgcaaggccctatccactctcccctccgtgtcagacgaccagnnnnnnnnnngccggcagacctgaccgtgggtatgagggacccagcacggttcaacatgcgtgcaaggccctctccactctcccctccgtgtcagacgaccagctctacaaggacattgacgagctgctgcgcaccgtcaagtccgccgccgatgcggctgtcctgcatnnnnnnnnnnatgcgtcggccctgctgacgcccttggctgtcgagcacctgctccgcttcctggatggcctgtgcctctactactcgggcaagcccaagcccgccacatgggttgccaccttgctgaaggtcctggcctcggcgactccagagacaaggcagaccggcgcgtcacgggccgctgccgccatgcagagcccgaccatgcgcgccagcatgggcatgtggtgggagctcaagccccggctgctgaaacccttgtttgaggccggggagtcggagggagagggcgcgcggagagtcaagcgagccagggtagtggactga

SEQ ID NO: 3274 - DNA, 294 bp, Chlorella protothecoides
atgccaccctccggcgcggtgcgtgcggtgctggtcgtcggcttcgaatcattcaacgccgccctgtatcgcgcggcgggggagcgtctgcttcacctccaaccgccagttcagctgtcggtctttagcgaccgcgatctgggtgagtggccgggcagagctcgcgactacccagcagatgctgggaaggccgagctcgctgccgccctgaaggacgcggacgtcttctttgggtccctgctctttgactttgaccaggtgggcttgacattcctggacggtaggggttcttga

SEQ ID NO: 3275 - DNA, 201 bp, Chlorella protothecoides
atgcaggggcaaggaggtgcggtggaggaacctctctccaacctgcgcccatcgagacgcagcctcccttgtccccgcctgcaggatgtcgtggacaaggtgtccttcctcatgctgggtctggacctgccggctgccccgctgttcaaggatgccctggagacggtcatcatccctcaagtgagaactggaggtggttga

SEQ ID NO: 3276 - DNA, 315 bp, Chlorella protothecoides
atgagattcagtgccaggaagggctgtgcgtccaggtgccatgcaagcgcgactgttctgcttttgcccgccactgagttccctcccactacctcccgagcatctcagggccgtgggccaaacacgcatgcctacacgcactccttggacgccggtcaccacatgttcatgaaggtcacggatggcaaggtgggtcacttttgcccagcacaggataatggtttgcatcaggacagcgccaggaggacaggcctccttgcagtgattctccacaccacaggccatcgccctcctctcaacacccctgcacgctga

SEQ ID NO: 3277 - DNA, 276 bp, Chlorella protothecoides
atgtacgacctgctgaggaagtatggggggagcctgatcgtcgacgacatcaaggcggggcggcggaaattccggctcaccaagcctccgcgcttcctcgcgctacacgtgaagcgcttcgtgaagaaccagttcttcctggagaagaacccgaccatcgtgaacttccccgtgaagaacctggaggttcccgtgtctgcgcctggtgcggtgccctgtgtgggatttatactgaggcattgtgggccggttcgtgggtggttctcgggcaactga

SEQ ID NO: 3278 - DNA, 498 bp, Chlorella protothecoides
atgccagggctggtggggctgaataacatgaagcgcaacgactatgccaatgtggtcatccagacgctcgtccgcatcgtgcccatcagcggtgaaccccgctgctctccccgcacctcacaccctacagccacccccaactcacgccgcagggactatttcctgcgcacccagaactacgaggcctgccgctcgccgctggtccgggagtttgggtcgctggtgcgcaaaatgtggatcacacgggccttcaagggccacgtgtcaccccacgagttcatgcagtcggtcattgccgccagcgagaagcggttcaccatcgacgcccaggcggacgccattgactttttccagtggctcgtcaaccgtctacacctggagctgacggggggcaagcggaagaaggcgtccatcatcacagaatgcctgcaggcgagggacctgggtgtggggtctgctgggtggtgtgtcgtggagcctttcggagaggggaactga

SEQ ID NO: 3279 - DNA, 321 bp, Chlorella protothecoides
atgcgaggagtttctatccaccaaatccagcacacaccctggcctctcacctctggctcaaaccgcttgcatcaaaactccaatcccacaggtgggggttacgtctttggaaacgtgccccttgtgcggaacaacttctccctggtcatgctggcgatcgtggtgctttccatcctccctgctgcgtatgaggtgctgacgacgcgtggcgtgcgccagcgtaagctgcgcctggcagggccagggacgctgactggccagtttggtgggctggtggtgtcccgccatccctcccaaacaggggggacattaacagcatga

SEQ ID NO: 3280 - DNA, 1056 bp, Chlorella protothecoides
  modified_base (979)..(988): a, c, t, g, unknown or other
atgccatccaccaattctgtgtcctttacgtcgagcaacgaggaagttgtctaccgtctgcactcaagtacctggcagcgtccagcctcaccacgattgccaagcctcctcataagtgccatcctccttctgccctacttcaattgtcctgcccaagctcaagatgtggccaattccgcatcaccagaagtttcctctgctgtggtgtcagggctcaggggtctgcttgattacctgctccacttggacgtccaccttggagaattggtagcaatccatggacgtgccagctacaccatcctctttgcgatcgtgtttgccgagacgggacttgtgatagcccctttcctgccaggtgtggggagcggcattgttggcgaggcaccgtatcatgtctcttgcttgaacgttctcagagtgccagcagctccagcgcctcactgccacgtgccatccctcgctgcgcacaggcgactccctcctctttgccacgggcgcactggcagcgagcgacaaactgaacatctaccttctacttctcacctacatggcagctgctgtgctgggcgtttgctcttgctacctgccttgatgtcttcccgcttccaattgcttggtgcagctggaaagtacctgggcgctcatgtgcagcagtccaggctggtaaagaaggagcacctcgtgaagacacagcacttctttgccaagcacggcggaagagcaggtgaaggggctggaaattcgccagtggtgctgggccgtttcctccctatcgttcgaacgtttgccccattcgtagcggggatgagcgccatgccagggtctgcctttgcttacttcaacgtcctgggagctgccctctggccctgcctgtgctgcggtgcgtgggagggtggagatttgggaattgcatacgcagccttcttgatacaatggtggccatgtgggaggggtttggcgtggtccaaattgcctcacnnnnnnnnnnctggacctgcctgtgctgcggtgcgtgggaaggtggagatgtgggaattgcatacgcagccatcttga

SEQ ID NO: 3281 - DNA, 774 bp, Chlorella protothecoides
  modified_base (270)..(279): a, c, t, g, unknown or other
atggccgacaacactccggccagcatccagcctggggccagctcggtcaccatcccagacatgactgccagcctgaacgccaaggtggtcgtgtcggatgatcagcaggcggaccccgcccagctggcggcctgctacgacgccatggctgccaagttcctgcagcatggcctcaacatcgaggccgtgcaggccacccgccagtactttgacctctcccaggtccaccagtgtggcccaatggtgtatgtcggccatagtatgcgaagnnnnnnnnnnttctcgtcaccctccagtccaccagtgtggtccaatggttgtatgtcgtccatagtatgcgaaaccttcaaacgcacgcagcattctcctccctacacctgttccccgtctccttcagctcgttctaatcgcactccggtcacaggcacattacccaggcctctggagtacgcccgcttcccctccccgctgccagaggccgctgtgcggctgggcgtgctcttcatgcagaagtgcaatcccacgctggcgagcctcgcccaccaggcggcgctggacattgcccgccatattccgcctggtgagggtgggcgggtgcactctctgattgaggatcccctgacttggggcatcaggctcctgggcctgatccgcgacccaggtgccgggagctttcatggccagtatgtcgcaggaatcagactcccccatcatctccagccacctcctaacaccccaaatattcccacccagcaggctacctgctgcacctga

SEQ ID NO: 3282 - DNA, 507 bp, Chlorella protothecoides
atgaccagccagccccacaccctgcgcccagacccctttgaccccggctgggcaccgccgtctggcgacgccccgcccgccgactgggcggcgccggcgccggcggccctggcccgcgagctgcgcgccatggccgccgccgcggccgccgagccaccgccccgtctgcgcgcccagcgcctgctgctggccgactccggcacgctgctgctgtgcagtgtggacgtgagcggcggcctggccgcgctgcgccggcggctgcgtcgggcattccccggtgcgccgccgcgtcagagtaccatcgtgcactgcagcctgggccgggttctgggcggggaggagatgggcgccgacgccgcggcgcgcatcgcggccgcctgcgacgcatggaccatgcgcctggcaggtgcggagtggacggcgcctggactgacgcacgtccgggagacggtgttcaccacggtggaagggccggccgtgttcatgccctttgcgtcggagccctga

SEQ ID NO: 3283 - DNA, 693 bp, Chlorella protothecoides
atgggagggtctcggtctcgacctaggcgggccgttgcggatatggtttggcagtactcggacatggtgtcgcgcaccatgcgcggttgccccgggctcctcccaccctatgctttatccacacacatgatcctcatggcctgcctcccgtgcgctcatcgcctcgaacctgtaccggcgctcatgacttcaccccccctccgtgccccggaacaggatgttcgagaccttctcgttcctgccccccctgtccgacgaccagatctcccgccaggtcgactacatcatctccaacaagtggatcccctgcctggaattcatcgacgaccctttcccgtacgtggcgcaggagaacaccatccgcatgggtgccgtggcctccaactactacgacaaccgctactggaccatgtggaagctgcccatgttcgggtgcaacgacggcagccaggtgctgaccgaggtgggcaactgccgcaaggccttccccgacgcgtacatccgtctggttgccttcgacaacgtccgccaggtgcagatcggcgggttcctggtccacaggcccccctccgccaacgacttccagcccaccgacaagcgctccgtgtgaggaggctcgggccccatgccctctggggtccgccgctcaatgagccgccgccctggggcaaccgctgccggtctggaccctga

SEQ ID NO: 3284 - DNA, 1101 bp, Chlorella protothecoides
  modified_base (711)..(720): a, c, t, g, unknown or other
  modified_base (963)..(972): a, c, t, g, unknown or other
atggcaaccctttggcacccacccttcgcctcagaacctgaggatgacgaggagcagcgcagcagccggggccactatggccaagcgggaggcatggtacgagcggcccacccccccgaacatgcggcatgtccactccgtacagcagtttgtgaacgagctggagggggccaaggagaagctggtggtggtggacttctttgcgccctggtgtgcagcctgcaaggccctcttccccaaggtctgccgaggagtggatggtggttgggatgggcccagatctatcgacatgggttgcccctgcccggaggcttgggagcctcatccatgccgatcgccgccatgcagtcagcgccgccgacccccaccttggcccaggtcgtgctgctggcagaggccaacaaggacgtcatcttcctggccatcaactttgatgagaacaaggcgctggccaggggagttggagtcaaggtgctccctttctttcacttgtatcgtggtgcagagggccgggtggatgcattctctgcctccgtctccaaggtccagcggctcaggtgcggttgggggtcccggccgaggggtgtgacctgggatactgagcggggttggacgccgcgcgcagaagggagcggcagcgtagggcctcagatgctgaaccctttgttcacaatgcgtcgcacagggatgcgattcgggtgcacaataccnnnnnnnnnnggaggagttcccggacgtgaggcccacgccggaggagtccgaagacaccgaggcaaacaccctgcgctctgttggctagcagcggcgatggtgtgcacactcgtgtgcctgctgacaggaagcgctcgacggtggggtctactccatcccaatgatgtgcctgtgccctcgctgaacagccctgtgcctcctcacccagccacctgcctgggcacgcccaggactgtccttaccctggactgnnnnnnnnnnggaggagttcccggacgtgaggcccacgccagaggagtccgaagacaccgaggcaaacacgctgcgctctgttggctagcagtggcgacggtgtgcacactcgtgtgtctgctgacaagaagcacttga

SEQ ID NO: 3285 - DNA, 480 bp, Chlorella protothecoides
atgaccacacagctggagcaggccgcagcagcaggggtggcactcgtcggcgtcctgaccgtcatcatcatccgccgctgcgtggctgacgacttccccgccgtccgctccggcgagctggacctcttccacgttcggctcacccccgacctgcccgaggcgatcggcgtgctctcctttgccttctacgtccaccccatgctgctgcccatgctggcggagatgccggcgggcgcgcgcggcgtggcgctgaccgcgcgcgccaatcagctggtcacctcgggcgtggccctggccatctactccgtcatcggcgtgtttgccgccgcgcgctacggcctcgccaccggcggcgacgtgctggtcaacgagtggctgggcggggcgtgggacggcgcgctggacgcgggcatggcgctctacctcgccctctccatggtccccatcgtcctcaccctgcgcctgcagctggacgcgtga

SEQ ID NO: 3286 - DNA, 282 bp, Chlorella protothecoides
atggcgcaggaactcgcgagccagcccacagaggctggcgatgggcgcgatccagcgccgataaaggattcttgggtgcagtgcgacagatgcgagaagtggaggaggatccctgccgctgtggccgagagactggacgaggagacaccatggtgtgcagtcagggagggccgcagagcgcatgctggggcgctgggaaacgcttcatgcgccaatctaacccgtctttccgctttccaaatgcaatcaccccctcacgcccttgcaggtactgcgaactga

SEQ ID NO: 3287 - DNA, 1911 bp, Chlorella protothecoides
  modified_base (54)..(63): a, c, t, g, unknown or other
  modified_base (976)..(985): a, c, t, g, unknown or other
atgtcacggactggttccccctggccgcccacccgccgctgcccacctgtccannnnnnnnnntgccacaccatgcatgcatgcatgtgccgggaggggtctggcacatgtcacggactggctctccttgccgcccacccgccgctgcccacctgtccacgccacgaccttcccgtccaggagtactgcccctgcggcgaccgctgcaccaaccagcagttcaccaagcgggagtatgccgcgctggacgtcctgcgtgccggggccaagggcttcggcctcttcacgcgcgacggcgtgcgcgccggccagttcatcgtcgagtatgtgggcgaggtgctggaggaggacgagtaccagcgtcgcaaggagtactacatcgcctccaaccagcgccactactacttcatgaacatcggcaacggggaggtcatcgacgcctgccgcagggtgggcaaagtttctaggggttttggggggtgggtgggcaggcgccttggtctgaagaggcggccgaatgggggtgtccagaccagtgagtgtcctggtcagcgacgcccgaaccccccccttcccccccctccccctccttcctacctacagggcgggcagggccgcttcatcaaccactcctgcgaccccaactgcgagacccagaagtggctggtggagggcgagctctcgatcggcctctttgccatcaaggacgtgccccccggcggagagctcacctttgactacaacttcgagcgatacggggacaaggtgggcgggcaacagctgctgggtgtgggattgtgtacagtgacgggggaggaggcagggggccatctcccgagcttgaaggggtgtgagatcctggctgccagccgctcccgttccgagaccccctttgccctgacgcacacgacccgctggtgtgccgcctgtgcgctacgtcgctcctccccagcacctcgctcacctcaccccaccnnnnnnnnnntgttccgagacccctgttgccctgacgcacacgacctgctggtgtgccgcctgtgcactacgtcgctcatccccagcacctcgctcacctcaccccaccctctcgtgccagcccatggcatgcctgtgcggctcggccaactgccgcggcgtgatcggcggcacccaggagaccgccgtcctggccccgccggtggtggtccccgagtacgaggacgaccccgagcccatcatggtgagcggggtcaaggccacgcccaccctggagcgcctgctggaccgcatcgtgggcgtgggcagccacgtcgggctgacctcgggggagcggagcctgtgagtggaggaggggcccgagggtgtgtttgtggtgtgctccggcctggaccaagggcatgggctgttgcgggtcgtgctggggcgccgggtcctcacacggcggcccaagcctcgtctgggccacaggagtggcctcgtgcttctcaccggtgcagggctccgacccaccgagcgctggccggccccctcacccccatgcagtctcaagcagctggcgcagcagcggggcatcaccctggagtcaagctccgaggacgaggaggagggcgaggaggtggcgaggcagcacagggaggtgcaggagccgccctcgccgcccgcgcgccccgcgccccccgcgccctcggacaaggagagcgacgtgtcaggtgtgttgccctgcatgcgcaccccggcggggcccgatcgtcatctgggtccccgtggatgcctcgcctgccaggccgtcatgcgctcaccggctcgcgccatgccccctccccgcagcgagctcggaggcgagggtggacggcgcgtcgtcgctcgcggcaaacgccgccgccggcgtcgccggcatccccccttcgggcgcgcggcgcgcggggcgcgccg

SEQ ID NO: 3288 - DNA, 597 bp, Chlorella protothecoides
atgggcgccatccggcagtacctgtgcctgtccctgctcaagaactgcgcgagctcggtgcccgccgcgctgccgccctgcgcctccatcttcctcacgctgctgacccgcttccgtgccgcgctcaagggcgaggtgggcgtcttctaccccatgatcctgctgcggcccatcgaacccgtgggcgcgggcgtgctggcgcacaccacgggctccgtgggcggcgccgcgccggtggacgtggcctaccgcggcgtggccctggcctgcctggcccgcctggcggccgacggccaggcgttgatggacctgtacgtcaactacgactgcgacctggagggggccaacctgttcgagcgcaccgtggcggcgctggtgcgcctggcgcaggggtcgccggggctggaggccgccgtgcccgcgcccgccgaagagcgcgcgctgcgcttcgaggccctgcgctgcctggtcaccatgctgcgctccatgtcgacctgggccgccgagcagcagcgcggcgcggggccgggtgggcacggcggcggggctggaggggacggggcggacgccgacgacggcgattccaccggcgccgac

SEQ ID NO: 3289 - DNA, 882 bp, Chlorella protothecoides
  modified_base (112)..(121): a, c, t, g, unknown or other
atgcacgtggctgtggtgccgggggatggcttttggggtctcgctgtcaggggatgggagggaggacaggtgggtcctggtggaaccaccgaggccgagaggctgcagggtnnnnnnnnnngtgcacgtggctgtggtgccgggggatcgctttttgagtctcgctggcaggggatgggaggggggacaggtgggtcctggaggaaccaccgaggccgagaggctgcagggtcgagaggacggctggagtccgtcaggatcgagaggacggctggagtccgtcaggatcaacgcagcgtgcctccctgcatgcatgcggagttccttgctcctccaccagcccaatgcgaaagctcttgttcctctcaacccctcattgacaggtgcaagaccgatgagctgatcaagatcaccgtcgccggcaacgccgagaagggtctgttccccctgaagatgcgtgacgaggccatctccgctggcttcgccttcctcaaggagaagggcctgatccccatcgccgactcctccgacgatgaggtcaactacgccgaggccgccggcgtcgagtgctctgcatcgggcagcaaagaggttggatggggctgtcatgatgacgccgggattgagagtttgaacggatacagagttcaggatgcctccaagattccggtacgtccgtggcctggtccatttctcttgcaactattgccagacaggggttggccttacacagtcgagacggctcagccatgcagttgggaaattcacagccatcccagtacagaggcagagcggagcggcatgtgcgtggcagcaggcgaggtccagacttgggctgtagcagggcccgaacccttgcacagcaaggcacacctcccgtga

SEQ ID NO: 3290 - DNA, 3696 bp, Chlorella protothecoides
  modified_base (2037)..(2046): a, c, t, g, unknown or other
  modified_base (2307)..(2316): a, c, t, g, unknown or other
  modified_base (3310)..(3319): a, c, t, g, unknown or other
  modified_base (3652)..(3661): a, c, t, g, unknown or other
gatggaggcatccacagccttctggttagcgatgtactctgccggcagcgccgccttctccagcttgtcctcgaagaactcggcctcgcccttggacttgcgcgtcttcttctccgtggacttgaagtacgcatcagtgaaagcagcggtatccacgccagagacgtccaccttggtggaggtggcgatgacgtaggcctggttcacacggcgggctggcacgccgttgacgcggaaagggccggtgaccagcagcaggccggagggcagctgcttgaggaacaccacgcgctttcccttgaagcggccggccagcaggatgagaacggtgccgggggtgatggaggcgcgcagcttggtggggttgcgcacgaagctgcggttcagcggcttcttggcgtcctccgcggggtagaagcggggggccttggtcaccgccacctcggccttctcggccttggcgtgcacggggaaagtgccgccattcttcttcttgatggcccacagaccactgcgtgcgggggttggccccagcacggagccctcctaaagagggcgtgcgcggctgaacacgggtccaccatgcaagctgctatcgctatttcagtgaagaaccgcggcgcacgggacgcccacacagacaggactctggccaccccggaatccagcgccgggtgcggaactgcccaccctcccgggcatccgggcagcgctcgaccactcgcgagcggtcgctcgaacaagaccatatcaggacatctcagagagcggccgcggccaccggcgggcttcactgcctccttggccattgcgctactttatacacctccgagactgggcggtgaaagaggggcccactgtcgcaggctgggtcctttcctggcgggagggggcagggcggccgatgtaaaactcgctcgttccccgctttctaatgagaactcgagcgcgcctggcgttcgagctgttcgtctggcgaatcaacgccaatcgcgtcgagccaatcgcaggtccatgacagcggacacatactggccaatacggttgatcgctggatacacccggcgtgttcgaacggcttggggtaggaagtgcaggtttcggcccttgccactccaaccagtggaccccaggaaatcgagtccattgagtgactggcgtttcccttccgccaaggccccgcttccaatgcgggccatgccaatgaccatcgccagcaccccagcgccattcctgcggatatggtcccctagatccaggccttcccttgcattcgtctcccatcgccgaatcagcactcgcgttgccagccctataggccctgatctgtccccagaggctgtcaccccagcctctcaccccgacccattccccaccctggccaagggcgcccccctgcccgaggggtatggcgagcccccctctgctcccccaaagcatcgacgctcaggcatcatcctgcaccccacctccctccccggtccctacggcatcggggagattggggaggaggccttccgttttgtggactggctggtggcatccgggcagcagatctggcaggtgggcccgggctctgcgagcgctgtgacgccatgcctggatggatttcgcttgcatgtcagtgacagaccctgcgtgctgagccatgctccctgcatggatggtgtgttgatgcctgggagcccagaccctgcttgtcatcagctgggttcccgtcgaccttcccataaagtctcttccagaatactgccctttcaacccctccacccggcctttcatccccccttttcgcgacccccgcagctcctgcccctgtgcccgccggagaccgagtattggtcgccctactccggcctggatgcgctctgcggcaacccgctcctcatccccttgaacggcctcaaagacctggggctgctgaaggagacggacctcccggtcccttccccgccaggcgacgcaggtctgcacgccccgctgccgtttgtgacaatgcctggagactactgcatgggggtggcaatcgagcctccnnnnnnnnnngcgacgcaggtctgcacgccccgctgccgtctacttccctgccgtctacgctgccaagatgccgctgctggagaaggccgccgcggtgctgctggccgacccggcgaggtttgccgacctgcacacgtgaggtggcattggggaaagcgtggcggatggggtcatgcccgctgggtcaggcagcgcatgggtccagtgtttaccttggagcgcacgttcacgcacaggagcctagtcccgcctcccgctcccccgcctcannnnnnnnnntgggtcaggcagcgcatgggtccagtgtttgcctcggagcgcgcgtccatgcacgggagcctggtcccgcctcccgctcccccgcctcggcccctgcgccatcctcctcctcacccacgcagggagatggccgcgttccgccaggaaaatgcgtgggtggagcagtcggcgctattcagcgcgctcaccgaggtgccgggcctggcgggactggcctggtgggactggcctgagggcgtgcgcgacaggcacccggccgcgctggaggccgcgcggcgcgagcatgccgggcgcatcgacgccttcatcgccctgcagtacctctttgaccgcttctggaaggcggtcaaggtgcttgcgcaagggagggggatggatgggggagggatgggtgttggggaagggggagaagcaaaaggggggggggagggggagaagcaaaaggggggggtgggggtgcacagtaggggaatcttcggtgatgcgggcattgacagccttaccagactgcctccccctcccactcttgtacctgctactgtgctggaagcccagtatgcagtcgccgtatctctacaccccaacccaccccccgcaccccttgtccaggcctacgccaacgatcggggcgtgctgctgatcggggacatgcccatatacgtgggcggccagtccgcggatgtctgggccaaccgcacactgttcgcgctggggccagacggcgcgcccgtggaagtctctggcgtgccccccgacgccttctccgactcgggccagctgtggggcagccccctctacgactggcaggtgggtctgtgcagggggttgagatcgcatgccgcacctgcctctctgccctggtcccgaagaaggcgtgatgctggagcaggaggagcatcacctggttgggcgtccagcgcaggacacctgtcccgcccaggcgcactgctgccaggcaccattgtcacccctcaccccctccaccttcgccctnnnnnnnnnncacctggttgggcgtccagcgcaggacacccgtcacgcccaggctcactgctgccaggcaccatcgtcacccctcaccccctccaccttcgccccccctccacccatgcgccaggcgcacagcgaggaccggtaccggtggtgggtgcagcgcttccagcgcagcctccagctatacgacgagacgcgggtggatcacttccgggcctttgccgggtactgggccgtaggcgcccaggaggagacgggtgtgcaaaggcggggcggggggacagggggcctagctgtgggcgtgccggcggctgcttgccgaggagtagcagtggcacctgcnnnnnnnnnntgtgcaaaggcggggcggggggacaggggggctag

SEQ ID NO: 3291 - DNA, 384 bp, Chlorella protothecoides
atggcgcgtggacagctgaaccaggcaatgcgcatgctgtgggcacatgaaaccgatcgtctccccgatgctgccatcaaggagggaggcaagaagggcgtggacctcgcgggcgtgtccgcgatgggcggtgtctgctttttcaacctggccgtggagacccctgagggcgacctggacctcctccaggctgtgatcgacggatccaacaccgaggtggatgagagcgctgaggagcgcaagggaggagccggggacatcggtgagcgggctcagctggttgggtccagggcatgcagaaagtccccgcccctggcgcacctccgtcctcacgcccggcactggccccctccccgcaggcaagatctttctctctgctggtga

SEQ ID NO: 3292 - DNA, 762 bp, Chlorella protothecoides
atgaatggcgtgtggaagaagggcccgggcatcgagctgtttgaggcgctggaagcggcgctggggcacgtccccatcttggcagaggacctgggtgtgatcacgcccgacgcgctcgactgtcagctggatctccacaagccctgtccccctccacttgtcctgcagggaggccatcggagcgccgggcatggtcgtgctgcagtttgcttggggcggcggcgcgaccaacacccacctgccacacaacatctaccagaacagcttcgtataccccggtgtgcggcaagcttgagcggagacgcggtggctaggtgcacgcatgccctccgcgcgcctgccgagggcacgcccgccaaagcgctcacctcttcccaaccccatgccacctcaggcacgcacgacaatcagacggtgctgggctggtacaaggccgggtgccggccagaggaggcgcgcctcattgcgcgatacatcggcgctgaggcgggacaggacatctcctgggcgttcatccgggaggcctacaagtccgtcgccaggaccgtggtggtggccatgcaggtgcatggcggcgcggctgtcaggcgcaaggggggttttctgaagccgtggccgcgactctcgaccatgcacactccttccaacccctcacacatccccgctttcctgccaggatgtgatgcggctggacgactccgccaggatgaacactccgggcaaggcggcggggaactgggcgtggcgggtgggcggcagtag

SEQ ID NO: 3293 - DNA, 551 bp, Chlorella protothecoides
tatttcttcccgccctcctgcgtgggggagacggggcgccaggggcccgcggggcgccgcgagattggccacggcgctctggcgcagcgcgccctggcccccgcagtcccgcccgaggcggagttcccctactccatccgcctggagtccacggtgaccgagagcaacggctcctccagcatggccaccgtctgcgccggctgcctcgccctgttggatgccgcgccgctgagtgcccccccgccaacaaccaccccaccaaacccccctacaaccaccaggcgtgccgctgaagggcctggtggcgggcgtggccatgggcctggttctggacgcgcaggcgcccggcggcttccgcgtgctcaccgacatcctgggcgcggaggacgcgctgggcgacatggacttcaaggtggcgggcgatgcgcacggcatctctgcgctccagctggacgtcaaggccgcgggcggcatcacgggcgaggtggcggcggccgcgctgggcgcggcgcgcgccgcgcgcctggcggtcctgcgcgccatgggcgcct

SEQ ID NO: 3294 - DNA, 206 bp, Chlorella protothecoides
atgccgcccgcggccttgacgtccagctggagcgcagagatgccgtgcgcatcgcccgccaccttgaagtccatgtcgcccagcgcgtcctccgcgcccaggatgtcggtgagcacgcggaagccgccgggcgcctgcgcgtccagaaccaggcccatggccacgcccgccaccaggcccttcagcggcacgcctggtggttgtag

SEQ ID NO: 3295 - DNA, 831 bp, Chlorella protothecoides
atgcgcagcgcgctcctcatctgcgacgcccgggagtcgagcaccgtggtcaagatcttccgcaactttaaggaggcgcagacgctgcgcctgccgtacagcgcggagggcatccacggcggcagcctgctgggcgtgcgcacccccgacgccatcaccttctacgactgggccggcggcgcggtggtccgccgcatcgaggccgaggtgcgcgcggtgcactggtcggagggcggcgccggcgtggcgctggtgggcccggcggcgacgcacatcctggagtactcgcgcgaggcggcggaggccgcgctggccagcggcgagggcgtggacgaggacggcgtggagtcggccttcgagctggtgggcgagatcggagagcccgccaccagcgcggacggcgtggagtcagccttcgagctggtgggcgagattggagagcccgccaccagcgcggtctgggtcggcgactgcctggccttcaccacgtccagctggcgcatcgcctacgcggtgggcggggagaccaccaccctggcccacgccgaccgcccgctctacctcctgggctacctggcggctgcggggcggctgtacgcgttcaagacgcgcgtgctgcgcggcgacgtggacggcgcgcgcgccctgctccccaccgtgcccgaggcggagcacgccgcgctggcgcgtttcctggaggcgcggggccacctggaggcggcggccgaggtggccaccgaccccgcccaccgcttcgacctggcgctggcgctggggcggctggactcggccgccgcgctggcggccgagtcggggtcggcgctggcctgg

SEQ ID NO: 3296 - DNA, 1290 bp, Chlorella protothecoides
  modified_base (233)..(242): a, c, t, g, unknown or other
  modified_base (393)..(483): a, c, t, g, unknown or other
  modified_base (549)..(558): a, c, t, g, unknown or other
atggcttataccttcccatgtgaccagggcatgctagggtgtatgtggcgtttgacatcctctacagattcctgctggataaggggtacccagtgcgatatgtgcgtaacttcacaggtgaggcatgatgttgctgagttcaggggcacattcctgtgccctggagacggccctagcctgacgcagcgcttcattcatgaattccacacagacatggtgagtggtgctggtannnnnnnnnntggagacggccctgtgagctggtgttgccatacccaggtcggtccctgtggaagtctgcgagctgcttgtgctcacagagaccaccactcctcctcaactcggcagacatcgatgacaagatcatcaagagggcaagggaggcaggcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaagggtgtgtacggtggctagttgactgggatgggcagtgcggcaacgatgctgtgttccgnnnnnnnnnncactggcagagcctgacgcagcgcttcattgatgagttccacacagacatggtgcggcgacgatgctgtgttccagagattcagccatgcaggcccttcagcctgcccttactctgtacagaaattgcttctgacattttgcccgggccatgcaaactgcaggaggcactgaactgtttgcaccctgtgctagagccacgagtcacggataacattccagccatcatctccatgattcagtccatcctcagcatgccattactttcagccgtggctctgcgccttgtcaatctttcttggcaatgccgcactgcagaaatgagcacgcctactgcgtggatggggatgtgtactttgaggtggcgactctgccccattgaggagcacagaccacacgggaggagcaacatgggtgtggtgcatctgagagctggtgggaatgggcagcatgcaatcagggcagtcactaaacctgccatcaacctcattctgaaggaggacaaccgggcgggggagcgggtggacgtggatggccgcaagcgcggtcccgcggattttgtgctctggaaggctgccaagccaggcgagccggcctgggactcgccctggggccagggccgtcccggctggcacattgagtgcagcgccatgatagcgagtcactttggggaggagggcatcgacatccacggcggcggcaggtgcgctgcgtcgtttgggaggaagtattga

SEQ ID NO: 3297 - DNA, 777 bp, Chlorella protothecoides
  modified_base (703)..(712): a, c, t, g, unknown or other
atgtatatcagaatgtcgacaaggctctgcataccctcattagtccgctccctgagtgcgataacacatgcaccgatgctgcccgtccatgcaccaacccggatgatgtcggtcctcctgggaggcagcccacaccagcaatgggtgagtgctactacacatgagcgcagccaagaacattctgcttatatatcatcccactcgcgtagcttggttgaagatgatcgtgctgcaagccccgccaccctgcaggcaacaggcctagctggtcagaggcgagcatgctcacgcatggggagccaaggcctggcctcctacaggagaaacagttcccatgatgggtcagacatcacgggtccagacctgtacctctacgacactgctactcgccagaagcggctcttcaccgtcagggatccagaccgaacccagccaggggtcgacatgtatgtctgcggcgtcactgtgtatgacttcagtcacataggtgggtttgatgagatggatccggtcacgcagcatgtcatctgcggcactgagggcgggctgggatgctggctgatgtgcgccattccaacaggagtttggcatgccgaggtcaaggccatgaccacagcctcggggctacaccctagccctttcaggatcccaaaccaagctccacacccagctccatcacccctcccacccaccatgtcttacnnnnnnnnnnattccaacaggagtttggcatgccgaggtccaggccatgagcacagccttggggctacaccctag

SEQ ID NO: 3298 - DNA, 855 bp, Chlorella protothecoides
atggcctccctggagctggccaagtccgggatcaccaccgcactgcgcccgctgggcttgcccgacgccagcgtggccggcgccgccagcttcgtgggcggcggcctggcctccttctcctcccacgccgtcatggtgccgctggacgtcgtctcccagcgccagatgatccgcacggggcagctgcgcggcggcggcgcctccgccacgccggcggtggggcccgggggcgccgccatggcgcggcacatcctggctacggagggcgtgcggggcctgtatcgcggcctgggcgccagcatcgccacctacgtcccctcctccgccatctggtggtcctcctacggcgtctggcagacactgctgtgggaccgcctggatgcgcttgtcggcgaaggcggcgcaggcgcggagcggactcagggccgcaccgtggctgtccaggtgagaggctgcggcggggctggccacagggtgcacctcggcggtgctgaccaacccgctggacgtggtgaagacgcggatccagacgcggcagcgcgaggcggggggcgctgggctgagctgggccgggacggcgcgggacctggcggagcgcgagggctgggcggggttctaccggggcctggcgccgcgcatggtcagcacctgcgcctggggcaccgccatggtcaccacctacgagttcctgaaacgaatatgcgccctgcccccggaaagctgaggcaaccgacctcaatgctggtgggcctggctgggccgccaggagagttggcctccgcctgccccaagctggactccttggcacccgcgatgcgcttgcttcttttgccctgtgtcgttgcaaggctgtag

SEQ ID NO: 3299 - DNA, 561 bp, Chlorella protothecoides
atgagcaagtcgctgggcaacttcttcaccatccgtgacatcctgggcgccacgccggccgcggccctgcgctggttcctgctgagcacacactaccgcgctccgctcaacttcacgcccaccgctctggaccaggccgccgaccgcgtgtactacgttttccagaccctggccgacgccgaggccgccgcgcgcgcacacgacccggaggtcgacatggacgacggtcgacctccccctggcgagccctgcgccctgctctccgccgccgcgcgcgcgcacgacccggaggtcgacctgagcgacggtcggcctctccctggcgagccctgcgccctgctctccgccgtgcgcgcggcgttggccgacgacctcaacaccccggccgcgctggcggcgctgggcccgcccctgcgcgagctcaacgagctggccggaaagcgcggcaagggcgcggcggggaggcaggccgcgctgctggcgctacgcgcgtccctggtccacgcgctgcgcctgctgggcctgctgggcccggccggcgacgccggcgcgccggacgcc

SEQ ID NO: 3300 - DNA, 1851 bp, Chlorella protothecoides
atgcccacccgtgacgtcgatcttgatgcccttctccagcgcgcggttgaaaacttcgcgcagcatgatctcggcgatgctcttcacctccagcttggtgagctggcggaagacgatgatctcgtccaggcggttcaggaactcgggccggaagtactgcttcagctcctcgttcaccagcgtcttgatgcggttgtaggaccggtcctcctcgttggtgtccagctggaatccgatctggccgccgcccttctcgatgacggacgaccccacgttggaggtgaggatgatgagcgtgttcttgaagtccacggtgcggcccttggagtcggtcaggcgcccgtcctccaggatctggagcatcatgttgaagacgtcggggtgggccttctcgatctcgtcaaacaggatgacggtgtagggccggcggcgcaccgcctcggtcagctggccgccctcctggtagcccacgtagccggggggcgacccgatgagcttggacacggtgtggcgctccatgaactcggacatgtccaggcgcaccatggcctcctcggagccaaagtagtagctggccagggtcttggccagctccgacttgcccacgccggtgggccccgagaagatgaaggaggcgatggggcgcgcggggttcttcagccccacgcgcgcgcggcggatggcgcgcgcgatggcggtcaccgcctcgtcctggccgatgacgcggccgtgcagcacgccctccatgttgatcagtcggtcgttctcgtcggacgacaccttctcgatggggatccccgtccactgcgccacgatgttggcgatgtcggcctcggtgaccacgggccccgcctcgcccccggcctccgcctccgccgcgctcgtgtccttggccgaggcggtgatggccccgatctgggccttgagctccatctcgcggtcgcgcagggcgcccgccttctcaaagtcctgcccgcgcaccgcggcgtcgcgcgcctcctcgggcagggcggcgtggcgcaggcgcacgcgcgaccccgcctcgtcgatcaggtcgatggccttgtcgggcaggaagcggtcggagatgtactggctggcaaacttggccgcgctggccagcgcctcgtccgtgtagcgcagcttgtggtgcgcctcgtagcgctcgcgcaggccgcccaggatctccaccgtctcctccacgctgggctccgcgaccagcaccggctggaagcggcgctccagcgccgggtccttctcgatgtgcttccggtactcgtccagcgtggtggccccgatgcactgcatctcgccgcgcgccagcgccggcttcaggatgttggccgcgtcgatggcgccctccgccgcccccgccccgatcagcgtgtgcacctcgtcgatcatgaggattatgtcgtcgttctgcttgatctcctccatcagcttcttcagccgctcctcaaactcgccgcggtacttggtccccgccaccagcaggcccaggtccagggtcaccacctgcttgccctcgatcgtctcgggcacatcccccgccgcgatgcgctgggccaggccctccgccaccgcggtcttgcccacgcccggctccccgatcaggcacgggttgttcttggtgcggcgccccaggatctgggtcacgcgctcgatctcccgcacccgccccacgcacgggtccagcttgccctggggtgcatgggcatggtgtggcgaggtgccgagtgccagcgaggtctgcagccggcatgcgcgagcacccaccagaccacacacaccgcgacagggtccagcttgccctgggtgcatggcatgggttgcagaggtgccgagtga

SEQ ID NO: 3301 - DNA, 1758 bp, Chlorella protothecoides
  modified_base (946)..(955): a, c, t, g, unknown or other
  modified_base (1358)..(1367): a, c, t, g, unknown or other
atgcgccggggtctagtggacgagggcaaggccacgctcaggtcggtgcttggtggaagggtgggtgatggcctggtctggtgtggcctggatgattgcgacatgcagcgggtcacggagctggcaccacccctgccttctcctcctgggaagggcgctgtggttcctgccgccatgatgaggcaggaccacaggaacgacaactacaacatgtttgacctgatcgcgtaccgcatcaagttcacggagcacccccacgccggtgaccggtggtgcatctacccctcctacgactacacccactgcctggtggacgcgctggagaacatcacgcactccctgtgcacgctggagttcgagtcacgccgcgcctcctactactggctcctggatgtgcgtgttgtgcttggctggctgccgccccgggggcccaagtccaggggggcctgggccttgcgtggggttggcggggcgcggtccgggaccgagtgtcgatcggttcaggggggcctgggccttgtgtggggttggcggggcgcggtccgggtccgagtgtcgatcggtacccgcagagctgtcagcgacacgctgctgcgatactggccatggccgatccgcaccagagtaacccccatggcccccccccctcctcctgcaccaggtcctggacacctacaagcccgtggtctgggagtactcccgcctgaacatcaccaacaacgtgctgagcaagcgcaagctgaaccggctggtgacagaccgctacgtgaacggctgggacgacccccggctcctgaccctggctgggctcagacggcggggcgttacccccaaggtggccggggctggaggggtgtgaaagggcggggacatgctgggccacgggtggtggccgcgccgtgctgtggcggctcgcctgtgcaagctctccagttgatcgccccannnnnnnnnntgccggggtctgaccacagcatgctgggccgcgggtggccgccgcgccgtgctgtggcggctcgcccatgcaagctctccatttgagggcgaggtgtacctgcacaagctggaccaccacatccgcatcgacctggacgccacctcggcgcggcggctggccgtgctgcgcccgctgcgcgtcaccatcaccaacctggcggaggggcattgggaggaggtggaggcccaggtgcgagcagatggggtggaattcatgttgggcatggctgcaggggaggaaatgttgaacagcatgtatggctagcggtgcctggagcccgaactggcatccttcttgttccagaggtcgtccttgagccagttttctcgttctcctctacactctcctcgccaggactttnnnnnnnnnngatggggtggaattcatgttgggcatggcttcaggggaggaaaggaggaacagcatggatggctagcggtgcctgggcccacactggcatccttcttgttccagaggtcgtccctgagccagttttctccttctcctctgcactgccctcgccaggacttccctgggcggggtgggggggtgtacacggtgccgttcacgcgggtggtgtacatcgaggcgacggacttccgggagcaggactccaaggacttttacgggctggcgccagggaagaccatcatgctcaggtggaaggagggagggggaaggggttgggggggggaagtcaagacaagggatccagaaagtccagagaaaggctacattcctggaaggcagcttggggttga

SEQ ID NO: 3302 - DNA, 861 bp, Chlorella protothecoides
atgggcgcaacaggagtaggaacccacggaatgacgagcatacctcggcggccaattggcgtcggggcaaggcgctgccacacacaggatctagtggatgggcgcagcaggaggtggaacccacggaatgacaagcatacctcggcggccaattggcgttggggcaaggcgctgccacacgcatgtccgatgcaggccgttcctggatcgcctgtgagcatcgaccccagagccacaagtctcccccccccaggaaacgtactccttaatctcctcgccggtctggtggcagacgtaggcgttcccccccttgatcagctgcaccgccagctcgtacaggcgctcaaagtagtcggaggagtaggtgacccggtggggcgtccaccccatccacgcgatgatctcctggatgtggtcgatatactcccgcttctccgcctcgggattggtgtcgtcgaagcgcaggaagcagtcgccgccgcgcgcggcggccatgccaaagtccacgaacatcgccttggcatgcccgatgtgcaggtagccattgggctcgggaggaaagcgcgtgaccacgcgcccccccgtggcgcgcaggtgctccgccagccgctctgcggagttggagatgctgagctggctcccgtccgagaaggccacggtggtgtggcacttgttgttctcctcgggtcggggcaggaaggcgtacgggtcggcggtgcgccaggcctcctcctccgctgccgcggggccgggcttgccggccgccgccccgccctccgccttggcgggcttcttctcctgcgtgtgtcgtggatgggaggagcgcttggagagtcaggccccgtggacacgggcctttag

SEQ ID NO: 3303 - DNA, 1515 bp, Chlorella protothecoides
  modified_base (558)..(567): a, c, t, g, unknown or other
  modified_base (1040)..(1049): a, c, t, g, unknown or other
  modified_base (1141)..(1150): a, c, t, g, unknown or other
  modified_base (1229)..(1238): a, c, t, g, unknown or other
  modified_base (1350)..(1359): a, c, t, g, unknown or other
  modified_base (1415)..(1424): a, c, t, g, unknown or other
atgtggtggggagtaaagggggggggagatgcagaaaggatgagttttaagggtggtgcaccaggggaatcgagtaaacaggagagccgtcagcaaagtgatgtgatgagcatgcgatcgcaagccatgcttgtgtcgatgccttgcagcagtgtctcaatgtcagagcctacagcatgccagctccaccagcagtgtctcaatttcagagcctacagcatgccagctccactaggtacccatccaactatcaccccccccccttccccaatgcacaggtacctccccgcggcccgggcagttgccttcaacgagctgcaggtgctgagggcgctcaccggcctcccccacgcgcatgagaagttcagggcggcctcctcctcgctcagcgccaaccccccggtggtcgaactgctgggctacttcctcgccgggcacagcgacagcgcgcggcgcctggagccggccgccatccttgcgcatccagagaacaccatctgggggtcatcatcgcctctcggcatcacccgctcggcctgtagggcagcgcaatgtaannnnnnnnnnggcatgtgcctggatggtggttgtggctggaggggtccatcatcgtccctcggcatcatccgctcggcctgtagggcagcgcaatgcagcaaatgccgcccccctgctcgattcacccctcccacacagggtggtcaccaagtgggatggcttggccccgctcacgcattaccccgcccagcagcagaccagcgggctggggctggggaggcgctggggggagggcgccggcgcctcccacacccgcaagcgcatgctgaggtgaggctgtggcgagggcgggtgggggcctggtgtgatcagaggcgtgggtacagagcacttgcaacctggcacactgcctcaaagaaccgagcgagtgctgttgagtcccgcatcgtctcgacacaaatgataaataagcatcagacattccattccccaaacaagcacccccttctcttcccccccctccctcacacccagggccatcnnnnnnnnnntggcgagggcgggtgggggcctggtgtgattagaggcgtggttacagagcatttgcaacgtggcacactgcctcaaagaaccgaggccattnnnnnnnnnncaacctgggcttcgcccgccgcgtcttctgccccctccccgacggcgccggcaccggtgatgctccgtgcttgcaccannnnnnnnnngctgtgctactgccacgtgcgcggcgtggttcacggttcgctgggctccggttcggtcctgctttcctcattcgacgacacccatgccgagcgcctggtggtcaagctggannnnnnnnnngctgtgctactgccacgtgcgcggcgtggtgcacggttcgctaggctccggctcannnnnnnnnncaacctgggcttcgcccgccgcgtcttctgtcccctccccgacggcgccagcaccggtgaggctccgtgcttgcaccgatcacttttatag

SEQ ID NO: 3304 - DNA, 1431 bp, Chlorella protothecoides
atgcacaacgatccggcgatcatgtttccgcgcgctcccgacaaagtcccggacttgcggtgcacgcttccagtcgacgtcaacccctgttcctggcctccactcgtgattgccacgctctccaaacctacttcttatgcgagtttatggatcactttgaatcgttcattcttcatgctacgtcgaggcttgaagcccaagccaccagagaagggtgtcttccccctggaccactttggggagtgcaaagaggtgaaggagaagtacatggcatgcctgaggagcaatagggatgaaacccgggcttgccaatccctcgctgaggagtacctgcaatgccggatggacagggacctcatggcaaagcaggacctgcgcgagctcgggctcgggcacgaggccaagactgagagcgcaccacgcccagacgagagcgcctcagcgcagcggcggagggaggctcggggctttgttgccggcgaaagccagaaagagcggcgggcagcaccggggcaggatctgccctctttcaaacgtgtcggggctgacgaacgtgcagttgggaagatcaagcagtctgagccagcagccacccatgacgaggcgatcctcagcacgcgacgggtccccccatgccgaggcatggggggagcatggccccgattcgcactcgactgcggacgaggcgtcgtcgtcgactacattacacattttgcgcccaagatctgtgcgttccgtcgcggcatcgttgtgtcatggaacagccgggtggctgagtttgggagcccgactgttgcagccatgcatgggcaggatctctcgacatgcagccctgcgctgtttcggccagcctcactggccacacgccgccccttccccgccccgccaaccgagcggtgtcgcaggctgcggggccgtgcagccggtcaggtccggggtcccgggcctgacgatgatgatgatgagcaggcgtccctgccctcctcctcctccgtggacatagacgacctggtgtccaagctgtctgcccacgccggcagaatgcgcgccggagcccccgccgagccgcagggagggcagggcactgggcgccagcgcgccatctccaacatgggcttcctgctgacccccgcgggcgacgaggcccacatcaccgagtccagcatccgtgccagcgtgggccctggcggcttccacgcctccgacttcgagctgctccaggagctgggccagatcagcatccagcaggactccagggccatcaccatctgcaaagggcctccccctgacgcaagaacccctctgtccgccccaggtggagacgtcgccgggcggggaggagccgcagcagcatgccctgcaccacaacacggcacgcagcgtcgccgtgattggctacacggctgcctaccgctccggcatgccctttga

SEQ ID NO: 3305 - DNA, 1125 bp, Chlorella protothecoides
  modified_base (194)..(203): a, c, t, g, unknown or other
  modified_base (473)..(482): a, c, t, g, unknown or other
  modified_base (1097)..(1106): a, c, t, g, unknown or other
atgggagtgggcctcacaggacacgccgctggccaacagccagagccactctggaatgtatcatggagcaagtacgctgtgcaaagtggttggttgatgcacagggccatggcatggctgcccccttttcgcacaccctctgacctctcacacccttgccattccccctttcctccctcaggtgatcagcacgnnnnnnnnnncggctccttcaacgcctccaaccccatccgggacgacgtgaaccccacctgcaagcccctcttcgagaaggagcaggaggtgaggatctggtgggtgttcttttcgaggagtgggggagatgtgaggtcgggggggggtggctacatcctgtgtagcctggccagacagcatccatgtgccagacaacgccttgccagccgcctctgccgtaattgtctcagcatgatgcgcatccgcacctcccagcatgccccaaccccgcgacctcnnnnnnnnnnggggggagatctgaggtcggggggggtggctacatcctgtggcgcctggccagacagcacccacgtgccaggcaacgcctcgccagccgcctctgccgacctgctgcacgacctttacgacatccccgcgcgctcctgcgaccgtaaggtgaacgaattcgtcaagcgcgtgcgggcggccaagatccactgcctcatcatgggccacctgcgcaagcagatgccctacttcgggcagaagaaggcccaggagaagctgatggacaatctggcaaatgagttccggcaggtgcagcgggagtaccacctccacgcaggcaaggccggggtcggatggggcggggtggagtcggggttgactggtgggagagggggattacgatcctgcatctggatccaacaccccgccgacgccatcgccaatgttgttcaccccgccgacgcaggcgacttccctgacgtgaatcggtaccgggacatcctgtccgcctttgacatttccaaattccccaagctggacaagagcatgatcaagcaggtgagcatgcgccgatggggtggcagcagcgattcatcgaggggaggacgtgttggcgtcctttttgagcgcagggnnnnnnnnnnagcagcagtgattcattga

SEQ ID NO: 3306 - DNA, 846 bp, Chlorella protothecoides
atggtggaccctgtccggctctgtgtcagtggcttggcgccgggggtgaccccatcggaactggaggcccgattccacccctttgggtccgtgctgagctgcgagatgatagcgcccaaggtgtatgacagtgttgagttccatagggggctcgcctacgtcaccctgactcccaaggacccggctgccctggccaattgcctggcagtgtacaatggctgcaagtggcgagggggcgtcctccggtgtgcaccagcctgtccagactaccgcgaacgactccgtatgatgcagagcgatgaggtgaagctgttcgaagccgatgttgggaggggtgttggtagcacgagaatgtcaaggagctggtgcagttttccagggggaggggtgtcgggagcacgagagtgtcaaggagctggtgcagttgtccaggggtctagctgtgtggagcaagactttccttgctggatagggccaagagaaaccctgccccaactaccattgtactccgcacaggcatctgtggatccatcaggcgcagaggagctggaacccgagagcccagcagtgctacggctcaagggccagacgtatggggaggttgtgacgatagcaagcgctgggaatggatcccaccgggccctggagggtgaggatgcatcgccaggcgctgctgagctgcgagcagcctcctcgtgggctcccttgcccgtccctgctggcgcaaactacacgttcgaggcacacctggccaaggttgcacacctggctcctcttcggcaggcccctgccccgcaggagaccgaggaaggcgagtgggagaggtgggcatgggtgactgcttga

SEQ ID NO: 3307 - DNA, 687 bp, Chlorella protothecoides
atgaccgcacgctcaagatctgggcctgcaagtctgcatcgcgccaaggcaggttctagattggggtctgccttgggacggggagtgagtgtgctcagcaaggtggattcagctccaccatgtgcgtccagggagacatgctgtgcctggagcacccgcggtcaggccggtgactggtatacagtggctctgatggaaccgcctgctcgccctggacctctcacagacgggccccggtggcagctggccaccaccctgcgaggcgatcactcccgcaccatcttttcggtcgactggtcgcgctgcgcgccgctgatcgcgagcgggggagctgacaacagcatttgcatacatggggtgggtgaggctgcaagcgccagcccacctcaagccgacgcgaatgccatgccatcgccacctgggagtgattccgggccgggatccggccctagcctggcgcctggcctgaaggtgaggagcctgttcatgcctgagcatgggttccaggcgccgccggtggaaaagctggcggtgacgctgtcgcataaagaggctgcggcgcacgcgagcgacaccaactgcgtgcgctggcacccgacgatacccggcctgctggcttcggcgggggacgatggcattctcaagctctggcagtatgaccaggaggctgaagacgatgcctcataa

SEQ ID NO: 3308 - DNA, 360 bp, Chlorella protothecoides
atggatgctgtagccgaatgcgcacaggagggctggggggcattgcgggggcgcatcggcgccgccgcgctgccggacctgatgcaccgcagcttcgaggcccggcggcggctgtatggcgacgaggcgattggtcgccgcacattggccatggtgaagctggcaaggagctgccgcgctgaggccagcctggcggggagcggcggctgcgtggcgctatgtttcagggaggagtcggggtacatcgagcacctgccggctctgcaagccgcatgcgaggccgcggacttcagcctggtcaggctgcgtatcggagacgccctgcatgccctccccgctcacgcccgcgacccctgttga

SEQ ID NO: 3309 - DNA, 1188 bp, Chlorella protothecoides
  modified_base (13)..(22): a, c, t, g, unknown or other
  modified_base (439)..(448): a, c, t, g, unknown or other
atgcccggaaacnnnnnnnnnnacaaggaggcctgcaagccacctggagttgatgtgagccgtgcgccagatgtttgtttgagtggaactccggtccggccggcatggatttatttccgtgagtatcgccccagtcccccccccatgccgcctctgaaggcacccgtcacgcaccgagtgcatgctcgggcggggctgcttggcaaccccagcgatggcttccagggcgcagtcatcgcagtgtcggtggccaacttctgggcggaagtgacggcctcccccagtccacgcatcgacattctgccctccccggatcacgacccaacctcctttggcagcgtagcacagctgtcccaccatgcggcagggtatggctgcaatggaggagtgcggctcctcatggtgagctgccccacgtccccccctcccttccaccctnnnnnnnnnnatttggcccgatcatgcgcatcaatgagcattcctggggggtggaagcagcgttgcccaggtgaactgccccacgtcaccccctcccttccaacccgggaaccacaggcagcatgccaccagttccagcagcactgcgatgccgccggcatccccctcccgcccatcacctttgcgctatcctacaccaccaacatccctcgccaagcggggctctcggggtcgtcagccctggtgctggcgacgctgcgctgcctcatagaagcgcacagcgtggaggacgggatcagtgccttcgacctgccctcgctggcgctcgcagtggagacttcccttggaatcgccgccggcctgcaggacagggtcgtccagacctttggcggctgtgtgtacatggactttagtgaattgtcctcgtctggccagggcgtgtacctggcgatcgacccaggtggggatgccttattatcagggcatcgaggccagcttgctgggattcgtgggaatgacaggtctgctgaccgtcaacataacgcacgccagcactgcgtgttgcacggcgaccaggcaatagtcaagtccctcaccttccacccacctaccctgccacagcgcacctgccgcccctgttcctcatcatcgacaaccatcccaccgggaagaccagcggacaggtccatgcactcatcaaggagcgctggctcgcaggagaccgtgcagtcaggtgcgggggcgctttga

SEQ ID NO: 3310 - DNA, 735 bp, Chlorella protothecoides
atggagtctcattgggaccccttcgctaccaacgcgtcaactgtacacgagcccacctctgtgagcaacgatgagctctacctcagctggttccagaccgccgacacagacggcgacgggaggctcaccggccctgatgcagtgacctttttccagcgcagcggtctgcagagggatgctctggccaaagtgtgggcggcggcagactacagtcgccgtggcttcctggacctgcccgcctttgccaaggcgatggagctcatctcggtggcacagaggacgggcaaggtcggaggcgaggcatatacccaggcaaaagccatgggcgtggccccaccgcgcatggcggggctggaaaagaaagcgggtcccggctcgcacacggagcgaggcgggatcaatccctttggcggcgcagagagctctgtgagtaggtcggggagagagagcaccccacgtctggcttcgtcgccccccgtgggtgtcccgcccttcaagctggctttcccaccgcaagccgaggcgagcagtcatcccagcaccgcccggacaacgtcacgccggcatcagtcgctgcgacggccggtgatgaccaccaaggaggcggtgggcatctctgaaggcctgaagaacatctacttcaacaaggtagatgcctaccatgcccgggcccagtgtcttgtcatcgttggcacctgcttctctggggttgtcgtcagctacaaaccagcatga

SEQ ID NO: 3311 - DNA, 1032 bp, Chlorella protothecoides
atgcatggcgtgggcactgctaaggattggaatcgatgtgagtgttgtcgtcatgcagcaagcacggaggcaccgtcgcccagcgggcacccgtcacgcacgcaggtcaaggtcaagcggcgcgacgacgacagcaagttcctggccaaggtcctggccatcggcaccgagtgcgacatcgcgctgctcacagtggaggacccggaattctggaaggatgtggagccggtggtgctggggccgttgccccagctccaggattcggtctttgtcgtggggtaccctgtgggtggagacactatctcggtgacctcgggggtagtgtcccggatagaggtcacctcgtatgcgcatggcgccaccgagctcctgggcgtgcagattgacgccgccatcaacagcggcaacagtgggggcccggtcttcaacgaggcgggcgagtgcgtgggcgtggccttccagtcctacgccggcagcgaggcggagaacattgggtgcgctggggcttggtgtaggggcttctggatgctgggatccaaggtgccatgggagcccatgctgcctgcctggggccgggccacatctgtccccaaggggcacctgaggggagggagtgggcagaccccgagtgaggatggtactcctggccgcctctgcttcctgccctccatggggcacctgaggggagggagtgggcaggacccgagtgtggatggtaatcctggccgcctctgcttcctgccctccaaggtgctggtcttgcacccctaccttccatggcatgcccaccagtatgtacccaaaccccttccccctgcacagctacgtgatccccaccccagtgatccaccacttcctggtggactaccaacgaaatggcaccttcaccggcttcccagccctgggcatccagtggcagcgcatggagtctgcgacgctcaggcatgtgatttgggaggtggggaggaaggggtgctgcctcgagcatgcaggcttcagaatcacacgacatgcaataccgcgtcgaggtga

SEQ ID NO: 3312 - DNA, 744 bp, Chlorella protothecoides
atggcggtgaatggctgctgcgtggaggattggccgctggtgcatgccatcgctgcggcccatggggaaatggtcgtcgccaactatggcctgcacccttggtgggtcggccggcagcccgaccactggcttgacctgctgcggcagcgcctgctggccaatcccggggctggcctcggggaggtctcggtgttcaaggcgcagctgctgctggcccaggagctgcagcgcccattgtctgtgcgcagcttgtcgggatcttcgtggcacccctcctcccacccaccacaggtccactgcgtcagagcggtcggccacctgcgcgaggcgctggccgaggtgcgccccacggcgcctgtgctgctgcattcctggtgcggcgcagccgaggacgtgcgtgccatcgcctccgcacacccctccgccttcttctccgtatcgggcggtatatcagcgctgccccccgccaaggccatccgcacgctgcgcgccatccccgccgaccgcctgctgctggagaccgatgcccccgacggcggcctgcgactgggccctgcgtggctcgaggcgctgccaggatttgcacgctccgcgcccccttgcccggagcgccaggagcccgcggggctgaggcggatgctggccctcgtggctgccgcgcgaggcgagggcgaggtgggcctcgcagcgctgacctggcgcaacgcgtgcgccgtcttcgccgggcttcccgccgcccgctag

SEQ ID NO: 3313 - DNA, 480 bp, Chlorella protothecoides
atgcccctcatgccgcaagtgacggagctcatgctggcagagctcctgtacctgcagtacgagagtgtgaccgcccccgtcttcatgtacatcaactcgaccggcgtagcgccctggaacaggctgcattgccagggcaagtgtccggagtcagtcctgcggaatcttcggaagctgtcctctgactcggcgccttcagcgtgggccatccagggccctgatcccgtcatcacactaaccaatatgacaacagaaaggtgccgggaagctgggatacgaggccgaggcttttgccatctacgacaccatgtgctacatcaagccgccagtggccacgatcgccatcggcaacgcctttggcgaggcggccatgctgctggcggcgggggagcccgggcgcagggccgcgctgccctccgccagcatcatgatccggcagcccatccagcgattccagcagatgcaggcgacagacattga

SEQ ID NO: 3314 - DNA, 627 bp, Chlorella protothecoides
atgccaccaaaacaaccgcggtccactcactgtacaccacagggcctgtcccagtttggcaatgggttcctgtccaagtttgagtccgcccagtgcgacaaccgtctgctggaggaaatctcgctggtggacaccccaggtgcggatctggggcctgggcatgcgctgcgccaggcgcagtacgtgagcagggaggagtcgtgctgcggccctgcttgcgagcttgtcggcaagaatcttctcagcgagggcgcccagccatgcctgagatgcatgctgaggatggccctccacctcgtccacgccccaccacatcacacctccctgcacgcaggcgtgttgtctggcgagaagcagcgcatagagcgcacctacgacttcatccaggtctgcggctggtttgctgcgcgctgcgacctcatcctcctgctattcgacccctacaagctggacatctccgacgagttcaaggaggtgtgtggggaggagggaccctgggggtcgcccatgagtcggaggcttggcgatcaacgggagtggggctcacaggacacgcagctggccaacagccagagccagtctggaatgtatcatggagcaagcacgctgtgcacagtggtgtgttga

SEQ ID NO: 3315 - DNA, 762 bp, Chlorella protothecoides
atgccgcccagaggtcgtcctcaccatggccttgttccaccacaggctgatgaggcccgacttcctcgtgcctcaccatctcttcaacaaggatccatcctactttgtcgtggcggggctggtgttcaccaatctcacaggtgggaggcatgggaggggcgttggggttcggcatcgaccccagcacgcagcgcgacgcgggaagctcgtgcggctgggctgcctgcccgatccatgccccctccctcgcaccaacctgctgcagagccgtacctggcatccgagtttgggcccgactacctgcgggaagcccccgtcaaactcctggaccggctgctgtacactcacaaggatcgaccagggcagcaggtcgtcatgctgaaccaggttctggcatgcgaggctaccatcggatatgaggacatctccaactcccagcgtatcctcaaggatgtgcgcccctttgtcgcagtcgcatggcaagtgcacactccccacactcctgaacccttcacatggcaggtggccaagttcaatgatgtgaaggtcaacagcttgcagcatctggtagagctggtgcaggagaacagggagcccttcatgcgcttcaacctggagagcaaggaggtcttggtgctggatgcatccctggctcaggcttgcacagaggagatgcaagtattccactccatcccccatgcgctgagcaaggacctgagggaggccctggggatcccagtggttgcagcccaggcagcgtga

SEQ ID NO: 3316 - DNA, 267 bp, Chlorella protothecoides
atggcggtctctttgcaaaacccctcacaccgccttgacccacaggtgggcgtcaccgccatgctcatcgcttccaagtatgaggagatctgggccccggaggtccgcgactttgtctacatctcagaccgcgcctactcacgcgagcagatcctgcagatggagaaggtgatgctgaacaccctgcgctttaacctcaccgtccccacggcccaccagttcctctcgcgctacctcaagatcgtggacgccgccagtgacacgtga

SEQ ID NO: 3317 - DNA, 348 bp, Chlorella protothecoides
atgagggtcgttggggctttcagctccggtaggcccccacaccctccccgcaccgcctcagtccgggtggcatgcgcccagcccagggacaggcggcagcaggctggcagaggcgcctcccaaccggtgcaggaggtagcccctgcacctcacgttgagggcattgtcagcaagggctaccatgcgctgcatgatccccacctcaatacggctgcgaggtacctgggtgaggtccccagcatgcctgagggagcagatggcctagagacgggttgcatgctccgccgccggggatcccacctgctgtggcgccttcacaggtccaccctgctggacggccgcgtctga

SEQ ID NO: 3318 - DNA, 354 bp, Chlorella protothecoides
atgtcctttaaactcgctgtcagcgctcgtgacggcaggaccatcctccccaaaggggagaagtacataagccttgctgataaggaggatttcaagggtggccactgcgtgatccaccgtctgcattgcccaccccaggatgccacggtggccgatctgaagcgcggcattgccgacagccgtcccgagctgtatacggcgcggcagcggctcaccactgtcgcagagaagggaaagaagggcaccgtcctggaagatggaaagaagctagcggagtacgggctgaccaatggggacaccgtcgtcttcaaggaccttgggccgcaggtcggtgattccaatcaagccccttga

SEQ ID NO: 3319 - DNA, 1044 bp, Chlorella protothecoides
atgctgtcgagggccgtggggttccacctcttcccggtgaattgtgtcccctctcccaccaccccctcatcgcaggcccagctcgaggcccggcgtgccgtgagtgcacacatccgttctcgctttcttggcggctttgcggccgtgtatgtggtcatcctggcctacgccgcctgggtggcacgcgccccgcccgccacatacacataccggcagcacctcacgtgtgtggcgcctgccatgtatgccccgcccgcggcctggcttctctaccgcctcctgagcgcgatactccaagccctggactcctactctgcacggaaagtggctctcctggactccaagctgcggaaaatggtcgcggaactcaagctcccaagcatcgctctggcgtgcactggcgtcccgcttcccactcgccgacctcttgtgctgcctgatcccacacaggagtcctcgcggtatgaacgcactctggccctgctcaagaagtatgaccccgagtacaagccgcccctgcctacgcctgcgccaaggcctgctgccccagcgggcagggcgcccggggtccaggggccacggccccccccgcagcctcagccggcggcggggcccaaggtcgtaccggccctcacgcaactctggacacgcgccgccgacaggctcatagcggacgacccggtggcgctgcgcctgctgcaggaagcgcaacgcgaggccgccgagctgcgcgccgcgctcgtggcgtcggagacagagacgctgcgcctccaggcccagaatcggcacctgctcacggaattgggggtggacatgggttctgacgtgacaggccaccagccccagccagcagaggccggggtggtagaaggccacgccatgcctgctggaggtgagccggcggtggcggccggtgagacagcgttagatacagtcgcagcgtccgggaacggaaagacgggggcggcaggcagctgtgatccgacactcaaggagcccgtcacggaacgacccaggtcccctgcgcggaaacgcctggtctag

SEQ ID NO: 3320 - DNA, 180 bp, Chlorella protothecoides
atggcccctggacagaagggggtgttggtgcgggaggtgctgcccctcagcgaggctgccggcgtgctgcagccgggggacgtgctgatgcagtttgaccagacacagattgccaacgacggcacggtggggttccggagcaacgagcgcatcgcttacagtgagcaggcagctggctga

SEQ ID NO: 3321 - DNA, 450 bp, Chlorella protothecoides
atgcacctgtcggaaatggcccgcccaccccgacgccgccctcctttgctgccacagagcaacgcccagctggacgccgcgctggagttccttgcccagacggggtcggagccgctggacgccggggcgctggacgaggcggcgggggtgggcgtggtcgtgaccccggagcagatctcggcggcggtggcgagcacgctcgcccagcacgcgcagcgcctgcaggaggagcggtaccacgccaacaccaacgtgctgctggcggagatccgggcggggctgaagtgggtggacctcgcggcggccaaggcggagctggagcgccaggtggaggcgctgctggggcccaagaccgaggcggactgcgtgaagccggagagaaagaaaaagatcaaggtctgggagggaggggggagggggggagagggaagactacatccggagggttga

SEQ ID NO: 3322 - DNA, 939 bp, Chlorella protothecoides
atggccaccgggtgtcccgcgacggcgaggtcggcctccagggcccccgcccatgccgggcctgccgctcgccatgcgccgcgcccgcagcgggtagggaggcccggtgctcccggcgcatcgaaatcactgcgatttgcgcgcacgcccatggcagcctcggtagataacgcccaagcgggggtgggcaagctcatcagcaaggtggagatcccggccttcatcccgcgccaggatatgatgaaccagctgttccggtgggcatccgacctggaggacaacgggtatgccctcatcggcagcccgtgcaaggaatctgcaagccaagcgagtccttccacagtcacctcgctggcgtcgtgccataccctaggctcatgcccaacccccgttgccctgccccagatcaccccgctgatggaggacgagcaggtccggaacttcaccatcagcctactcaacagtggggtgtctgttgcggacatcctcatcgcattcgacgaagatgtggccgtgaagcacgagtggattggcatggggccgggtgagacgcggcgtgtgggggtgtccaagggagggtcccctgtggtggaattgggtgtctctctctggctgcggcatggcatgggcgcgtctctccatgcgcctgccccctctgcagctgggaaggtcgatgcaaacccgacgactgctcgcaatgtcagaggcatacccggcggcccactcgctccctccctcgcccatgcgtgcccgcagacaagttcccagtgcctgagggccaccgacgtgcatggcaagcacctggaggtgcgcaagaccgacaccaacagcgtgtctgacgctctgcgggccgccttgcacctgttgtgcgcgaatctggcggaggcggtgaacaaatactacgcctttggctcctgcttctcggaggatgccacctga

SEQ ID NO: 3323 - DNA, 246 bp, Chlorella protothecoides
atggcgacgcagacccgcgaggagcaggaggcggaggccactcgcctcttcgaggccatccagctcgcgcctggaactctagcaggggcgatcaagaatgtcaagttcaggcaggccctggtgcagaccgtgcgcgaagcaggcgtcgagtcggggtgcaccaagcagcagggcgctctgctttacaccgtagccagcaaggtgatgggaggggtgccaagggatcaagatcgcgctttggcttag

SEQ ID NO: 3324 - DNA, 1704 bp, Chlorella protothecoides
  modified_base (84)..(93): a, c, t, g, unknown or other
  modified_base (919)..(928): a, c, t, g, unknown or other
  modified_base (1554)..(1563): a, c, t, g, unknown or other
atggtccatcagattagcatgtggccattgccctggccggcgctgcagtatcgcatgctccatgcacaccaccaacacgtcacnnnnnnnnnnggaggacggtccatcagttcagcatgtggccaccgccctggccggtgctgcagtatcacatgctccatgcacaccaccaacacgtcacaccctgacgcacgagctcccatcatgcccctgaggcgacaccatcccagtccccatcaccctttcccctccctgaatctcccaaccccagtcgacgccgtgaacgacgcgcactcggcgacggtcacgggccgccaggccgccgcatgcacggcccagatggagcggtacctcgcgcagtaccgctcccgcctgggcatgcaggcctgcctggccctgcagcagctgcttctggtgtcgcgggcagtggggcgggcgtgcgccgcgcgaccgcaaggcagtcagaccggcgaggcgcacgcgcgctctctcaacgcgttcgtgctcgagcacgggctggagggcgtcaacatcttccagctgctgcgggctgggggccccctccttggaagtagcatgtctggggtcaggaaaggacgcatgatgtccccccccccaccctccatctcaactactacagtgcccggcatggaggctggaaagcccggcggcggcggcggcggccttgggattgaggcggcggggcagggcccgctccacgccctcctctccctgctgcggggcctgcgcagcgcggacaaggatgggcgcataatcgttgaccccgggggggctgatgggggcagtctgcgctttgtcctggtggatgcgggccggctcttctccagccatgcgggcccggcgctttgggtgatgtggtgcggtgaaggcatcaatgggagctgcgcctgtgcaaagnnnnnnnnnncacctgatgctgcgctgggggtaagcatgcgggcccggcgctttgggtggtgcggtgcggtgagggcatcaatgggagctgcgcctgtgcaaagtgtgtgccacagagttgacacagctccaactgccgtcctccatcagatcgtatccgaggctcgctccgtcatcctggcgtccgggacgctgtccccgttgggacccctcctcacccttttcccaggcgtgcccatggaccgcctgcaccgcttctcatgcggtcatgtggtcgggaaggaacggtgtgttgtcttgggattcgagatgcactggggagcattgaccttgcctctcagcctggcacatggagcccatctgcccagctggcctctcaaaaccctattcttgcaggctgctggccctggctctggcctccgggtcatccggcacccccttggactttcgattctccaggcggggcgacccggcggtgctgagggagctgggccaggtgctcctgaacgtctgccgtgtgacccccggggggaccattgccttcttcccctcccaccactatatggaggaggcggtggcgaggtacgtggggttcagatgctggacaactgggatgctgggcatgccgtccgtctnnnnnnnnnnacgaggcgaaggagctccatccgcagtctgagtccctgccccgcttcccggagctgtgcaccactccgcctgatttctattctgccttgggtgtcacatgcacttagagcctcagataacaactgcagaaatggactttaa

SEQ ID NO: 3325 - DNA, 2133 bp, Chlorella protothecoides
  modified_base (624)..(633): a, c, t, g, unknown or other
  modified_base (689)..(698): a, c, t, g, unknown or other
  modified_base (772)..(781): a, c, t, g, unknown or other
  modified_base (1883)..(1892): a, c, t, g, unknown or other
atggagcataggggaagaacgtcattctggggctgcgttgtggaggctgggtgctcgcacaccttcgacccccctagtcattccttctccaagctccacctgtcacaggtaggtgtctcgggggtctggggtgagacggggcgtggatgggagtctgggcctgccgtcacccagtcatggttatggctccacagcccccctcgcctgccgaggcgtgaccaccacaccatacccagccctgctgccgcgctctccacggatgccaagcccaaatccaaggccaccctcgaggtgaagaccagggacagcctcgcacgggccgtcgtcaccctacgcgccggtaaagtcgagcatgccagcatagacctcgtcatcgacgagcaggtcgtgttccttgcagtgggcgacgccgacatccacctcaccggctaccacatgccagagttcgagggtgaggagggtacggcgggaggggaggggagggggaccgatcttgggggtgctgctgtgtctgcacgtgggagcggatcaagagcctcctgcgagtgcggtgtgcacacacgctgggtctgcacattgcatgatcctgatcgaccaactaccgcactctgcgaggccagatgnnnnnnnnnngcggggtgctgctgtgtctgcacgcgggagcggatcaagagcctcctgccagatgnnnnnnnnnntgatgagcaggtcgtgttctctgcggtgggcgacgccgacattcacctcaccggctaccacatgccagagttcnnnnnnnnnnagggggaagactacagtgaggaggactctgaaatggatccatacgaaggagatgcgatgggagttggcctggacggtgaggattacagcgaggacagtgaggattacagcgacgaggacagtgacgaattcagcagtgagcgagggaaaggtggcttgccagcctctcaagcgggtgtgcaacctcctgtactgtgtacagggtttgtctccagggcattgactgctccccaacggggcccatccgtgctcagtgccatctcccgtgaaaccgcaggcgacgatgagagtgacctggaggctgcgggggaggtgaggcgcccgacgcctgaaatcagggagctacctgctgatgccggggaggatgacgttgaggccagcgatgacacggaagcagacgacgaggagctggatgaggacgagagtgaggaggaggacgagagcgaggaggaggaggagcaggaaaaggctgctgcccccaccccaggccagaagcggaaggaggcagccacaccagttgcccagccgtcggctaagcaggcgaagcaggctcagcaggccaaggaggccaagcaagccaagcaggccaaggaagcccaggtaaccaaccaggccaagcaggcccaggtgaccaaacagcctgcagcacagacggtcgcaaagcaggcagcccagcctgtggccaaggccccggtcagggctgagaccgccaagccggcaaaggaggcaaagaagcgcaccttccccaatggcttcgagattgaggtcctgaagcaggcacgcccgcttggctggaagggcctgggtctgccggatgcaaagtttgccaaggcggggaagactgtctctgtcaagtacacagggcggctgaagtctagtgggaaggtgtttgatgccaccaagggcaacagggcgttcaacttccggttgggagtgggagaggtgaggcgtccttctggtcaggggtacgggcaggctctgaacatgctagggggtgggattgtgagaagcactgtgggtgccgactccgctcgcggtgtccaccacagcagcggaggcttgaatggccctccattgctgccagcaatgatgcagcagggggnnnnnnnnnnacatgatttgccctccattgctgccagcaacgacgcagcaggtctgaactttgaccctgcaatccttggccatccccaggtcatcaagggctgggacaggggggtcgagggcatgcgcatcggcgacaagcgccgcttgatcatccccccggcgatggcgtacgggaccagtggggctggcaaggccattcccccgaatgcctggctcgacttcgaggtggagctggtgaacgtcaagtga

SEQ ID NO: 3326 - DNA, 675 bp, Chlorella protothecoides
atggaggaggaggccatcatcaagtatcggtacctcacacagacctatgcacttgctgccgctgctgctgctccgtgcctccgtcggggcgctggcccagagcccagaggcccagtgtgcggagctcctacctgcctgggttgccccacccttcttcatgcctctgatccccgccccgagacgcccaggttcttccaattccggaccgctctcacctctggcaccgcggcggaggcgcgggccctgtacgacgacctcctggtggacctgcatgccattcagtcggccctggaccgccaggccaccggcgcgcgcgctaccggcgcgcgcgtggcggagcgcgaggcggcgctcttcgccgccgagcagcggcgcctggaggcgggcattgccgcgacgcggggcgggatcgaggccgcgcgccgggagctggccgccgcgcaggccgacctgcgccacgcgcgggagtacgaggcgctgcggcgcagcgtggcccaggcgcgggggctggaggaggcgatggcccggcgccgcgccgcgctgaccgggctgctggccgtcgcggcgggggtggcggccgagctggagagcgaggcgctggcggaggagggcgcgctgccagagacagagacggcggagaccgtcgctgggccggctgcgtcgctggaccgatga

SEQ ID NO: 3327 - DNA, 828 bp, Chlorella protothecoides
atgaagccacctccctctgggccccgcacacactcctgcacacctcctccccccaggagggaacgtctgcgcccgccggctcacgaggcagccctgtcctccacgggcagtgacctccacctcaccgtccagcaccggcggcggcgggccagctacttctctggcgatgtcatggaggtgcagcagcagggtggcgaggatggcatgaccccgccgtgggccaggcgcgtctcgccggccctggcggcacgctccgacgtggctcgctgggtgacgcgggagctgcaggcgatcctgctgcaggacgatgtcgacctgctgggtcagcacctgctgggcacgctgcgaggtgctgcccagcttggtggcggcgctcgtcgggggacgaacggcggtggcccctcccatgcggtgcggtggagcccgttttggtcgagggtgttggaggtgtgctgcgcgccttggagatgggagaacggcagggtggctctggtgcaatgctcgctcgctgcaaccctcaaacctcattcccccctttgtaagctccaggacctctgcactcggctcggcacagcggccggtcccttcctgcaccggcacgccacgcgcttcgcccagcagctggtgtccttcgcgtccagcggccagagcctggcgacctgggacgctgccgcggcgatggcggaggaagtattggttgccggtgctctggctgccagtgacggcaacgccgcgacgacagcagatggcgatgcaacctttaccgtggtgctctctggattggaggacgaagacggcaggcagccaatcagtgggggtgacggctga

SEQ ID NO: 3328 - DNA, 426 bp, Chlorella protothecoides
ccgcacccactcccagctgtcccagtttgtgggggagctgcggcgcacccgattcgtagacagcctctccctggtggttttgggctcccgtggcgcgctgtgcatcaacgatgcggttgcccgcctgggctcccccgccgccgtcaacgaggcctgcgccgagctccagcgccgccccgcgccgcgcaagaaggcggggagcggggagaggacgggcgggaagggggcctgcccttacctcgcgcgcggcggcgcgcacgccgccagcctccgcgacatggtgctggcccaccccattgacatcgaggagctcgccaagctgggtgagctggggattggcccatgtcagggtgcaggcggcgtggcaccattgaaccccttgggaccccgggaagggggtcccagcccagggcgacctgcagactg

SEQ ID NO: 3329 - DNA, 1275 bp, Chlorella protothecoides
  modified_base (346)..(355): a, c, t, g, unknown or other
atgcagaagctgctgaatccagcgccagcccatgctgtggcaaagagacggctcaactgcggggctgacagcgagagcgaggtggaggggcctgggaccgagccaggcttggcaggcctcccacggagatccagagccggcaccttcaccgaggtgcaggtgtgcggcctccccttgctgcgatgccccagggagtttgcggacttgactcttccctgccagggtgcgggcgaggctacagccccgccccctctctttctgaaccaacttccatgccacccctccccctccccggggtgctctcaggccaacgaactgcgcagggcgttcgaagcctgcaacggcnnnnnnnnnngcccccctctgtttctgaaccaacttcaatgccacccctcccccgccccggggtgctctcaggccaaggagctgcgcagggcgttcgaagcctgcaacggcgctaaggactgcctgtcacgtgtggtccaggccctgggaggccgcttcaagaaggtccacgtcagccgccagctggctgccatgggcctggccaaggggaagttcacgcccgaccaggacacactcctggccgcgtactgtgaggagtacggcggcagcacgcccgacggccgggcgctcatcgcagagcgcttgaacgccggtttctcggccacccaggtgaagcggcgcttgcaggccctggggctcgtcgcgggcccacccactgccgccggcaagcaggctcgcgattggcaggccctgctaggatcctccagtgacgaggatggcagcgaaggcgaggcggggcctggcgaccgcggcagctcacctgtcggggacccagcggtggaggtccggcctcctggcagcgttgcctctgctctggacgctgaggagagcgggatcgagggagagggcggggccgagagcggcagtcaggcgagcgccccgccgggacacctgagcgcggctgagccccctgaggccgccgcggcctcgcccgagtccaaacgtgcacgcctggaaggtggggaggacgtcgagcaagcggcggctcggcgcaaggccgccctgcaagccctgcgccagtgccggctgcagcagcaggtggcggcaggggagccagagtcccgtgcatcggaccctgagccgctactctcagccagggaggcgatccaggctccggacaagtcgagcggccgtcgtcgcctgaagaaggcgggagccgcccccgcctcgctgctgctggacgccggcctcatggatgaggatgcgtag

SEQ ID NO: 3330 - DNA, 1887 bp, Chlorella protothecoides
  modified_base (1389)..(1398): a, c, t, g, unknown or other
  modified_base (1737)..(1746): a, c, t, g, unknown or other
atgctagcgtatggcagccccccggaccccagggggcacacccgacccttcttcagcccccgccccggccccttcctgcagctatgtggccgtcttgatcctcgtcaattcctactctcaaggctcgggcctcgcactcgctggcgtggtgctgctgcacttcctcccgtccctggtcctggcacccatcacgggcatggtggccgacaggcgagtgggtgcctccgcaggcacgagcctgccgggggatgggctgcaccctgtctgcctggccacttgtccccggccgagcacccctcgaccaacctccccacccaccctccacaggttcaaccgggtcggcatcctgatcgccacctccctgctctcctgcgccgtggtctccgccctggtgaccgtcacctcgcgggagcacacgccgcggctctacgccctgctctccctccagttcacctgcgtggccttctacaccccggcccgcactgcgctgatgcccgtgctggtggcgccccgggacctgcctgccgccagcaccatagacacctttgcctggtcgctgacgggggcggtggcctccagcctgggcggcgtggtcacctccaagctcggcgtccgcgccgctttcctcctggtgcgatgcgcgcggcctgcacatggcgatccggggcatgcagcgctgggcggtcggtgccgtcggagtcggctggcaggagcgccggggtgcaggtgcacggctacccccactcgctccccagagcaccacagggcacctcaaccatccaccctccgtcttctccttcccgaaacgcacaggatgcagtcacgtacctcgtcagcgcggtctgcgccgcgcaggtcccccgagcgctgggcgtgccgggggcgcccgccgccagcaccagggcccgggagggcgaggcacagcccctcagcctggagctggcggcgatggaggcggtgggctgcgacgggggcgcccgcaccgcgtgcggcgagggctcggcctcggactccgagccggagcccttggccagcgccggacgcagcagggcgctgcctggtatggccagcgtcggacgcagcgggatcttgagcagcaccggcagcatcaagcagggcgggatgctgcacagcgcggacagcgcagtgctccggtatgactttgggtcgcagctggccgctggctggcgcacagtgacggaggggtgcaggtatctggcagcccccgagaaccgcgacgtcgcggccatggtcacgctcaaaggcgcaggctccctatcctggggctgcatggacatcatgaatgtgaggcagcgtcagccaggggggatgcgcagggtgcctggcgccgatcgcaggcccgcaggtgcaggatccatggcacatgtnnnnnnnnnnatacctccaggcaggccgcatcgtgtgatgggtggcagggatgcgcagggtgcttggcgccgatcgcacgcccgcaggtgcaggatccatggcacatgttcccctgtgaacctcgctgcctttttatttgtcgagcgctggagtgcctctcctctcgtgttcctgcaggcaccctgcctgcccgccgctgctattccaccagaccagttcccttgccaacccactccttcctcttcaccccttcttcctccatcctcctgccttcccccagctgtctatgcctccgcacacaccctccctaccccaaccccttccaggcccggctcagcgacctacccnnnnnnnnnncacccactccttcctgttcaccctttctttctccatcctcctgtcttcccccagctgtctatgactccgcacacacactccctaccccaatcccttccaggcccggctcagcgacctacccgagatgcagcacctgggtga

SEQ ID NO: 3331 - DNA, 561 bp, Chlorella protothecoides
atggatgaggaggtccgcgccctggaggcagaggtgacggtcgctgcacagcaggtggcgaccctgcgcacctcgatgcagactgccctgcaggaggagctggcgctgcgcctggcctccacccgtccttcgtctgaggcaagccccgtggagccggacgctgacgcgggctcggcgtcgcgtgagcccgcaagccccgcggaggcggacgctgacgcgggctcggcgtcgcgcgagcctgtttttccggccctagagcctggcctccaggcgctgcaggaccagctggaggccgcggcggcccagatcccctccctgcgcgcacgcctggaggagagcatttcgcgcatgtcgcgcatcgccaccgccatgcaggcagaggaagcccgggcgcgggaggtggcgcctggcacagtcgagaaggtgttggccgggaggacgcccggcccggggtccgacggcgtggccccctccagcccccccagctccgatgaggaggcggaggagggggcggacctgcgccgcgccctggccgccagcctggaccggcccctggattga

SEQ ID NO: 3332 - DNA, 2637 bp, Chlorella protothecoides
atgagcctccgaatcgcatcctcggccagtactcgacctggtttctcagtgcttcatgccactctccgccttcccagcagaggtggcattcgcagcctagagctctctgatcattcccctctcgctcatgctgcacccaccaccacaggcatcacccatcccactccgcgtcaacgtcatgtcggagcacgcgccgagctgggaggaggaaccgactccaaattgcagcttgctgcgggcgtggcaggggtctttgctgcacctctggtcctatggagctcgtacacactggcgacgacagggtcaggcctcccaccaggacccagtggtgtccttggtgctgcagagggcctgagctacctggtcgtgacggccatggtggcatggtctgtgaagactaagatctccagtggatctgggctccctgctggcccttacggactagtcggtgctgctgaaggcctgtctttcctggccattgccgctgccacatggtgcatccataatatgccatccaggacctcatacatcaaatgcacaaatctctgcaggcatcatcgcatttgctgtcaagacggtcaacagttgagctccccgcacttggattgccgagcttgtttgacagatgatcaaaggctggcgaagaccatcccattgatgcttcttgcaaaaataatgctggcccttactgtggcagggttagctgaagtgaagctgagccgggggcgcaggcgcgagcacgacattttgtcacagctcgggagggccatggtcgcagttatcaagtcgcccgccgacaagaaggattaccgatacattgttttggacaatggcttgcgtgcattgctcatccacgacggtgagatagtagatactactcaggaggatgctgaggaagcggagccggtgtctcactcgggctccagcagcgagtcgggctcggagagtgaggtgagtactgccggtagctggggatctgacgctgagggggagggggacattgaggcagaggcaccggccggcggtgtcaagaaggcggcagcggcgctcagtgtgggcatcggcagcttctcggacccttgggagctgcaggggctgagccattacctggagcacatgctgttcatgggcagcgagaaattcccggacgagaatgactttgattcgttcctcaccgctcacggcggcgcctccaacgcatgcaccgaaaacgtgagatggaagacggaaaggcgctaccgtccctctcccctccatgcttcttcccctccatgcctgtccccacccaatgtcccctcctctccccaggaggccaccacgttctacttcgactgcaagccctccgcgctgcagggtgcgctgcagcgcttctcccagttctttgtggcccccctgatcaaggcggatgcgctggagcgggaggtccaggcggtggacaacgagttcaccggcgtggcccagagcgacggttgcagggcgcagcagctgcgggcgcacaccgcgcgccccggccacgagctctccaagtttggctgggggaacaggaggagcctggcgcaggagccggcggcggcgggggtggacgtcaggggcgggctggtgcggcactacacgcagcagtacagcgcggagcgcatgaacctggtactcctgggcggggagaccctggatgagctggaggcctgggtcagggatgagttcagaggggtgccggggggaagagggccccggcccagctatgcggaggcggggttcccatttcaggtgactgttgtgcaggttttgtctctcttttgtcagtgggggggaggaggaaaggaaggagaggctttgctctcgccatgggacgttatctgcggccagccacagaattgtgcatctaggtgcatcctcggcctcgatgacaacaccatcccctgcatcatctaccctacagggcggcagactctactgccttcaggcagtacggcaggcgcatcacctgcagctcaccttccagctcccatgcctgcatgccgagtacaggctgcatttaagatcagaggtgtgttgcatgcatggtccgcagcatgcctaacattatgcatggactatgctgacagtgtgtcaatgatcaaaggcctgtatcccccaaagcatcaccatcagaaagtcccagctgtgcaaattgtgcctctgggccacgatgtagagagccctccttctcttaacaacacgagcacccctccttacacaggaagaaggctgacgactacctgtcccacctcatcggccatgaagggagggggtcactgctgtcagccctcaagagccggggctgggcttcggagctgtctggcggcgtcaccgagcagagcaccgcattttatctctttgacattgtcatctccctcactgaggcagggctggcgcacggatcaggtacatggaggatggaaacagggtcaggatgcccttgtaagcactagcactccggactagcgccggtctggcctgcgtcgagctggtgtttgcatacctggagctgctgagaaagagcgggccccagaagtgggcgtgggaggagatggccaatgtcgcagccatgaagttcaggtgagggggtgctggagggctgcatcacggatccatgcatga

SEQ ID NO: 3333 - DNA, 2253 bp, Chlorella protothecoides
atgcgggtaggtggcttggaggcaggggggaagcatggggctagggcatgggctggctgctgggggacccgatgcgccccgccaaccctcgccccgagtcccagcacgatgcacaccatttcatgcactcctgcaggacgatgcggctcaggaagtgattgcgaatggggttgctcaggccaccatgcggcggagcaggcgggtcaccgccagctcctacaaatcgacctcctcgtcgagcaccctgccccccgcctggtatattctcgcatgggacagggaatgacccccccgaccaccaccctctcgatcactcccacctcgcaccacccttctatccaccctccgagctgtgccctgcgctcctgcccctcaaaggctccctcctcttcaacaataagccttcctgcaatccctccctccgccatgccccccgcagccaccactgcccgacatgactccagcctaggcctgctgacgcgacgcttcctgagcctgctgaatgaggcggaggacgggagtctggacctgaaccaggcctccgacatcctgcgcgtgcagaagcgccgcatctacgacatcaccaacgtgctggagggcgtgggcctgttggagaagcaggccaagaaccacgtgcgctactgctccgggccggagacaccctgtgcgcaccgcgaggcgggccgcgccgcggcctcgcgcggcggcggcggcggcgccgagggcgaggcggccgcgctgctggcggaaatcgcggaggagacggcggcggtgtgggacgcgatgcgcgagatgagcgcgcacgcgctgaacaagcagcgcctgtacgtctgggaccgggacgtgatgggcctgccaggcgtggcgcgggaagaccgcgtgttcgtggtgctggcaccacacgggaccaccctggaccactcgccctgccaggagccagggccgggcgaggccgcgccgccccacaggtcagtgggttgggtgggggtggggacgggggctgagcgggaacggcatgtgtatgtgtggggggttattgaaggggaacggcatgtgtatgtgtgggggggtattgaaggggaacggcatgtgtatgtgtggggggtatttgaaggggaacgatgtgtacgtggggaattggggcaggggaggccccgaatcgccctccctgtgaggaacaggggtggcgcatgcctgtggccggctgcgagacgggctcttttgtgtcacagcaccgtcatacgcagggcacgctgccgcgtactttgtcccagtgccgcccaaacactccgtgtcaccgcttcgtcgcaactcctcctccttccttgtttgccccgcccacctgcccgaccatgccgccccctccccacaggatcatggtgcggagccagaaggagcccatctccattgtcaccctccccgtggcgcgccaggccctgcagcctgggtggggcctgggccccgcccagcagccgccgccgaccagcctggcgaccccgggctggccggggtcgtccttcctcatgccccgggcaggcctcgcgctccgtgaggcgcaggccggctccgtggccgacgcctggtaccgcgccgtcgccgccaacggcgccggcccgaccgccggcgacgggctgcccctgggcagcgagctggaccctggggaggggggcggcctgcttcccggacagcacagcctcccgggcggggcgcctgcgcacccacaggcctttttggcgcgcagcagcgcgcatgagggcggtccatgagaccagggtcggaccgccagccctcgcaggtgccggtcacacaagcatgtcactcggggaaggctgcagtcccggccgtctctggggcccaggctcctcacgggacagggcagctccgtgcccctgcgcgcatggtgctccgaccagcgtccatgcggtccagctatttaggagattgagcacctcccgaaatacttttcccctgtttcagctccatcccacactaagctccgcccgtcctgatgtgaccacgtcccatggtctggcttctcagcctgtttgcgtcctgaagctcttcggagccggagggtcagtgtgtgagtgcgatgagtacgagggcggccactgccaggccgccagacttgaaaaaggcgtcaccggtccagacgtcggtcagtccatgctctgcggcatggatgctgctgcgccggcgcgccggcgcatgcacttggctgcagtagtaggggaggagaattgggggttgtga

SEQ ID NO: 3334 - DNA, 1518 bp, Chlorella protothecoides
atggagggggacaagtgcttgcggccaacctctgaggtggggcagccttcggtgttgggggtggcagcagtgcatgtgctcagagagttcacacctgtgtcgcgcacatcccccggaaaccccctccctacctgccacagccaccatctccagccctcccccactccacaggagtcgtggcgcacacctggctactccctgcagctcctgctgccggccgtgcaggccctgctggacgcctggcgcgacaccgacgccctcttctcatcggttcgcagctggtccgcccagcccatcggcctgcgccaccccttctctttctactacggccacctggcctcctttgcgcgctcgcggctgctgcccgggcggcccgccggccacctggacctgctgtacagccgcggcatcgatccctgcgtcgtcgaccccagccggtgccacgatcaccccccgcccccgcccacctggccgggcggggaggaggtgcgtgcctacgcggtgggcgtccgtgccgaggtgctggccgacgcgcgggcgctgccggcgcgcacgcacgcgctgcacatggtgctggagcacgagcggatgcaccaggagacgctgtgctacatgctggcgcagcagcgcggcgcggacgccgcgctgactcagcgagagggggtgctgggggccttggccggccgctgggcggggtgcagctaccgggcgactgagcagcgccgtgccgatgccgcgtgggtccatgtccccgccacccagatccagctggggctgggcagggcggcgcgccacgggtttgtctgggacaacgagctgggtatgccggcaccacaggcggtgccagccttccgtctggcttcccaccccgtgtctgtgagggagtacaaggccttcatggacgaggcacaggtggggctgccgggttggatcttgaaaagtggctggccgcggtgcgggttgctagatctgagcgtatctgcgccaaaattctatgcccagcttcattgtcgtgccctggacccaagagcctcaccgccaccaagccctgtcccctttcagccatatgagagagaaggactgtggtctgccggggactgggcgcacatctccagctcaggctggaagaggccggccggctggatcctcgaccaggagggccgtctgcatgttggcctgcccgaggccgtctatcagtgggaagaggtggcggacagtccagtctacgtcagcctggctgaagccgaggcgtttgccagatgggctgggggccgcgtcatgacggaggaggagtacgccgccgccgtccaacacaaggagctgcagggcctgctcagcagcgtggcagccgaggcagatgagcaagccaccgcccagtgcctcgagtctggtggctgggagtggacaagcaccccattcaagcctttccagggtgaggcaggctggcaggaggtgtcaaggggccatgccatgatgaaaggacagaggaagtacatgatcctgaaggacggatgctga

SEQ ID NO: 3335 - DNA, 780 bp, Chlorella protothecoides
atggggcatgagttgccgggctgtttttgtcatgggctgcccaacctgagagtcagtcggctacaaggagccgctgatcgccaatctgagagcggccgtgggaaagaggactggagccttcggggatatccctcgtcccttctcacacactcccattggctgtcttcacaggagttgacaagtgcagtgtggacacctggctctaccccaacctgttccacatgggcacgggcacagccttatactttcagactccctcacaccctgccagggtcacctcccgactggttcaaccaggacggtcagaactgggggttccccacctacaactgggaggagatggccaaggacgactactcctggtggaggcgacgtctcgcccagatggcacgctactttcaggcatgtaggcgggacctgggtggaaggaaggaggaatgctctcctagagtttgcgatacatacctaggaggcgatgcaatggcaggacatagggaagggaggcggtgccccggtgcgccatcgttcttgcgcaggagaccgccgctcgcgacctcccatcctgggacgcccccgctcactccctgcctccacactcacccccaggttttccgcgtggaccacatcatcggcttcttccgcatctgggagatccccggtgactgctggagcggcatgatggggcacttcaggccctgcatccccattgccagagctgagctagaagccaagggcatctgggatttccacaggcatgtcggacacaaggaggcggggtaa

SEQ ID NO: 3336 - DNA, 2130 bp, Chlorella protothecoides
atgggactgctgcaggttctgaatgagtgtggcggccagcgcccagaacatgatgcaagcaagaggcatgtcgtcacccttgttattttgcagatcctttgtcagaacgcagcctcacaacatcagggatgcgaatatccccttcgacaccgggcaagaacacttctaagatccaatgcttgcagatcttatctttcacatccatgtaaagggcaaggtggtccagcccccattcgactcaccaaagggcaccctctacctttcactgacccctctgtgctgtgccccagcatgaaatcatcaccggctgtcgctgatggctcccgacatattccagccgagcttggaggtggctgtgtcggtgccccaactcccttggcggggagccatgctgaggaatctgcgacccaatgggccaacctacaatctcaacagtatactggaggacctcggggccgacggccgcatcatcgtgggaagggaccgagattgccacgtcgctgcgagccatttcgaaagcgcacctcctggaacagcctacatgctctcccggcggcatgccctgatcaaggtgatctgatcgggccgccgagtggtgtacaccgcgttctctgcccaggttctggaccgctctcagcacgactcctgctcgcattggatcctctccaggctgtcgagggacgattctccatcctggataacaatgcaacgaatggcaccttcctcaatggaagtcccctggagcctgagagctggcatgtcctggaggatggcgacatcctccactttggcgggccccagactgtgaagccaaagggtgccttcatcccgaatccctgggccttccggttcagcagcgggggaggccccgaagcggattcaggtaccggcacggaggtgccctgccccattgcacacctcgactcccagccgagacgcgaggtgtacagcttcagcccggcgcggtccctggcgacgagcaggcagcgggagtgggtggggcctgtctttgccgacgagaacacgaggcatgctttcaacctggaggcagaggcactgctgcaggagcaggcagaccggagcccatgcagcaaccccgcaggtacaaagaaagcttggaaaaagggaccctgtcatgccgcagacctgttgagggagcgcgaagcatggtctgtcgcgtgcctcctgggcacacctgtctcgaggatcacgccggaattgctcccccacagcgtcagtgcaagacattccggcttcagtggatgccagcattcctccaaacacctgtctcatcgggccacccctgccattggccggcgtagaggacgacagctcgctgcccatcgaccttgtggagtgcaggaggaggggcctgtgtttgggacggatgctgctgcacccccacgggcaccttctgaggaggtgtcagcctcactggccatccctgcttcccctgctgccccacagcagcagggcccagccaccttccaggcagaggcatggcaccctgccaccgctttgtccacggcgacgagcaccagcccagacaaggacgcgtgcgccgccgagcctgagcgtggcagcagcgggagcatgctcccgcgcccagcctcctcgccgagcaggcccaggccgaaacgcgcgggggaggagctggtcgggggccggcccagggcgagcgtgtcccccgaggggagggcggcgtgggccgaggcccggcgcctgcagctcgacgccatcacggagcacctggtctgcgccatctgtcaggcaggctggcgacgcaaggggtcactgcaggggggtccggacccgccagggacgtgtgggtgtggtgggagtctgcagagtctcgtgggcctgggtcgcaggcggcggtccccaccacgccggccggtccctgcgcccatgcacctcgcctccctccccctgcaggaaaacctggtggccacccacgtcctggtgccatgcggccacctcttctgcggggcgtgcctaggcgacctgtatcgcagcttcaaggacccgccccagtgccctacctgccggtgggtgggcttgcgtgggacgtggcccattgcagccctggggaaggaggctgtcagttgggggaggtgcgtgagagtctga

SEQ ID NO: 3337 - DNA, 927 bp, Chlorella protothecoides
atgagggatcacggcatcgcccacgactcagctgccctggaacagcgctggctcctgcgcatgcagggcctggccctcgcgctgggcagggtgcccgtggtttgggaggaggcctttggcagggcaggcgcgggcctggaccccaagaccctggtgcacgtctggaagtggtggggggagggcagggagcgggagcaaggcgcggcggccctcgcctcggcccggcgcctgatggcggggcgcatggcgtgggaaggcccagggtgggcagcagaggccacgaccactcggagcatgccgctggggcccggcctggcgtccccaggacccgaagacccccgcgtctgggccgccaagctgagcgccgtgaccgctgcggggcacggcgccctcctctccgccccctggtacctgaatctggggacgtttgcggaggaggactggaaacggtactacgcagcagaccccacggcgttcccggcaaggaactccacccaggtgagggctgggagacctgtggctggccgagggcacccagggaagctggtgtggcgccggcgtggcggcgcactcacgcggcagccaggagccaccaaatcccggccaggccttttaccgcccctccttccccagggacaatggcaggaacaccccgcgcccagccttccccacctgccctgctccctcccccccgtgcagcgcgatctagtgctgggcggcgaggcctgcctgtggggtgagttcatcgacgacaccaacgcgctgcagaggggctggccggccgccgcggccgtcgcagaacggctctggtccccggggacgatcaccagtctggctgcggcggggccgcgcctcgcacagttccgatgctggctgctcaggctgggcatccccgctgcacccctggggcctggcagctgccagtga

SEQ ID NO: 3338 - DNA, 564 bp, Chlorella protothecoides
atgcatggactgggcaccccctctgtctcgcaatccccgttctcgacgagccccacccctgcctccccagcgctgcgcatccagcgcatgccctccggccaggaggagtttggcgaccccgctgactacccctacatgtgcgtggcctcgccgtccagccacgacaccaccaccacacgcgcgtggtacgaggaggacgccccgcggcggcagcggtactacgcccaggtaccgcaggggccggtcggggccgaaggccgctctcgtcagagcgagtggcgccggggaatgcatgcacctgcttcctttgaaactgatgtgctgggaggggagggacccgccccagcgtcctgcaccccagagatcatgcgggccatcgcgcagcaacacgtggactcgcccgccgtgctggccatcttccccattcaggtgtgctggtgtagtagggcgggggtttggggtcttgccaaaaggggacgacccacacgagcaatgggcagcctgccccctcggcaaagctcgaggattgcaaacgggagcggaggggcgctgctggcactgtga

SEQ ID NO: 3339 - DNA, 1077 bp, Chlorella protothecoides
atgctgcagccatcccagcccacctgccggcgcacccattcaggacccccccctttcttcctcagattcctggtgccgctgctgctggtgcacggcaacctgtcctactaccgcattgcgcgcctgatcaagtactcgttctacaaaaacatcacctttgcctttgtgctcttctactaccagttctacaacggtttctcggggggtggggagcccagtgccctgcatcgcgatgctgcagcgtggagggtcgcagcctgtcccccccttgcgttacttcaccaccaaggcccccctccccccgaggctcttccgaggacgacgcactccctcgacacctgcgccccccaatcagtcgccatcacactcccccccatcacccccttcccccacctcgcaggccaggcgctggtggactccatcacggcggcggtgttcaacgtggtcttcacctccgtccccatcctgctcttcgcggtgctggaccgccccgtggcggacctgaagacctacatccactacccgcgcctgtacgacaagtcggaactgcacacgctgaccaccgccagcttctggaagacgggcgtggcccaggccgtggtccacgccgccgtctgcttcttcatcccctactacagcatcgccaccagtgggcgccacaacatcaccgacgtctacagcctgggcaagctggcattcgtcgcgctcctgggaaccgtgaacctggaggtggcgctggtggcgcgctactggaccgtgctctttgccgtcttcgtcgcgctgtcctacttcctggtctacccctacatggccatcttccccctcatccagctgggcctgaacatctatgaccctgccaacgtgggcgtgtcggagaacgtgctggccagccccaccttctggttcgtcatcatcatctgcaacctgaccacctttgggctgcgcttcgcggaacgcaccgccgactggtccttcaagccccaggatactatgatcatggccgagcacgaggaggaggcgcgcaagcagggcaaggtgagtgggtgtggatgtggggtgggggggggccgtcggtga

SEQ ID NO: 3340 - DNA, 1467 bp, Chlorella protothecoides
aaatctgacccagcctgccctcgtgctggagctccgcacacacctccgtggccacctcccccaccccaaacaccccgactccagggtccctcccccgacgaggtggcgctggtggaggccgcgcgccagctgggcttcgagttcgtcagccgctcccagacggggctggtgctgagcatgctgggggaggaggtggagtacgaggtgctcaacatcctggagtactcctccgaccgcgggtgcatgagcgtgatcgcgcgcgcccccgacggcaccatccgcctgttctgcaagggctccgacgccaaggtcatgaggaaggtgcgccccggcaccgaccccgtcctgctccggcagaccgacgagaacctgcacacctttgcgcgccaggtggggttctggcggggcgctcgattcccgagcgccggggctcgagggggggcgcggcgtccagaccgcagctggcaccccggcccctcggcacacgaccgcggggccggggcgccagttcctcgacccctcctgctggccccgcagcgggtcgctcctcggctcgcctgggcgcgccaccgccccccctgcgcgcctgaacactccccactcgacagacccctgctcgcacccctccagggcctgcggaccctggtgctggggacgcgcatcctggaggagcagtggcatgccgcctgggacgcgcgctaccaggaagctgccagcagctttgaggaccgggacgggaagctggacgccctgggggatgaggtggagagggagctggagctcgtgggggtcaccgccatcgaggacaaactgcaggtggggctgggaggaggccgcagcgtgctcggcccgtcggtggcggcgccccagagaggcgcgggtgcaagggatcgccggtcgtgtatggggcaaggatgcctgtgcgctgtggggtcagcgtggagctgcccgtgctccctggcctcaccccccgggcccttcacccgttgggggccagcacccaccacccccactccctgtgttcaggatggggtgccggccgccatcaagaccctgctgacggcaggcatccgggtgtggatgatcaccggggacaagatggagaccgcggtgaacatcgcggtctcctgccagctcgtcaaggaccccgacagcatcatgatgctggtcggaggggatgtgtcctggcaggccaaccccccggcgtcgcagatcctgtcgtccctgagaatcgcgagcctcgcgaggcacaatctcttccaggaccctcccctgcggatgccaccccacgccgtgacgactccccaccccgccagcaatcaaccctgcatgaacccctgcagacccggccacagaggcggaccgcctgctggactcgtgcatgaagcgcacgctggagacatacgcgcggagcagcggggagcgtgtggccaccctggaccaggtcccgcactcctggcaggctga

SEQ ID NO: 3341 - DNA, 240 bp, Chlorella protothecoides
atgcgcggcgcctcagggcgacattatcccattccccaccattcgccccctccattgccggcaccgccaggtgtgcacgggccggcctacctggagtctcgcatcctagagttcttggccggctttgtctccacgctgcggggcatgcccgaggaggagttcgagaaccaccgggccgcggtcatcagcgcaaagatgctcaaggtgtgtgtgtgtgttggggaggcgagtgtgcggtga

SEQ ID NO: 3342 - DNA, 495 bp, Chlorella protothecoides
atggcggtggacgggcacacgctgaactacatcctggtggacgaggcgctgtcgagcaagctggcgctgctggccgcgcactgcagcggcgtggtggtgtcgcgctcctcgccctcccagaaggcgggcgtggtgcggctgatgaccgcctacgagatggagcgggtgacggggacccggcgcgggctgcgccgctggtacgcgcggtacaagcgtcggctgtcgggcaagatgctgagcatcggagacggggccaacgacgtcgccatgctgcagaccgccgacgtgggcgtgggcatcatgggcaaggaggggcgccaggccaccaacaactccgactatgccatcacccagttcaggtgctcgccgggagggggacggggagggtcgtctcgaggggtggctgttggtcggggcggggcttctggcgcagaggaatgggtggggctgggaggcgcagacgttgtgcaggggattggcatggtttgtgtgtga

SEQ ID NO: 3343 - DNA, 837 bp, Chlorella protothecoides
atgcaagatgctgtaccccggcggcccaccttcaacctccatgcatctgtggtcccacactccagattcatccaacacctgcgccttgcgcccgagcagccgccgcaggagcatccaggtacccagtcagacgattctattggcaatgcaacggctgctggagggggtttgtccgccacatcaggctcgggtcctttgcctgatgaggttggccaccatcaccatcgccgccgccgtcatcaccatcgtgcccttcaaatcacggcggtgcacgtcaccgtgtacctgccggatcagtccctgggtccagccaccaacgattcctacagcctggccgtggctgcgccagccatcaagctgcacgccgtctcggtgtatggcgccctgcatggcctggaaagcctggcccagctggtgcgccggagaccctgcgacggactgtgtggcgctgaggccagcagcgaggggcctgagcaagagggagaggctgacgtcccgaacggccatcgccatcacagtcggaaacgacaccggcgccgaactcccctgatcttgggtgtgcaggagacggtgatacacgatgcaccgcgcttcccacaccgcggcctgctcattgataccgcgcgtcacttcctgtcgatggacaccatcaaggcacacttggacgcgatgtctgcctccaagctgaatgtgctgcactggcacctcgtggatgaccagtcctttggctatggctccgaggccctcccagagctgcccgcgcagggagctttcagcaaggtggggcttctttacgagggagcattggcgatggtaactgctgcacggcttctgtaa

SEQ ID NO: 3344 - DNA, 579 bp, Chlorella protothecoides
atggcgcagcaccggagcatggtggaggaggccgatgggatgtgggaggcggtgaccagccaaaagtacgactttgacgctcgggctcgagaggtggaggtgctccagcagctcacccttccagaagtcaaggtgtgggggcaggggatgagccgtgcgggaggtgggctggccagccaatcgggccgctggagtatgcacggccttgtaggggccatggaagtggtctggaagataagccccctgcccatccatcagatccacgtgtcgattgtattatcactcccgaggaacctgcaatccccttcacccccctcaaaggccttttatgaggagtgcatagcgcccagtgcgtcgacgctgcgccagctcagcgtgcacgtcgtgggcaaggcgcaccaggccgagctgtcggcggacgcgggggagggcgtcacccttctctcagacccctcgtccctgcaccagcgcctccccctggcagacctggaggcgacagaccccggcgcacccgtgggcgtgccggatgcaggcccacaaagcgacgcccccgccgccaagcgcctgaagggcgcctga

SEQ ID NO: 3345 - DNA, 450 bp, Chlorella protothecoides
atgctcccatcatggccctgccggcactgctgcaggcggccagcagctctcaaccgatgccggggttccagagcagctgctcccctccctgcgcccacgccgtgcaggggacacaagctggagtgcagccacgtgggatccaccctggtgtggcagacctcgctgcgcgtggcacacccggccgacctgctgtacaagtatgcggtggtggatgccaggctcaacgtggtcaaatgggagtcggggtcgcacacactgcacctcccggctgacctcgtcaacgacgccatcgtcaccgtgacagatgtctgggaggtgaggtgctgcgaggctgtgctggttcgtgactcggtggactgtggggctggagctgagtcgctcctgcaaggggtgctccaacaagaggggccacgaggagcaggagcgggagttatactgctggttacctga

SEQ ID NO: 3346 - DNA, 894 bp, Chlorella protothecoides
atggcacgcacatcaagctgcctgctgttctcttgtggaaagggactggaacagcacccccctgccctcctgcccctgcctggcgcgtgtctggcatgccggccaggcagatgccaccacgctgagcgcctcacccacccaccacgcagtgaggtggtgctgcggacgctcacagtgccggagggcatgtccggcctggccgtgagcgcctggcccaggatccacgagaccctgctgctgatgcggcggaatgtgctgcttctgagggaccccgaggatccacagaagctctacccggtgcgccgcgcgcttggtcgaccctcgctgggcgaggggtgtgtgggcgtgatgacttgtttcttatggtcccaggcaccgctgctcctgcagcggtgggctgcactgcatcacctcccagtccaacaagccagaactctccaaccacgctcacagcgctttgacttgaccaagaccaccagctttgctgccctggacaatgtggcctgggccgaggagctggcctggcagcatgatgactacttctaccggcgccaggtcagtcattcattcatggagggtcctggggttgctgtgggcagggcatcctctcctggtcggcaagcggggacagtctgtcgcacgggcggcccatcgtggttctgggtgcagcctcacctttcagactgtgtttgtccaaccctgatcacaagacagttgcatacactcccctacctgcccctcgtcttgggcacaggaggagctgtggagggcacagggtcacaggacgctgcccgccctcctttcatcctccgacatgctgatgtgtggcgaggacctggggttcacgccggcgtgtgtccgacccatcatggaggagctggggatcctgggtga

SEQ ID NO: 3347 - DNA, 252 bp, Chlorella protothecoides
atgaagcagggcgtcgaaccctggtttgatttccagtatgttgaagccgtcatccctggagacctccttgagaggtggcagggggcccgcgcaacagaggacatgagcctcccccctcccaaccactttgttcctaccgacttctccctgtgctgtgaggaggccaagttgcccgccgaggagggccccttccctgctccacccgctctgttggtggacgagcctggcctgaggtgtgtggaggatttctag

SEQ ID NO: 3348 - DNA, 639 bp, Chlorella protothecoides
atgcctggatgcttccttccttgcctggctggtgaggggcagtctcgagaaggtgcgggccaaagctcccgtcctgaggttccctcgtccccatccacgcctccgcttccccgcttcctgcctgccccttcaccccgtcccctccacctgccctgcacagccccaaaggagggacccctgcccctcctcgtggtacggaatgattccttcttccgccacgagcggcggtggaggggcgctggtgttgctgtccccgtcttctcccttcgcaccgaggcgtcagtggggtgcggtgactttgcggacctgtgccccctcctcgacttctgcaggaacacaggggctgatgatggccatgagcgcagcgaagaggggtttgcatgggggccgaaaagggggcagtccatgcaacggggcattgttggcgggcgagggttcctcgcgaatttgcacagcatgctgtcagcctgtcacaggagcgactcgtcacatgacacccgcagggctgtcggtggtgcagctgctccccgtgaacgacacctcggtcaagggagactggcgggactcgtatccatactcctccctctgcgtttttgcgctgcacccactctacctctgcctggaccggctgcccggtag

SEQ ID NO: 3349 - DNA, 306 bp, Chlorella protothecoides
gagccggagctgcgccggcggctgtggcgccacgtcggcgtgctgagcggcgcgctgggcctgccgtcacggtcccccatcctgccggtggttgtgggcgccgaggcccgggcgctgcgcttggcggacgacctctggcgcgccggcttccacgtccctgccatccgcccacccaccgtgccagccggcacgagccggctgcgcatcagcctgtccgccgcgcacagcgatgccgacgtggtggcgctggtgggagccctgcaggagcagggactggcgggggccagcgcggctgcgaggctctga

SEQ ID NO: 3350 - DNA, 1809 bp, Chlorella protothecoides
  modified_base (140)..(220): a, c, t, g, unknown or other
  modified_base (1011)..(1020): a, c, t, g, unknown or other
  modified_base (1185)..(1242): a, c, t, g, unknown or other
  modified_base (1507)..(1516): a, c, t, g, unknown or other
ctggcggccgccacgcgggacgagctggccgcctacgtcgacggcctcgggtccgcgcggggtgcgccggggtcaaacgcgccgggggagcccgggccggcgcacgcgagggcggccgccgcgctgtttgcggcgggggnnnnnnnnnnnnnnnnnnnnnnnnnnnnnnnnnnnnnnnnnnnnnnnnnnnnnnnnnnnnnnnnnnnnnnnnnnnnnnnnnggggggaccacgggcgccaggctgctgaccctggtgcagaccctggcctccgacaaggtgctcgctgctgcgaccccggggtatgcagcccccgtgccgccgcccgtccaggcgagtgcgggaggggtgatgccgtatcggggtgtgtgtggtggggggggtggggaccgggacggcggctgcatgcagacgaagaacggcatgccgtggcagccttgcggggctgctcacaggcagcgccccgcctcgactcgcgccatccagcctgcccctcctccctccgactccaggcgcacgcctggacggcgctgggcaagatgtgcctgatggacgaggcgcttgccaagctgtgtgtgcccctgttcgtgcagcagctgcgctccgcggcggcgccggcggtgcgcaacaacatcatggtggcgctggcggacctggtggtccagttcaccgccctggtgaggaaagcgcggggaggtcctcaaggggaaggggggagatggtgctggggacacggagaggggccggctgggcgtcgcagcgtcggccaggacagccagtctcggatcggctggctggacccgacgccgggtgtcaggaacgagagatgcccaggtggacgcccacgtcccggccctggcggcctgcatcacggacgacaacgaggtcgtgcgctcccagtccctggcgctgctggccaacctgctgcagaaggtgctgagttgctgcccgggagggggggggggacaaggcagtgggggactggaggtgactctgcagccgatcactttgcnnnnnnnnnngggggggatgggagggggggcggggcaaggcagtgggggattggaggtgactctgcagccgatcactttgcagtgggcagggtggcccatcagcattgtggtgtgttcagcaacggggagccaagcaggtgtcccatcgctgggtttctccaaaggagcgggccnnnnnnnnnnnnnnnnnnnnnnnnnnnnnnnnnnnnnnnnnnnnnnnnnnnnnnnnnngcgcgggcccctgttccaccgcttcctcctggcgttggtggacgagtcccccgccgtcgcgcgcatggcagaatacctgctgggcgacgcgctttccagccaggtgcggaggtattgctgggagtgggggtgggcagggaccaaggtgagcacgggcctgcgccatgggcgccgtgcatcgcagcgatctcatccagaagtataccaatccattccccctcccactttccctctgccaggcgcccaacctggcgtacaaccactnnnnnnnnnnacgaggtgagcacaggctgcgccatgggcgccatgcatcgcagcgatctcatacagaagtgtacaaatccattccccctcccactttccctccgccaggcgcccaacctggcgtacaaccactttgtggagtcgttcttcgtcctgaacgcatgccgggagggccccggcgcgggcgcggccgtggccgcctgcatggacctggacgccgcaacgggcgcgtccgtctgcggcggcggcggcggcgacgctccaggccggcgcccggccacgcgccgtctggacggcgcgtcg

SEQ ID NO: 3351 - DNA, 516 bp, Chlorella protothecoides
gggtacggggccccggccgccgccgccgccgcgcctggctacggcgctccggccgccgctgctggcgcgggcgacccctacgcggccgccggagcgtacggcgcctacggcggagcgcagggctacggcgccgccgcatacggaggtgcgatgtgtttgtttgggttttgttttctgaggtggggggggggcaaggtcgcgcagggcttgacaccttgggaatgtgactgtggatgtgggggatttgttcaagtcagcacccgcccatccctgtgcatagctcggtctgaagatggcatggcctttgttggcgggccgcatgctgctcgaggggatttctcccgctcgtgtgctccaggcggtgcgcaggcgggaggccctgcggccggagggttgccgggagcgtctgccggcggcgcctcgcagtggcaggagctgcacgatgaccagggccgcgcatactactacaacgccaccaccggcgtcacgcagtgggagcgccccgccgacctctga

SEQ ID NO: 3352 - DNA, 1269 bp, Chlorella protothecoides
  modified_base (191)..(200): a, c, t, g, unknown or other
atggtgtgttcgctccctggcacccttctgccagggcgttcggcctggagaagaaccccatggcatgttcagatgtgggttccttctgtacatcgttctttccccctcacagcccgctctcaaacaccttcttcccctccatccatgctttcctcagctggtgcgggacgtgctggaccgcgcccaggccnnnnnnnnnngcaccccgctctcaaacaccctcttcccctccatccctcctttcctcagcttgtgcgggacgtgctggaccgcgcccaggccaagggtgtgaacgtggtgcgggcctgggcccaggccgtgacccccaactacgcgctggagaccgcccccgggcagtacaacgaggccgtgttccagggcctggactacctgctggacgaggcgaggcagcgcggcatccgcctgctcctggtcctgctggacaactggcagccggggggcgccgacacgctggccaactgggcggggtcgaacgtgcacgaggacttcttcagcaacgcggacgccaagcggctgtaccaggcgcgggcggaggcaatcgtcacgcgcgtcaacgccatcaacgggcgcagctactcggaggaccccaccatcttcgcctgggacctgatcaacgagccgcggtgctaccgctgcggtgccaccaccgccgcctgggcctcggagatggcggcgtacgtgaagtcgctggacggcaaccacctggtgacgatcggagaggaggggttctacccggccggccaggcggcctccgccgccaacccccagggcctgcagtcctgggcgtttgaggagggccaggacttttatgccgaccacaacgaccccaacatcgacttcacggccatccacctctggcccgacaactggctggtgggtgcttgtgtggcgagggcgccctgcatcagggcgggagggggtgggtgggcacagcgccacgagcctcggctggctgggaagcataccgctgctgggcttcaggagatcctttacgaggagcccacgggggggggagtagccgccagcactcctggttgcaagggcgaaaaggtgggaggctacatggcatccatgattttcaggaacacatattgcgcacgtggtgcaccaaaccagaggccgctcatgctcatgcccctccctctccctcccatgcaggacaagaccacggactttgtggagcgctggatcgcccagcacattcagcaggccgcctccctgggcaagcccatgctgctggaggagtga

SEQ ID NO: 3353 - DNA, 1938 bp, Chlorella protothecoides
  modified_base (694)..(703): a, c, t, g, unknown or other
  modified_base (1227)..(1236): a, c, t, g, unknown or other
  modified_base (1460)..(1469): a, c, t, g, unknown or other
  modified_base (1576)..(1585): a, c, t, g, unknown or other
atgggcggtggtggggacggggcggggctggtggagggagggttgtgtagtgccacccacggccccaccactccacccgcacttgcaggtttggcgtgtaccggtcaagtggggccgacacgatgcgggaccagtactacaagctcatctatgacctcatccaaaaggtgctgcaaagggtttgctgggggtgattggcatgggaccctaggaaaggggcaccggcatacgcatgaaaggggcaccagcatacgcttgtattccacaccgacaatcctgtgctcaaacaactttgccaatggggatcgagcaaagttgattgccccccttaccccaccccccattcccttgtttggcccgcctctgcctgctctccagccctgcgttaccaaccttccacaggacgccgagtcaggcggaccctcaggcggcgcgctcttcttccagtactatgctcccggccagcaggctccctcggaggagggtggcggtatcaccggcgtctttggcgtcgtggaggccgacaacaccttccccatcatcgacgccttcaccgccagcatggcgcagctgactggcaagagcgtgagccagtgctccgccacgtccggagtatctgtcaccaccgtgcgtgactgctcctacacgcaagtcaacgggcgaccgggcacagggcgtcatgtgcgcgccgggnnnnnnnnnncacatgattgtgccatcaaccgcctccctacctgcccaggcgtcatgtatgagggccccgcctgcgacgtggacatcaacgagtgcgtgcgtggcacgtcaggctgcgcgatcactggggccgcctgcaccaactcggcgggcgggtacacctgcgcatgcacgctgggctacgccggggacggcttctcctgcaaccccacgcccaccctggaccagctgcagctaaactacaccacccagggcgccgcgcagctggcctgcgacgaggggcaggacgtgaagtaccccaccggggtcccgggctttgcttacgacccgacggggggcctgtccagggcggatggggcctccgatgccatggtggggccaagggggatttcttttttgtggggaagtgcatctttgaggggtgcgggccacgtgctgcatgctggggaagtgtgtattggggggaggttgacacgatcggcgtcatggggctctccttgtgtcatgctagtagccacaaggctggccctgtcnnnnnnnnnngttggggggaggtttgatacgattggcgtcatggggctctccttgtgccatgctagtagccacaaggctggccctgtgagctccgggtcttccatctcggtgcagccggtggactgcatggcggcctgcaatgaggcgcccggctgcacggccttttcctacaatccgtccctccaaaagtgcttcctgaagacggggtcgtcgtacaacacctgccaggtgannnnnnnnnntggctgcacggccttttcctataatccgtccctccagaagtgcttcctgaagtcggggtcgtcgtacaacacctgccagtcttgtcgctcgtcaccacagttcacannnnnnnnnnaatccatgacttccattatcaagcacaagagacggtgtgcacatcttcacgggggacgcagtattcatgcggattctggcagtcgtactacagagaggacagcgggagcgcctcgacagcagtgcagtcggcctcccttccctcaacgtccccgtccgattctagtacaggaaattcagaaccagcaggtgcaagcatcacattgcttcagcgagaaatcaactcagcagatggagaacccagtgcatccccctcaatcagcctgcttcagtcctttgggtagaatcctgcctcttctagtggctggcaatggtattcccatattcttccgtattccaagtgtcgaactctag

SEQ ID NO: 3354 - DNA, 1677 bp, Chlorella protothecoides
  modified_base (642)..(651): a, c, t, g, unknown or other
  modified_base (1068)..(1077): a, c, t, g, unknown or other
atgagggcatcagtgcactttggttggatctgccctccaacttccactggaactgcactgaagatggcgagctcgatgtgcatggcatctactcctgcgtgcatgcccacgaggacactcaccgaggtcgccgcacaaagcatcatggctcgtcgtgcaggggcacacctctcgtccgtttctccgccagatgactgcacacatgtccagcaggtgcaaggtgggatggtgatgtgggttccacatgcaaatccgtcgatgcgacccctgatagatgtgcccaaggacccatgtaccagcattcgtcgtttcgaatcctgtcctgcactcccaaaccccactgctcaccgctatgcacgccaggtaggcgcccagctcttcgaagcactggcccgacttgacggtaaatttcttggggttcacccgcggcggattcccctttcccttctctcccatgcttgcacggctcggagctgcgccaggtgggtgtcgcgtctattccagagcaataaggcccccgaccagccagtcgacgagaggtctcgcttgctcagccggtttccagaccagaccacactgtcaatgcaatgcactacagttttatgttatgtttttcctctgttgcgtttacctgcccttcannnnnnnnnncactgtcaatgcaatgcactacagttttatattatgtttttcctctgctacgtttacctgcccttcgcatgggggaagggatgggctcgctggtgtttgcgaagtatgggtaccgggaagggtaccgcgattacttctgtcaacgatgaacttgagcgacctggacatcacgaccgagctccacgacagccacaacgtcccctggcgggacctggccgccctcttcatcaccagccacacccggctgactcctgtttggcgtcaagcagcaagccagcatgcaaacgggctcgtgttgtgggactaccacgtggtggccctgcatcgccagcaggagggagactgcctcgtgtgggacatggacaggtgggctgctgtgtggacgccctgcttgggagggcaactaaggatagctcnnnnnnnnnngacatggacaggtgggctgctgtgtggacgtcctggttgggagggcaactgatgatagctgctgaaggggggcacggcactgcaccctacttctgccctgctcatggcatgcataccgctcggcagccctcttccccagcgaggcagaggtggcaaggtttgcacccaggtgagacccaatgcatatccctcaaggcgtctatgcattgcactgcagctcgcaccatggaagccgagacctggcatcaatcctcaatggtcctccattggtgttgctggcgctccaaccctgaagcccacctccgccacctggttgtccgcagggtgttccgcatggtgtcaggtcgtgcactcacctctcgctttgagtctgaccgctcgcacatgaggagcgagtccgggggctggagtgcgccgccgcccccttggccctgctttgagtgcgctgctcggggcggtggggaccccctgacactggaggccctgctcagggttgatgcagacctgggaccagggacaaagctccttgagcaggcagcgagcatccagctcccttgggaggaagtgtgcggggaagccgaggctacactggccgagtga

SEQ ID NO: 3355 - DNA, 465 bp, Chlorella protothecoides
atgcccggggcaaaggagcgcgcgcccccccgcgccccccagttggccccggccccgcccgccccggcgccgccggagggggccgacccggcccagctgctggagctgctcctccgccgcggccacgacatccttcccgccagcccggtgcgcccgcacccgggccccatcgcccacccgtcccatgccaagccacacgccggcccggccatcgtgtcgctgggccaggacgccggccgcaagcgcgcgcggcgcagcgagggctcccgcacctgctccaactgtggcgtgaccgccacgcccttctggcgcaagagtcgggccagcgggctgcccctgtgcaacgcctgcggcctctactcggccaagaacggcgatgcgcaccggccgcccaagctgtggcgcgagggacagccggtgccgcccggggtcggcgacgacgcgcgcggctcgcccgccgccgtc

SEQ ID NO: 3356 - DNA, 2325 bp, Chlorella protothecoides
  modified_base (703)..(712): a, c, t, g, unknown or other
  modified_base (2112)..(2203): a, c, t, g, unknown or other
atgcccccacgcagctcttccctcacacctctgctgcgggcatactttcagcagggaaattcgtcttggtccttggaaacattcaatcaaatcaggagcagtgctggcgccagcctcgcggactctgcccgacgtgggtatgcagccacccgggcagccctgcgctccgccctcccggcccaggaggcagaggccgtggagaggagtgtgcccagagcgccaccaaacaaggcccgcggtagtcacaaccagggtgagactgggatcgcatgggtttgggcctcgggggagtggtccaccaccctgcgcgtcccaacacatgccgtgttgcgtacacccaccctcccgacagcacaatcaccccccctcaaccatccaggctccccagcggctggtccatccaccaggcacacccctgggacctccaccgctcgcgcacaggtgaatgggaacgtccagcgccagcccgggccgcagcagcagccccagtccgggcctcggtccagggcagccggcccccacacgccgcccgcgccgcggccacgccacatcccccgcaccgcaccgcccagcccgcccccccaacggcccggggtcaaccacatcccggccccccggccgccgggcggggctccgcgtgctgcagcgagtccgggcaaggccacgccaggaggcgcggcccggcgcgaggcgcggcacccgnnnnnnnnnngggctccgcgtgctgcagcgagtccgggcagggccacgccgggaggcgcgtcccggcgcgaggcgcggcaccctcgtacccccgagcagcagcgggagtggctcaaggccacgggcaagtgggtagaccggtccgcgccgggcgcgacgtggaagcacccgcgcacgccggaggagcagcgcgagtggctgcgggcaaacgggatgctgtgggaggccggggcgcagccgcgccggcacccgcgcacgccggaggagcagcgagagtggctgcgggcgcaggggaagctgggtcctgaccaggcacccaggtggggcagcgccggcgacatgcagcagcagcagcagcagcagcagcagcggcggccgcgccaggcgcacccacagccggagctgtggggggagcacgccgacctgcaggatggtcgggggtcggggacgagacccaagcccgtgcgcgcggcgccggcggtgcagccgccggtggtcatccccgcggacgtgaccgtgctgcgtctggccagcctgtttggtgagcagcgcaggtcgatggccgtgcctgggtgtcgtggctctgggtgtttggcagggcttgtgggtctccctcatgcccaaggctcctgcccgcacggctcggccttcctcactcgcgtgcctcacagcccgcctcctctccctaccaagtggcacccgcaccccccacaccgctgcccgctgtcccggctggagggcatcctggccagcctgggctccccccctggctccgagcaggagctggtgtcgcccgaggacgccgagctggcggccatggagctcggcgtggcggcggtgctggaccctgaggcggcggcggtggcttcgtcgtcatccagggacgcccccgacgcggccccccgcccggcggtggtggcggtgatgggccacgtggaccacgggaagaccacgctgctggacgcgctgcggcgcacggcgctggcggcgcgcgaggcgggcggcatcacccagcacatcggcgccttcagcttcccgctccccgcctcgggcaccgcgctgaccttcctggacacgccggggcacgcggccttctgcgccatgcgcgcgcgcggcgcggcggtcaccgacatcgtggtcctggtggtcgcggccgacgacggcgtgatgccgcagacgcgcgaggcgctggcgcacgcgcgcgcggcgggctgccccgtcgtcgtggcgctgaccaagtgcgacgtgccgggcgcggcgcccgcgcgcgtccgcgccgcgctgctctccctgggcctggagctggaggaggccgggggcacggtgcaggtggtggaggtggccgcgccgcgcggcacaggcctggacgccctggaggaggccctgctgctgcaggcggagatgatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggtggtcgaggcgcggctggacagggggcgcggccccgtggccacggtggtggtgcgccagggcacgctgcgcgccggcgacgtcgtcgtggccggcgcggagtggggacgcgtccgcg

SEQ ID NO: 3357 - DNA, 1053 bp, Chlorella protothecoides
  modified_base (638)..(647): a, c, t, g, unknown or other
atgttatgcctgatggctgagctgtgcgtgcgcaggcgtattgtcatgtattcatcgcgggttgcagctgagagcgcgcaatggcagcagcctgattgcgggtggtcaaaggcgcgatggaagcattcacatccatcatcaggacatccacgttcaatacggtcaccaaatccttacaagtgcatagtaacagtcaggtgtgtagacacacagacttacgagcccctgttcgtgggctccctcgcctcgatggcaggagagtccgtcgggctcgactccctgggcccacaggagctagctgaagtggggaagcagctggaaggcgagatcaatggattcatccagaatgctctcaccttgcagcagacggcggggaagtttgccgctgcagggcagtcggtagagtacctgcaagagcagaaaaaaggtcagccccttctcctccccctcaccgaatccctgtacgtatctgggaccttagagtctgtggaaagcgtgctcctggagattggtaccgggtattttgtcgaggtgggctgctctggaagggggggcaaccatgggtgcattccttggtgtgtctattctacttctaagcaagccgtattcccctcgcttgcatgcagcgtgatctggannnnnnnnnncgtcgagcgtgatctggagggcggcattgactactgccgcaggaaggtgctgctcgtgagggacaagacggagcaactgtctcaggtatggatgggtgccgatgctagcaggaacggccgagaacaggctatttacactatcgcactcctcccgcacacagctcatcaagtcccggcaaacagcgctggctcaggtgaacgctcttctagagcagaaggtgggcggtcaggcaggccaggcctgaggaatcggatggcatccatggacgcgtatggtcatggttgtgcagagtgtcgcgctcaacaaagcctctttcagtgccgaagcctcaagagctattcatcctgcctgcgtcaccagtgtcttccttcagctcattttaaagcttgtaatttgtcacagtga

SEQ ID NO: 3358 - DNA, 2826 bp, Chlorella protothecoides
  modified_base (318)..(327): a, c, t, g, unknown or other
  modified_base (501)..(510): a, c, t, g, unknown or other
  modified_base (649)..(749): a, c, t, g, unknown or other
  modified_base (1471)..(1480): a, c, t, g, unknown or other
  modified_base (1933)..(1942): a, c, t, g, unknown or other
  modified_base (2497)..(2506): a, c, t, g, unknown or other
atgcaccggagtacatacgtctgccaatgcagttatatcgtgacgattagttcttcatttttcaccggttgccgtccgcagctgggcagggagcggcaatcgtgcccaaaaccggcagcgaacaatttgcggcatgcaggtcgcggctcgcacatggcctgcgggcacctattgagcagagtcgtggaggattcctcaaacgtcatgacgggtctccgggtgtgtttcgatggggcgagtggaaggttgggctgttcaagcattgcaacaaccccaccccgacatgcagtgcctttgcagcatgctctgcctgatcgnnnnnnnnnntgccgtccgcagctgggcagggagcggcaaccgtgccccaaaccggcagcgaataaactgcggcatgcaggcgcttgcagagcaggacggccgccccatcgacctgctcatctgctgcggcgacttccaggtctgttgagctttgatttttgtgatctgtttctccactccttnnnnnnnnnnggctgttcaagcattgcaacaaccccacccggacatgcattgcctttgcagcatgctgtgcctgaccatggacatgatccctgctcaggtagccgtggaaggctgctgccatggagagctggacgccatctacagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacaagaacaagcctgccttcatacatgcccgctttgcctggcgtcaccatggcttctcatccccctccccgccctcccccacacacaggcggtccgcaatctggatgacctggaatgcatggcctgcccgccaaaataccgggcaatccagtctttctacaggtactactcaggcgaggcccgggcccccatccccaccctgttcatcggcggcaaccatgaggcggccaaccacctctgggagctgcactacggcggctgggccgcgcccaacatcttgtacctgggcgccgcgggtgtggtcggctttggcggcctgcgcattgcgggcctctccggcacctttgccgcacaccactatccgctgggccactttgagcgcccgccctacaacaacagcagcatgcgcagcgcctaccacgtgcgctcgctggaggtacaccgcctggccaggctggcctccgccccggacatcatgctgagccacgactggccgcagggcatcgcgcgccacggcgacctggacgccctgctgcgaagaaagtccttcctgcgcagcgaggtggggatcagagacaggatcttgtgcagaagcgacgaggggagatggggtgaccgctggcaataccgcagcagccctgcattccttgagtatcaccctggtgtgtacagagcaagacctgtggaccccacgccttgctgggcgagagttgtagcannnnnnnnnntggtgaggagagggcaggtggggatcagaggcaggatcttgtgtgcagaagcgatgagggggagatgggctggacgctggcaataccgcagcagccctgcattccttcagtatcaccctgctgtgccttcgagcggtgccagtcttctgcatgtggtgatcacccagctttcaaaaggtcgccagcatatcacccacacctccatttatccactgccaccccccttgtcccaccctcacaccgtccagatcaccgacaactctttgggctcccccccagcagcagagctgctccaccacctgcgccctgcctactggttcagcgcccacctgcacaccaagtttgccgcgctagtgcgacacgctgcggagcccgagcaagaggtcccacagaagcatccacccaaaggctcgtcacccggcaccctcaagcccagaagcagcaatgcagccnnnnnnnnnnatccacccaaaggctcgtcacccggcacccccgagcccacaagcagcgatgcagctcctcatgtccggggccgccaccccgccacgcgcttcctgtccctggacaagtgcctgccgcgccgccagttcctccaggtgctggacttccctgaggcctccggcgcgcacgagttcacatacgacgcggagtgggcggcggtcctgcgcgccacgcacgagctgcagaacctcgcaccagcgcccacggcgctgccgcgcgggccgccggcccccgtgaccccggcggaggtcgcgtcggccgaggcggccctgcgcgccgcctctcccaccggcgacctggccgtgcccaccaactttgtggccaccgcgccggcgcacgacccgggtcggcccgggcagcgggggcggatgccgcgcgccgcgccgcgcaacccgcagaccctggagtacctgcgccgcctgggcctgccttatgacctggacctcgatgcggtgcccggcccgccgcacgggggctgggccgcaggaggcttgacgccgccgcaggctaccattnnnnnnnnnnctcccaccggcgacctggccgtgcccaccatctttgtggccaccgcgccggcgcatgacccgggccggcccgggcagcgggggcggatgccgcgaggcccgacgccgccgcaggctaccagagcctcggagcccaacccggaggagatcgacctcgacctcgagtctgaggaggaggtcaaggacaatgcagaggcggaacaaaactcaaacctgtgcggcagcgacggaaggccccctctcctcgcctcgctggccgccgtgcttggaccacagaacccagaggaggtccagcttgacagcgagacggaggaaagctga

SEQ ID NO: 3359 - DNA, 1677 bp, Chlorella protothecoides
  modified_base (24)..(33): a, c, t, g, unknown or other
atggtcacctccagattcgtgttnnnnnnnnnnggacgtatgcactccggtgcatggccagccatgcagggacgggcacaccgccagtctgggcgccatggtcacctccagattcgtgttcggagggatcccagagcaggcaccgcacgggcaatcctgggccgcgcgcgggcaatcacatccggccccggatgggccctgtcagccagatgtggccacgtgcgggcttcgccatcccgtcccccgacaggggcttcctggcgcgcctcagccgcgggtccggcgccccgaccccagacccttccgccccctgcgaccctgcgtgaggctcacccgctcctgccactgatccagtcatccccctggcctccaggtaacttccccacccttgaccttcccccccacacacctgccccccgaggtgccgtgcctccgggtgccatgattcgcggccgcaggatcgcgacccgactcctcacggagattcggtccctggcccccgccactcatgaccccaccaccctcccggcccagctcccaggcatgtcccggtccgcccatgactccccccgccccgcctccaaggagggcaaggccatgcaccccgacctcctgaacgacaacatcctgaagacgcagtatgcggtgcgcggcgagctgtacacccgtgcccaggagctggccaagtctggcggggaggtgatctacaccaacatcggcaatccacagcagctggggcaggagccgctggtgttcaaccgccaggtgctggccctgctcctcgcccccttcctgctggaccacccgtcggccagtgcgctgttcccacgcgaggccatcgaccgcgcgcgcgagctgctggccgccttcggcgggcgcatgggcgcgtactcggacgcgcgcggcgcgcccgccatccgccagcaggtggccgccttcatcgaggcgcgggacgggcagcccgccaacccggaggacatctacctcaccgacggcgcgtcggtgggcgtcaagtacgcgctcaacgcgctcatccgcgacggcaatgacggcatcctgtgccccatcccgcagtatccgctctactccgccgccatccagctgttcggcggcaagctggtgccctactacctggaggaggacgcgggctgggacctgaacctggaggcgctgcgtggcgcagtgaagaaggcgcgggcggagggcaccgtgctccgcgccctggccttcatcaacccaggcaaccccacgggccaggtgctgacgcgcgagacgctgcgtgagctcatcgcctttgcccacgacgagggcctggtgctgctggcggacgaggtgtaccagcccaacatctaccaggacgagaagccctttgtaagcgccaagcgcgtgctgcgcgagatgggcgagccctgggccagctccgtggagctggcctccttccacaccgtgtccaagggcatgctgggcgagtgcggcctacgtggagggtacgtggagtgggtcaacatccacccaggcgcgcaggcggagctctacaaggtggccagcgtcaacctgtgccccaacaccgtcggccaggccaccgtgtccctcatggtggcgccgcccacaggcgacagtgaggccgcgcgccagtacgccaagcagtacgaggacagcctggccagcctcaggtag

SEQ ID NO: 3360 - DNA, 153 bp, Chlorella protothecoides
atgtacatcaggtaccgcaagccggggccgagggcgcgctacgccctggaggcactcaacatcctctgcttcctggtcaccgtctgtgccatcgccggctccgtccagctcatcgttgcagactccgcagactacgaggtgtttggtaactag

SEQ ID NO: 3361 - DNA, 1791 bp, Chlorella protothecoides
  modified_base (150)..(159): a, c, t, g, unknown or other
  modified_base (446)..(455): a, c, t, g, unknown or other
  modified_base (689)..(698): a, c, t, g, unknown or other
  modified_base (1164)..(1173): a, c, t, g, unknown or other
atgaatgctgtgagatgcgggccacgatcttgggggcaccctgacgagcggccccgccaggcctgtcctacaggctggcaccggcactcctcgctgcaaccccgtcctcgtgtggccaacaccccctcccccctcctccgacccctctcnnnnnnnnnngagcggccccgccaggcctgtcctacaggctggcaccggcactcctcgctgcaaccctgtcctcgtgtggccacacccctcgcccctcctccgacccctcttcctgccctgctcgcctgcgcagtgtgggagatgtatcactgccgcagcgtgcacagcggggtgagggagcacgccgtgctggccggcgtggtccagggcaccctccgccccatctttgaccccggctgcccgccggcgtacgccgccctggcgcgcgactgctgggcacaggagtcctgggggannnnnnnnnnagtcctggtgggttggagggtctgtgatttcgcgtttgttcgtgggtttgggggggcaagaggtgggggaggggggttcagcagacccatcagagaagacgtcgatggagcaggcagggacggcgggcggcggtgcctgcagcgcagggcatgttgccagccaaatcaccatcgatgccacctggcgttgcaccgcgaccgggtcgcctctcgtccagcatatgcacctccaannnnnnnnnnggagcaggcagggacggcgggcggcggtgcgtgcagcgcagggcatgttgccagccaaaccaccgtcgatgccacccggcgttgcaccgcgaccggggtcgcctcacgtccagcacatgcacctccagccatctcctctgcccgtggcgctcccaggaagcggcccacattccaggaggtcctgagccggctggtggcggcggagatggccttcagggccgagcggcacgcggggcgtgcagccagcgggacgcatgctgtgcggcaagcaaggtatggccgccgagcacccgcactgccagccagcggtcacacccgcactgccaggctggagggcggcacccgagcctggaggccccggagaccctcctcccatcaatgtggtgggcagccgcgcctggctttcccatgccgggcccggccctttcagccagccatacagtcatcatgcctcgctgctgggagnnnnnnnnnnactgccaggctggagggcggcacccgagccggccagtcccggaaaccctcctcccatcggtgtggtgggcatccgcgcctggctttcccatgccgggccccgccctttcagccagccatacagaagtcatgcctcgctgctgggaacgaagctgacggtggtgcgagtttggcccaggaattggaggcccgtggcctccgtgcccgacatgagcagcgtgctgcctgccggcatggccaggctgccggcgagctggctgccgtcgggcatgcgcagggtggggctcagcccctgcagcccgtgcaggcacaggatggagttggcgggggggaaggggcaggtttccgggaggtccagcagcaacagcgactcctccacccctggcccctcagtggctggccccgcccggtcggccatagccgtgcctggcctggaacctgcatgggtagagtcgtgtccccccttgccattcattgcacccgtaccgtggctcccttccggtcctgtgctcacagcgacaggctgttctccacacgtgctacgagaatgctccgtgctagggttccgatgcatggaagcctgaggcagcataggagtgctagtactggaaatgcttga

SEQ ID NO: 3362 - DNA, 318 bp, Chlorella protothecoides
atgaccgacgctttcaatgggctggagggcgcatcctgcaacttcaccgagggcgccatgtactccttcccgcgcctgcacctgccggcgaaggccatccaggccgccaaggaggcgggcaaggaccccgacaccttctactgcctggccctgctggccgacaccggcatcgtgaccgtgcccggatcgggcttcggccaggtggagggcaccttccacctgcgcaccaccatcctgccccaggaggacgtcatgcacgagttcgtggacaaattgaggaccttccacaagtcattcatggccaagtacaaggactaa

SEQ ID NO: 3363 - DNA, 519 bp, Chlorella protothecoides
atggaagtaacgagcgatctggacgtccgcttcagcaaggccatctggctggtccggaaggggcctcccgtgcccggcaccaccaacgacaccaagttggcgtactacgcccacttcaagcaggccacggagggggatgtgaaagggaaccaaccttgggccgtacaaatggaggccagagccaagtatgacgcctgggccatgttgcagggcatgaccaaggacgaggccaaagccaagtacattgaaatgctggagaaaggtgggctcggtggtgcaaggacggcccaatcatcgaggatcggcggttctcccacgtatcccattgcagcgcattggcgctggtctgggcgggacctgcgcctcccagttgctccaattccctccttactatgttcacatcacccctgccccccctcccacatccaggagatgccgagtgggagagccaccccgccttcaaggactttccgcatgcttgatgaagcccaacacaatttgcaaaatcctcccggctga

SEQ ID NO: 3364 - DNA, 1089 bp, Chlorella protothecoides
atgttcatcccgtccctgctggcgcacgggaccaaggagcaacaggaggcgtggctcccccccagcctgcgcctggagatggtgggcacctacgcccagacggagctggggcacggcacctttgtgcgcgggctggagacggtggcggtgtttgaccctgactccgacgagtttgtggtgcattcccccaccctcacctccaccaagtggtggccggggggcctgggcaagacggccacgcacgtcatcctcatggcgcgcctgatctcgcgcggcaaggaccatggcgtccactccttcgtggtccagatccgggacatggcccggcacacgccgctcccgggcgtgacggtgggcgatatcggccccaagatgggctacaacggcgtggacaacggcttcctgcgcttcgaccacctccgcatcccgcgctccgcgctgctggcgcgctttgcccgcctggagcgtgatggcacctacgtgcccccgccctcggccaacgccaaggccagctacgcgaccatggtcttcgtgcgcgccgacatcgtgaagaacgccggcgactttctgggccgcgcggtgaccatcgccacgcggtacacggcggtgcgccgccagacggctcccggacccggcgcccgcgagctgcaggtgctggactacgacaacgtgcagcaggtgctgctgccgctgctggcgcgcgcctacgcgctgtccttcatgggccgcgccatgttcgggcagtacaaggcgttcgacgccgcgcgcgcgcgcggcgacttctccgccctccccgagctccacgcgctgtcctccggcctgaaggccgcctgcaccgacacgaccagcgacggcatcgagaccgcgcgcaggacctgcggcgggcacggcttcagccagctgtcggcgctgcccaccctcttcacctcctacgtccagaacgcgacctgggagggtgacaacaacgtcatgtacctgcaggccgcgcgtttcctggtgcgcgcgctgatcaccgcgcagcgcggcggccgcctggcgccctccgtgcagtacctggccgacgaaggcgccggcgcccggcgctgcggc

SEQ ID NO: 3365 - DNA, 555 bp, Chlorella protothecoides
gcggggcccgtggccgggtccggcggggtgctggcattgcacctggcgccgcgctacctgctgctcaactccctggacgcggcgctgcagtaccggcagcagggtaccggcgcggaggcggagctggggccaggggtgagctgcccgctgcgttgggcggatgcggggctgccgctgcggctgtgtgtccgcctgcaggaggctggctggctctggtccggcgggtttggcctggactcgccgggggacaccttcatcaaggtccggcaccgcgaccgcggcgagaccatgctgctgcgcgtaggcgtggccgccgctgcggcggggacgctggcggtgacgctgagccatcagcccgcgggcttcgcgccctaccgcctggagaactgcagcctgctcaccctgcacgcccgccagcgccgggtgagagagcagcaggacgtgctgcggccctactgcagcctggggtacgcctgggacgaacccgcccggccccatcagctcgtgctggagctggcggggggggtgcgcctcggcacctggggcctcgaccag

SEQ ID NO: 3366 - DNA, 324 bp, Chlorella protothecoides
atgagcggcagcggcgtgccactctttctggaacatgcaagggtggcactgggagaggcgttccgctctcaaagctgtcccagtgggagccgcagggatcgctcgcctctcatccctcccccactttggccgcgatcgcaggctctgcccgggcagaccacccccgacggtgtgccagccttcaagctggtgctggttggagacggcggcacaggtgcgtgggctcagtttgaattcagctgcccggcagtggagtttaagatcacaccgcccattccccccgccacaccccagggaagaccaccttcgtcaagcgccacttga

SEQ ID NO: 3367 - DNA, 2001 bp, Chlorella protothecoides
atgacaacagcattcctcaccactcgtgcatgtccatgcacgccgcaaaattttcagggggcgacattgaatcattgcaggacacttcttacctcgtcaggatctcgccgtcgaggcaacgccatggccatgcgggtggccactcgtgaggtcctcaccggttcccagcggcagaagatggaccccagcgatgacacgatgttctacgacagcccaaagattgtgcaacatgtcgatgacgggttcagagcccagctcacacagctgtaccgggagaggcttcccccagggggcacgatgctggatctcatgagcagctgggtgagccacctccccccagaagtgacctacgccaaggtggtgggccacggcatgaatgcagaagagctgtcgcgcaacccccgcctggactccttcttcctccggaacctgaatgtggatccgacgggctgggcgctggcagacaactcccttgatgccgtgctgtgcactgtcagcgtgcagtacctccagcagccggagcgggtgtttggggaggtactgcgtgtgctgaagccagggggtgtgttcatcgtttccttcagcaaccgcatgttcttcaccaaggcagggtggaagagagattcaacaggtaaagcaccgtcgccattgcgatacctttccacccaagtttcagcagcaccatgcgctcctacctcctgttcccaggcaattgccgcttggagggacggcacggactacagcagggtgaggggatacttgaagtggcaggggagggagctgtgtggattgccctctgagcctgtcactgctttgcgctttggaggggagtgtcgtatggatggccaggccgcgcggaggcccagccctgtcgatcgctcttgtccctgcacccaccccctcccagatccagctggtgaagcagtactttggtgcctgtccggggtacgagcagccagaggtgatcaatcgcgtctctgtgcccgaggacccctccctcctgggcaagttctggacggcggccggtgccttgggcggcggcatgcacgaccccttccatgcggtgctggcacggaagaagatggaggcctgacctggccggggcagaggtgccaagctcataggaacagcattaagatctggtggcgtgcatttggcttcggcaagtgtgctgcctcctctcggcgccgagctggaggcatcggcagcttggggcgcggcagcccagcatggcagcgcagtcatccttgcctacccctcctcgccctcctctctgatggggtcccttcgatgcccaaccccccactctgccgcctgagttgcaatcgccatggccagccatgctgtttcttaatccagacctggggcaacacactgcagacagagccggggaatatcctgcaagcttggcaagcagggtggcctgggcagctcatcactccgcactgcacggcatgttggcggcctcggtcagctgccgctcgtactcctgctgctgctgcaggtcgatctggacctcggggggcgccagcgccacctgctccacaaagtgcaggttggggtcccccaccagcttgcgggccaggtgacctgcttgggcttgacctgccggttcttcacgtccaccttgttgccgcagaggacgatggggatgttctcgcagacgcggcacaggtcgcggtgccaggtgggcacgttcttgtaggtcaggcgggaggtgacgtcaaacatgatgatcgcacactggccgtggatgtagtagccatcacgcaagccgccaaacttctcctgcccggccgtgtcccagcagaagaagcgcagcttgccgcggttggtggtgaagtccagggggtgcacctccacgccgatggtcgctgcaggggaggctgggtagcagtgcactccacaatccaataccaatgcagacagtggtgctgtggcgatcaggtcagtgccgacgaaggacttgtgagtgatcatccgcagaagcttctcccatga

SEQ ID NO: 3368 - DNA, 1005 bp, Chlorella protothecoides
atggggccaggaggcttctgcacggccggcgacctctctcacctgcgccaatcagatttgaggaccccctcgtctcgccagggcgagctgccggcgctgacaccttcgggcgaggccatcctcgccgcccccggccggctggcgctgagccccgacggcaacggcggggtgtacgccgcgctgcggcgctctggcgccctggcggacatggcggcgcgcggcgtggcggcgctggacgtctggcccgtggacaacgcgctggccgcccccctggaccctgcctgggtgggcgcgtgcctggcggcccgagccgaactgggctgccgcgtgctgcagaaggcggcgccgggggagcgcaaggcgacgccgggggagcgcgtgggcgtgttggcgcggcgcggcggccgcctcgcggttctggagtacagcgagctgagcgaggcgcgcgcagcagcacgcaacccggccacgggcgcgctgcgctacgcctggtccaacgcctgcctgcacttcttctccctggcctggctggcgcgcgcaacggacgcgctggaggccgccccgcgcttccacgtggcgcgcaaggcggtcccctgcctgggcgggggcacgcgcccgggggtcaagctggagctcttcatctttgacacctttggcctggcggagggcgtgcggctggtggaggtgggccgcgccgcccagtttgcgccggtgaagaacgggccgggcgcggggagcgactgcccggagacggcgcgcgaagcggtgctggcgctgcacgccggctgggtgcggcgcgcgggcggccgcgttggctgcggggagggtgtggaggtgtcacccctcctctcctacgccggcgaggggctggaggacgtgtgtggggggcaggattttacccgtccctgggacgcacgcctgcagctggtgggcggggacaaaggtgggccggggttggggccatccggtaggaggggtggccaccctgccacactcaatatgtag

SEQ ID NO: 3369 - DNA, 615 bp, Chlorella protothecoides
atgggcgggctggaggcagccctgaggactgctggacagggccacctctgggaccacctgctcaccctcgatggagaggtacgaacggctttccaggtacagctggaggccgtcgattttgcccgcgtgcagcgcatattccaggccagcatggccatgacggaggattctgaggagggcgtggagcccatcgacggcgtccaaaccattcaggacactaccgaggagcagcgtgggaagtggcgggcgctgggtctggcagccatcgccgggggcagggttgctggcctcctcctcgccggcggccagggcacccgtctgggtagccccgcgcccaagggctgctatgacatcggcctgccttcccgcaagtccctgtttcagctgcacgctgagcgcctgctgcggctgcagcagctggcccagcgggaggaaagcgcgcctcgaccatgcataccctggtacataatgcccagccccgccacggatgtggagacccgggccttcttccaggcgcacgcctggtttgggctggatgccgagcaggtgttcttcttccagcaggtacgcagggggcccagttccataggggtcaaggtggtgagggtgatgtag

SEQ ID NO: 3370 - DNA, 630 bp, Chlorella protothecoides
atggaccccccctctgccacggacgcagagggcctgctggccgaggcgcgggaggtggcctccacgcgccaggtcaccgacgccttcgcggccaccttccccgagcggctggagtaccaccttcgcgccgcgagcgagggcggccccgcgggcgcggacgccgcgctgagcgcgctgcgcgaccagcacctgcgcctggccgccgactacgacaacttccggaagcgcagcgccgcggagcgggacagcgcgcgcaccgctgcccggggcgacaccgtgctggagctcttggcggtggtggacagcttcgagcaggccgcggcggcgctgagccccgccacggatggcgagcgcaaggtggtggccgcctacgacgccgtgtaccgccagctggtggccgccttccggcggctgggcgtggaggcggtgccgggggagggcgagcccttcgaccctgcggtgcacgaggccatcatgcgcgagcctgcgcccgcgggcgtgccggacggcaccgtcgtccaggagttccgcaagggcttccggctgggcgacaagctgctgcgggcgggcatggtcaaggtagcctttgccgaggacgagcccacgcagggtggggaggaggaggcctga

SEQ ID NO: 3371 - DNA, 603 bp, Chlorella protothecoides
atgggcccactcacccctcggctccacaactcacgcccctcacaagcccaccatctcacctcccctgcagcgaccatcggcgtggaggtgcaccccctggacttcaccaccaaccgcggcaagctgcgcttcttctgctgggacacggccgggcaggagaagtttggcggcttgcgtgatggctactacatccacggccagtgtgcgatcatcatgtttgacgtcacctcccgcctgacctacaagaacgtgcccacctggcaccgcgacctgtgccgcgtctgcgagaacatccccatcgtcctctgcggcaacaaggtggacgtgaagaaccggcaggtcaagcccaagcaggtcaccttccaccgcaagaagaacctgcagtaccatgagatcagcgccaagtccaactacaactacgagaagcccttcctgtacctggcccgcaagctggtgggggaccccaacctgcactttgtggagcaggtggcgctggcgccccccgaggtccagatcgacctgcagcagcagcaggagtacgagcggcagctgaccgaggccgccaacatgccgctgccagacgcagacgacgacgacatgtga

SEQ ID NO: 3372 - DNA, 714 bp, Chlorella protothecoides
atgtctgcggcgaagaggctgatcccccttctagaccgagtgctcgtggagaaggtcgtcgctcccaccaagagcctgggcggagtgctgctgcccgaggtggcgtcatccaaggccacacggcaccggggtcgtggaggtttctccagggactcgaccgctgcacgcaatgatccagatatctacatcgccgcacagatcaaccagggcactgttttggctgtggggcctggccggagaacctccaccggggagctgattcccgtgggagtcaaggctggggacaaggtgctgctgcccgagtacggcggcacccccgtgaagctggaggatactgatggccctccaaggtctgggtttgtggggtgcacggacactcagtgctttgaccatgcgcactctgcactgctccccctcagacatggcgtccatttgtctcttgacttccaggtacatgatcttccgcgacgaggagctcctgggtgtgctccagaactgatctgcgtgctggggacccggtgccacccacccaggactcgacgcaatcctcctctgctttctaacttccggctgcactgctcacgagacccccctcatgcattgccttgggttcgtcgcactgtgtcactcactgactatctggcaacgaggtcaaggtcttttgctgccgtcattgccgtgtccttggtgactgtgaccgattcaatgtcatga

SEQ ID NO: 3373 - DNA, 258 bp, Chlorella protothecoides
atgggccccgcctgctgtggtgctctgttccacatcaggcctccacatgcacgcgccacccaagccctcctttccacccggccacgccaggatgtttacaagaccggggaccagatcaaggcggcaggcgtgagcctgctcaaggagcccggcccgctgcctggcctggggaccaagatcctgtcgctgaccgaccccgacgggtacaagatcgtgtttgtcgacaccgccgacttcctcaaggagctggagaagtga

SEQ ID NO: 3374 - DNA, 171 bp, Chlorella protothecoides
actgcatacatgagctccagctatcctgggggaaacttcggagggaaccagctactagatggttcgattagtctttcgcccctatacccaagtccgaaaagcgatttgcacgtcagcacatctacgagcctccaccagagtttcctctggcttcgccctgctcaggcatag

SEQ ID NO: 3375 - DNA, 435 bp, Chlorella protothecoides
atgaatcaggtggaggaatttctggtgcgcccttctgccacctttcaccatagggatgtgaggaattgccagcatcttgcttgcccgccctgccctgaccttgccatgtatcatgaatcaggtggaggaatttctggtccgcccttctgccacctttcaccacaggtgtattggattgacatcgatcccttggtcgtggctcggctggcactggaggccggcgagctggcctttgccgtcctctttggagagctggccttggtggatgccaggggcgacagggatcagactggcgcctgcgagaacctgctcgcctctgctctgggatgcctgggggagccggacggcctgtatgccgtcacgtactccccctccctggaggcgcaggtggggctgaacggtcgtgctacattcctatgcaatgatgagtgctag

SEQ ID NO: 3376 - DNA, 708 bp, Chlorella protothecoides
  modified_base (59)..(68): a, c, t, g, unknown or other
atgagtgccagtaggccgccggcaagctcccccccatccccacaccctgccgccaaagnnnnnnnnnnggccagtaggccgccggcaaacccccccatccccacaccctgccgccaaaggaggaggagcaaggacgcacagcccgcctccctacgcagcgccctgcttgcggctgactcgccgcgccactgcgggcggcttgcacttgccgcaggcccgcgcgcaggaggtgagcatgaagcccgggttggcgtcgcactcgccgttcaccgcccactcctcgcagtggggttccttgtcgccgcagccgggccccgcgcccagcgtgaactcgctcacgtgcatccacttggtggccgaccacttctcgccggccagggtggggcaggaggcgtgggtggacttcatgtccaggctgccgtcgggcttcatgccgtagaagaagatggcgtccccgcgtcgcgccttgaccgccaggccctgccgcgcgcaggcagaccactcggggccctcgcgcttgggcaggccgtatgggaacaccgtttcgcccccctcctccggcgtggtgaggtacatgagcatggtggccaggcggttgccgccgtgcgcggcgtccgagttcttgctgtcgtggaagtagtcggtgtgcgccttgtactcctgcccgttcacgtacttgagcacctggagaccctcgccattctctga

SEQ ID NO: 3377 - DNA, 825 bp, Chlorella protothecoides
atgcaggagctctggcgtggcagggtggagcaggtctcctgggagccccgggcctttgtgttccacaacttcctgtcggacgcggagtgcgaccacctgatgcacaaggccaacaacaccctgaccccctccactgtggtggacagcaggacgggcggcagcatggcctccaccgtgcgcaccagctccggcacctggttcagcaagggtgctgacgacgtcatcgacgccatcgagcagaggatcgccctggtcacgatgatcccggcagagaatggcgagggtctccaggtgctcaagtacgtgaacgggcaggagtacaaggcgcacaccgactacttccacgacagcaagaactcggacgccgcgcacggcggcaaccgcctggccaccatgctcatgtacctcaccacgccggaggaggggggcgaaacggtgttcccatacggcctgcccaagcgcgagggccccgagtggtctgcctgcgcgcggcagggcctggcggtcaaggcgcgacgcggggacgccatcttcttctacggcatgaagcccgacggcagcctggacatgaagtccacccacgcctcctgccccaccctggccggcgagaagtggtcggccaccaagtggatgcacgtgagcgagttcacgctgggcgcggggcccggctgcggcgacaaggaaccccactgcgaggagtgggcggtgaacggcgagtgcgacgccaacccgggcttcatgctcacctcctgcgcgcgggcctgcggcaagtgcaagccgcccgcagtggcgcggcgagtcagccgcaagcagggcgctgcgtag

SEQ ID NO: 3378 - DNA, 414 bp, Chlorella protothecoides
atggcatccagggcgggcgtggcgaacagcctctggacggagatcggcgagcgctacgatcaggcgcaggggagcggggcggcgagcaccacgccgaccgaggtgcagcgggtgcgggatggggacactggtgtggagttcatcgtccaggtggccgccaatctacaacataaagcccgcagcagcagtgcgacactcagcgtggggcgcccccctccccacaaccccttcctgccgtatgaggaggcgctgtgggtccgccacctctcccccacccacaccctgctcctgaacaagttcaacgtcgtgcctcggcacgtgctggtcgtcacacgcgagtttgcgccgcagagtggtctgctggcggaggctgacctggcggccacctgggaagtgctacaggtgggagcttga

SEQ ID NO: 3379 - DNA, 1224 bp, Chlorella protothecoides
  modified_base (1086)..(1129): a, c, t, g, unknown or other
ttcctccctcgcctcatccccatctggtgcgccgcgctgtgggaaagcgtgcccagcgtgcgcgagggcgcggcggtggcgctgggcgacgccgccgcggggccgcccgcggtacgcgacgtggtgctgccggccgcgctggcgcggctggaggagagcctgctcatggccgcgcagcagccccgggatgacgccgggacgggcaacgacactagggcggggaacggcgtgggactgaggaagggcgcgggaccgaggaacggagcggaccagggcgacggcacctccagccgtgatggcacggcgcagccccagttcgcgtggggggtgcttgccccggccctggctcgcggggccgactgctgcgtggaccatggctacaccaaccggcaggcgggtggtggtggggagggcgcgctggcgatgggagtagtggtgggggtgctgggtagatccagcacaccacaaggttacttgcaggggctgggctggacggagatggagccatgggaggccagcgacggggcaatccacctggcgcgggagctggcgcgtaccacccccgaggacatcgccgcgcggctgccggccctggccgagctggctcgcatgcggcactttggcgccagcgcgtccctgcagcagacgctctggcgctcgctgccggccatcggccgcgacgtgggcaaaccggccttcaagcgcgagctgccgcgcttcctggacccgctctttgcggcgctcacctgcgaccagcctcttgtggcggcggcagcgggggggtgcgtctccgccctgcgtgactggctgggacccggcatctgggccgggcggctgacgccagagcagcaggcgctgcagcgggacagcccggacgcctgtacacgtggcgccttgagattcaagaacgggatggggcagggcagtcttgaccgccaggcaggagggcatcacgggtgttgcagcatgggcgcaaggatggcgcctcaagcatttcaatgcccttcacgacttctggttccagttgacaaagtcgcgagtgttgccagcctcaagaatctcgatccagtacccatctgggtcggnnnnnnnnnnnnnnnnnnnnnnnnnnnnnnnnnnnnnnnnnnnnatgaaggcaatgttcctgcacagccagaggagtgtgacgggtcggtagatagaacagcagctgctcgaggcggcaggtattatcatactccatag

SEQ ID NO: 3380 - DNA, 1584 bp, Chlorella protothecoides
  modified_base (465)..(474): a, c, t, g, unknown or other
  modified_base (1322)..(1331): a, c, t, g, unknown or other
atggcgcagatcgcattgtcgtttcaaaaaggagcgatcccagacactcaaactgcgccagccctgcgcatgatgtatcgactggcaccctgcacgcttgagagggtccctgcatgctcgctgagaccaattactccgaccttcattgtctgcctcgttgctctcgcccctctaatccggccgtgcacctctgctgcacatacacaactcgcaacccgacacgcggggtctctccccccagactcgtttccaaatgctcaagccagaaagggattagcttcagccttccctgaagagggtggaggagggtggaggatcgacgaacccctccctgcctgcccctgtccgaatccttgggatggcgggccagcaacgcaccctcctcaacttaccctgagtctggtgagccacgccatgcaaggcccccttatcatgcagcatgggcatcctagcacctccccaccnnnnnnnnnngcttttcatgaatcacacgctgcacgtgcacagcccctgagcctggtggtccgcctagacgcctccaccgtctgcttcacccccaccgatatccaggccctgcgcacggtgctactggaccccttccagtccaagcacgacctgctgtgcgcgctgcgcaagctggactgctatcgcctggagctggccgacctgacggcctcgggcatcggcgcggcggtggcgacgctgacggggcaccccaagcccgacgtcgcgcgcttcgcggccgcgctgctctgcaagctgcgggcggtggcggagcgcggcctcttcccccgcctgccctacgaccgcgcggaggccgcggcggcgcctgacggccagccccaaacccccgaggaggccatcgccatcgcggcacaggtcgcgcgcgcggcacgcagggcgcggcgcctggcggccgaggccgacttcctcgatgtcgcctcttccagctccagcgatgaggacgaggggcccggggcgaggggcggcacgtcgaacgacggcgagtggcggcccggcggcaggggctgcgccgtggcagccacgccgccaacggcgcccggcgccggtccggaccccggcggcgtggcccgccacgtcaacgcggcacgctacgcgccggacagcgccttcagaaagacccgcgccgggtccagggtggccccgggcaccgagcagggcgctgacgggcggttgtaccgccaggcgacgctggcgtccgccttctgccggcccgcccagcctgctgctggccatggattggcgccgagcgccaaggcagagctgccgaggacgatggtcgtggaggaggagctggtcgnnnnnnnnnnctgccttggcggcgagcgccaaggcggagctgccggggacgatggtcgtggaggaggagctggtcgtggtgggcgtgcggccggcgggcagccccgagcccatggtgctggagctctaagaggctgcgggggccggtgctgggccgggactgcaacgagcctggtcccccccttcagtgatcatcctggcacccatgctgcgactggcgtcaaacttgtacataccgagagcatcgcaccggaagcagggtga

SEQ ID NO: 3381 - DNA, 534 bp, Chlorella protothecoides
  modified_base (372)..(381): a, c, t, g, unknown or other
atgattcaagctccctcccaatttcatcatcgcagacctgaaccaccagttcatggaaagcgtggagtcggagcgggagagcgagcagcagatggccctgctggacggccggcccctgcccggggacaacttccgggacgaccccagcctgtgggacgagaccctggacctgaccccctacatcaacatgtcggccttcaaggtgggtgcaggttgttacctgcaggtcgggcgtcacagagaccttctccctggagcgctcctacatcctgttctgcaacatgggcttgcgccacctcgtggtggtggatgagcacaactgcgtcaaggccaggcgacagtaaggtcactttccctgtgaggagcttcagnnnnnnnnnngtggatgagcacaactgcgtcaagggcatcgtcacgcggaaggacctgctggggtaccggctggacgaggccgtcgcgcgcgctcgtacgggctcgttggccggcgggggccacgccccagggtctaacggcacggcctacgcgccagcctga

SEQ ID NO: 3382 - DNA, 768 bp, Chlorella protothecoides
  modified_base (308)..(317): a, c, t, g, unknown or other
  modified_base (648)..(657): a, c, t, g, unknown or other
atgtgtatcccatgcctggatttgcctcgagggcctcgctctgcacacgagggcggtctctgggtgattctctcgacaaacactgcgcctttccctcactcacccctctcagccatggcagcggtactgggatcgctggataatgatggcggccatcggcattgcggtgggcatcaccggcttcctcctgcacctcctcatccacatcctggctgtgatcaagatcgcgagcaccaggtgtgggctgctggagcgggagcagatgggagtagggtgatgtgcgaccaagctggggaatgtctcccaannnnnnnnnnggctgctggagcgggagcagatgggagtagagtgatgtgcgaccgagctgggcaatgtctcccagcgcaccctctctccaacccgcccttcccacccacgtacccctccaggtggctgctgacgcacacccatgtcatcttgagctggattttcaacctttcctactccctgggcttggtgtactgctccacctggctggtggtcaacatcgcacccgaggcagccggggctggggtggcagaggtctcggcctacctaaatggatgcaacatccccaaggtgagatcatggagggggagcgcacgaaggaggatggtgaatgtgcaaatnnnnnnnnnnaacatccccaaggtgagatcatggagggggggcgcacgagggaggatggtgaatgtgcacacgcaggagaaggggatagcccaggggctttcatgtcggctgcagggttga

SEQ ID NO: 3383 - DNA, 1494 bp, Chlorella protothecoides
  modified_base (314)..(323): a, c, t, g, unknown or other
  modified_base (1088)..(1097): a, c, t, g, unknown or other
  modified_base (1194)..(1203): a, c, t, g, unknown or other
atggcactttgctgtgagctgcagagccgcctcgtcgaacttctggttgggactgcccatctctttactcagaccaacggcccgtccccgcctcagatgagctgtggcaccacctggcggagctgggggtccacaagggggacaggcaccatccggagcttgggagcgtggacgaatgcctggagctcttcgtcgcgcaatggtgcggcggggtggaggagtatggatgcacgtgccaaggctgggtgcagtctgaagagctcccgcctgggttttcctgacacacccacaacaaacaaatgtgctgtccgggnnnnnnnnnnagggtggaggagcatgcatgcacgtgccaaggctgggtgcagtctgaggagctcccgcctgggttttcctgacccacccacaacaaacaaatgtgctgtccgggagcaggtacatcaatgtcaacaaggacaggagtgggtcgggcgaggggatgacctactcaatcggaggtgggtgaggtgcttgggttggggtagctggagctgcgaaatcacaactccagggatgcaccgtgccaggcaggaccaacctctcaccacttctgaccattggtttgactcgacaaaatcacaagcagcggaagccttcgccaatgttgaccttcgaacgagggcgacgaaacggggaaacaaggcaaaggtccacacgaaggaaagtctcccaatctataaaagcacaaacgacccaattttatggttacgctttcgcaggcgtggtgtagctcgcaacatgtcgctggcagctgcatgggtgaggtcaccgagctggagtgtgacgggcaaccgcccttctgaagacaagaggggcgcgtcggcgggcttcttggcatcatacaggcatgacttcaagcagctggagttcgatgtggcagctctgtcagggcctgcattgcgattcctggacggcgagacagcgcacaatgtagccatctgggcggcggcacatggcttgctgcccaaggagacccgtccagacccccccagcctcagaacgaccgtgtgggaccgggacttcccaaacccgcttggtgtgtgtgtgtgtgnnnnnnnnnnggcaaagaacaaggctgctcaatggggactgacgaggcttccaggacctgttatttcagtgcatcacatcgcctttgatacctattccataggcctnnnnnnnnnncggtcaggctgggtgctggcgagttgcgtgtgcagctttggtcgccaagccgttgcaaagcacaaggctgctcaagggggactgaggaggcttccagaacctgttatttcagtgcatcgcatcgcctttgatacctattccataggcctggcagctgggttcgacaagagtgcagaggggcctgaggccctcttaaacctagggtttgggtttgtcgagatcggtgagtatcacccaagcaagcaacgacagggggttgtaaggcggctccccatgtttgaggtgttctga

SEQ ID NO: 3384 - DNA, 1203 bp, Chlorella protothecoides
  modified_base (33)..(42): a, c, t, g, unknown or other
atgcacaggcctgcgcgccctccagggcaggcnnnnnnnnnngcacgcccgctcgctgccggcgattcgtgcccccctctccagcgattccgcctggccccgcgcacaggcctgcgcgccctccagggcaggcgggagctgcagtccttggtccggcgggtcaaggccgagcgggatgccctggcctggcacggaaagttgtcagccatggcagactatggtgccatgcatgctcccggcaggcgtctgccttgtcaaggcagcctgcaagtgccccgtctctctgcaaaggatcgtgtcccaccctttgccacccctcactcccatcaactcatgcagcccgccccgccgctgctcatcaagatcgcgcccgacctcacggcggaggatctgggggacattgccgccgtggcgctgtccgagggcgttgatggcctggtggtctccaacaccaccctggagcgcccgccaggcgtcgcggcgcaccccgccggcgccgaggccggcggattgagcggggcacccctcttcgagcgcagcacggcggtgctggggcagttgtaccgcctcacccatggccgcctgcccctgatcggcgtgggcggcgtgtctacgggggagcaggcctaccgcaagatccgcgcgggggcctccctggtgcagctgtacacgtcgctagcgttgagcgggccggcgctggtgcggcgcgtgaagctggagctggccgcctgcctcgcccgcgacggcttcaagtccgttgctgatgcggcctgcactgtctgtttgaaaatccaaccctgtcccaaactgtgtgagagtctgtcacaggaatcggcattcacactcgatttgttcctggccagttcctgcgaggctactgctcgtcgccggcggaaaagtcaatccagttctgaggcagggcctcctgcttcatggaggggtcccaccacttggactgctgcacctgcgactgcggggtgtccagtgatagggggctgcgtgaacacactggcgctcgtcatcgagcgtttggagcattctgatcatccaacgattcaaccacgaacgtcgccgcctccccaccctcaaggctacacccagacaacaccataccttggtctgcttgaggaagcgctcccaggtcttgcgcgcatgctcatccatctccatctcctccagcacacctggaagggagggcgctga

SEQ ID NO: 3385 - DNA, 627 bp, Chlorella protothecoides
atggtcacccacgagatgcgagtgggtgaccgcatcgtcctccaagggacccatcggggcactattaggtacataggcagtgtacccaatcaggctggggaatggacgggcgtggagtgggacgatgcctcccgaggaaagcatgacggctgtgtggccggtcagagactgttcacatgtcagcggcctgggactccagcgaccttcgtgcgctcccggaagctggtagagtctctcctccccgtgatgagcctcctggagggcctgagggagaggtactgcagggatgaggcccccagcctggacctgccgtcccccggccagcaccccaaagggcggggtgtggtggtcatgggcagggctgacctcctggcggcagcctcggacttgaccatgctagcccacgccagcgttcttggcatgcacgtcgccgccagggtgagctcagggcaggtcgattgctacctcagaggctctgcccagcctacaggacctggatgccggcgataccctgctcggaagctggcacgcggctgccacggcgctctcgagcctgcccgcgctgcgcacgctgagcctggcggggacacggctggaggcggtccccgccctgccgcccccgccgcc

SEQ ID NO: 3386 - DNA, 618 bp, Chlorella protothecoides
atgcgcagtcccctcgctgatgccgctgtcccgcctctcccgcccccctgtgtttgcagccgagtggtggaggagacgctggagctgttcacctgctcccgcacctcgcataccagccaggtgcatggtgggggcggcccgggcgacgccgacggccccggcgggaagggcaacatcaccatcccctcctcctacaacgagctggcgacgctcatgagcgtcacgggtgaggggagagagtgggagcggtggacggggcctgggtggagggactgcctgtgccagggaggatgctcgggttcatgtccggcaagaatcaaatcttcacacagaccgacggccatgcgaggctacaagtctgagatgtggggaagcatgctgcccagatcggagcggcgaggacgcgatccggcacctcttctcgcgcggcacacaccgcgagtttgggtatgcggccctggtggtcatgctggtgtggtacttcctgggggcggcctggacagcagggtctgcgatcgcctcgggtgggcgggggtggtcgggctgtggctctctctggctgctggtggggcttggcgtggggcgccggcgagggtcgaccaatgggtggcggcgtga

SEQ ID NO: 3387 - DNA, 633 bp, Chlorella protothecoides
atgagccagggccactccaccaccctgggctgcgactcgggcctcttccgccgcttccagaaccccaaagacaagcgcgactttgtgaccgtgggcgccgcggtcggcattgccgccgccttctctgcgcccatcggcggcatgctgtacgtgtttgaggaggtggcctccttctggcagcaggcgctcagctggcagatcttcttcgccaacatgattgcagtgctgacagtcgacacattgcgcagcgccgagtcggcgctgcaggagggcacctttggcctgttcgaccgcgagtcctccaccgtcttctttgaggtctatacccagctgaacaaccacgtcatggccatggtccccgccgccctctgcggcctgctctgcggcctcctggccgtggccttcaccatcatgaacctgaaggtcatccgcttcaggggcagcgtcatcaaccccgaccgccgcctgcgcatggcagagccctgcatcctcatcatgctcttcgtgaccatgggcatgatcctgcccctcttcttcccctgcacacctacccaggtgaggaggattgttttggagggagggggcgctgggggaaacgacccatctttgggggaaggggggtcctattcctga

SEQ ID NO: 3388 - DNA, 306 bp, Chlorella protothecoides
atgcctggaactgacgcacaactgggtgagggcaccgagagtgaccctgacttcaagggctaccacaacggaaatgaggagcccaagggctacggccacatcggcttctcggtgcccagcgtggccgaggcatgcgcccgctttgagaagctgggagtgccattcaagaagaagcctgatgccgggagcatgaagtgggttcttgggcgaatagggccttggggcttgtccatttgctcatttctcaaaccaggaagtcatgcccttgcatgtggtgccaatattttgaacactgagcatgactaa

SEQ ID NO: 3389 - DNA, 573 bp, Chlorella protothecoides
atggcggcgcgcaacggggcggggtccgaggggtgcgtgactggggcggtcctggcgcctgccggcctgctggggcgggggaggctgatgctgtgggcatcgggggcaggcccttccccgcctcggcctctactggtctgcacccccaaaccctgcctcaaccccctccacatctgctgtaccccccctcaccccctccccagggcgccacccggggtcttcctcccgccccaccccatgtccttcatcgaccccggcgcctttgcgctgattggggcgggggccttcatgggcggcgtcacgcgcatgacgatcgcccttgccgtcatcctgatggaggtgtccaacgatgtgcgcatcctgttgcccctcatggtcgccatcatggtggccaagtgggtggctgacctcggctcccacccgctctaccacggcttgctggaggtgaagtgcatccccttcctgcccaaggcccccgtctcatccgcgtccctggatctcatcgaggtccgctacgtcatgcactggcccgtcacctccctcagggtgaggcggcgggaagggggctcgtga

SEQ ID NO: 3390 - DNA, 2823 bp, Chlorella protothecoides
  modified_base (579)..(588): a, c, t, g, unknown or other
  modified_base (2764)..(2773): a, c, t, g, unknown or other
atgctcccagggcactcgcggcaaagccccggcccctccaccctcgtgacgtgttcctgcccaattggatgcctcgtcgacccatggcctcggccggcaggatcttgtcaaagaacgagggcaggtcgccgggcctgtgtgtggcttcctgggccgcagcggagggggtgtccaggggactatttgagggcaggcgcggtcgggaccgcgtgtaccccggcttgggcaggatgctgccggaggccaggcccccacacagctgccggacctgcaggatggcgggggtttggagagagatgttgctgctcggaatcgtgctgggatgttctggcccccaaagcaggcaggatgtggggctgctctgcgcgattgcacccccgacaatggccctcaagcacatcgctcaattcccaagcctggaatagagctcacccgctcgccctggctcaggctgcccgccggtgtctctttggtggccttgatgtgccgcttgacctggggatgtggagtagtagtggtaagggtgggccacgcaagtgctgcacagggataccatggtcctgcctcttggccagggcnnnnnnnnnngggagtggtaaggatgggccgcgcaagtgctgcacaagaccctgcacgtaccatgttggcgccctccacgaccacacggggccactgccgatcgcgcaagacttccttcacggtgccgatgcggcccttgtcccgaccggcggtgatttgcaccttgtcacccttcacgattttccatgtgttggactcaaacatgggcttgaaagccctcctgtacctgcccatcctgagcgccgctgtgcaggagggaggcgactcctatgcgtacggaaggctggggtgtatctgataagcaatgagtcagagggaagctcaggccctcgcgcaatatctcttcaatttaaagtttggtttccaaagcatcctgcgactgctggggcattgtctccgggaggtttgggcactttgggagcggggagccaaagcacggcacagcatgcaacagcacccgacctcatgaaagcgcatgtgtggatcggcgagctcatcgggttcccaactccatgcacgtcaattcttgcggaacataatctcctccaagtacatccagcccgttgtcgcagtgccatgcgtgcgatcacggcgtgtgccgcatctcacagcctggcccaacccaccagcctgaggcccccccatgccagcctaccagcagtgactctggcccccggccccaagccggggtccatacatcgccttcacctcctgcgcttcgccctccttgcccccatgctgtctccacctgctgtcccaggcctgccaggcctgccggtccttcaggctggggcggccgccctggcagaccccgtgggcgcccacctgccaggggagcgccctctcaccgccgtcctgctgcagacgctgcgggagtgccaggtggccataggggtgtaccccccgtttgcctacgatgcgagtgggggcatggggcggggcaccgtgcgaccccggcccgacggactcttggacctggattttgatccacgcaggtgtgctgtggtggtgccagtgccgttgccttgtgaatgggagttgggatggagctggattacctgtacctgctctgacctcgtcgaaccacttcaacccctctaccaccccaacaccctgcagtctcgtcatccccagcatcgactcccacacgacgagtgtactgggggtgcccctccccccgcccctgtccatcgccatccagcccctgtccctgagcggcacgctggaccccgccacgggcagcatggagttgaccctggacgcggacttcctgttcaccgcaggacccctctacaaggcgccgcccctgcacgtgcacagtctgctgagcacgaaagatggaaagggcgaggcgctgaaggccaacgggagcgcgcgcctggccgggaccgccaccgtgccccgcacccccgatggggcgctgaacgccttcctggacctgcccacggaggccctggcggtgctctctacccacctcacctttgtctgaggggtgggcaggggttgtgggctcatacagggttcacttcaccgctggcgcctgggctgtctcgtcctgagtctgcctgtgctggacccatccccttggaagtatcctgggtgggcgggggttgtggggctcatggagggctcacttcaccgctggcgcctgggctgtctcgtcctgagcctgcatgtgctggacgcatccccctggaagtatcctgtgaagctcacacagccaactggtgctccttggatgtgcttgctggcaccaccgcagcactgatgtgcccacatgctcacctgggcagcaatgccctgcagtgccctcagagtgcggcgagaggaagagtacaggctttgcactgtacggaaagcagccttgccttggcgtgccaagcacacataaaactactgggcctgcgccctgggggccaccaggtatcggtggtccttggctgcattcttcttcctccgcttctccatgtacttctccagccggccgctggccttgagctcctcaaacttggccaccagctccagtcgcttctgctccgacttcttgaggtggaagggcgtcttgcccgcctgtactgccgcccgctccttgctctgtcgcatcaatggggtgggaggaagggtgcattggtggcagcacggaatgcagcagcgctcgcagcgatgccagagcgggctgcctgcnnnnnnnnnnccaatggggtgggaggaagggtggattggtggcggcacggaatgcagtag

SEQ ID NO: 3391 - DNA, 663 bp, Chlorella protothecoides
atgccctgttacctccactccttccaggcggaggaggaggacgacgaggtgccgcttgggcagcgcgccgcccagctggcggatggcagcaccgaccgctccgccatgcgggcccgggcgcgcgctacgctgcgcgcggggcgccagccccgggagaacaagcaccggccctcggaggccagcagcaagcgccccgtgccggtgctgcgggagagcatccagggcccccgcgcccagggcaaggacccacgctttgagtccctggccgggggcgcctttgacgagcgccgcttcaagagccagtacgctttcctgtacgacgagaagctgccggaggagcgcaagggcctgcgcgccgcgctgaagaaagccaagggcgcggaggcgcgggccgacctgcaggcgcgtctgacccgggtggagcaagcgctgcgggaggagaatgctcggcggtggaagctcgacttcaaggccaagctgaaggtttgtgatgggggcctggtaaaagggggtggcgctgtgttgttgtatcgggggggaaagaaacccagcgggcgggactttggccgtggaacacggccgctctcgtcggcgcgggcgggactgtggccgtgggacacggccgcccttatcggcggtgaggggagggaagccgtgcgttga

SEQ ID NO: 3392 - DNA, 210 bp, Chlorella protothecoides
atgcgacagagcaaggagcgggcggcagtacaggcgggcaagacgcccttccacctcaagaagtcggagcagaagcgactggagctggtggccaagtttgaggagctcaaggccagcggccggctggagaagtacatggagaagcggaggaagaagaatgcagccaaggaccaccgatacctggtggcccccagggcgcaggcccagtag

SEQ ID NO: 3393 - DNA, 861 bp, Chlorella protothecoides
atgggttgttacctatcccacctccccaccaccaccctcgcaggcgggacatgcccggagacccgtcaggaggccggcaaccagatcgtgggcatcctgcgcagccaccccgagcagctgcccggggtgctgggcgcggtgagcgccctcctgcgcagccccaactgggacacccggctcgcagcagccaggtgcctgggctccgccgcgatgcactttgtgcacgccacccccgcggacattgccgccgcctcgggcctggatgccgtggccctggaggctgagctggaccgtgaagagccgatccctgacggcacagtgaaggcggagcaagatggggacgagggccccttgaccctggagaacctggacatccaggagatcgtggacaactgccctccactcctggcctccgggggagaggtgaggggggagaggtggggcgggggcggcggccatgccaggtgccgcacgtgtgggtgcctgactgggacgttcgccgccgggtctggcgagcttggcctggcgcgccggcttctcacctgcccacagactcgagtacgcccttcgttgcatgttgccccctcccctctcgacacccctcgcccattctcccgggccctgcgcgcaggagagtacgcggcgcaggcggccgagggcgtggcggcccagcgctcggcgctgcgcaagcgactgggcctgggcggcgcggccggcggcttcatggacgacgcggagctgttcaaggacgaggacctgctggcgggggcccgcgaaccggagcccagcgccgcccagcccgagcctgcgcccatccaggcgggtcggcgcgcttgcgcctcgcctcctcgcgccgcctga

SEQ ID NO: 3394 - DNA, 396 bp, Chlorella protothecoides
atgtcccaccccggcggcttggacgcgccgacgcccgacggcctctcccccggcgagctccagcgcctggccttcgcccgcctcctcctccgcccgccggccctggcgctgctggacgagcccacctccgcgctgggcgcgggagcggcggccgagatggggcgtttggaggagcacgggtcgaggcagcggcgcgtgtcgaccgtggctcttgcgtcgccgatcgtgggcgcacggcaaccattttcaaggccaggagcgcacagtgttgccgagtgcgcggatgaactttgtgaagacgtgccgcacctccgcgccgcgcacgccgcggtgctgaagctggtgggcggggatggggcctggacgctggagggcggcgacgacgtggcgccgtga

SEQ ID NO: 3395 - DNA, 660 bp, Chlorella protothecoides
atggacatacctgttgcgccccatgggcctccattgcaggacatgacccaacctgtgctgacgggtcatggtgatctcaatccggcccatgtgcgcgcatcatgcggttgcacgaatcgcagcttgttgtcaattataagctcctctctggctcatccttcgttgatccaacaccgtcgatcacgctattataatggtattccgttcaagctactacctctgcaatatcatgagaaaggcctccgtcatgttggtgcttgcctaagcagccccgaccatcaagcgtcatcaagccaattaccagggcatgaggcatttatggccaaatgtaagcgagatggtgggaataatctcccgaatgcagtcgtaaaattttcatgtcctatccgtatgggactcaaggcaaccagcaatgaccagcaggcatgggatgccttgagcgggtgtagtgaagctgactcccagtgtgtggtggtggacaggtcccagtggggcaggctgcggctggtggggccaggagccttgccccttctacagggtcagtccactgcggacgtgatcaacctgagacctggccagtgctgcgaaacggtgcggtgtttgcatgttggggaattcaatggatgcatggcgcttgaagatggaggcagcgttttatga

SEQ ID NO: 3396 - DNA, 591 bp, Chlorella protothecoides
  modified_base (132)..(141): a, c, t, g, unknown or other
  modified_base (201)..(210): a, c, t, g, unknown or other
  modified_base (374)..(383): a, c, t, g, unknown or other
atgctcgatcccaagcagcatcgttgcgcttgttgccgaaatcaatggctcactctccggtgcaggcctgggcacttctttgcctcgtcggacaaggccaagcgtgagctgggctggaagccagagcacacnnnnnnnnnnttccaacatctgcagaatcacagatgcttgatcccaagcagcatcgttgcgcttgttgcnnnnnnnnnngttcacccaggatgcagccgaggtgaggacgagcgagtgcctgcgccagggtgcagcaggcagcagtgcgtggaaggtacccctgtgcggctttcagctcttgtgcaggcactcagtgccgggttgctccgcacacgcagctggtggaggcctacaaggcctcnnnnnnnnnnctttacccaggatgcagccgaggtgaggacgggcgagtgcctgcgccagggtgcagcacgcagcagtgcatggaaggtacccctgtgcggctttcagcgcctgtgcaggcactcagcgccggttgctcctcgcacgcagctggtggaggcctacaaggcctctggacggcgggaccaggagatggatttcagcggaggctcggtgtga

SEQ ID NO: 3397 - DNA, 249 bp, Chlorella protothecoides
atgacgagcaatcgcaccttatcgggacagcccctccatgcacccaccaggacccgcagggcggcgctggcgcggcgcgcggcgcccagggccgagcatgtcctgatctccaacaccaagagcgggggccatgccttcctgggcctgcacctggctcaaaagctcctggaacaggggcatgaggtcaccattctgaatgctggatccaaggtgccgaggcacgtggtggtggagatgcgggtgtgctga

SEQ ID NO: 3398 - DNA, 480 bp, Chlorella protothecoides
atgcgaggggaggatgtgatgggggccggagtgccgccacagcaggctggctgtggagggcaagcgctgtcctggccgcgcgctggcgcggtgcggggccaggtacacttggagggggcgccgtacggcggcgatggcggccagcctggcctgcatcgtgttcgggggagccccctccgctccccctctcacgccccttgcctccatcccctcttgcccccccccccctttccaacaacagtgctgaacagcgagcaggaggcgctcctggacttcatcgtcctgtccaaaagccgcctgtttgtgggctttggctcctccaccttctctttttacctgcgagagtaccgctcgctccaggtgggcacgcctggcccggagggcggctgcagggcgggagggcgagcgcctgtgtcaggccacgccggtgcatacactcgggggttgagcagcaagccctcggcatgctgcacccgctga

SEQ ID NO: 3399 - DNA, 744 bp, Chlorella protothecoides
atgctgcccctcacctccagcggcccctcacgccgcggcagcctgctgcacctgaccaacagtcctggcgggaccccctccctgggcctgcaaccgatccgcgaccccagcaacctccgcttcctggccgggctcctggcggtcacgacctgcctcctgttcctgggcctgcaccccgacacctaccccctgagcggcgccttcccgcgccggcgcggcctgtcgggcctggtggcggacagcaggctgctggctcgccatgcggaggcggctgcgggggccgaccagggccccacaccacggcccctccccgcctcgcccgcgccctcgccccccgccctccccgccggcctgcccgaggactttgatgccgaggcgtaccgcgcctaccacccccacctggacctgcccagcgcccgcgccgccgccgagcactacctggcgcacgggcgggaggagggcctggtcgcgcaccgcctgcgtgtcctcctgcgctacacggcctgcacggggctgatcaaccagcactactcccacatcgccgccttctccctggcctccgtgctgggcgcggaggtggtgctgccccccgccgtctgccgcgactccttcgcacactacttctctgtgttcaaggagaagaacgaggtgcagtgggctcccgtccccctggactccctcctggacgtccctgccctgatcgcctggccaggggcatccacgtgcacgaaacgccggcgctga

SEQ ID NO: 3400 - DNA, 1437 bp, Chlorella protothecoides
atgctggccaggcgccgtcgatactcgcgactgcgcagccgtcagcgacgctgggggtgcaccggcctgcaccagcgatgccgctcgaaacgctggtctggcccctccacaccatgccttgcggcctccttgcacccaccccccaatcctgcaggcaggaacccggacctcaaggtggtgctcatgtctgccacagcggatgccgacctgtttgcggcatactttgaggaggccctggggcagcccaccgcgcgggtggtcatcccggggttcacccatcccgtcaccggtgagtcgctgggtgggaccgtgccagccacagggggccctgcctgcacgcggggagcccgggatttcctggcgcctgtgccaaaaatcacatgggcgtgtggccccggtctggcggaggctggcaccggtccctgccccaaacctgcccgtggggcacatggaatggggacttccatggagcccagcagtcttgactgcaaggctgcccatcaccccgccacactcctcacctccgtccacaccccccagcccacccttccctcacacagagtactacctggaggatgccctggagcagacgcggtcacccggccgccctcccgcggaagcagccgcgacggcccgggtggaaagaaggaggtcaaggacaaggcggcacccatcccgcgtgggctggaggagtacagcgagcagacgcgggcggggctggcggccatcgacgaggccacgatcaactacgagctcatcggctcggtggtggagcacgtcatcgccaccaagttctccaagggcccggcccaggccatcctcatcttcgcctcgggcgccgaggagatcgacaaggtggtgcgccagctgcgctcctcgcgccaaccgctgcacgtgctgcccctccacggtggcctgccccccgcccagcagtcggccgtcttccagcgcccgcccaaaggtgcgacggcgcagagtgcagtcaagcatcgagcgggacaccggcgcgtgcccgccgggggcgtcactccactttcctcgcccctctgtgcccctcctggcccctggtacatgcctcccctgctgacctcctgcccccgccctgcaggctgcatcaaggtggtggtggccaccaatgtggctgagacctccatcaccatcgacgatgtggtgtgcgtcatcgacacggggcgggtgaaggagatggcgtttgaccccgaccagggcctcaaccgcctggcggagacctgggtgtcgcaggcctcggcgcagcagcggcgtgggcgggcggggcgcgtacggcctgggacctgctggcgcctgttcagccgcgccacgtggcgcaagctggagaagaacaccgcgccggagatccaccgcgtctcgctgcaggtagatacacgtgggagaggtgggtttggcgcgccctgggactga

SEQ ID NO: 3401 - DNA, 336 bp, Chlorella protothecoides
atgacgcacgggtccaagtccaagcgcgagcatggcagcatcggtcccggcacgaccccgggtcgcgtcttcaagggcgtgaagatgccgggacagatggggaatgagcgtgtcaagatccgcaaagtggaggtgaggcgggaagcagcgcttgcacctcgtctggaatgccttgccccagagcagagagacacccttacctccccccccaaacaacctcaggtgcttctggtggatgaggagaacggtgcgctggtgctcaagggaggactaccgggcaaggctggcaacgtgctggagatctgtccggccaaaatcgttggtgtgaatgtctga

SEQ ID NO: 3402 - DNA, 717 bp, Chlorella protothecoides
  modified_base (128)..(137): a, c, t, g, unknown or other
atggagggcgtgctggcgggccggcgccagctggccggcatcctgcaggccctgggctttgtggacggcggctacctggcgcgcctggatgcgccgccctccagcgatccgccacacgcgctggacannnnnnnnnncctggcgcgcctggatgcgccgccctccagggacccgccacacgcgttggacgcggcggccgcctcggcgcgcgtggtcaaggccgcgctggcggcggggctgtaccccaacctgctgcgcgtggacgcaccgccgcccaagttccaaagagtgcacgggggcaccgcgcagatcgacgcagacccggccgagctgcgcttccatgaccgcagccgcggccgcgtgttcctgcacccctcctcctgcaactttggggcggggcgcttcccctccggctggctggtctactccgacatcgtgcgcaccagcaaggtcttcgtccgggccagcagcgccgtgccggcctacgccatcctgctcttcgcgggcgagctcagcgtggatcacgtggcggggaccctcaccgccggcggctgggcgcggttcaaggcccccgccaggatcggcgtgctcgtgcgcgacctgcgcgccgcggtcgcctccctcctcgccgccaagatcgccgatccggggctgagcctggcggggagcccggtggtggaggccctgcactccctcctcgccagcgacggcttctga

SEQ ID NO: 3403 - DNA, 624 bp, Chlorella protothecoides
atgcgcgccgtgcgcgccgcgctgcccgccgccgcgcagcgggaggccgtcctggaggggctggccggcgccgccgtgctggtggtggagggcgccacgggctgcggcaagtccacccaggtcccacagtttctgctggaggacgccgtggcgcgcggggcgggcggcgcgctcgacgtcgtggtcacccagccccgccgcatctccgccgtgggcctggcggcacgcgtggcggcagagcggggcgaggcggcgggcgaggtcgtgggccacgcggtcaagctcgactccaagcgcagcgcccgcacccgcctcctcttctgcaccacggggggggggttcccgtggggcgcgctcgccgccctccattgtcgtcaagccaggccgatcatgcgcccatgggtctttccagctcgttccaatcttcggcctgcggcacctcaaggcacgttgcgccgtggcgaggcacccacgtcgcagcaggcaccctacctgccccgcccaccgcccggcctcgcccacccaacctcacccccccacttcccaccctcgcccggcccgccccaggcattttgctgcgccggctgctcaacgaccccggcctggagggcacgacccatgtga

SEQ ID NO: 3404 - DNA, 309 bp, Chlorella protothecoides
atgccgggacatggcagggctccccctgcatgcatcgatgagtccgtgacgcccgcaagttggacgctgcaggggcgcaagggcacccagtacatcttcatcgcctctgccggggcgtacaagcccgaccccaaccagcccccgcttgtggagggggacccccgcaaggagtctgctgggcatgtggccgtggagaagtacatcgagcaggagcatctgccttacaccgtgttccagccgctgtacatctatgggccgcacacctccaaggactgcgagcagtggttcctggaccgcatccttcggtga

SEQ ID NO: 3405 - DNA, 291 bp, Chlorella protothecoides
atgacgtccatctacaaggatggcaacatgctccccgtgacggtggtggccctcgagcccggcaacatcgtgacccagctcaagtcggagggccgggaggggtacaactccgtgcaggtggggtaccgcgtcgtccccgaccgtaagatcaccaagccagagcgcaaccacctggccaaggcgggcgcgccgcccatgaagttcctgagggagttcaaggtgagagaactgggggaggtggtgccagcccccaaggggacacccaaggacttgagcctggtcaggccttga

SEQ ID NO: 3406 - DNA, 825 bp, Chlorella protothecoides
tacctcgccgagcccgggcgccgcgcggcgctgctggagctgatcgtcggcggcggcgccggcgcgctcagcgccgcgcggcgctatcgcctgcgcggcgtgcgatgggcggcgctggaggccatgcgcgccgaggcgcgcggcgaggcgcacgcggagaccgtgtctgcgctgatcggggagatcgtgctggcgctgaaggagggcaacgccaagacgcgcgccgcggcctttgacctcctcgtcggcctggcccacgcgctgcaggacgccggggcatcggccgcactttccaccacccccgccgccgggcccctagcggccctgggcggcgtgggcacgctggtcacggtgctgctgggcgggctggtgggcgcgtcgccgcacatggtctccgcctcggtcatgggcctggcgcggctgctgcacgagttcagcgcggcgctgctgcatctcgtccccgacctcctccccgcggtgctcatgctcctgcgctcccgcgcgcgcgaggtggtcaagtccgtgctgggctttgtcaaggtggtggccagccgcctgcccgtggaggagctggtgccccgcctgcccgccatcctggagggctgcctgctgtgggccgaggactccaagaacaagttcaaactcaaggtgcgcatgatcctggagcgcctggccaggcgctgcggctacgaggcggtggagcccgccgtgcccgccgcccacaaggcgctgctgacccacattcgcaaggcgcacgcgcggcacgagcgcggccgccagggcggcgacggcggcgacggtgacggcgcctcgcgcgcggacgcc

SEQ ID NO: 3407 - DNA, 648 bp, Chlorella protothecoides
atgacccctcctattccaacacaacaacagtctggggagctcttcgactacatcgtggagaaggggcggctgatggaggacgaggcgcgacgcttcttccagcagatcgtgtctggggtggagtactgccaccgcaacatggtggtccaccgcgacctgaagcccgagaacctgctgctggactcgcgcatgaacgtgaagatcgcggactttgggctgagcaacgtcatgcgcgacggccacttcctcaagacctcctgcggctcgcccaactacgccgcgccggaggtcatctccggcaggctctacgcgggtccagaggtggacgtgtggagctgcggcgtcatcctctacgccctcctctgcggctccctgccctttgacgacgagaacatcccaaacctgttcaagaagattaaggtgggcatgtgggggggttgggggccgggggaggggaccgggtccgctgcacccaaacccccctgccgaggcacctgctgggcagtggtctctcctggccatgcacctgcaggcgcctttcctgttcctcgcacacatcctcaccttccgaggacacttccaacctcaccccctttatccaccctcggctcgccgctgttcatccccctccccgccctccaacgcccg

SEQ ID NO: 3408 - DNA, 537 bp, Chlorella protothecoides
atggcagacgctgcgcaccaccaggcccctcccgtggcctaccccggggttcccggcgccaatcccatggcgcagacggggacggagttcttcctgtcgaattaccggcttggcaagactctagggatcggttcttttggcaaggtactcccggcggatgtgatccgagcgcaccccagggtcaaggtggctgagcacatcctgacgggacacaaggtcgccatcaagatcctcaacaggaagaagatccggcagatggacatggaggacaaaggtaagagcagggtggatgatggtggaggttggccgggcgtcagggcaactctgctgcatgccactctcgcgcaaaggtccaggcagacctgcatgtactcctcctgcttgccccgacctgcagttcggcgagagatcaagatcctgcgcctcttcatgcacccccacatcattcgcctgtatgaggtgatcgagaccgcgcatgacatctacgtggtcatggagtatgtcaaggtgggagagcggagccctgcctggtggtag

SEQ ID NO: 3409 - DNA, 2439 bp, Chlorella protothecoides
atggctgaagatgtaattgctggagtggcaatcaatcgcctggcacgcatcgccattgcatccttaagtgccagcagcgtcgtcatggacctatgtaagacccccacctggcctgcctatgtcttccgtgtgggcctggcgccctgcacacctcttgattgttgggatggttccagagtcccccctcccaacccacaatcccccgcccccgtctcaaccccccctcttgcccatgcaaaggtggcgatcgtgggccgccccaatgtgggcaagtccgcgctgttcaaccgcctggccgggcggcgcatggccctggtgcagaacaccccggacggccacgtgacgcgcgactggcgcgaggcgcccgccagccttgcggacctgcgcttcacggtggtggacacctcgggcatggagccggagctgggcgcgcgcgcgccgcgttccatccaggcacgcgcggcggcgctgacggcaggcgtgctggcgcgcgccgacgtcacgctcctgctcatggatggacgggcgggggtgctgcccggggatgtggagctggcgcgctggctgcgccgcctacccccgccgcaccgcgtcctgctggtggccaacaagtgcgagcggcgcgagactagtgcggcggggctggcggagagcccgcgcctgggtttcggccccgccgtcgccgtggcggccgaggcgggggagggcatggccgacctgtatgcaggcctgcagcccctgctggatgccgtgcggggggcggcatggggagtcgtgggcagcgcgggcggacctggcgttggcggcgcggagggagccggcgttggcggcgcggagggagccggcgttcgcggcgcggagggagccgacgtggacagcgcggagggagctggcatgggcggcgcggagggagctggtgtgggcggcgcggagggctccgggccgccggggctcgcagcggagggtatgcaggcgcccgacgacgcggcgccggccgctgaaggcggtgacgcagcagcggagcgcacgactgaaagagacagcgcgaccaaagcccagtcccccggctcgcaggcctctccgctgctgcgcatggcggtggtgggcctgcccaatgtgggcaagtccacgctctgcaacgccctgctcgccagcgagcgatgcctgacggggccggagccggggctgacgcgcgacgcagtcacagcgcggggcattgggtgggcaatcccaaaccctgtgggccctacacatcactggatgatggccaggggctgggtgtgtggtgccctagaggacgcggagcgaggagcatcccaccagccggacgcggtctcttcccaacactgcccccaacccccgccgccgccgcctcccaccccagggtcaaatcctggagctgacagcgcggcggccatgcacagcgcgcaggtcgtggtcctggtcgtggacggcgtcaggtgcccagtgtggaggaggagggactttagctgtactggcacagccgtgttcatgaggccgggcaagggatggggcacgaacgccacgctgagtcaggcggcgggtgtcggagcatggcgaggggctgacacaccgcgagctgatgctggccaacgacgttatcctgcacggccgcgcgctgctcatcgccgccaacaagatggacgcgctggggcgggaggcgagggcgggtgtgctgggcctgctgcggcgcagcctagaccgcggcctccccgccggcgccagcgtgcgcctgctgcccatgtcggcgctgcgcgccgatgtggcaggcctgctgccggcgggaggggtgtcggcgggtggggtgggtgggattgggctgaggatgacaggggcgggagctcttctgctgcactccccaccgtggccttgcccacctgcctgaggtgcggtgcgctgcacgcggcctggctgtggacgcagagcccgcatgcgggtgccctgggcggaggagccgcacactcatgcgacctccacaccaccttttcccgtctcccgccagctggcaagttcttacacgaccgggggagggaaggacgtggggcgcatcaagtacatgctgcaggccaagggccggcccccgacctttgtcgcctgggtgtcgggctccgcgtccatgccgtcctccacccagaacttcctcaccaagtccctgcgcgccgagtttgggctggagggggtgcccatccggctaaaggtcagggccaaggagtccaggaggccaaagtaatgagagaggcttggggcggttacctgagtgatagtgctcgactaggtggaaccttgcccccccagactctaccgaactggcaatgccacacccaccaagctgattccttcgtggttgtactgtcagcgctgatagtgggaggttttgaggattgggcgagaatgggctggccagaaccaacaggctag

SEQ ID NO: 3410 - DNA, 1431 bp, Chlorella protothecoides
atgaatgaacccactacgccacggtttcgacatctatgcatcgtatttcatgatgagccaggaatagatagcatctgcgctgtactgagccatggttcgcttccactggcatgtcgagggtggccagtccgccttcattccacccgcgggcgtccgcatggacgaggaggccggggtgtgccacctcagctgcgagatggaggtgggaataacgcaggggaatgcatgcatcatatcctgatgcgcccaggtcgtgtgtcctggtgtgccgtcgtggcaccagctgagagcatcccacctgatctgggcttgcataacccctgcccccctcccttccacccctgtgcagctggctgggcagaacgagacctgcacctccatgctgacggtgccagccacctacctggacagcgcctgcatccagcccatcggcatcctactggcgcacgggctggaggccggcgactgggactcgcccctcatgcgcggcctggtcaaccgcttcgctggcgcgggccacatcgtgatgcggtaccactgccgccagaaagaggcacggcgccagcggatcctggagcgcgctctggaaagcgcggcgctgtcgcccctggccctggccaccgtgcagcagtgggtggtggtgggcttcgacaacggcgcgcgcgtcgccgcctcggtggccgccaagacgcgcatcaggatcgggggctatgtcgcgctgtcttacccgctgctggtgcgacgactcggggggcgattgcagagggaagggagacaggcggctgtatgtgtggtccctcgatgccgatcagcttcaggttcgatagcacctcttccctcacatgccaggaactccagaccccacatgccagcctgtgcccgtttgctgcgcccaccgagcacttccccctttcctcatctcaggagcccgcaccgccgccgcccaaggctcgggcaggcgcccccccgcccagcgactcggagggtcccctgatccggctggcggaggcgctgagcccgcccatgctcttcgtggtgggcggacgcgacgcgcggtgccccccggagcgactgggagcgctgtttgcccccggcggaccggccgcggggacggacgcccgggctgtggtgctccagggtctgggccccagtctcgagtcggggggcgcggagggcgctgacggcgtgcagcgggtggtgagggccgtcgcggagttcgtcgctgcgctggagcgaggcggggaggccggcgaggcggccaccatcaaggggtgcggcctgccgccagccgccagcctggcgcccagcaggccgccggcgggggcgtccatgcttggggtgacgacgcaacccccggcatcatggggctccacccccgcaccccccctggggatggtcttgcagcacccaggactggggggagcattatag

SEQ ID NO: 3411 - DNA, 516 bp, Chlorella protothecoides
atggtagaatcgcggcgacgggtctccataggcgatccgggggccgggagaagtcctttctggggaggaacaggaaccagctacggtaagcgggaggtgtggatccctggggagggctggagccctcgagccgccgctgctcgcccggccgggcaagcctgtcgaggccggtgctgccccggttcctggctgcggacacgggagtcggggcaggccatgcccagcattccgtgcaaacgaggtatgaggcaggaggttcgtgcccgtcgctcacgtccccggcccccctgccccctcccacagatgggtcgcgttatcaggggccagcgtaagggtgcgggctctgtcttcaagtcccacaacacccaccgcaagggtgccgcgaagctgcgcaccttggacgcgtccgagcgccatggatacgtcaagggcgtggtgaccgaggtcatccacgactccggccgtggcgcgccactcgccagggtgcgccgaggggggggagaagggtatggttga

SEQ ID NO: 3412 - DNA, 1026 bp, Chlorella protothecoides
atgctgcccgacgacaggtacaacctgaagcgcaaggtggcaggactgccacctgtgacgcgggaatggtacgatgcccgcaagtctcagctgctggggtcgctggacacgagcgtcaagcgcacatggcaagaccctctgaccggcaagaagtttggcagcgagaacacatacgaggccttcactcgatcaccgcacaccggcgccctaaaagaagacctcccccccctctcctccgcccatgccgccaggtccaagaagtaccgggacctcctgagcaagctggaaggccccgcacccagcgccatcatcaccatccagcggactggcccggccggcgcggatgccgctgcggcttcaggcccccctgcaaccccacaacgagtgctggggcatgtgagcaagcccatcggcaagccagcacccgcagcgaccgaggaggatgaggagggctccgtctctgacatgtctgacgactgggagacggaggatgatgcgtccgaggcaggggagggcgcccagcaacccgaggactgggaggagtggaacgtgtgccagtccctcttcgacggccacgtgtctgcctcgctggaggagaacctcaagtacatgtacctcaactttggcttctacttccccgacaccgagttcctggtggaccccgagggcctcatgagatacctgggactggtgctggagattgcatgccacaccaggagcattcagggcctcatgccaagacccgaatccctactggctcacgcagggtgccaagctgcagtatggcggggttccgctgtacaagtctggggaggatccggaggccaagcagttcaggtccctgcatgccgtgcgggtgagtctgcttgggtaggggggcagggcgggtgcattgtgatgggcgtggttggtgcctttgctctcagaacacggtttgacagggtttggggccatccacgctgtccaggcttctgcccaacactggcgctgatgagatgggcaaggccttgccctcagttaccctga

SEQ ID NO: 3413 - DNA, 1899 bp, Chlorella protothecoides
atgcgggctctgcgtccacagccaggccgcgtgcagcgcaccgcacctcaggcaggtgggcaaggccacgcagaagagctcccgcccctgtcatcctcagcccaatcccacccaccccacccgccgacacccctccctgccccagctcaccccagccacaaagcggttgagccggcccgtggagatgcgcaggttccagaggcgatacacttcgtgcaccgccggcagcaggcctgccacatcggcgcgcagcgccgacatgggcagcaggcgcacgctggcgccggcggggaggccgcggcccagcacacccgccctcgcctcccgccccagcgcgtccatcttgttggcggcgatgagcagcgcgcggccgtgcaggataacgtcgttggccagcatcagctcgcggtgtgtcagcccctcgccatgctccgacaccctgcagggggccaaggggggtgggggaaagaatgcttgcatttgcttgacaaaggcaacagggtcgcgctgacgctgggaccactgggacggatacatccgcaccgccgcctgactcagcgtggcgttcgtgccccatcccttgcccggcctcatgaacacggctgtgccagtacagctaaagtccctcctcctccacactgggcacctgacgccgtccacgaccaggaccacgacctgcgcgctgtgcatggccgccgcgctgtctgccagggagcgctgagtcagtacaccgccggcgtcagggtcatgcgcgtcgaggcgcgtgcgccgccccccccccgccgtgtccaccagctccaggatttgaccctggggtgggaggcggcggcggcgggggttgggggcagtgttgggaagagaccgcgtccggctggtgggatgctcctcgctccgcgtcctctagggcaccacacacccagcccctggccatcatccagtgatccccggctccggccccgtcaggcatcgctcgctggcgagcagggcgttgcagagcgtggacttgcccacattgggcaggcccaccaccgccatgcgcagcagcggagaggcctgcgagccgggggactgggctttggtcgcgctgtctctttcagtcgtgcgctccgctgctgcgtcaccgccttcagcggccggcgccgcgtcgtcgggcgcctgcataccctccgctgcgagccccggcggcccggagccctccgcgccgcccacaccagctccctccgcgccgcccatgccagctccctccgcgctgtccacgtcggctccctccgcgccgcgaacgccggctccctccgcgccgccaacgccggctccctccgcgccgccaacgccaggtccgcccgcgctgcccacgactccccatgccgccccccgcacggcatccagcaggggctgcaggcctgcatacaggtcggccatgccctcccccgcctcggccgccacggcgacggcggggccgaaacccaggcgcgggctctccgccagccccgccgcactagtctcgcgccgctcgcacttgttggccaccagcaggacgcggcggcgcagccagcgcgccagctccacatccccgggcagcacccccgcccgtccatccatgagcaggagcgtgacgtcggcgcgcgccagcacgcctgccgtcagcgccgccgcgcgtgcctggatggaacgcggcgcgcgcgcgcccagctccggctccatgcccgaggtgtccaccaccgtgaagcgcaggtccgcaaggctggcgggcgcctcgcgccagtcgcgcgtcacgtggccgtccggggtgttctgcaccagggccatgcgccgcccggccaggcggttgaacagcgcggacttgcccacattggggcggcccacgatcgccacctttgcatgggcaagagggggggttga

SEQ ID NO: 3414 - DNA, 1269 bp, Chlorella protothecoides
atgcccgccaaggctgattgggtcggggtcacggaacgggtgtcgtgggcatgctccgacatcgcgggcgctgcttccaacgggacgacgacgcggggtcctcacgatgcaaggacgtgttatcaactcgcatgcaggggagctcgcgatctgtcgattgtacaccgcatgctgccacggcatgctgtggtccctcagcacgtcggcatatcatctgtacctggccccctttgtgtgtggagtctaatgtcgtgggactacaggtacacgtcagacgacgcggttgacgccgcgcacggagttgcagatcttggtggagacgtagcgcaggaagtcgggctggaaggggaaccagtccgcggtcatgccgtcgctggaggtgacggcgcgcagcgccacgacatgggagtgggtgcgctgatccccctgcactcccacgctgcggatgggcaggaacacggcaaaggcctgccagatgtcgtcgtacaggccccactcccggatggcgttcacgtacacctcgtccacctcccgcagcgtggccagcgcgtcgccggcggtgacgtcgcccagcacgcgcaccgccaggccgggccccgggaaggggtgccgcgcgatgaagcgctcgggcacctccagcaggcgccccagcgcacgcacctcgtccttgaacagctcgcgcagcggctcgatgagtgtgaagcgcaggtcctccggcagcccgcccacgttgtggtggctcttgatggtgtggctgtgcttctgcccgctgccggggggcggacagctctcgatcacgtcggggtacagcgtgccctgcaccaggaagcgcggcgcgtggcccaggctcgcctccagccccgtcgcgtattcctggaaggtgtcgatgaactccttgccgatggctttgcgcttggcctccgggtcggtgacccccgccagccgggccagcatgcgctccgacacgtcgatcttggtgacggggaggtgcaggtgctcgcggaaggtgtccatcacccgctccgcctcggcgtagcgcagcaggccgttgtccacgaagacgcagtgcaggcggtcgcccagcacgcggtgcacaagggtggccgccaccgtggagtccacgccgccggagagcgcgcagatgacgtggtcggtggggcccaccgccgcggtcaccttggccatctcctcctgcagtacgtcggccatgttccagtcgccctccagccccgcgacctcaaacagcaggtgcctgatttaattttttga

SEQ ID NO: 3415 - DNA, 459 bp, Chlorella protothecoides
atggtggacagcggtcgatgcaccatgctgtatgatgggaacgaggacgagtatgccgacttctatgattacacgggcgatgacggcgaggctgtcagcgctggaggcgagttctgggtcctggcgctggccggcgaggacggcgcggccgcagccaccggcttcgagctgggcgtcccactgcagtccggcggcacgcggtacctcggcacgcgcgagttcgccaggtactacaagcagcggcaccgccacgaccgccgtgccgcgctcacggccgctgcgcgggtgctggcgcagtaccgccgcatggagctgcccatgctggccttccgggccccggagcaggtggagaagcggcgtgccaccaaggtccagaacaagcactgggcacgggagcggctttccctgggcatggcgcgcaacatcaacgacaagctgcccaagaacgtaccctactga

SEQ ID NO: 3416 - DNA, 246 bp, Chlorella protothecoides
atggttgaccgcgtcacggcaaaatcccgtgggtttggattcgttacctttgcggaggaggacgacatgaaggcagccatcgagtccttacactcccacgagatcgagggccgacgcatctccgtgaccaaggctgtgccggaggccaaaacggcccctggcacgccggcgggggctctcaggaatgggggacctctcaggaatggggagtaccgaccacgcgacgaccgaaggtgggactcttga

SEQ ID NO: 3417 - DNA, 543 bp, Chlorella protothecoides
atgaacagcggcgagccgagggtggataaagggggtgaggttggaagtgtcctcggaagcggacccggtcccctcccccggcccccaacccccccacatgcccaccttaatcttcttgaacaggtttgggatgttctcgtcgtcaaagggcagggagccgcagaggagggcgtagaggatgacgccgcagctccacacgtccacctctggacccgcgtagagcctgccggagatgacctccggcgcggcgtagttgggcgagccgcaggaggtcttgaggaagtggccgtcgcgcatgacgttgctcagcccaaagtccgcgatcttcacgttcatgcgcgagtccagcagcaggttctcgggcttcaggtcgcggtggaccaccatgttgcggtggcagtactccaccccagacacgatctgctggaagaagcgtcgcgcctcgtcctccatcagccgccccttctccacgatgtagtcgaagagctccccagactgttgttgtgttggaataggaggggtcatggcgatggagatgggtga

SEQ ID NO: 3418 - DNA, 699 bp, Chlorella protothecoides
atgcaggatgccatcaaggaggtgaacccccgcatgatcatcctgtcaggcggccccaactctgtgcatgccgagggggcccctctgcttccccccgaattctacacctactgccagtcatctggcattccactgctgggcatctgctatggcatgcaggtcagcccggggctgactgatgggtggctatgttcaatcttgaagcgggtgacagggtgtccacgccggcgctcccccccagcccaccaacttccattcaatccccgctccacccttcagttgctggtgcaccagctgggaggtgtggtgcagaccgtcatggacagcggcgagtacggccgcatgcccatcaatgttgagcgtgactccgtgctgtacgcgggcgaggaggccgaccggcagctggtgtggatgagccacggcgactcggccaccgccctcccggaaggcttccgcgccgttgccaagagcgagcaggtgcccagatgcgcagcagctcaggccttcctccctccctccccatcgccgcagggcgcgtgcgtcgccatcgaggacccatcccgcaagttcttcggcctgcagtaccaccctgaggtggtccactccgagcgcggctccgccatgatcaagtggggcagcggctctgtttgttggggcacatgtgtgtgggatcttgtcgaggcaggcctcggcctgtga

SEQ ID NO: 3419 - DNA, 822 bp, Chlorella protothecoides
atgcgcctactccttgtccaccttgagcagggttccgcggatgcgccccgtccggcgggcggcgatgaggcccaccttctggccgggcggcgcgtcgcggcgcgtggtggaggcgtgcccaatgtgctggtggttaccaccaccgtgggggtgctccacggggttcatggccacaccacgcaccttgggccaggagttgcgcttcacgcggtacttgtggtaggcgcgccccgccttgagcaggggcttctcggtccgcccaccgccggcgacctggccgatggtggcgcggcaaccggaggggatgaccttcttgaggccggagggcagcttgatgcgcgtgatttgggcgtcggggttgtgcgccacgatgatggcgtagtcgccggaggcgcgcgccatcgcgccgcggtcgcccaccttctcctccacgttgcagatgacggtaccctcgggcagctcgcccacgggcttcacgttgccgatgttcagggtcgccttctggccgcagtagatgtactggccggtgtggatgccctccgccgcgatgaacagctgcttgtcgtgcatgtagcggacggtgtcgcggaaggtcacctggggggattgggaccggggccgggaggtgagtgggcggcacaggaccaggcgaggcccagaaggggccgggggccgggaggggagctcggccgggccgggaggtcagcgacggcagcctggcctcgggcagaggtcttatcccagtgggagaaaccctcccaggagctagctccagccacgcagaagggccaccaaaaagaccccgcattcgagtgtacttga

SEQ ID NO: 3420 - DNA, 519 bp, Chlorella protothecoides
atgtacgagcctcgccccgtctacaatgatcgctcgatctatgagcctcgccccgtctacgatgaccgcccagtgtacgagcctcgccccgtctacgatgatcgcccgatctacgagccccgccccgtctacgatgatcgcccagtgtatgagcctcgcccctactacgcacgcgattatagcgcgccggtgtatgatgcgccagcgtatgatgcgccggcatatgatccggtggcataccagccgacggcgtatcagccagcgccatacgagcctcgcggcggggcggaggcccatgcgccgaggggtgccggagcttacgagccgcgcggcggctacaggccgcgggaggaggaagacctctatgagcctcgcgggcggtatgaatcagcaccccaggagtacagcgccgaggcctacaaggcgtcctccgaggaccgctcttcccgcgggtacggccgggagcgaggccatgagcggccccttcgcgcgtcgggaccctacgaccgggcgcgatga

SEQ ID NO: 3421 - DNA, 1959 bp, Chlorella protothecoides
  modified_base (124)..(133): a, c, t, g, unknown or other
  modified_base (347)..(356): a, c, t, g, unknown or other
  modified_base (1684)..(1693): a, c, t, g, unknown or other
atggcagtacaccgctcccatgaacagtatggacttgagacgggtggtatctgggtctgtcttgcctggctcgtgtcgtccagcgttgctggcagacacctctgcggctccaaactccaacttnnnnnnnnnncatcgtgcagtgttgctggcagacaaatggggatgggagcagttcatgacatctcccacatgcctcctcccgatacgcaaaagcccctcccccttcaccgtgcagcctctgcggctccaaactccaactttttcaagggcgtgcagtggtcgccggacggcaccttcctcctgacctgcaacgacgatgctgtgctgcgccccggcaagctgtnnnnnnnnnngtgcaacgatgacgctgtagccaagtctcacgccaaccacgatcctgtccgtacgccccttgaatctccctctacctactggcagactgcgtgtgttcagcaacgtgctggactgcgtgtgttcagcgacgtgctgggtactggccccgacttgggcgaggccccccccccgcccctcggcatccctggcggcgaggcggtgtacgactacgcgtggttccccgggacggccgcgggcgaccccgcctcctgctgcttcgccagcaccgggcgcggccacccggtgcacctgtgggatgcgtgctccggcgccctgcgctgctcctacgtcatccacgacgcggccgacgcgcccactgccgcccgctcgctgtcctttgcccccgacggcggccagctggcggcggggctggaccgcgggatccacctcttcgacaccgcccggcccggccacgccagccgtcgcctgcccacccacgcccgcggtggcgagggccagcccggcatcgtggctgcgctggcacacagcccctttgaccccggctggctggccgcggggaccacgggcggagctgccgggctgtacgacacgcgcgcgccggaggcgctgtgcctgctgcagggctgcgcgggcgccggggtcaatgcgctgcgctggtcggccgacgggaacttcctgtacgtgggcagccgcgggcggggcggcggcgtcgcctgctgggacgtgcgcggcggcgccgtgccctacttcatccctcgtgctccggcgggcgcggcgccgcaccagcgcatgcagttcgacgtcgagccggcggggcgccacctggcggccggcggctgtgacggcgcggtgcgctggtacgacctgcgcgacgggtcgcaggccgacgcctgcttcgtggcgggggacaccatcaacggcgtcagcatccaccccgcgctccccctgctggcaactgcctcggggcaccgccgcttccccctctgccccagctccagctcgtccgaggaggagggggaggggggcgacgaacctgggccggccagcgataggtccctggatctagcagaggcccctgcgctgggcctaggagagcaaggaggtcagagggagcgcagtccactgggcctcgctcggtgctcacagggggacgaccccgcgcacggctgcaacgtgctcagggtgtggctgctggattcgcagccgtttgacctgtactccgagcggtcagggagcgagcatggagaggcaaagatatgtgacgagggcgcaaccaagtcgcgcgcacacaagcccctcaagtccttgatcaagcgtcagctggacnnnnnnnnnntgtgctcagggtgtggctgctggagtcgcagccgtttgacctgtactccgagcgatctgggagcgagcatggagaggcaaagatgtaatgtagtgactgccggtgaagggtggtcttgctgcctagatattccaagtggccggggatctctcagatgtgacgagggcgcaaccatgtcgcgcgcacacaagcctctcaagtccttgatcaagcgtcagctggactcgatctggcgagctgattatccatttaagaatattcattga

SEQ ID NO: 3422 - DNA, 435 bp, Chlorella protothecoides
atggcgctcgtggagcctggcaccctgctgaacagggctcggcttggggtgctgcaatccggtcagggggccccaggaggtgtgtctttgccacatctctccttgctacccccttttctcgccggcccccggccccaccaacctcgcccagcccctcaaccctcctccaactcgccccgccagggtttcctgtatgtgctgaatgcggtgaccgggggagcattggagggttggcccgtgcagatgggtcccatccttggagcggtcgtggcggacgacatcaacgacgacggcaagctggagctggtggcgacagacaccctgggcaacgtcgccgcctttgatgggactgggaaggaggtgtgggagcgccaccttgagtctgccatcagccaggtgggcagggatggcagggaggttcaggggggtggctga

SEQ ID NO: 3423 - DNA, 792 bp, Chlorella protothecoides
atggcccccatcctgctggtccccctggccgcctcgccctcccccactcacctccacctcgtggtgctcgcccacgacggcttcctgtacgccctgcacggtgccgacggctgcgtggaggccctggacctgggcgaggtcgggtatgcgcaggcgctggccgacgacctcgacggcgacggccggctggagctgctggtggcctccatgggcggcgacctgtatgcggtggcaacgcccgccccagcacacccgctgcgcgcctggacggccgcggcgcagggcctcaacgggcacaccgcgcgctggggccggcgcggggtgtgggcctcggccgacgcccgcgcgccgcgcgacgtgcgcggccgcacgctccccatccgcttcacgctgctggacggcggcgcggcggcgagggggaggggggcggcggcgggggggagcaatgcatcgtggcctgtgcctggccccgggccctggcgggtggcggccacgctgaccaacacccccctcgcccacatggcggctgccgaggcgccggtgatcggcgcagccgacacggtggccgcgggcgggcgctacgcgctggaggtgccctgccccgtcgcccgcaccaccgccacggtgcgcctggaggcgcgggacagatttggcctgctcacgtgcgacgagttcagcctctccttccacatgcactactacaagctgctcaagtggctggtcagtctgcccctggccttcaccctcgccgctgtcgtgctcatggggcgccagctggagctgcctatgtga

SEQ ID NO: 3424 - DNA, 1164 bp, Chlorella protothecoides
atgatcacccgctggctgtgggtggtggccttgttccctgctgcactggcgcaggtcgtcggatccacggtgcacctggatgccgacaggatcgccggtaacaagttcttgcagcgtagcgccaccaaggactctgtcgtgcactctcaacagccacctgggctggatgtcgaaaaggactgccctgccccatggtccccagcccgccccgcccgcccacacccacccctcccgccaccacaccacagggacgaagtgccctactccacctgcagccacgacctggccatcaagtggcatgcgagggcagggtcggcggtgtacgctacccccctcatcactgacctgcatagcgatgggcggcgggacatcattgtccccgcctttgtgaacagcctggaggtggtggaggggcgggggggcgccaagcaggcggacttcgaggccttccacgagtccaccctgcacacctcccccctgctcttcgacgccgactttgatggcgtccaggacatagtggtggcgacctacggcggggagattctcttcttcaaggacaatgctctcgatgctgatgtccgccctcctcaccccgatatcaccttggcccggcagggcgaggaagccagcaggcgcctggtcatcccgcccctggaggttcggcggggctggttcgagggcctggcgctggaccacgtggatcacacccggcccgacgtaacgggcgcggagcagcagaccggcgggcagggcgctggacgccggctcctgtcccagagcgagggcggcgaggcggtgcctgtgctggaaagcacggcaggacagcagacggtgcaggagcgggtgccgggtgatgcggcgccgcgcccggaacccgaccaggttgcgcctagggggagagccacgaggttgctggcagaggaggcaggcggcgcgggggcggtgggcggccaaggcctcgcagttggtgccgcaaccccgcctggtggccagaatgccacaggcagctttggcacaatcggcagcgtggccgccttcctgtgctcgccgctggcatcggcggtgacggggcacgtaatgtacgtcgacaacggcctcaacaccatgggcctggccctggactccaaggtgctggagcgcgagcccgtggacgccagcgcctga

SEQ ID NO: 3425 - DNA, 873 bp, Chlorella protothecoides
  modified_base (767)..(776): a, c, t, g, unknown or other
atgcggtcctcatcaccctctagcagaaccccggcaacccacacaccacattcttgtggggctattcaaagcccggagcacaccactactttcctcctttcctccctctttcccccctcgaagaacacatgtacaccaatcagcccacctggcgacgttgacgccatagctggcggggcaggcccccggcacgagcttgtagaggaaggtgacgtggtcgccgccgtcgccgtccacgcggcaggccatgtggcacaccgccaccggcagcgccacctgtgcgtgctccgccacggcgtggtagtgcgtggcgaacaggccgcggcagcgcaggtcgcttgccaggtgctccagcaccgcgccggcgatggcggcgccatcgctggttgccgtgccacggcccagctcgtccagggccaccaggctgtgccgggtggcacgcgccagcgcggccgaggtctctgccatctccacgaagaaggtggactggcccaggagcaagcggtcgcgcgcgcccatgcgcacgaacagcgagtcggcaggggtcaggcgcaggctcgccgcagggacccaggcccccacctgggccagcaccaccgccaggcagatctggcgcatcagcgtcgacttgccgcccatgttggggcctgggcgtgcgtgggttgtgtgaggggtggggggagtgagggggatgggaggcgagggggcggggaggtgatgggtcgaggggttcctggcgcccagtgtgggtcatggagaggccgcannnnnnnnnngagggggatgggaggcgagggggggggaggtgatgggtcgaggggctcctggcgccccgtgtgggtcatggagaggccgccaacgggcctgggatga

SEQ ID NO: 3426 - DNA, 669 bp, Chlorella protothecoides
  modified_base (19)..(28): a, c, t, g, unknown or other
atgtccaagttcatggatnnnnnnnnnngacctgggcggcggcacagccgagtctgccatgtttgtggcgatgactgctcagaaccctggcaaagtgtacagaaaggtagacttcacattccaccccacacaacaccttgcctggcgcaggaaaacgtggcgctgatgtccaagttcatggatctgaagaggttcagccacatctatgtggtggatctgtgttcctccctgtgcagacaggtgggggcagggcttgtgaatgtggcattccagagaccgtttcagctccaaggtacacccttgatagcgaacaaccataggtggccaacaaaattctccctgccatcccattcacaggcggagcagaaggtggctcagcatggctggaccaacgtgactgtggtggaaggtgacgcctgcacctttgttccccccggcgatgttgcaaccctcgtcaccttctcctattccctctcaagtacgtgcaggggtgggaaatggggtgaaagcgctgcccttttcaggcatcgagacatgcttttcccttgctcagctgagcgtattgttgagaacgctgatgacctctcacaattgtgcccctatcctcctgaactcgctccgcattgggaccttgtcaggactcaccgtttccttgcctcggcaccttga

SEQ ID NO: 3427 - DNA, 1281 bp, Chlorella protothecoides
atgggtaggatcgggacccctccatggcctgctccgaggtctagcccggcaaacgtccgccaatcttcgaccgcgatcctctggtgcgcccctgctcgggcttcccgcaggccacctcggcgagtgtgggagcttgaagggctcgcgcgccctcctgagcaaggaaaatccaaatcggatgggattctcctgcgcttgggcctgctcccggtgatggtcagtgtcagcatgttttcgtgcgtgacatggtctcctcgacgttcaacacccggtcgccttcccggcgggcccaaccgaacgaggatctacgtcgcatcatctgcagagcatgagcagttccaggatcccgagaaccagctacgaagatacggtgcgcgatatgggaagccctacctgctgcagtcgattgtggacacggcccctcgcgtgcgagtgcgaaaggcgcgcgacagggcacgggatcagctggcagatctcgcggctccagatccctctcccctccttcacctcattcccttgcgcccaccgcaggtgatgaacgagcggctgatgcacggcgacgacgcgcgcgcggccgccatccgccagcgcctggactacctgcgccgcaggcggctggcctgggagatggtttacgacgtggtgatcagggacgacgcgctgtgcacgctgagcgtgatcgaggaggccaacagccgcgtgcagcgcatcctcagcgaagagcaccgcgagcgggcgggggtggcctcactgcgtcgccagatggtggagctgcagggggaggttgcgagcgcacgggcgcgcctagacgccacccaggaggctctggccaggaacatggccgccatggagcgcctgagggtggaggccgaggctctgcagggcctggtagctggcgggaacctggttgaggcgggcgagccgagccaagccacacccctgctccagcatggattgggtgaagtgcagggcagcggagcgggaacacctggacggccagagccacccatcgccctgccttttacgagctccgccgccattggtttgacgagtgaggagcgggcactcgcccgaccttcctcgcatgcagcaccacccatgggtggccatgcggcagccccgcctccgcaggtcaagcggcggcgtggcctcaagtccagcctgttcctggagccagggctgaaggagcactggtatggcgtcgcgttttgcagccagctccagccggtgaggatgctgttggatgctggacacagctgcggcgcggcgatcgtaccgtag

SEQ ID NO: 3428 - DNA, 987 bp, Chlorella protothecoides
  modified_base (445)..(454): a, c, t, g, unknown or other
  modified_base (513)..(522): a, c, t, g, unknown or other
ctctccatcgccgggtcgcacgggtcgctgcgctcgctggccggcccaggccccaacccggccctgctttcctcctactccgccgccccgccagcctctgacccgtacgccagcgcgcagagccagggcggcggcgtggcgctgatccccatgcccgcgccgcgcgagcccagcgcgcccttcttcgacccgctgccggcgcggcggcacggcccgctgggccgcgccgtggtcacctgccaggtggtgctgctggtgtcggtgtggatcacgctctacatcctctccgtctggcaggcgggctggagcctggctgacctagcggtcaacccctgggcgggggccaaccctcgcgccctgctggcagtcggcgcgcagtctcacggctacgtggcctcgcgtggccagggctggcgcgttctcacctccccctttgtgccggcgnnnnnnnnnnctacgtggcctcgcgtggccagggctggcgtgttctcacctccccctttgtgccggcannnnnnnnnngggggggggggggtgggtggggggggggggtccccggcaacccatcacacatgcacaccaccctccaccccatacacacccacccgcaggcatcatccagctggtgccaaacgtcatgctgctctccacctttgtgcggtacctggagcggacgctgccgctgccccccgtaaccatccccgccatcttcctggtggggtcctggtgcggggcggtgacggatgccaacctgaacgtctactacgtgtccagcggcgcctcggccggggtcgctgccctgcttggtgtgtggaaggggggggtggagtggtgataggaaaggggcgcgcgatggggggggagaattcttcgcattggtcatgtgtgttgggggaatcgctgcaagtcgcatatcccttggcctatggggaggcaaggggtgacgtggactgcctccgccaggacaagaaaggaatgcctgtttga

SEQ ID NO: 3429 - DNA, 1200 bp, Chlorella protothecoides
atgtgggagctgcgccgccaggatggtggggacgtggcgtgcgtgcctgctggcaaccctgcaagcacatcgcgcagtccaggtgagagtagaggcatgcaggagtgcacggcctcgcttccactttacgcgttggcccccttgatacctcacgatgcctccctttccacccactggccaggtggcgtgccgtgcactgaggtggacggcttcgtgtgggtctggcccgggtcgcaggcgcccaccccgccgcccaccgcctcggccgttccgctgggcttccgctgccatgctgagatcgaggtggaggtgccggtggagcacggcctgctgctggagaacctgctggacctggcgcatgcccccttcacccacaccagcacctttgccaaggggtggccgatcccagacgtggtcaagttccaggccaccaagctgctaacgggcaactggcagccctaccccatcaccatgtccttcgccccgccaaacatggtggtgtcgctcatcggcttatcgcgcccaggcgtggtggaaagggtgagtgatgttggggcgactgcagctggaggatggccttggaggctggggttgctgagtcgcgcctcctctcctttcggtgttgggctggggcttgccgtgcaagtacgccgcatgcgctcgactcctatcccccctccctcatcgataggcaactctttcctcaccctcatgcgcgaccatgtcccgcgtcgattccctcgcccaagaagcacccctgccccctcaccactccagggtctgagcgcggagtcgtgcaagcgccacctgcaccagctccacgtctgcctgcccagccgccccggccacactcgcctgctgtaccgcatgagcatggactttgctgggtggttgcgcttcgtacccggcatcgctgccttctggcgcagcatcgccgggcaggtgctgggcgaggacctggtgctggtccgcggccagcaggaccgcatgctgcgaggggctgacacctggcagacgccggtgtcgtacgacaagctggcggtgcggtaccggcgctggcgcaaccggttggagggcggggagctggacagggaggtggtggcgcaggccgcggcggcgctggccatgtcggctggggagatgtttgcgctgtcggaggagaggtgcggggacgacaacggcacctgcgtcgcggagtga

SEQ ID NO: 3430 - DNA, 519 bp, Chlorella protothecoides
atggtccttcctaacttccctccgcaaacttccgttccatatctgcaggtggaggcccccccctgcttccctcccaccttcctgtatacccagtcctgggaggaccctgcggtggacgagcccatcctggacatccagcccgacgacgtctgcctcaccctcacctccggcggctgcaacacactgcacctgtgcctggccggcgccgcccaggtgcactctgtggactgcaaccccgcgcagtcggcgctgctggagctcaaggccctggccatccgtcgactgggctacgacgacgtgtggagcctctttggagagggacgccacgccgacttcccgcgcctgtatgagcgcgagctgagccccttcctgacgcagacttcgcatgcgttctggcgcgaccgcctgcactacttcaggcagggcctctactaccagggcggcatggtgagtgggagttttttgggggtggagaattggtttaacgaggagaggaggggggcagggggaggtcaataa

SEQ ID NO: 3431 - DNA, 1074 bp, Chlorella protothecoides
atgattgcatgcaccctaaccctcgtggttgcaggcctgcagacctccacggccgaggtggaggcggagctcatggcgctttggtccgccgtcgagaaggaaaggacggaggtgacggcgcggcgggagcggcacgctgccgctcgcgagacgcgggccgcccccattgcacaggtcgatgtcgaggcggaggccggctcttcgcccagccactccaagtggctgccgctgcagggggctgacccggcagaggtggatctgggccacaccaagctcctgcaggagggccaagagagcagcagcttcgtgtctccgacggaggacctgcggtgcgagcaggctgccctcaaccccagtaccgccatcgaggtggacgagggcagcctggtggtcgacgcagacgggcagccgccgggcttcctacgcgtctctgccgacatgtttctggatgtgtggctcctgcccaggtcgggtcaggggcgtggggaggagaggggggaatgccagggctgggcgcctgccacccctcacggccgcactccagcatgccccgtgccgcacactgccagggcgctgccagagggccaggagagcagcagcttcgtgtctccgacagaggacctgcggcgcgagcaggctgccctcaaccccagcaccgccatcgaggtggccgagggcagcctgcactgcactccacctttccctccttcccaacaccttcccatcaccgacaggggcccagaccgccgcgccttccacctcgcgctgtgcctcgccttcttcaaccaggccgtggcgtccaccgccatcatcaactacgcgccctccctgctcgccagcgcgggcctggcacccgcccgcgccaccctcgcctcggccgccgtgtcggcgtgcaagctggtgggtgtggtggtgggcctggtgctggtggaccgggccggccggcgccggctgctgctcacgggctccgtgctgtgcacgctgtcgctcgcctggctggcggtggcggacgcggtcggcagcgtcggactgctgctggcgggcatgtgcctcttcgtgctcagccacaggtga

SEQ ID NO: 3432 - DNA, 549 bp, Chlorella protothecoides
atggcggccaagagcccggcgacgtcggccgccaccgccaccctctttgcgactggggccgccagcgacgcgctcttcctctccttgcgtgactggctggggccgggtgcctttgcaatgtacgcctgcatcgcggcggctgggggggtgtatgtcatggccaaggtgcctgagacatccggcaagaccttggaggagatccaggcgctgctggcggggggccggcgcgacctggagctcaccgctgggacggggctggcggcatgggcgggcgagaccgatgtggtctgcagggacccccccggcgtcgtcccggtggatccggtggcaggtgggggcggcggcgggctggccaccccctcacccgccagggtcgtgctggtgggcgaggacggcgagggggaggcactgccgtttgaggcggagcacagggaggagcacaaggaccctgcctgcacgctgctcagcccttccacatcaacgtcctcgtcggccagagagatttgcaggccctacgtgtcgtgcgtgcgtgtgggagggggagcgtga

SEQ ID NO: 3433 - DNA, 495 bp, Chlorella protothecoides
atggagactctcctgccctgtgtggatgacctgggacgagaagtcgaagcccctggccggccacagtataatgtgctggcaatgcaccagccccagccctccattgcgcgtgagggccctctctccaaagctcaatattccgcttccctcgctggctcctcgcagggcgccgtcgtgtggatggcgcagtggctgttctgggcgctgggcctgggtggtggcatgaagcgcctggtctccgctcccacactggaggaccaagtcaaggtctgggaaggcctctgggttgtgcgcttcctggtctatgccccggtctggctttcctccctgttcgtccagttctttgcggccctgctcttcaaccgtgccgccctcatccgcaaggacggcgtgcggctgagcacatacgcggcccgcgtcttcgacggcgtggtgcgagggtacagcctgagggacgacaattgcttctactacaactgcctcgcgggtgagtag

SEQ ID NO: 3434 - DNA, 435 bp, Chlorella protothecoides
atggctgtgcgtgggtttggagggtcggcctcacagcggcgcctgcaactcccacgtcagacctcccacggcccacctcccacgcctccccccgcagggcgctatgcgcgcaacaactgccccgcctacctgacgccgcacggctttgccaacctgaagcagggagccctggactccctgcagatccacacgggcttcttcctgcccaccctgaacaagcgcaagtacagcaaggtcatcctcatggaccacgtggactggctcagcctcccgcaggcagagctacacacgcctggaccgcaggaggtcgccgcggccctaggccggcaggtggtcaagggcggcaaggtcatctggaggtctgccgccctgtcgccgccctacgcaccgctcatcgccaaggcgggcttcaaggtcagtggcaagctgagctga

SEQ ID NO: 3435 - DNA, 684 bp, Chlorella protothecoides
atgggcggcaagtcgacgctgatgcgccagatctgcctggcggtggtgctggcccaggtgggggcctgggtccctgcggcgagcctgcgcctgacccctgccgactcgctgttcgtgcgcatgggcgcgcgcgaccgcttgctcctgggccagtccaccttcttcgtggagatggcagagacctcggccgcgctggcgcgtgccacccggcacagcctggtggccctggacgagctgggccgtggcacggcaaccagcgatggcgccgccatcgccggcgcggtgctggagcacctggcaagcgacctgcgctgccgcggcctgttcgccacgcactaccacgccgtggcggagcacgcacaggtggcgctgccggtggcggtgtgccacatggcctgccgcgtggacggcgacggcggcgaccacgtcaccttcctctacaagctcgtgccgggggcctgccccgccagctatggcgtcaacgtcgccaggctggcgggcctgccggacgccgtggtgcggcgggcaagcagcatggcggcctccctggcacagggggccaccatcgacggggaggagggggcacgggagaagctgggcagcatcctggaggcctgccggcgggggcccaaggccgtgcaggcagcatggctgtccatgcgccgcccagccatatcagtgtga

SEQ ID NO: 3436 - DNA, 306 bp, Chlorella protothecoides
atggccggagggggcaggggggcattccaggccctgtccacccctcttgccgtggacggcgccggtgctacccagcgcctgcgcctgaaccagctgctgaacacctcggggaagctcggccgtgcaaacggtaactcgctgggggcacttggactgatgtttgcggcgacagaatcctttggaaactacatgtcggatggcgtcgtgccgtccgaggtggtgacgctggctgcgggagcatcggcgggagctctgtaccgctcggagtgcatcttctgggatcactccatcatctccatgcaatga

SEQ ID NO: 3437 - DNA, 1065 bp, Chlorella protothecoides
  modified_base (27)..(85): a, c, t, g, unknown or other
  modified_base (512)..(608): a, c, t, g, unknown or other
cgtcctgcttgccgccgggcaggtggnnnnnnnnnnnnnnnnnnnnnnnnnnnnnnnnnnnnnnnnnnnnnnnnnnnnnnnnnnncgggggcggacagcgagggaggcggcggcgacggcgcgatgcctgacgccgacgcctccccgccgccgccctctgcagcacagctgtccagccccagccaggtgtacgcgaggtatgtggcggcggccacgcgcgcgcgcgccgaggcgctcaaggtccgccagcaggagatcgtgctggaggagctatgcgcggaggtggagaagcgcgcggtgctagtgcgcgaacagcaggcggagtacgagcggctgaagggcgcgtacgcaggcatgggtgcggcgctggagggcgctgaggccgaggcccgcgctgcgcgcgccgaggctgaggccctgcgcgcgcagcgccgccgcgacgcgcgcgagctgcgcggcctggagcagcagcgcgtcgacctgggcgcgcagatcgtgcgcctgctggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggccggcggcgccgcggtcggcggcggcgacgggggccagggccgtgccgagtcggcgccacccgccggcccaccgaccaccgcgtcccaggtgaccgatagcctgctgctggagttccgggacctggaggagctgcagcgcaggaacgcgcagctggtggcggtgaaccgcgagctggcgcgcgaggcggaggcgcggcgcgaggaggcacgcgccgaggtccgcgccgagtttgagggcgtgctgtccggcctgcgcgccgacctggacgcgctcaaggccgccggcgccgccgcgcgcgacctgctggagaaagtcacgcgacagcgcgacacgctgcgcgcactgctggccggcgcggacggcgacctggccgcggcgcgcgaggggtatgctgtggcgctgcgccgaggcggaggggaggggagcccggacgacgccgcggacgccacg

SEQ ID NO: 3438 - DNA, 1305 bp, Chlorella protothecoides
  modified_base (791)..(800): a, c, t, g, unknown or other
cggcgcggacctccagcaccacgccgcgcccgtcggcggcgtcgggcgggaccagggacaggagcaccgccgactccagcgcgggcagcgcggccgccagctcgtcgcgctcggccgcggccgcggcgcgcaggtcctcctcctcacccgggtcgcgggccatggcggccacctcctccagctccgcgcggcggcgcgccagacgcgccgcggcctccaccacgggctccagctccgcgatgtcgcgggccaggcgcgccatctcctggggcggcagccgcgaaaaggagggcgccagagaatcgcgcaccaacgcggcgtgccgggccgcgatctcgtccagccggccctggatggcaggggtcaggtggggggtgccgggcaggctggaggtggcgcgggtcaggaagggggggttggcccggtatgcctgccagcagtccagggccgtcttgctgtggtggggctggtcgtgccgctgacaccctgcaggcccgcactcacaggtggtgtcgcaggagaccctgcgatgcccgccggcacaccgccatggcttcaataaaggacgaaatatacacaggaagtgcattcacacaggctcgcagtctagtgttcactcgtgcaggtgtatgcttggatcgctgctcctctcctacagctcccaagtgcatcgaacgtatcacatccagggagatccacctgctcacgggcgatggccaaggccggggacaagaagcgcttggagcagaatgccgatcacatacgcaaactcaagatcattgtcattgtgnnnnnnnnnnacgggcgatggccaaggccggggacaagaaacgcttagagcagaatgccgatcacttacgcaaactcaagatcatcgtcattgttgcaaacgtggcatggctggtggtgcgcttcctccttcgcaggagcaccgtcacctggaccagttacgcagccctgggcctcacctccctggtctatgccatttgttaccctggaatcgcgactgccttgggtgaggcacttgtggttggaatgccgttcagcggctggaccaggtgtactgagaacctctgttcgtattatatggggggagtgctctcctactatcatgacctgctctacatcacagcctttgtgcagcttggaagcacaatcagcaagtgggcatggctggcctttattgcgatgatgtactatctttgcatttatagacgttggaagtgctcggctgctcatgagatgcagtctgcgtactctctctgcatctgccatgacgattctcccccatctccgtccctctga

SEQ ID NO: 3439 - DNA, 468 bp, Chlorella protothecoides
atgggtcccttcggagccatcgagcgcccctggaagcccttcaaccccatcctgggcgagacctttgagtaccacaagcccagcaccgggatcaagtaccttgtggagcaggtgtcgcaccatccccccatcggtgctggccacgcggagtcccccctctggacctacgacctggtctccgcccccaagaccaagttcctgggcaactcggtggaggtctaccccatcggccgcacccgcatccggctgaagaccaccgacgaggtcttctcgttggtgccccccacctccaaggccaacaatgtcatcctggggtccacctgggtcgacacctacggcgactacaagctgctcaacgtgaccaccggcgccagggcgcacatggtctacaaggagtgcggctggtttgggtcggggcgatacgaggcgagtgcagtggatggctggggacgggtactggttgtctag

SEQ ID NO: 3440 - DNA, 369 bp, Chlorella protothecoides
atgaccccactgcgacgcatcccctgtccgggagtgcatgccagcaagcactcccctcgcaggaggggcgctctgactgcaccagccccttcagcctccaccctgcgctgcaccgcctcacaggaccgcaagcaagcctttaagtcgtacaaggactacctggggaaggacatcaccagcctggtcatcctgccggtctggatcatgcagcccttcaccatgctccagaacatggccgagatcatggagtacaccgaggcccttgacaaggcagccgtcaccgaggacccctacgagagggaagatatgcctcatcctagactttgcaagcgtgacgttgcaccaacgtacgatacgccagcactgtaa

SEQ ID NO: 3441 - DNA, 1088 bp, Chlorella protothecoides
atgtgcatcctggacggcaaccagtacgacgccaagtgcgtggacgcgggggaagagcgcggcgacgacctggaggcctgcgcgctgctgctgaacaacaaggcgcagccgctgctgctggcgggggccgggggcagccactccgcctcctcgcgggtgctggtgccgctgacgcgcggcgcggcggtgctccccgacctccacgtctccgactccagcgaggcgatgctgagcgggcgcaagccgcccttccgcctgctggtgcgtgcctctgggggcgtggtgcccggcgtggtggtccgccacgcggtcagcgagggcttcgtggtggccacgcgccgcacgcgcacggcgggcaaggtggagatccccaacgtggacgaccacgtgtccaagctggagcacatgggcaaggagacggtgaagaagctgcaggacgtgcgcgggtcggggcacgcggcgggcatagacatcgccgtccccgacaatgccatcaacaaggtgggcgagttccggcgcctggccctgctggcggaggcggacgggcacctgcggcagaagctgcagcaggtgctcaagctgagcaaggagaagtgggaggaggcgcgcgaccacgccatgaaggcggtggtggccgacaaccgcatgcgcatctggtacgcggacaaggccaacatggaggtgggcctgctcttcacctgccgcctgggcaacgtggacctggaccggcccgtgggcctgctgaccaagaaggcgcaggacggcgcgcagaccaccatggacgcgacgctcatggcgcagcagacgcccagccagcgcgaccaggtgcgcgcgctgcagcctgccgccgtggccgcctggtggcagggcgggcacccgggctgggccatctaccccgtggacagcgagcagttcctggccacgggcgcgctggactccgtggccctgccacccaccgaccacatcgtggcgcccacgctgcctggcggtggcgccgccggcggcgccgcgccgggtggcccgggcggcggctacccgcccctggggccggggtacctgcccggcaacgaggcgctgctgcgcgccat

SEQ ID NO: 3442 - DNA, 2508 bp, Chlorella protothecoides
  modified_base (86)..(95): a, c, t, g, unknown or other
  modified_base (171)..(180): a, c, t, g, unknown or other
  modified_base (1183)..(1192): a, c, t, g, unknown or other
  modified_base (1598)..(1607): a, c, t, g, unknown or other
  modified_base (2198)..(2207): a, c, t, g, unknown or other
  modified_base (2385)..(2394): a, c, t, g, unknown or other
atgcccgcaagcgtgaagagcgtgtgtatgaaagtcagggcatacgtgaagctgaatttgacgacgctgaacactgtgcaagtggnnnnnnnnnngatgaatcataccactcagccaggttacagagggctgcaaccccccgcgccgcgacccaggtgcacaggccctgcnnnnnnnnnngaggtgggggaaagaaggcttgcttgggcgtcctggggagttggcaggtggggtgcgggaatgcagggaggccctgtgcgtgccgcgactttggcgggccattggtggcagcctctggtcgcgggcatgaagggcggggcccccttccttgcggcgaggggtacaagtcggggggcgcgttggggtgcaggccgcggttccgaacatcatgcgtctgaatggctatttggagaggaccgggatattcagggagattcaagtggagggcactaccaaaggtttaaaacattcccttgtcttgcactgctcacacacttgggcagcatgtcagttgtgttgggagtgcttttcatgagggttgagcctcagccaggtcacctgactcccaagtatcagttacacatcatcacttgcattatcgacttttctgaaggcttatgtgctgcattctgcccttcaggtcacctcctgcaccttggcatctcctgcaccttgtacagtgtcctcactgcgcgctacatcccacctgaacaaattgacactttccccattctttctagtctcagcgctgcttgttgggcgcgcgcgcatgaaactgcttggatacatgagcacagcagtttcgagggggagcatactactctagggcgcgcgcgcatgaaactgcttggatacatgggcacaggtctctcgtgtgatgagccattcgacgagaaaaatcacgtattacttgttttacttaccaaactagtggcaccagcacctggactggcggcagtacacgcgcacgagcgacgggggtggggatcggcgccctgccccaggcagcatgagcctggccagcacagccgctgtcgacaggctcgtgctccagtacctgaagcggagaaggtgaggatttggggcgatgtctcaggcagtacggcgggtctcgggatcgaacattccgccacacgcacacacccctgcccactccaggctgcacgaggcggggaaggtgctnnnnnnnnnncctcgggatcgaacattccaccacacgcacacacccctgcccgctccaggctgcacgaggcggggaaggtgctatccctggagctgcgcgccagctgcgcgccggaggacgttgagatgcaggcctggtccgaggtgaatgacggcgacgacgacggcgccctgctggaggccttggccctggacggctcggagccggccgcctacgcccgggcctacaccgcctttgccgcctgggtggacgcctccctagacctctacaaggtaccgggaggtggctcggctggggagcgccggggtgcggggccggtgggccggccagatgttggatgccgcccctcaccccatcctctgtgtttacacggaggcgcgaagccacgatgcccccctcccccctctcctccccnnnnnnnnnnctgttggatgccgcccctcacaccccatcctctgtgtttgcacggaggcgcgaaggcacgatgcccccctcccccctctcctcccccgcagcccgagctggcatgcctgctgtaccccgtgctcgtgcacgtgtccctgagcctggtggagcgcggcgcggcgagcgaggcccacgcactcctcgccgagcatggcccgcgcttcgccgcggcggggtccggccccgccgctgagcaccgcgcgcgggagctgcagagcctgcagacgctgacggggcgggagcagctggctgggaacgcagcggccgccgcctggcgcgcgcgccgcgccggcgtgcgcctgtcggcctactcccacggcctgctcctgcgcgcgctgcagaccccggcgctgcagctcatcctgggcgtcgtgaacgggcacgtgcggctggaggttgcggaggggccgcccgccggcgccgccgagctggccgccgcggaggagctgggcgcggggcgggcgggggaggaggacggcgcggcgcacaaccgcgggcccatcgacctccagctcctccaggtgggacacaggtgaccttgtggggcccnnnnnnnnnngggaggcggggtgcacggtgggcggtggggtggtcgtggctctggggccagaccttgtggggcccccttgcccgacccgcgccagccaccccggggtggaccccctgggaccagccacacgatctcacgccatcccggccgagttcgtgtgcaggggagcgtcgaggacgcgtgggcnnnnnnnnnnaggtggaccccatgggaccagccacacgctctcgctccatcccggccgagttcatgtgcaggggagcgtcgaggacgcgtgggcgcaggccaagttcgatcgcttggagcgtga

SEQ ID NO: 3443 - DNA, 495 bp, Chlorella protothecoides
  modified_base (132)..(141): a, c, t, g, unknown or other
ggagccgggcgcgggcgtgcgcgcgcacgtagagggccacggcctcgtggccgtgggcagcgctcgctgggcgctgggcgacgagggggagagcggggcaaaggagggcgtcggcgccgcgccccggggcgnnnnnnnnnnggagggccacggcctcgtggccgtcggcagcgctcgctgggcgctgggcgacggggaggagagcggggcagaggagggcgtcggcgccgcgccccggggcgtccacgccggcaacccgagcatgcgttcgtcgcactcgccggcaccgccatcacctgacacaggttcccacgccgtggtgcacgtgagcttggagggcggcgcgctgggcacgctggagctggcggacgaggtgcggcccgaggcgcgcggcgcagtggccgcgctgcgctccctcggcctggccgtgctcatggtgtccggggacggggacggcccctgcgcggccgccgccgcgcgcctgggcatcgcccc

SEQ ID NO: 3444 - DNA, 294 bp, Chlorella protothecoides
atgtctggaaaagccttacgcggtaataaattagtgtttggtgactatggattacaggctttagagtgttcatggatcacatctagacaaattgaagcagctcgacgtgctgtaacacgccaagttcgtcgtggtggtaaattatggattagattatttccagataaacccgtaacaatgagacctgcagagacacgaatgggttctgggaaaggagcgcctgaatactgggttgcggtagtaaaacctggtaaagttctttatgagttaaaaggggttccagagactagtgcc

SEQ ID NO: 3445 - DNA, 1386 bp, Chlorella protothecoides
cgcctcggccgcctccgccgcgacctggaccgcttcgagggcctggccgcgctgcccagcgtgcccagcgcgctggccgaccggtaccgcttcgacgcgccgggcgagccgacggcggacgccggcggcgcgccgctggacgacaaggccctggccaaggcacggaaggaggttgccaagcagcaaaaggtgggatggctgggtgtgtgctgtgtgtgtgggaaaggggcgtggggtacggtcatgaggtcaagggggctgccagacaggcgtggagcaggaggcgtcaggcaccgtgaccttccagaccaccctcctccacctccagatccgcaagccgctggaggacgcgctggagaagaaccccgacttcctcgagcagctgcgcgccgacattgccgccctggagctggaaggcggggcgcaaggggccgctgcggcaggaggggcggggtgacgcgaggatttgccatggaaacttggacagacggatgcatggaggagagttccacagaagtactgtccccacaggatagggaacaggtacagggtggtgccggggtgggaaaagacgagccaaaaggtgtttgtgaggtagtggggagaggatcaaccccgcagcgccgcgcgtcatgccgcggcgccctgcagctcgcgcgcggcgccgcgcgcctccacgtactcctgggtgaaggcctcggtggtctccgcccgcccgcgccacgcccccggcgtcccgcccccctcgctgctgtcgccctcggggcgccagcgctgctggcccgtggccagagccacggcgcgcatggccacgtccacgttctccaccggcccccagaaggacacgtgcttgaccccggccaggtcggcgccgtcctccacgcccatgcgcacgcgcagcacgtcctggagtgcgcggatgtgggcgcctgcgggccccagcagtgcgcccactcgccgctcggccacgggcagcatgcggaagcaggtgctggtcacggcttggatgccgggcgcgtagcgcgggtcacgcgtgaccaggtccatcacctccgccgcgccggcggccagcgcggcgggaccgggcgcggccagcgccacggcgcggaagggcacgaaggccgcgcgtggcgggcgcggctccaccgccgcatggcatccgcaccgcgcgcccagggccttgatggtctcgccgccggggcccatcaccgcccccgcgcagtgcccggggatgacgatgcgcagcgccagctcgggcgagccggggcgaggcgccaggcgctccagcgcaccggggacggcggccaggcagtccagcagcacgcgcagcgcggccgccgcgctggccacgctgggcgacgcgaagatgagcaggcgctccgtggg

SEQ ID NO: 3446 - DNA, 786 bp, Chlorella protothecoides
ttctgccggtacaacagcgcgacgacctaccccacggagcgcctgctcatcttcgcgtcgcccagcgtggccagcgcggcggccgcgctgcgcgtgctgctggactgcctggccgccgtccccggtgcgctggagcgcctggcgcctcgccccggctcgcccgagctggcgctgcgcatcgtcatccccgggcactgcgcgggggcggtgatgggccccggcggcgagaccatcaaggccctgggcgcgcggtgcggatgccatgcggcggtggagccgcgcccgccacgcgcggccttcgtgcccttccgcgccgtggcgctggccgcgcccggtcccgccgcgctggccgccggcgcggcggaggtgatggacctggtcacgcgtgacccgcgctacgcgcccggcatccaagccgtgaccagcacctgcttccgcatgctgcccgtggccgagcggcgagtgggcgcactgctggggcccgcaggcgcccacatccgcgcactccaggacgtgctgcgcgtgcgcatgggcgtggaggacggcgccgacctggccggggtcaagcacgtgtccttctgggggccggtggagaacgtggacgtggccatgcgcgccgtggctctggccacgggccagcagcgctggcgccccgagggcgacagcagcgaggggggcgggacgccgggggcgtggcgcgggcgggcggagaccaccgaggccttcacccaggagtacgtggaggcgcgcggcgccgcgcgcgagctgcagggcgccgcggcatga

SEQ ID NO: 3447 - DNA, 897 bp, Chlorella protothecoides
  modified_base (191)..(200): a, c, t, g, unknown or other
  modified_base (440)..(449): a, c, t, g, unknown or other
atgccccacccccgccccccctcgccctccatcagacccacttcgcggccaagaacaacgtgggcgacgtgtccgcgcgggaggaggtctggggcgtgggcgcccagctggtgggcctgggcgccagcgtggccctgctgcgcgccctggaaagcgcgcacgccacgcccggtgtcgtgctggcctgggtnnnnnnnnnnggaggaggtctggggcgtgggcgcccagctcgtgggcctcggcgccagcgtagccctgctgcgcgctctggaaagcgcgcacgccacgcccggtgtggtgctggcctgggccggcatccaggctgcgcacgtcacgctgcgcgccgcggccctctcccgcctggccttcccttggcccaacaggaagcgcgccgcagcgctggtcgccgcgcacatttgcgaggggcgtgtgcccgccannnnnnnnnncaggaagcgcgccgcagcgctggtcgccgcacacatccgcgcagggcgcgtgcccgccgtccgcgaggtgaatcgaggggagagcgcgctggcgctgccgccgggcgacgtcgcgctgggctgcacgctgggcgaggcgctcgcggcgggggccgggcgcgacctggcggccctctgcgcgacctactcggcagaggcctacctgctcacccgtcactcggggcggtgctgggtggtgctcaggcagcgcgcaggggcgcacgacgcgctgcgcgcgctgtggcaggcggcctggctggaggcgcacccgggggagggcgaggccgccggcctgcgggccatgcaggccgccttccctgacttccagcggcaggcggaggcgcaggggtgggtcctgggggactccctcctgggccaggggcccacacggttgcacgacgccgagtga

SEQ ID NO: 3448 - DNA, 480 bp, Chlorella protothecoides
atgcagaccggacccccctcgaggcgggcattcgccgggcatgatctccggcctgaggggcccacggcggtgcatgggcacaagctgcggttcccctccctccgcgccggtgccacctcctcccctcccaccccccaatctgctcccagcaccctcagcttcattgaggtgggcccccagcgcattcagcgcctgggcgtgggcgaggatggggaggtgagggaggtgggcgagccgggcctgggcaccggccagaaggaggcatggtcaggggagtcggcggggcccctcggcccggcccgctccttcctcgcgggtctcttccttcccaaggactggccagacagcgtcacccccgactacctggagtaccagctgtggaccctgcccacgcatgtgacgggcgtcatgtcacatgccctggccaccaccagcatgctccaggtcgggagccatgcgggtggtggcccactgccctag

SEQ ID NO: 3449 - DNA, 531 bp, Chlorella protothecoides
atgcgaggagtgttgactcctcgagcgtcggccgcttgcaatggacggatggttacggggggggagtatggcgcagggtacgcgagccggccgggcttgacagctcgacaaccattgtttggcgccccatcagaccaagtccaggtttcggttgagccctcgctggattgggacgatgagattgagcagcttagagcaggggtgggacgtttgaaacaggtgtcatctgcgattcaagaggaaaacacgctcacaaaacaagtcatggatggactagtgagctggtgctatggagagggaatgaggagaccagggtcatgtgcagatatatgccagtcagctgctgtattcatagaaagtgccatggagacatcacggcaatccctgaaacaggcatccaaaaggctaagaagagctatggtccagagtcaatccaaccatgtcctgtatgtttttcttttcgcaatcgcagtattctttgccctctacttctggaacaagctttacaagctgttgaggtggattttgtaa

SEQ ID NO: 3450 - DNA, 870 bp, Chlorella protothecoides
atggacatacagattagcaaataccaaggggaagaaggcaaagcgcaaagcgcgcgagaagcagctggaggaggcgcggcgcctggcaacgctgcagaagaagcgcgaactcaagagactcgctcaggctgcaaatcccctccctcaataccacatctccaggctgccggcattgaggtgcgggagcggacgcggcgcgggggcgccatcgactactccaaggaggtgccctttgagcggcgagccgccgccggcttcttcgacacgcgcggtgaggacctgcaaagaggagaacctgggagacctgggcagggagatgacgccggagaggtcgcactgcagcctggctgtcggggcttggctttgaatgcagggggcggctcagtcgcaggcactgtacagcaaaggcgtgcaccagccggctcgtccgcggttcccaccgtggcccacctgttccgcatgaacacctacggtgtgcgcacccctctgccgtgcgaatgtgtttccttcagtaagccaaaccctccccctggaacacccacccaggaggcgacgcggacctcggaaatgcaggaggacttccggcccatcacagtggacgagctggaggggcgcaagcgcaaggacatcgagaaggagctgatcaaggccgacctggccaaggcgcgtgtggccgagcgcgccaacgccccggcggccctggcgcgcgcgctggcggccaacgaggcctccgcgggcccggttcggcgcgggaagctcatgctccccgcgccggccgtgaccgacgaggagctggaggcgctggcgcgcggcgggtacgccgcggccgaccgcgacgctgacgtggcggcgggcggcagcgccgccacg

SEQ ID NO: 3451 - DNA, 444 bp, Chlorella protothecoides
atgaagtatggcctaaaccagtgggcccgcatctcgtcactgctcacccggaagtcggccaagcagtgcaaggccaggtggtacgagtggctggaccccgccatcaagaagacggaatggacgcgggaggaggacgagaagctgctgcacctggccaagctcatgcctacgcagtggcgcaccatagcccccatcgtgggcaggacgccggtgcagtgcctggagcgatacgagaagctcctggacatggcggctgggaaggagacgtacgaccccacggacgacccccggcgcctccgccccggcgagatcgatcctaacccggagtcaaagcctgcccgccccgaccccatcgacatggacgaggacgagaaggagatgctgtcggaggcgcgggccaggtgcgtgcttggcctctggccccacgtcgcgtgttgggaatga

SEQ ID NO: 3452 - DNA, 465 bp, Chlorella protothecoides
atgcgggtggtgccccgctgccctagtgcaccgggtgaccacctccaccccttctccctctcaacgctgaccaccgttccaccaagcccacaggccgtgggcatcgatgcggggcccgggggcgccgcgggggcctccgccgcaataaagtggatcagcaaggacggcatcggggcgctgggccgcttcgccgtcagcgcccgcttcgcctccgtgttcgacgaggacccacggcggtggcgcctggcggccgaggcggtgaccacgctgggcctggccctggagattgcgacacaggcctaccctggtgggtggggagtgaggccccgtctccccctaattccccccaactccacaggccactttgtgctgctggctggcggtggcaacctggcgacggccgtgggccatggcctgggccacccctgcttccgcgtgatacaggcgagggaggttggcgggtga

SEQ ID NO: 3453 - DNA, 297 bp, Chlorella protothecoides
atgtccaaagcctcacgaagtgcccctcttcccatgcaggtcctggacccgtcagccctgcaccccgacgactacctcgaagcccaacgggccgccgcagcagctgaggagcagcgaagggcggctcagaggcaggccacgggccgcatagactttgtgaagagtgcgagtcaacccaacctgggtgcctccaggccgtcgacagaggaagctctggcggcggcgcaggcgcgggcggcggcagtggcagcgagggttgcggcaatggggcctggttatgctgccgccaggcggtga

SEQ ID NO: 3454 - DNA, 960 bp, Chlorella protothecoides
atggtgccggtgcggtggtggctgcgcccccgaccccctcactcccccctaccgacacaggcactggtcgaccggccggacgagatccgccgcgtcgtcaacttcaagcgcctggtgctgaccgacttcaagatcgacatcccccgcctggccaagaagtccgtgctgaccaaggccctggaggaggccgatgtctttgccaagttcagcaacagcagctggggcaggaagatcgccaagcgcgaggccaaggccaacctgaccgacttcgagcgccacaccgcgctggtcgcaaaggtgacccgcagcaagaaggtgagcgcggcggcaggtggcaggggatggcgtgggtgggcctgggcagtatgccacggcctggcttatggcgtcagattgatcgagggaatgatcctcgccagggagatctgctggggttctccaccaacccccacaccctcgcccctgtcacggctggggcgaagagacacgcccctctcccctcgggcgtcactcggcgtcgtgcaaccgtgtgggcccctggcccaggagggagtcccccaggacccacccctgcgcctccgcctgccgctggaagtcagggaaggcggcctgcatggcccgcaggccggcggcctcgccctcccccgggtgcgcctccagccaggccgcctgccacagcgcgcgcagcgcgtcgtgcgcccctgcgcgctgcctgagcaccacccagcaccgccccgagtgacgggtgagcaggtaggcctctgccgagtaggtcgcgcagagggccgccaggtcgcgcccggcccccgccgcgagcgcctcgcccagcgtgcagcccagcgcgacgtcgcccggcggcagcgccagcgcgctctcccctcgattcacctcgcggacggcgggcacgcgccctgcgcggatggaaggccaggcgggagagggccgcggcgcgcagcgtga

SEQ ID NO: 3455 - DNA, 219 bp, Chlorella protothecoides
atgccgttcacacgctacgttgagattgggcgcgtggccctcatcaactacggcccggagtatggcaagctggtggtcatcagcgacgtggtagaccagaacagggtgcgttgggggacaagaggcaggagaagggagtggacatattggcgcgggttaaggggtgctcaggagctggactgcggtgtggagaggcgcgtggcgggctcatggccgtag

SEQ ID NO: 3456 - DNA, 1686 bp, Chlorella protothecoides
  modified_base (66)..(75): a, c, t, g, unknown or other
  modified_base (1416)..(1425): a, c, t, g, unknown or other
ctcctgtcgccgtcggagcgcacacatgccattgcagccagcccctggactccggaaagcctagcnnnnnnnnnngcccgacacggcaggcagggcagaggcaggccaggaacccagcccaaacgccctccgcgcgccccgcaactccctcgacaggcctcctgtcgctgtcggagcacgaatatgccattgcagccagcccctggactcagggaaggcctagcctgcttcagaccgaccacccctcatccccccccccctccccctgctcacccagcagggtctggcggtaggtggcgtcggaggccaggcgcagcagctcctgctggtcggcctcgttccagaagcggcggtcgtgatggggcatggcgccgcccggccccagcgcggcccccccgcccaggcccgctgcgaattggggggaaggtgcatggcccctgcgccgccgtcccccggctcatacagcccggcgtagcccatggcctggccggggaagccggcgccgccggacaggtaggagtactgctccggcgtcaggccgtgctgcagcgcgccggcggcctcgggtgtcaggccgtgcggcgccgcgccgtagtacggcaggcccatcgagccggggtcgccgccgtacatgcccgccagctgctcgctggcagatgggtgcaggtgcgagaccatggacatgtagccgtggggcatgctgaacaccgcgccggcggggcgcgggggcagggccttgttcttgcgttgctctgtggtgggtgtccaaggggggagagggaggaggggggggggatggagctttggcagggtggctcatccaagaactggggcctggcgtgggagccaggtcctgaaggcaggcccaggaggctgcatggggctccaatccccaccccgaggataaactgcaccccctctttccccccccctacaacaccgcaccgagcaccaccgctcacccttgtccgggttctggagcttgtcgtacttgcgcttcacggccttgacggtgcgcgagaagtggcgcgcgatgggggcccacttggtggtggtgtcgcccagccgagagcggcggtagtcctcctgccccaccagcttcaccagctcgtcctcctcctggggggtccaggcctcgtcggatttcttggcctgggagtccaccgtggcagtggtcatgcggtagtcggctgtggggcacgggaggtgggcgggaagggagtaaaagtgagcagggagcggggattacgctcatggcagggagatggcaagcggaggatcgcatcaggtggtccaggtgcgccggctctcgacccagcagacaatcccacgcgtagcagagcgcccccctggcaggagcctgggccggcagggaagggtgcaccagcagtgctcctcgtccctccctggcggcgnnnnnnnnnncaggagcctgggccggcagggaagggtgcaacagcagtgcttatcgtccctccctggcggcaggcgcatggcccttcccctgttcctcacgctcaccagggtccatgccggcctccgtcatctcctccagctccccatcagactcggtgtcactgtgtgtcgcgtgtgacaggcctgcagggcccaccaggccatgcagccggtctggcaggccgtgctccatgcctggctcagtcccatccaccagggcggagtggatga

SEQ ID NO: 3457 - DNA, 420 bp, Chlorella protothecoides
atggcgtgtgcaggcagcagggagatgcaactgtccagcatcgccacaacactccccagcctctggtggcggcagcttcgcaccacgtgtacacctgaagctcagccccggccacattccatccacccccgcccttctgactccaggtccgtgcacgcccccaactcgcggcgccagacgctgtgcggcacactggactacttgccccccgagatggtggaggggcgcgcccacgacaccggcgtcgacatctggtccctgggcgtgctggccttcgagttcctggtgggcaccccccccttcgaggctgcggggcacagcgacacctacaagcgcatcctcaaggtggacctccgctttccggacacccctgtcgtgtcggcgggggcccggcgcctcatctccaaggtgggcgaatga

SEQ ID NO: 3458 - DNA, 540 bp, Chlorella protothecoides
atgccccacggctacatgtccatggtctcgcacctgcacccatctgccagcgagcagctggcgggcatgtacggcggcgaccccggctcgatgggcctgccgtactacggcgcggcgccgcacggcctgacacccgaggccgccggcgcgctgcagcacggcctgacgccggagcagtactcctacctgtccggcggcgccggcttccccggccaggccatgggctacgccgggctgtatgagccgggggacggcggcgcaggggccatgcaccttccccccaacttcaccgacgtgctcatgagctcgctacagtacggcgtccccggcacgcacccgggcgccggcggcgacttcgcagcgggcctgggcgggggggccgcgctggggccgggcggcgccatgccccatcacgaccgccgcttctggaacgaggccgaccagcaggagctgctgcgcctggcctccgacgccacctaccgccagaccctgctgggtgagcagggggagggggggggggatgaggggtggtcggtctga

SEQ ID NO: 3459 - DNA, 324 bp, Chlorella protothecoides
atgaccactgccacggtggactcccaggccaagaaatccgacgaggcctggaccccccaggaggaggacgagctggtgaagctggtggggcaggaggactaccgccgctctcggctgggcgacaccaccaccaagtgggcccccatcgcgcgccacttctcgcgcaccgtcaaggccgtgaagcgcaagtacgacaagctccagaacccggacaagggtgagcggtggtgctcgtttatcctcggggtggggattggagcctacaggaggggggctggcaaggcgcccctggttcctttgatgcgcccccctcgggccaggtga

SEQ ID NO: 3460 - DNA, 633 bp, Chlorella protothecoides
atggctactctccaagtggacaaggagaattgcctgcccttcagacccacgcacctgggcaccaaaaccgttgccaagggcctgacggagcagtccggcgcgcgtcctgcagtccttcagcccctcagtgtcaatgtcgcatcaaatacagcagccagcgcggctcccggcaaggctgcgcagccgacgggcccggtcaagacagcagctgccgagagtcgcacggcggagaggaccagcagcagtgcaagtgcgcgatggcagctgacagacttcgacatcgggaagcccctgggccgggggaagttcggaaacgtgtacctggcccgggaacggaagaacaagtacattgttgccctgaaggtgctgttcaagaaccagctgcagacatccaacgtggagcaccaactgcggcgagagatcgagatccagagccacctgcgccaccccaacatccttcggctttacggctacttctacgacgagtcgtcagacccagatcggcgcaccctggtcccacacccttcctcccagacccgcgtgtaccttatcctggagtacgctgccaggggcgagctgtacaaggagctgcagagggtcgggcactttgacgagccccggactgcgacgtga

SEQ ID NO: 3461 - DNA, 1386 bp, Chlorella protothecoides
atgcaccaggagttccttgccaacatggacgcgctgcacgcctttgggagtggcggggtcctgcgcctgctgctcacacagggtggatcatctgcggaccgggacgtcgtggtcatcctgcggaggctgagcggtagcctgctgcgcagcggccgccacagccccgccgcgtgtgcacctctcacccagctggccatgctcctggaggacggcgcgtccactgcgtggaccctggacgtgcagcgttggcaggccaccctgatccggagcctcgcggcagaggcatggcagcgctggctgcgcggcctgtgcgcagagccggcaacctccctgcctggcaggctccatgcctcagagctgacgcgcctggtgggcaagattgcagcgggcacctccgtggcgatcggggccgtggacgcgcgcaaggcgcagctctctggcgccgcgcaggccctgctgcggcacagggtgcccaattcgcgggctatggccgtgtctgagcgagcagcactccgggctgtctgtgctgcgacccttgcggcacacagcgacaccatccctgaggatctgagggaagcctttggcgctgccattcatgacctcctcagccacgatcaacctgctgcgggcgatgtcgtctcccttcttgcccacgcggtgaatggcagcagtcacagcggcctcaggcaactgtggctcgtttgcttcatgcccattgtccagctgcttgcccatggcgaggagtttgctggtgggtggtggactttggggccccttactggcgccgggtgtcagccaagtgcgctcggtggctccatggcccaatacgcagccctgcgcagtgtgttgggatctgctgaaggacttctgctgtgcctgtctgacaacatcggcctgaccacctccccacagacatgctggcccttggaaaagcctgggctctcctgggcctgggccgcctccacctctgcatccctcctgcggcatgtgaccccgcagctgaggtgtgtaagtggccgtgacgcggcatgtgcactgagttcccatgtttaccttcctattttcgaccacttgcccctctccaatgctcctgcgccatttcaacctggtgaaggtggcggcgatgaaggtccatacctactggcagctgcaaaaagcaagaaggacctggcgacttccgctgagcgcctcgagcacttgtgcacgccgcgccccctgccaccccagtactttgagattaggagcgaagtctgccgcttttgctctgggattggctccacagaaccagtcaggagtctgatcgaggtagggatgctgtgcagaggggtgtccgccgtcaggcagcgtatcatcttcacagccgatctatgtatgctgaaggagtaa

SEQ ID NO: 3462 - DNA, 594 bp, Chlorella protothecoides
atgtggcatactgcgctcctctccacatccctaaaccttgcccctggtgtcttcatccaggcgggcgccacgctggcagtgctcaacctgagtcagcagacagacgcctccgacctgctgggaggcttccgccccgtgcgccccaccgacgccgctctgccgctgttcgagcgcttccaggacctggtgcagcgccagtggccggcgggaaacaacggcgccttcatcgatcgcgttgcccgactggcggccaagaggcacgcagggaggctggtcaaggccttcaaggtggccctggcgaagctgggcgtggcctgcccgcccagcagggcggagcttgcggaatctgctgctcccgaaccatccacacctgcgcgggagctccggcgggcctggctcaagttctcggtggacgtggcgcatgcggaggccacgctactggctgccgagggcgggttctcctttgcgttcatggagggcacgctggtgcaggcactgcgacagggctcctggctgctgctggacgagatcaacctggcgccgccagaggtgcggggtccgaggcaagggaggtgtctgctatgttcaatctga

SEQ ID NO: 3463 - DNA, 777 bp, Chlorella protothecoides
atggcagcctttgtcaggggccagcggctccatatcttcaattgcaatcagcacacagaggcgtctgacctgctgggtggattccggcccaacagagcccctgtggctgaaggcgaagcatttgtgccctttgtctgggccgatggccccctggtccaggccatattccagggcgacatcatcctgattgacgaactcaacctcgcagaggatgccgtcctggagaggttaaacagcgtactggagcctggcaggacgctcactctggcagaaaaggggggaagcgcggcagaggtcatcgtcgcccaccccaacttcagggtcgtggcgaccatgaaccccgggggcgactttgggaagaaggagctttcccccgcgctcagcaaccgcttcaccacgatctgggtgcctgcagcaactacgccctccgagctgcacgcaatcctgagacagcggcttgtcccagcagcacaggccgtgacgcagcccctcatcgacttctggacgtttttcaaccaagagatctccgcctcggttcgacaggcgttgtccatgcgagacctgatggcctgggtggaattcatcaacctgaccacccccggcctgggagctatgctggcgtacgcgcatggcgcagagctcatccttctggacggtctgggtctgggcgtgggacttcccatcgaggtaggcatgcgagtatggagcagctgcattggctcgtggcagggctcccggtcaacgatcgctgtttgggctggtgggccccacgtgtag

SEQ ID NO: 3464 - DNA, 393 bp, Chlorella protothecoides
atgtatgccactcccggcgtccttgccgtatggagcccagagagcctttccaagtcaagaacgcccccattcctgcctgccaggtcggatggtccgttgctccacgccatcaagacaggagcctggctgctgcttgacgaactgaacctggccagccagtctgtcctggagggcctgaatgcggtccttgaccatcgatccgaggtcttcatcccggagctggaccagacattcacctgcccgccaacctttagggtttttggggcgcagaaccctttgcaggagggtggtgggcgcaagggcctgccgaggtctttcctcaaccgctttgctcgtgtgtatgtggagttgctgggcacagacgacctccacttcatcgctggtgggtggtga

SEQ ID NO: 3465 - DNA, 1263 bp, Chlorella protothecoides
atgcagtcactgggtacctatgatgctgaggctcagtcccagctcgatgtggcgaccagtctacaggagtcttgcgcagcgtgggccaacagcctgcttcagcgatacccatcgtatcgagacatccttgagccggtccaaactgctgcgggcgagcttcagtatggcctgaacttgatggtcactgcacgccagcttggcggcacagattcccagggcgtgtcagcacagctggcgacgctgatgcgatacccaaagccggcgcggctgcatcttacacccaggctggtgccgcagctggtggccaggggcaggcagacccatgaccccagtcaggaggcggtgggcgctcttgcagcccgcctgaagctgctgctctttgtgttggaggactgcagccgctaccttggggccgtacagcagagccgagtccccctcgtcaacgagaccgagtggaaaactgtgcaccacgtctacggcgcactgctgcaagtgtgggtcgacgtgcagaacgaggagcgacgcctcgaagaggaggccgcactcgtgttcaagaccaaggccaaggcggtgacgctgtccattgatgagcaggtagggtgttccatgcatatgccatgcgcactaacaaccctgggcttcgggatgatgcttgggcacctccagacattaaatgcccttccccctcccttccccctcaaaatcatccaggaggatgaggatgcctacaaccagcaattcccagatcatagactggcatttgcagatttggagctcgatcatgacgtcgctgatgcacctaatgaagtctcaggccccgagcagaaggcagcctttgcgctggtgggcaccctcaagggccatgtccttgagcgcctcgcggcggcctatgcggccctcttcgcctcgagacgcgaggttgtggccgccggacggtcgcccgccgccttcttatcagcatatcagctgggtctacagatcgccggcggggacagcacatttgattcaagccttgaccgggagacattcactggacatattacggcggtcgctcaggaattccacacccttgccaagccggcctctcacgaagctgacgtggagacctttgatattcagtctccctcaagtgaggaagctctgttgatacgagctccagtggctgcactccagctccatctcctggagctgcttgcggagtggccagagcatgtactcctcgtgcaagtgagatgggggaggtttgctactattgtgcactag

SEQ ID NO: 3466 - DNA, 654 bp, Chlorella protothecoides
atgggtgacggatcaacaaagggagccaaggatgtcagcgatgagattgacaacgaagaccagcttctagggactgacaaggacaagcaggacgacggcgacaatgaggacacaatggacaacgacgcgaagggcagcgaagatgaaaacgagggagacgaactggacagacaaatgggtgacacgggcgacgctggagaagatgtcgacgagagggcagccgagaaccaggagcaaaatgatacggtgaacgagaaggatgctggatccagtcctgaggatgccagaggcaatacggatactgtggctggactggaggaaggcaatcaaagtggcgacgacaatggggctgacgacgccagagaaaaggaggaagatggtggcgggaacgaaggggaggacgccccaagtgaaatggaagacgaaggagtagaggattcaggaatggtggatgatgataaccatacccatgccgaggaggaggcagcaccctttgaactcgaccatgacatggatgccatgtctgagggaagcgaggatgaaacctcggcctctcaggcatcagacgccgctggcgatgccgctagcagtgatgaggagggagagccagacggtgatgatgatgaacgagagggagccgagaagagaatgtga

SEQ ID NO: 3467 - DNA, 1107 bp, Chlorella protothecoides
atggcggggctcctacaggatcccagggggagtttggtgctggcggagcgtggggatgctgaaccggtcactcgccaccccgacttccgcctctttgccgcgatgaaccccgccaccgatgcaggtaagcgtgacctgccggcccccctccgcaaccatttcaccgaggtgtgggtcgccgagccctcccagacggaggacctgcgcgccatggtgacctcctacctgggccagaccacgccccgtggcgtggtggagggcgtggtgtccttctaccgcgccgccaaggcggaccgcgggctggtggacggcgccggggcctgccccgtcttcaacctgcgcacgctgtgccgcgctctggagtatgtgcgtgccgccacggcccgctacggcccgctccgcgcgctggccgacggctttgacatggccttcggcactgcgctggaggcgcgcagcgcggcgcgcctgcgctatgccatccagacccacctgctgggcggggcagggtacggcgcgaccacctcgggcgctgccggcgcgcccccgggcgactgccacgtttgcgtggaggggtactggctggagcgggggcccgccgaggcagtgccgcgcgagcgcgacgcccagggccgcgtgttcatggagaccccggcggtcagggcgcacgtgcggaacctggcgcgggcgctggtcctgcggcgctgccccatcctgctgcaggggcccacctccagcggcaagacctcgctggtggggtatctggccgcccgcacggggcacgcttgcgtgcgcatcaacaaccacgactccaccgacctccaggagtacttggggcggtacgtgtcggacgagcacggccggcttgtatttgcagagggggcgctggtccaggcggcacgcaggggggactgggtggtcctggacgagttgaacctggccccctcggatgtcctggaagcactgaacaggtgggagaagagggttgcggagcgagtggaaggctggcatgccaggggggctaaggggaacgcttggctccgcggcacattcctgaccaacgtcggggtgtgtcagttgaagggcgtcttgccactggtcctcacctga

SEQ ID NO: 3468 - DNA, 1365 bp, Chlorella protothecoides
atgatctccttcctggcgagactgcaggcggagaccgtcgcgcgcactgggtttgctgcctcgggtggcccttgggagttcaacctgcgtgatctcctgcggtggtgcgagctcgtcgccgcggactgctcggggtgcgatgcggcgggcagcgccatggctgacggagacgggcatgaactgcagtatccacgggacccctgcgactcggctgcggcccaccacgggcacatgctcttcacccagcggctgcgtacggctgaggaccgggctcgggtcggggcgctcctgtctcagacctggcccgggcacggaggggcccctgcagcggccccagccgtccacctgaccccgcaggtcctgagggtcgggagggcggaggtggccaggtcccgcgcccctcgcatgggcggcgccgcctcacagccattgctggccctgcttccgagcaaggggcgggacctggagggcctggctcgcgccgtcggcgccgggtggatgggcttggtggttgggccggcgggggccggcaagacggccctcatccgcacgctggcggagctggccggcagggatctgacggagctgtcgctcaccgagggcaccgacacctccgacctgctgggtggctttgagcagctggaacccatgcggagagtccaggtgaggattggggcggcccccactgagatcggccatggcacgattaatttcttgaagaagcacagggctgggtcccctgtccagccagccacgtcaagcaccatcgagaatcatgcttcccttgtcgtcgacgtgcagaacattggagctgcagtgaaagcgtccctggcatcctgtgggcggtctctgctcctcctccccaatgttgagggcgccgccagtgtcctgtctgccgtcactcggtgctgggaggcgtcatgcgaagccctgccgccaggagccagtcaggacgagggcgaggggcaggagcagatggggcgtgcggcctcgctcctcctcctggcagtggatgggctgctggcccagcttgcgagccattcgcccagcactgctgcgcttcaggaatgcatgcatggcctcgtgtcccatctggaccttgctcagcagcgtctgggtgcactgctggcggaggcagaggcgagcgagcatggcgttgctggccgcttcgagtgggtggatggcccgctcacgaggtgcgtgttggtggccaaggcagggaggggtgagagaccgcaggccttcctggcgcacacgggacatgggcaacctgtgccagatgaggtacccctgcttcatggcaacccagtccaaacaagtgggaccacggcgcagcctcagccaacgagctccagccccggctag

SEQ ID NO: 3469 - DNA, 678 bp, Chlorella protothecoides
atgagcagtggtggccagctccagccctactaccacccctttcacaggctgctagacgacaatcgcgagctgttcgtgcccgagcttcaggagaccatcaagccacacccacacttcatgctgtttgccacccaaaacccgcccggtctgtacgcggggcgaaaggcgctgagtcgcgcgttccgctcacgcttcctggagatgcaggtggatgacatcccacccacagagctggtcaccatcctcgagcacaggtgtggcataagcaacagcgatgctgggcgcatcgtgcgggtcatgcaagccttgcaggatggccgggctgcagggaatgtattcgccggcaggcacggcttcatcaccccccgagacctcttccggtgggcggggcgcggtggtcatggcgacgagctggccataaacggctttgcagtgcttggagagcggctgcggaacgccgaggagaggagcattgtaagacagtctatacagacagagctccgtgtaaagataaacctcgaggaggctttctttactgagggcgaaaagccgctgctggagctccaggctaggctcagagctggtgagctggacggcgccatgccaggtccagagacccaggcgcttcagaagatgctgcgtggtcttgtctggacccgacccatgcagaggatgtga

SEQ ID NO: 3470 - DNA, 1233 bp, Chlorella protothecoides
atggcgatggatccccggcacggcgaggtttcgcgggccatgcgcaaccgtggcgtggaactctttctgcctgactggacgttgggcgagggagccgcgcgcgagaccgcagagctgtgcctcgtcctggagcaggccgggatcgaggagcaggcgctgcagtccagcatgtgcgctgcgcacgctgtggcgacagtgcaggccgcgggccattcccgcaggcccccgggcctgggtgcgctgaagcggtgggcgctgctggcgcggtcgctcgtggcacggggctggggcgcaagcgaggcgctgacggcctcctttggtcagctgtatggcggcgaggaagggcagagcccgctggctgctgcgcacgccgctgacagccggtccacaggcgtgacccccagtcatggtcttgtgcggcgagctgcctggccgctcccacgcgacgtggcggctgcggcagaggatgcgacggccttttctgtcgcccgacgggccacccccgcagtggcgagcctggtgcggctgggggtggagctcatgcagcccgcgagcgccggcgcagctcccgccatcacccccaatgccttggccagcctgctgaacactgcgccactggacgccgcaacggtgcgtgcgtccgttgtgctgcacgctgcacaaggcgctacagccgagctcgcgccctgggtccctggccacggctcggctgcctcgctctggcgccgtgcgctggcctgcacgcacgctgcggccgtctgggcaccgggcggcgcccaggttgctccctcatgcctgctgcccagtctggcacaggtccacgccgcagcgagtgctctgggcgcgcctgggctccagcaggcggtcatggtggcagccgcgctgatccgcgagctggagaggtaccagggcacgctgctgagggggtggcaccccatggaggacggagaggacggcatggccgaggtgcaggtcagtggcgctccagaggcggccctaccctgcgcgggtgctcccctgctgaccaggatcatacacggagcagtggaggcccgagcacttctcatggcggcgatcctgcatgtgagatcggcggaggatgccgtcagccccctgcagttctcctactggcggcatgctcatccacaggtaggcgcagcccctgggcatcgggcagagggcttgtcagaatatcgtgatgatgtgggcttgtctctgggcatttcagcttaa

SEQ ID NO: 3471 - DNA, 597 bp, Chlorella protothecoides
atggtggacgacgaagaggctgacaagggcgaccagccagccgctgttgaagaagcagcgggccaagctgattaccgatatctcaatcaggaggaagaggtggctgcaggcgacgaacagacactgggagcagccgcggacggacaaatcgaccaagagcttccggacgcgcaagagcaggctgcccctgatgaaggaacagaaaagaatggagagcggcgcttgggaatgacggacgatgcccaaacaatggcggaggcaccgacatctgccccagctcccacctctcctctgagagtcgaggaggcggactcctacgaagatgctgctccgacaacggcatctgtgacggagagagatgaaggagagatgataacggcgatggggaacatgatgcaggaggagcgagtcaggcgtgaagtcgcctataacgaggtcggcgagctcggcatcatcaagtttggtggcaaccacggtgctgaagtcctgcacccattggagaagccgttctcggacgctgatggtgctcgagtcgttgaacaggtaaatgccgagcacctgcttttcaaccatatctcttggcgttcgggccgatag

SEQ ID NO: 3472 - DNA, 1395 bp, Chlorella protothecoides
atgcagcaagcgatggccaagcgttcagcagcactggtggctcactttgagaatttcatctccaccctggcggagaggactgcgcaactcagggcggacacagcgcggggccacatctccagaaagcgcctggccctcaaggatctgtttgatgccatctcggaaattggcatcagcaagtccgagattgcagtcccggcacagaacagaggggtcttctgcagtttcacccaggctttcccggaggtcgctggtgaggacggcaccaaaatctccaacctagttgagaccatcaatgagtattattacaagagcattctgcgtatgaagaaggtcgacgaggctatggagaagtcgccacatgcggatctggagccgcaccatgctctggccgcgcaacacatgacccatcacattgtgtatatgctgcaacagactcgtgagagtttgaatgcttgcacccgagcgagtaccttgatcagggcggctgtcttcacaaagcgaccagcgcctgatggcggcttgagcgggtcaactgagtctctgacgtcgcaacataggagtatgtcagttcgtctcctcacgatcaagacagtacttgatgaagcctgccgaggtctcagcatcagcttgccacaccagccatctgcagagctaagtggacagcaaagagtgatgcgcaccctcctggagatgggccaccgggtggccgcactacaagcagcactcagcgaaacggctttgcctcccttgttcaagaccggacttgtgcacagtcgagcctcggacctaatggagagcatgcagcagagtctgagaagcatggagcgtgaagtggaggagatttgcaagactcatgcagatggcttcactgccgacgttctgcaagcattccaggctaccgagagcactgcagcacccgatggagaggaggcagcagccagcctcaggcagcacagctctgacctgccagtgttcgcggagtatcttgcacagctccaaggcgagctgctctccctccaagaagcagacatccccgaagctgaaccgacgagcttggagagactggacgtctacctggattggctgggcatactcaagactactgtggagaaggtttccatcagccttcgcgaggtgcttagattttctgcaggccacccagaccttcaagggagcgagatggacgcccttgagagaaccctgggcattctgaaatcagtcatggagagcatttcctctgtgggtgcagctacctcgaggctagcctacttcatcacatccttattctgtggcctcatctccgagggattctgccgaccagatgatgatgacggtgaggaaggtggcgagagtttcttgttctgtgttggaacgcatctacgttatacctaa

SEQ ID NO: 3473 - DNA, 1149 bp, Chlorella protothecoides
atgcattgcgctcttcctccactatcgcaggactccttctggaactttggagacgggccttcccccccaccccccatcaagacgtgccaggggtcggagaaggaggtagccgtggggaaggagaccggcgctgctgcgccggccccagacctgctgggcctggacatctggcccggcgccctcgccctgtgcaactacttggccatgcacccgagcctggtggggtgccggcgggtgctggagctgggggcgggcatgggccttccggccctgctggccgccaagctgggctgctcctccgccctgctcacagactacgagcccctggtgaggcgcgcgttgggtggcggttgtgagctgatgttgcatggctgggtggcttgggctggagaggtgcgaggccactttttcctcacctccgtgcaggttcaggctgcagcagcagctgcaccctcgctcgctcataacatcgcattgattagtcttctctcctatacatctcccttttcacaatctcccctcccctcccccccaaccccttttccgtacatcaaggtcttggagctggcggccgaaaacatccgcctgaacggcgtgggcgacatcgcggccacgcatcgcctggactgggaggacccgcagggcaccctggcccccggccacccccactccttccacgtggtgctggcggccgatgtgctctacatctccgacatcgtgctgcccttcgtgggcatgctgcaaaccctgctgcaccccgaaggtgggagggagaggtcgtctggcgggcctggaacaggctcttgggaggcctgggcaggggcctcagatgatgagcggcacggtccaagcgctcgaatcacgcacccctcctctccaatccacccaggcatcgcgctggtggcgcaccagacgcggcgcccgctggtgctggaccccgagaccggcgtgccgggtctgtcgcggcgcgacgagccttacgaggccttccaggcggcggtgcgggcggcgggcctggtgccgcgccagctgggcgcgctggacgccgggggcagcgctgggccactctacctctcagccctggcctgggagcaggcctacatcgcgacgctggagccggtggcgcgactgcggcctctgaaaggctga

SEQ ID NO: 3474 - DNA, 1161 bp, Chlorella protothecoides
atgagatgtaggccatgcactggacctgagctcgactttgttctggccgacacccccgcgtccctgaagacctgtctcctcggcagcatctctggggcagccattcagcacagggaaactccagagtacacgccggttcctattgcagtgacgattggtacgatggatagtgtgtgtcggcggcgtcatgctgtgtttatacgaagctatgtcccatccatcacttccctatcaaccactgcatcaggagggcggcggaagcggtatgtgtggacggcctccggcctgtccacggtggacgcagacgcgctggtgggtgggaagggggactcctcaccacgcagccgcgtcgacgtcctgctccgacacccctttgagtgggcaaagcatgaaatacgacacgccttcttcccacaccgtgacgaagtctacccaggtgaagcagctggggctgcttgcttgagtgatggggcaatggccttctggagtatgacatttccctcccattacccccctccctccctccctccggctccgcgcttgtccagactactggacctatgcaaagtggagggctgtgcaccgcttcttcagcagcatgaactcggtctttgcgacgcaggctgggacggcacgcccacgcctgctccgaggcctgccccacctgcatcctcaccgaccttcactcgctctccgcgccttcagtccttgctccaagccgtcggcatcggggcgcagcgcagcctgccggcggcggccaccatcaactgggttctcaaggacgggctgggacggctgggccgcctctccgtggccacacagtacggtgcctcctttgatgctgacctcaaggcgtggagatacctgtaccaccgcaaccctggcttggagccaatcgtggatcccctctcaacttccagtctcactccaacatgcacggcgagcgtgaagagagcgctcacacctcaaacgcgcctaccctctccacgtcttgcctcagagattccggtttgggacgtccatcctgtactgcctggcgctggccctggagtacgccacccccctcgccccctccgccttcctgcccttggcctccctcgccaacgtggggaagagcgtcggactggccacctatgtggccacccaggtgggagattttga

SEQ ID NO: 3475 - DNA, 1341 bp, Chlorella protothecoides
atggttgagtgtcgtgccattggcttctctgttgattcaggcgacactttacaagagccagtccctgctcggagcacacctgtactcagtgccctactcgttgccctcacagcaacacttgtcgatgttgtgggctctgctgccctgctcaccaagatcgaaaagtcaggggtgagcctcaatatctctgtcaactacctgcggcccggcaaggggggcagcacagtcaagattgtgggtgaggtcgtgaagattggccgaactgtgtgttccatcgaggtggccatcacagagaaggatagcgggcgcctcattgcaaaggggactcatgtcaaggtgagactgccattgatattggactgtagtgtgtgcagttttgtggagcaaagcaggagaccgcttgatcagacccaaaccttgtgcttattggtaaggaaaatgaaggaggcgaatcctttgctctggaagggattgcggatctctgtgcaatttacatctgaaccccaaccacacgtgcagcacattttggaggccgaaccgcctttcccgaggttggactcagtagcagaggagctgacccatcgccggaacgcagtgcggaacaagacccaaaaatctaggctcctccactggcaccaccccggcagaatgtccggggtgcctgactatcaacgcttcgcagagcgcttccttgatctcagctccaaccagcgggacagtgatggggggccatccatgtttgacagtgcagcaatgccaggtctatacgacatccaagctgggcctgggcacatcaagtgctacatgaaagttggcaagacgcacgtcaattttatgggcaacctccacggcggttgcacaggtgatttgggccaggcatgggctgctgtaggctctcttgtagatttggtggggtcagcggccttggcaaccttggggaccacccctcatgtgagcatcagcatcactacaaactacctgcgaccggctccaatcggcaccatcatcaggatagaatccagcgtgagtgctgtggcagagcaggatcatgagttcttggacacccgcccagtctctgcatacaggcttgagccagagccgctgcatgacccaaaaactttgagtcactgcaggtatcggcaggggatgcctgggtatcctgtgatggtgtcaggcgcacacggtggaaggcctccatgttcttctgttctcatctcatctcccaagattccatttcatgccacacgtatttttcctgagcagatgatgatgcacaagcaacagatgcctggggagtatagcgctcccaaaaacgaggacactcagacgtcccggttgtga

SEQ ID NO: 3476 - DNA, 600 bp, Chlorella protothecoides
atgtggccaggccgtgtttccacaaagcacattgagtgcacccctgtgacccccacccccacacctccaacagtctacggcaagcgcgccgacagtgccggcctctcccagaagagcgagaggacgagtgtgtgggccctggcctgggctgcctttggcctcttcaccctgcagctggtggcctgcatcctggactttggcaaccactccaagatcgaggggcccgccggtgcgtggcagagctcacacgagggtactgtgctggatctgggggccagggggctggtgcagcaagagcacatgcatgtggggggagccctctgctgcaatttccacacgccttcccacctcctcaccccttcccaccgcccaggcgcccagtacgggagctccccaccgtaccagggcaacgcgcagtaccctgcccaacagtacggtgcagccccccagtacggctcggcctatgcctacggcaacgcgacctaccagccccccccacagtaccccccgccctaccagccgggcggcaccggcacagtcaccggcttcccccagcaggcccccggctcagcgccgccccaggccgtccgccccgtctag

SEQ ID NO: 3477 - DNA, 330 bp, Chlorella protothecoides
atggctgcctttgtgaagagcatcgacagcaaccacctactgaccacgggcgaggagggctaccgtgtgaggggcgacacctcctgctgcaccaacaactggctgaacggtggggtgaagggcgtggactttgacaccaacgtggccgaccgcaacatcgactttgctaccgtccacgcctaccccgacaactggggtattgcggccagcgactacaagtggtacggccccaacttcctggccgaccgtgcaagcatcgcgcatgccgccggcaagcccattgtcatggaggagtacggcagccgcgaaggtgacatgccggggtgctga

SEQ ID NO: 3478 - DNA, 279 bp, Chlorella protothecoides
atgcccctgcaggcgcatgcggcgcagggcgtcaaggtcatccgcgtgttcgcccacagcgatggctacggcttcccggataacatcaagactccgaaccccatccagccccgactgggcgtctacaacgagaacgccctcatgaggttggacttggtcattgctgccgccgccagcactggcatccgcctcgtcctcgtgttcaccaacttcgagcccttttacggcggcatccaggtgagtccccggaaccctccccagcgtgcgtgtcagacgtag

SEQ ID NO: 3479 - DNA, 1200 bp, Chlorella protothecoides
gccgccgtcggcgaggccgggcccggcccgcacgccgcgctcaccgcctcgggcaacatgtacggcctggtggcgcgcagcgcggcctgcgagtctctgtgcgaggtggcggcgcgcctggcggcggcacgtggcccgctggcctcgctactctcccccggcgacagcgccgcgctggacgccttcttcggcgagggcctggcggctgcgggggacgcgctgcgccacgtcagcgacgccggggtccgcctgctcctttccctgggctggctggccgaggcggtggcgggaaccaactacgcgctggccgagccgcccacgcgccaccagccctgggtggaccagctgctgcgccagctgggcgtgtttgccgaccgtgtcgcacacgtggggcgcgaggagctgtgtgtgggcttgcgagggctctctgcacgggcccacgcatctgctgccggctcacgagcgcaccgcatcttcatcgccgcccaccctcctccctgcaccccctgcgcccctccacaccctgccccctctcatcggcccctgccccccccttcacacacccacgcattcaaccaccacaaacaggcgagcggtctgtcccaggccggcgcggcgcgcgcctgggccggcgcggcggcgcacgtggaggcctgcgtgctggacagcgtggcgcgcgtgcgcagctgcagcctggagggccgggcggccatgaccctggatgtgcagggggtggcacacggcctgcggcgcctggcccccctgcccgtgggcgcccaggcggggttggcccgggccgacgcgtacgtcaaggccttctacatcccggtgggggagctgacgcagtgggcgctggcgcaccccgagtacacgcgggagcaggtgggtggaggacttagggtggtggtggaagggtctcgacagctgctctggcaaagggggggggcggtcaaatcatgcgagtggcgccgcgaaacccctggtgttgatgtgcacgcaggtcccctgcagagtgcttccctcagcctcctgtttgatcgccagaggcacgctcatagtccccccccccatctgctccggcagatcctggcgctgaccgcctgcatcgcggacagcagcgggctgcggcgcaaggagcgcgcagcgctgctcgcgcagatggaggctgcgctgcacgaccccggcaggcagggaccttga

SEQ ID NO: 3480 - DNA, 369 bp, Chlorella protothecoides
gccacgcccacggtggagaccgtgatgacctttttccagaccaagcagctgggatttagcaccgagtatctggggcagatccggctggtcggggccctggcctccctggccggcgtgggggtctacaactacggcctcaaggccacgcccctgcgcaccatcttcctgtggaccgccctgctgggcaccgggctgggcttcacccagctcatcctcatcacaggtgcgctggtgtgtgggtgtgtgtctgtgactgcgcatgccggaaatgcactctgtcatgcccctgcgtgccgtgccatgccccaccaacttccccagcaccgcaccacaccctccaccaggcaccaacctgcggttcgggattag

SEQ ID NO: 3481 - DNA, 1467 bp, Chlorella protothecoides
atgagaaaggacaagtgcacgccttcgcagatgaaggcttgcatggccagccagcccgtgattttctgtccggatcctgctgatcccggcgcgtcaaatgttcaccggctccataagctctacctgcatgtgaccgccatgcgtcacacatcaactgctgaggctgcgaccgtcgacctatgccctgcaaccgttgcgtcaaggggtgcgtggggcagtgtgcggggcttgtgggatcgagcatacctcttgccaccaggtgctggatccttggcgccctcactctggcatgccgcctcagcggcgccggtgctgagcacattcctctgccccccgatccctccctgggaaaggtggacaagaactcccttccaatatccctggaatggtttggcaataattgctcccgcccctacctggtcatcggggtggttggggacgactcccagcaccctcacacgtgagcagggggaccgagggggcagcggttcaggtcacacagatgtgcccctgagagtgtctggttgggatgcatacacctcaggggatgtcatgccttcctactcaaccgccccccacatcacacacctccacagatggctggacaacgccccgcaccgctcctttgacctgctgctcatgtactatggccaggacccggacttccagtgcgagcactgtgtggccgtgtaccgccgctccggcgccaagtggcagctgctcaggaagctgagcgagtccccggtgtggccccgtgtgcggcaggcctacaagttcgtcatgatccccgacgacgacgtcctgatgtccacccatggtgcggggtccctgcgccgtcctgtggtccagctatgctgggtaaaggggggttgcgtctgcgttaagccaagccatgcagtgtcgaagctgttggctgtcgcctcgggcagcacgaccccgtctgcaacagccaacagatcctcgcctcctcaccggccatcatccccctcttccccccaccatctgaactggtctatcgtatgcagtgatcaatgtggcattccatgtggcacaccgcttctcgctgtccatggcccagccatctgtctgccggcacaaggactcctacagctactggcacaacgtctaccagaacacttccaacgccctacgctacacggcctttgtggaaaacatggcccccatgttctccatggacaccctggagcggcatgtgctgccaactctagagaatgccagcatcggctggggtgcgcccgcattggggctgtgatggggggccatgggtggggtttatgcggaaacggcagcgaccccagggtcacggccagaggagggggcggtggggatattggttgccatgtagatggtctgcacaatcaccagctggcagccgcaacgtgccttacacatctatcctcctccctactactacaggcatcgacttcctctggcccctgctcctag

SEQ ID NO: 3482 - DNA, 1341 bp, Chlorella protothecoides
atgagggttcttgtggtgtcgcaggacatggatgttgcgtccggccagggggcagaccccaacacatctgtgtttaaaaccctgcgagccctcctgacgacgtcgcctgcaatgcccctcccctccctgcaggactgctggggaggagtttccccgcacaatgctcctgagttttcaagcgcacaggatgctgggctggcacacaggcccaaacatcctgcgtttaggatttggagtagcgctatgtcctttgagagtcaggatctgtgccgtctgtcactggtgctctgtgctccccacacatccaccctccctgctgcacaccacgtccctgcaggtctcaaggagtaccctaccagcatcgtgtttcatgcggaaccgctgccagaagggggctatgagctgaagctgccggcgttctgtcccaagaccttctccctacctgctgtcatcccctgtcggacggtgttccggatctggagcctggttccgtggaccatgttgggggcgctcttgctctacgtggtagtcttgaggatgaagagctggaaggcacggcgctggccgctgactgcgacgcctaggaggaagctttcgggacaccggagcctgccgaccaaggagactaggggtttcgccacgttctcggcagctacccttccgatcaaccgattgctgacgacggacaacgcaagcagggaccagcttcttcgagcgccccaatcgcaacgcacatgcaggggcgacgctaaatcctggagacttgcgtgcgctgaatactgccagcatggatggacatgggattcagagtaccgtggttctgattgttctaatcctccaaccgttgccaccctgcgactcacggtagagaaggccttaatgaaggccttgggtcttgccctggtggtgttcttcatgggcaaccacccctgccagggtagagtcctacatccttccccacctcctgaggccaacaacagctggaatgtagcacctagtccgccatctcaaggtctggaatacatcggcagcccatgctttcgaccgtatctgctcatcgcagcggtgggggacaactcggccctcggttctcctgcatggttggacgacagtccaggccgatcgtttgacatgctggccatgtactacggcaatgacacggcgttctcctgcccctcatgtgtcggcacgtttcggcaccctggtgccaagtggaagctgctgcacctcctggcctcacggccagaatgggatcgagtcatgcagccctaccaagcattcatggtcacagacgacgatctgctgatggcaccccatggtgcggaggcaaaggctgggtga

SEQ ID NO: 3483 - DNA, 426 bp, Chlorella protothecoides
atggacggcgactacgcgcccctggcccgcctcgccgagctgaggcgggcccacggcttcctgttggcggtggacgaggcgcacgccaccctggtctgcggcgacaggtgcgcagatggggggcggggtgtcggggttgtcatgtgcgtctcgtgtggggcgggcgctggagtcgtgactccagcgcccgtggggggccggcgcggcggaggcggcgggcgtggagggcagcgtggacctccacctgggcaccctgtccaaggccgtgggctgctccggcggcttcctggcctgctcccgcgcctggaaggccctgctggtggccaaggcccggggccaggtcttctccaccgccatgccggtgcccatggcggcggccgccagcgcggcactgcgagtggcccgggaggtgggttgggatgctga

SEQ ID NO: 3484 - DNA, 276 bp, Chlorella protothecoides
atggcggccgtggcgggcagccccgaggtggaggtcttctccgacgagctcaaccacgcctcgctggtggacggcctacgcctcgccaaggccgccggcgcgcgggtctaccgccacaatgacatggcgcacctggagagcctgctgcaggccagccccgccaagcccagtgcgcaggggtccgtggcgggggtggggggcagggcgtgcctgctggtaccgggttgctcagggggtgtggagggacgtcccacgggttcctgcgccgggccctga

SEQ ID NO: 3485 - DNA, 450 bp, Chlorella protothecoides
atgaccagccgctgggaggcctacctggaccaaacgctcgagagcctgcgagtcacgagactttcgagggagcttcgcgcgacagttgccgggaaccatgccgcgcaggtgcactgtgctgtgccggccggttgccgcagtgtggggtgggcggtgtgcttgaccttgagcatggtcagcacccagggcccaattgccgccgtgcccttggccactgaggcccagacggtgggcaccggtcccggtcgcacggtgcggctgttcagcctgaacgactacctggggctttcgacccacccccaggtgtgcgccgccgcggcctccgcagccctggccgtgggcagcgggccccgctcctcggcgctggtggggggttacacgacgcaccaccgcgagctcgagtctgacctggcgacgctggcaggtcagggagaggcaggggaacagtag

SEQ ID NO: 3486 - DNA, 966 bp, Chlorella protothecoides
  modified_base (34)..(43): a, c, t, g, unknown or other
  modified_base (215)..(224): a, c, t, g, unknown or other
  modified_base (401)..(410): a, c, t, g, unknown or other
atgctgtgtccaccgactgtctcaaagacgacgnnnnnnnnnnttgacctatgtggacgcattattgttgggaatgacgcccctgctctccatgctgtgaccacggactgtctcaaagacgacagaccccacacccgcgatcctgccgttgatcaaccaggctggacacttggtgaagcgtcaaaatttgtcttgcttacttcaagcaaaggcannnnnnnnnngatcctgccgttgatcaaccaggctggacaattggtgaagcgtcaaaacttgtcttggttacttcaagcaaaggcaggggggcttttggcgtggtcgtgcttgtatctgcctgcttgctacccgagcgagacccaccctgggtggggacagggccctcgcacccgcgtttgggaccnnnnnnnnnngcgagacccacactgggtggggacagggccttcgcacccgcgtttgggacgtccccatggcgaatggggcacttgtagcgacggcttgattgtaccaccacttctggcacggccctgcctcctcatggacctgctcgcgatcgctcgctactacgtcgacaggatgttgacggaggtctccggcatgaaggccctgctgctggacgccgagaccacccagtccatcagcggggtgtacagccagactgacatcatgaaccaggaggtgtacctggtggagaagctggaggccaacaagacggacaagctgccccacctcaaagtgtgtgtgtttgttttttgggggggggccaagtggtgccagagtgctaccctgcaccctgccttggctgggtgccggaaagggatgcttgaccatgtgatcatcgcacccctcactgctgcacacgttgacgcatgcgcaggcggtgtgcttcctgcgccccacccgcgagaacattgctcggctgcggcgcgagctccgcgatccccgcttcggaggctaccacctctgtga

SEQ ID NO: 3487 - DNA, 1260 bp, Chlorella protothecoides
  modified_base (89)..(98): a, c, t, g, unknown or other
atggtcatcaagcccacaggtaggtgcaagcgtcgagctgctcacgctgtcgacggagggggccatcgccgtggcacggcgcgggccgnnnnnnnnnntggtgcaagcgtcgagctgctcacgttggcgacggaggggccatcgccgtggcacggcgcgggccgctggggtgcctctgtgaggttgacagtggggcagctgggtgcgcgtttgggtttagaggccgtacaagcactcggtacccctggccgagtcatgctcttcaggattgctggcgaacgaaatgcacatcattcagtgcagccaggggtgcgcctgtgcctgcaccatgtctgtatgcactcgacgggcccgccctcaccatctcctcggagcaaacggttcctcaacccccctgccttcgttccccctcccacacacacacgcgcgtgccctcccccctgtcgccatccaggcgacgtggtgagcgaggagacgtggcgtacctgcatcctgccggaggggtcgtaccgcggcgtaccgctggggcccgaagacgccatcgagctgcagcgcggcggcaccggcttcgcagagcacgacaagcaggcgcaggcgaagaagttcttccacctgggccctgggtcagggctgtcggaccggcggggccagcacggcggacccgtctccaaggtcaggcatggccatggggctcagggctggggtctgactgcagggtcacggcaatgcgcggcggccaagcagggggttggcagattggcaaaggaagggaggtttcaggggcatgggtggcgcagttcctcagtattccgctgtccactgggacctgccccgtgccagggcaatggaagtgatcctgcgagaaggcatgtcgcagcgatgctgccagagatggggaatgattacacgaggatggcgtcgcagcaccgccccagggccctgcgcagtcccgaggcggccggccggcgcagaggagcgctggccggtgccccgccgacgacgggggcagggtccgcggcggccatggccgccgccttgcgcatctgtcgctgcccggcagacagggaggcacagaacaccgccgcgtcaaaggactcccatcctgacagggtcacgtcgcttcctgaggagggttgtggggtgacaaacaccgtgaggttgtcatgcaggaacacctcctggggcttacaccgtaggattgaggcgctgaccgtctccaccagcattgatgagaacacgctgaacagtggaaataactaa

SEQ ID NO: 3488 - DNA, 567 bp, Chlorella protothecoides
atgctggatctgccacgagcccgacctgccgaccagacccctcacccggccatgccgatgcatgccggcccaccgtacatgcctggcccgctggcagctccagtccgcagggaaggccgaggaaaaggtaagcgcatacggtcgacaggttggcgggccacctgcaagcagcatggggtggttccggggggcctgtgccttcatgtcggaggtcagggctttgcggggaagggcagcgcccgagcgcgtttccacccctccaaatcactcccaatagtatgcgccccgctacagatgtgccggttctgcggtgcagacctgccagactggagaggttgctggtccacccttcccaaggccgaccccgtcatgacggtggcccacgatggccagacccaccaggtggtggtgcggccggggctggagggccgggcggccttcgagcgcaccatccgagagatttttggtctctcagagaacgacaccgtctccctcacctttggctgcgccctgccccaaggagtggacactggagcggcaggcatgtgctggtggccggggctgtga

SEQ ID NO: 3489 - DNA, 1221 bp, Chlorella protothecoides
  modified_base (563)..(572): a, c, t, g, unknown or other
  modified_base (848)..(857): a, c, t, g, unknown or other
atgggcatcctgtcggtgcgtggaaaccacgacgaccgcgcagcggggtactggcaccgctggagcctgcacggggagaacccctccgaccccgagttcgactgggtcaaggacctggagccggcggtgggcgacttcctcctcaacctgcccttcaccatcagcctggaggcctacaacgtgctggtggtgcacggcggcttgctccccggcgtgcccctggcctgccaggacctggcggtcatgtacaccatccgcttcgtggtccccgcccgcccgccccccttcggctccttctcctgggcgctggagcggcgcatgctggccgaggcggtgcgcagcgggcgcatcaccgtgccgccggcgtaccagctggaggcgcgcgagcggcccgactggaaggagggccggccctggggcgggcagtggcaggggccgcagcacgtcatcttcggccacgccagcagcaggtgtctggttggagttgggggggtggggaggggtgttgtcgccgcatggggtgaggtgcgtcgccgtcactgcgcactggacctgggtggggnnnnnnnnnncttggttggaggtggggggggtggggaggggtgttgtcgctgcatggggcgaggtgcgttgccgtcactgcgcactggacctgggtggggcgcgctcggggtgtccttggggggcacgggaggggcaaacttgcgcatggcacctcgcgccagggggcctcgcgactacctcaccccgtgcacacgcctctggcctacaccctccaaaaccaaccctcccctccccccccgcaccccaccccggcacaggatgctgcagctggagccgtttgccannnnnnnnnngcacgggaggggcaaactcgcgcatggcacctcgcgccagggggccttgcgaatacctcaccccgatgctgcagctggagccgtttgccaccgggatcgacacggggtgtgtgggcggcggctacctctccgcctgcatcctgccggcgctgacgcgggagggcgagatcgtgcccgacacgcatgccctgccgcccttcctgtaccagcagaccatccgcctgcaggacggagagggcctgagtgcgcgcgtgtgcatgcagccctccctgcagccagggttccacgccggcaaggatgcaaagggccagctggagtgagctgggcgagacggcagccccgcagcgccttcccggcagattga

SEQ ID NO: 3490 - DNA, 2307 bp, Chlorella protothecoides
atgacccgcatcaggatagagggcctgctggccgctttccccaagctggtggggcagggcaagcagcacacctacgtggagaccgagaatgtgcggtacctgtaccagcccctggagtccatgtacctggtactggtcaccaacaaggcctccaacatcctggaagacctggagacgctgcgcctctgcggcaaggtcgtccccgaatacgtgcacgggcttgaggaggaggcggtgtcggaggcggccttcaacctcatctttgcctttgacgagatcatcagcctggggtacaaggagaacgtgacggtggggcaggtggtgcagaacacggagatggagagccatgaggagaagctgcacaagatgatcatcgccagcaagatcgctgagacgcgggagacaatgcagcgcaaggcgggggagatcgagaagaagaagatggaggcgggccgtggctcggcgcgggggaggccgggcgaagggccgcctgcctacccctccgcccccgccgcgtccggggccggtgggtttggcgagtcccgccccgccctgccgcggcccggccttggaggtagccgcggtgaggctggtctcggcgcctcccgccccaagaagggcatgcaggtgtggatgtggggcggtgaaccctttttctgggggtgggcggggcgtaaacaggtgggctaccagaagggatctgatggagagaagatgtgtatgtcggcagggggagagtcaaaacctctttgcttgcagcacctgcaccagccctgctcacccactccctggcctcagctgggcaagggcggccaggccaaggacctgctggcgagtctgaaggcggagggcgaggcggtggaggacgcaccctccgcccatgcacccccctctctggcaggccgccgtcgccttgcaagggtgtggtcttccgctggggtcgcccagaacccccacccaccccctcgctcccctcattgcacacacaggcccaagggtgggtgcgaccgccagcgaccccgtcttcgtctcggtggaggagacgctgtcggtggtgctgtccaaggacggcggtatgcagagcctggaggtccagggctccatgagcctgcaggtgggcgagggcgccgacgcccgcctgcgcctggccctcaccggcgacgccgcgcagcagggcttccagttcaagacgcaccccaacatcgacaaggggttgtacgcgtcccagaacgtgctgggcctgcgcgacgccgcgcgccccttccccatcggcgcccccctgggcgtgctcaagtggcgcttccagaccgacgacgaggcagccgcgcccctcagcatcaactgctggccctccgtgtcgggtgggtgggtgtgaaagagggttcgtgcgacgctcgggcccgtgtgccgggcctggccgcgagcggcgcgtcgagtttccactgtcctgcttttccagcacaactcgcgtgtccccaacaaccccttccctgggtcacctcaggcggcgagtcgtacgtcgacatcgagtatcagagccaggtgccctttgatctgcacggcgtacagatctccatcccagtgcccgccggcggcgcgccccaggtcaaccagctggacggcgactggcggtacgacgcgcgcaaggggcacctggtctggagcatcgagctgatcgatgccagcaacgcggcgggggccctggagtttgtcgtacccgccgcagacccctcggccttcttccccgtggaggtgagggaaggcgacgaggatgtgtgcctgaacaccccggtgtccttcacggccaacaagaccatgtgcgacatcgggatcgctgaggtgacggcagtggagggggacgcccccgtcaagtttggcacgaggtccctcctcaccaccgacgagcaagactgtgaaaacctggtattggttcgtggtgacgcttgtgcgaccgcgggggagactctcacgaggcaggatgatccgtggcaagtgcttacgataatgaaatgcagtctgcggcgccgctgcgctctgccatggtgcagtcgcaacattggcgctctcggagcccgatggagtcgtgtaggggaattcgcgcgcccagggcctggtaccaggagtgccatgagccaacccccgcgtgaaggttcccgcaacaagaaagttaagaggcaagttcatcgttactttctagcacacggcgtcgcagactaccctgctcaccagggagattggactccctggaccatcgttccgctgtgttgcccccaatcgacccagggccctctgccgccaacgcagtaa

SEQ ID NO: 3491 - DNA, 1218 bp, Chlorella protothecoides
atggagggcatcccgggtaggggcttggggcgggggccgctcgagtcgcgacccggcacgggcctgcggagctgcaaagtgtgttattggcgacagtactgggcgccgctcgcgtgcgccgcgccgctcatgccggaggcggcaataccgagcccttgccaacatggaaagcatctcagcgtgcctggggacagcaggcctgcatttgtttgccatgcccgctgtgctggagagcacaccagcagcaggctcttcctccgcatgggccctgaccgccgccttcctctccctccctccccgcccccaacaggccaggctgcctttggcaacatggtccgcggcgggcacatgtactcccccaccaagacctggcgccgctggcaccgcaaggtggcggtgaaccagaagcggtacgcggtggtgtcggccctggccgcctccgcgctgcccgcgctggtcctcgcccgcgggcaccgcgtggagaacgtgcccgaggtccccctggtggtctccaacgcggctgagtcgctgaccaagaccaagcaggccctggccctgctggcgtcggtgggcgcgctggaggacgtgaagaaggtggaggcgtcgcgcaacctgcgccgcggcaagggcaagatgaggaaccggcggtacgtgtcgcgcaagggccccctggtggtctacgccaacgactcgggcatcacccgcgccttccgcaacatccccggcgtggaggtggcctgcgtggaccggctgaacctgcttcagctggcccccggcggtcacctgggccggttcatcgtctggacgcaggccgcctttgcgcgcctggacgccgtgttcggcaccacctccactgccagcgagcagaagaaggggtaccgcctgccgcgccacgtgatgaccaacggcgacctggcgcgcctgatcaactccgacgaggtgcagagcgtggtggccccggccaagcccgccggcaagcacgcgccgctgaagaagaacccgctgcgcaacctgggctccatgctgaagctgaacccctacgcggccgccgcgcggcgcgccgagttccgcgcctccgccaagaaggcgggcaagaaggcgcgcgccccgggcaccaaggacaccgccaaggccttctacggcaacatggtcaccgactccgactacatcggcgagcagtacgaggtgttctccgcctggctgggggcggagcagtga

SEQ ID NO: 3492 - DNA, 885 bp, Chlorella protothecoides
atgaatcccatctccaatcttccacaaaacaaacaggtggactccaccttccgggtgtcccacaccgacccctggatccggggggacccctaccacacctcccgcagcatcacagtgcagagcaccaaggcctcggtggccgccatccacggcaaggcagtcggagaggacgtcgccgggcccgggccggggtctccccgcccgccgcagccgaggcccggggcgcagggcgcgaggtgcgaggctgggtttgaaccggggagggggtatggtgttggggagcttgcaggggacacgaatgttggaatgggccgggcttggaatcgcgcagggcacagcgtacacgcggccccaagcgcaggctcgacgtggcaggctgcaccggcagtatgccctctgtctgccagccttcctctccatcctggcggcggcgatgactttcatgcgtgcgtacttcagggaaccccccccacacacacgcacacacctccctacccgctcatcgtctcttcctccctgcctgcagcagcctcgccgacgcctcggccgggtccatctttgtgtcgagggtcggcggcagcgtcgagtggagccgacccctgggcatcggctggcagggcggcctgggcgccagctggcagagggccacccccagggacgagcgcgcgaggcccctggaccaggactgctatggcggccagctcaccatctccgggacggggcaggacacgatggcgctgggcattctgcggctggcatacgcgtgaggggagggagaggacttttgggggggggggaagacgcgtgcccggctggtcttgggtatcagaggaggtggaggccggggattattggagggtccttctgaattgccaagctccatag

SEQ ID NO: 3493 - DNA, 1083 bp, Chlorella protothecoides
atgagctcaactctgaccggaacagatggtgtgtgtgaaaagccagcagagagcccacgcagtctaacaaagggtaatggaagatgggtgaggatgcatgacgaggtgatcagtctctgttgcattctgagcaaagtcgcaaagggtgccctgcctcatcagaccagtgttttctggagtcgaataaggtcgcgggcagcactttcccaccttcctccggccttccccaccgacgcactcaaattacccgagagtaacaacaggatcggtcggcatggagcaatgcaagttcccaacccacccatgctacgtgtcgatggatggacgtgcaaccgaccgcgatgtgagtacacatctgcagcgctgagcagaagacaaggcctgactgcggcacactggaccatgcgccagccgaggtctacacattggcacaaggcttctattgctcaggccagcaccggcgctgtctccacctcctccgcaccacccagctcctggacaaggatgtgcgaatacgatatctggctgccaggtgagaagaatggatgttcaggtgcggtgactggcacggagggaatgctggtcaccggtggcagcctgccgacaggtgtagggtgcatgctggcaagcggggagctggacgagtgtctggagctgttgggcggggaggaggccgcgggtcccggtgacctgcagctgggcgccctgcccccctcctcacccggcaccgtcagctacctctctgtggtgtgcatgctgcgcggccgcgtgtacgacgcccaggagaacttccagcggggcacggcctggtaccatgccgcgctgcaggcagacccattcaactacgaggccttccacacgctggtgggcagccaccggctgaccccggcggaggaggctgagctgctggacagcctcgccatcccgcccgagcacggctggctgggcctcctctatgccgcacgcagccggcagcacgacgccggcagccgcgtggaagctgccctcggtgcgctgggggggatcggtcagtacatggctcagagcgcaggcctctccctgtcggaggacattcgatcctga

SEQ ID NO: 3494 - DNA, 384 bp, Chlorella protothecoides
  modified_base (6)..(15): a, c, t, g, unknown or other
atgctnnnnnnnnnngaccctcatcaacttcttgtccatcccgagcaggcgtattttgcgccctacccctcccagcgccatgctgagctggtggcggagctgcagcagatggacggcgtccagctcagtgtcctcggtcaaacgctggacggcagggacctggacctgctgcaaataggtgtgttgttctggagcagagctgggtcaggggtgttgggcagctgcatcgcagagttaggaccatgttcaggaccggcaccctcccgtcccccaacccaggcacgcctggagaagggaagcgggtggcgtggatcattgcgcggcagcaccccggtgaaaccatggcagagtgggcagccgaaggtacggagggggggaagatag

SEQ ID NO: 3495 - DNA, 894 bp, Chlorella protothecoides
  modified_base (753)..(762): a, c, t, g, unknown or other
atgcagcatcatatccaatcgcccagaagtgaaggcatacgcgagggcaagatccttacaggtagacctccatgccggattcaggtgttccggcatggagcccatgtccggatcagggtccgatcgcgcagcagcgttcgacatcctgcatatagctgtatacaacgatcatcgccggaccctggagccgagggtgtgctgtctcggtgctccttggccttgcgtgctgaggggcagcatggagtcaggagagcccatgcatggggatggttgcagtatgccacactttgcaattcccggcactctcagccccatgtccatttacctacacaccacgcaatgcttcgcccgctgctccctctaccaggcgccaacttggcctcccagttcgatagacacgtactggacaagggatggacagcgacgccgcggcggaccccatcccccctcctctcccctggagctgtcatctcagcccaactagaggccctgcagaggaacgactggccagaggagggtgcgggtgtggccaccgcctttgcatttacactcccagcaagtgcaacggaggcgggggcgctggactcggtgaggaggaagcttgttgtgcttgcgggtgctcatgggttggcggagtgggctggggcacacactttgcaagcaacactcctacctcagcacaaagcatgcagcagcttgaggaggcactggcaaagcaggaatcggatctccatggccacctcaccgcagacnnnnnnnnnntgcatgcagcagcttgagcaggcactggcacagcaggagtcggatctccatggccacctcaccgcagacgggtgctgtggcggtctcacggtggagcggggagcgaagcttcgtgccccgacctgcctttga

SEQ ID NO: 3496 - DNA, 651 bp, Chlorella protothecoides
atgcagcgacacataatcccgatgcatgtcccaggtctgcatgtggaggagctggcggtgtgcagcgaggaggctgggcctgctggcctgcatccgcaggcctgggttcccctgcgcctgatcaggtccgccgccgccgcagctagcccccttcccaccatcgtcctgttgcactacaccagcggcaacatgacgggcatggcgccccaggcagcggtgcttgccaggaggggctacctggtcgtttgcatcgacctgaggtaccacggccgccgcaacttctcccgcctggacgactttgctgcctaccaggccgccctcgtcgcggcctggcacggcagcggcgagcgtcccttcctcctggacaacgtatgggacctcatggtcgtcgcagactacctcgtgcagagcaggacagacgtggacccgtcacgcatcgccgccatcggcgtcagcctgggcgggatgcacgcgtggctgtgggcagcggctgacgccagggtcgcagccgccgtgcccctcatcgccatccagagtttccggtgcgggccagggggggtaagggaatctaaaggccaaacgaatggggaactctggcctggtgatgtgggatgggacagcagggagaggcacgacgcgtggtggggttaa

SEQ ID NO: 3497 - DNA, 1305 bp, Chlorella protothecoides
  modified_base (6)..(15): a, c, t, g, unknown or other
  modified_base (1091)..(1100): a, c, t, g, unknown or other
atgatnnnnnnnnnngtaagggaatctaaaggccaaacaaatggggaactctggcctggtgatgtggggatgggacagcagggagagacacgacgcgtggtggggttaaagtacgccatcgacgagaactgctaccatggccgggtcagcagcatcccgcaggtcttccaggtagccgcaaaagatctagggaaggaggcggtggatgccgaggtggtagcagtggtctgggagcgactgacgccgggactggttgacgcctacgatgcccctgcctccctccccattattgcaccgaggcccctcctcgtggtgtgcggacaggcagaccctcgctgcgtcattgatgtgagtaggagcctgccgctgagcgctacatgctctcgcccccagagcgcgctgtgttcagaaggcactgccagtgatgaccagcaagctttcgtgatcctctccacggtcgtgcctcgcagggcgtctactcctccatgcaagcagccgtggaggcatatgccgcagcgggtgcagaggatgccgtggacctcattgtggaagagggggtgggccatgtgtgcacccccaccatgtggacagcggcattcgattggctggatgagaagctgcaaaaagcatgatgacggtgtgagatccctggccgagtccaagggatcggctcacagtccaacttctgtgtgtgcacgcatgacgcagtgcatgtgcactcgtgccagccttgcttcagcccaaccaacacaccctccatgcatgtgcactcgttccggccttgctccagcccaaccaacacaccctccagcgcgtgttcttaatctgtctgcaccaccttatgatgcaagcgacccaaggtcaacctggatgctgaaagcacatgtgcgccatcatgcctggcgcttgcaacctccagcccccaagcacactctcaggagctgtggattcaggacactcttactgaatgcaccattggttcccatcaaacaggcaaacctcccaacagcaattcgcccagtcccagcctgccttggaggcaccaccttggggatacccatgatgacagcagattgcttgcatgatgcgannnnnnnnnntatcaaacaggcaaacctcccaacaccaattcgcccagtcccagcctgcctgggaggcaccaccttggggatatccctgatgacagcagattgcttgcatgatgcgatgaacaggcatcacctcggatcgagggggagcccactgatatgcacgagaaggtgtgagcaggagattcaaggccaagttatcaacacaaaagtatga

SEQ ID NO: 3498 - DNA, 1017 bp, Chlorella protothecoides
atgttcagagcctccaggcgagcgaggatgtcctgctcccctgccatccctatcacagcacccaggcgttcaggcgcagcacgcactgtgctcatcgacttgaaaatagggaatactatgcaatggcatccatcgaggaggttcctcggcccatcgcacctgcacggctccgcttcgtgcgtgctgcgctgtgtgctgtgccctggctccctcatatccggatcattactgcttggagaagtactcgagggaggccttggggctgggcttaatggtgtcctcgccctccttccagttagctgggcacacctcaccgtgcttgtctgtgaactggaaggccttgagcaggcgcaaggtctcgtccacggagcggcccacgggcaggtcgttgacagtgacctggcggaggatgccctcgggggagatgatgaagaggccgcgcagggccacgccggcgttctcgccctcctcgatgaggacctggtagtcggcggagatggacttggtcagggggagtccacgctcgctccgacgacctgcagcgggaggagggcgggggtggatgagcgaggatgggcaagcggagcatcctggaagggaccatggccgtcgtgcacagggaagccgtgggcgggcagctcagcttggctgccgctccttcactccatgcacactacggcagcctcccgcgggatgccctggaccaggcccctacgccaggcccagccacctgccacccacctccacgccaatgtcgcggaactcctggatgcgctcagagaaggcgataatctctgtggggcacacaaaggtccagtccatggggtagaagaagaggacgacatacctgacgtggggggcagaggagcaggcgcgcaagggcgacacccagtcgagctcctcgctccctcagaaatggcacactcactttcccttgtagtcatcgaggcttacggtcttgaagtcgccatctacaacagcagtggccttgaaggcaggagctgcaaatcgtggtga

SEQ ID NO: 3499 - DNA, 5349 bp, Chlorella protothecoides
  modified_base (110)..(119): a, c, t, g, unknown or other
  modified_base (471)..(480): a, c, t, g, unknown or other
  modified_base (1062)..(1071): a, c, t, g, unknown or other
  modified_base (1311)..(1320): a, c, t, g, unknown or other
  modified_base (1829)..(1838): a, c, t, g, unknown or other
  modified_base (2308)..(2317): a, c, t, g, unknown or other
  modified_base (4468)..(4477): a, c, t, g, unknown or other
atgcacaggaacctgctggttgccaagctgcctcccaccaatcacggctgccggcagcacctcgacagcgtcggcaacctggagggacgacgtgcaaggcacctgcctgnnnnnnnnnnggctgccggcagcacctcgacagcgtcggcgacctggagggacgacgtgcaccgcacctgcctccctcatcaggccatacataggcaggaggagcatgtcaggacggatcatcgcttgggagtttcatcaaatactccatcgtcacccccctgctcgacctcgctgccgggtgccctcgccgccctctgcaccccgccccccccacccgatacttcgtggtcggatgtggaggaggacaccctcctgcaggtcgctagtctggagcgtcgtgctgcgctgtcacatgcagagtccggggtgggaggcccgccggctccatccccgcctgctgggacgctgcagcccgggctnnnnnnnnnnatactccatcgtcacccccctgctcgaccttgctgccgggtcgccagtctggagcgtcgtgctgcgctgtcacgtgcagagtcccgggtgggaagcccgccggctccacccccgcctgctgggacgctgtggcccgggcgcaaccgggcgtgcatggcacagccggtcatcaaacccgactcttcacccagtcacgacctgcgtgcctacctcccaggggatgtggccgaggtgtacttgtcctcaaccatgaaaggggccaacctttatgagtggcaggcagaggctctggccctgccaggcgtgctgcaggtgggttgctggtgcagacggctggaggacagtgttgctgaagcagtccattggctggcctaccctgtccagcaggggctcacacggcatccatacccactccaggggggtaacctcgtgtacagcgcgccgacctctggtggcaagtccctggtcgctgacgtcctcatgcttcgcagcgtcattgcctcagggcggcctgccatgctggtgctcccgtttgtgtccctgtgcgctgaaaaggttgcgcactaccagcgcttgctggtnnnnnnnnnnggtagggggatggcccaccacacagggtctttgcctttcctgttctgtgtctgcgcgaatctggactggtggcccgtgctcccctttgtgtccctgtgcgctgaaaaagctgcgcactaccagcgcttgctggcgccactgaagaaagaggtggggcagggcagtccaaggaaccccgagggctgctttgtgtcttgtcaaggttgttgggcggggtcctattacacacccaggtggagnnnnnnnnnnagaggtggggcagggcagtccaaggaacccggagtgctgctttgtgtcctgtcacggttgttgggcgggatcctattacacacccaggtggatctcccccaagcacctcaggtctgtgaagcctatggggccaagctcttacagcagatgaccatcggacctgacacgggcatcatcgtctgcaccatcgagaaggccaacatcctcctcctcaagtccccctgtgtccttcctcacacgactcccaccccaccttttcgactctggccagggtcaaccggctccttgctgcccaagcactggacacactttcctgcctggtggtggacgagctgcacatggtgggagaccaggagcggggatatcagctggagctcctcctcaccaagctcatgtgaggtttcagatcacttgatctggggctggaagacagggcaagcagcatctactgctcaaggatgggtatggacccttgcgaggaacctgaggcatccacgtatgcctccacnnnnnnnnnnatctggggctggaagacagggcaagcagcacctactgctcaagcatgggtacacagctgtaggcagtgacaacctgccattggacactttgggtcatcaggatctccacggctcacttgcccagcgaggtttgagagatggccttcagatcgtgggcatgtcagcaaccctcccaaatcttgatgtggttgccagggacaccaggaatgagataataagggcaagatcattgctggctggaatctcaggcatccccatccactcactgagagcaggtatggtgatagttgatggtggagggatggaaggcacatcttcagggcacacaacctgagggaggcgaaactgtgagacatgtggctcgcctcttccccccaaaagaagtgcgtccactggcggagagtgtccatacatgtgttctaccctcctccctttcccctcagcctgtgcagtcccctttcaaccccatnnnnnnnnnngtccatacatgtgttctaccctcctcccttgtcccttcagcctgtgcagtcccctttcaaccctacctcgcccagcccagtctctgatctcatttctgcaccaggacccagacttctgtgcgactctcgctcaggagatagtgagccaaggccattctgtcgtcgtgttttgtggaaccaagaaggcctgcgagacagtcgctctgaagttggcccgaccaagtactgtcttctgtgactttgtggggctgcctggccaatgctcctcctgtggtcctgcctttgcatcatccatcaccagcatctactacatctcctccatcgcctcatcacccaggctgctcaaggtccctcaacgggcaaggagcgactgcggtgggatggagcagcgatcgcgcactgatgtggcagccctgcttgggcagctctccgcctcagacacctgcctggcagagtgtgtgcgtggtggcgtcgcctttcatcactctgccctttcctcagaggagcgtcaggcggtggagggcgcgttccgcgccggatcgatctcggtgctggcggccacgtctaccctggctgccggtgtcaacctccctgctcggagggtcatcttcaagcaagcctaccagggtgcggtagcgtggccgcatctttactctgagtattgccccaccatccctgcgatgcaggtaccgtcagatggcggggcgggcggggcgggcgggggtggacgccgagggagactccatcctgctgactgggacgggcgtcaccttgcacagcttgcgagccctcgtgcgagccccagtcagtcccatcgccagctgcctcacagaggacaggaaagccggggccgagcttgcgccttgcagcccctcccactctggttccccttcttaacccataatgttcctggtccaggcatgaagagagcaatgcttgaggtggtggcgacaggggtggtcacagagccgtctgatgtgcagcagtacatccgttgcacccttctggcacacatgaactcatccaaggcgagttgccgggctggacatccagcctcctccatctcaagtgtggggtttttggatggggccgtacacttggtgacagggcgacatcaagaacgcgcccagctaccgcctgtgcccccccgcagatcgtgcgcccctgggcacctccatgtgcctgctgtcattcatggggcaaccgttcaccacaaagcctcccagaacacgagtcatgcccctgcttgcattgcaaggaggagcaggcttgctccaaaggctgtctcatcaagcgcaccaccatcccacccgctttctcctggcgtcagggcgtcagacccaccttgcctgggactatggctgattgccatgcctgagcggccgagccagtggggcctggtgccactgccctgtaccgcacacaccttccggacccacattgagtcgctgaagttccaattgcttctccatccacctacactgccacacctccttgcacaggcagaccttcagcgggctagggagtgcattgtgctgacgtcagacctgcacctgaccttcctctgcgtctccccgacagacaacctcatcccggactggcggcgcctcctgcagctcatcaactccctgcaggcatgtcggcgctcgaatctttgggaacgactggcatttggacacttcgtgccttccttgaggcacctgatggcatggagcgaaccgatcgctgcgcctactggaggccagtcagggccatccccgtcttggagtctgcctgctgaggcaccatgcacattagcttgcaggagcagtacttcaggacagcaagctcagctccccattcctgccctgcgcgcagggcgccgacgcaaacgtggcctcacacgtcggcttgaacctgggagccatcatggcacgtgcgcatggatatcaccaggcgagtcgggctggtctctcggtgcaacccaagcatcgaccagcagtaatgtgacccccaacccctctcatcctctccagagatccagcggcaagcccgaggcgatgactgactctgagcgtgtgggacgcagattttgggctgcccttatcctgagggatgtcttggcagaggtgaggggaggctgtgcatgtggagtgtgctcagccaaaccannnnnnnnnnctctccagagatccagcggcaagcccgaggagatgactgactctgagcgggtgggacgcagattttgggctgccctgatcctgagggatgtcttggcagagtatcttgcagatggccctgcagcccttggcactttccaatgcgaccacaaccgacaggtggacctgcaggaaatctcacgcaagtttggcgcggcacagggtgctatccagggtctgcaggagcggagctcgcgctttgcgtccatgctggctgccttttgcgagcgcctgcagtggcaggacctggagatgctggtctccaaatttcaggccagggtcctccagggggtaaggcccgagctccttgccctcactgagatcccctttgtgaggggtgagtcaacagggaagggagttggagcctgggaacgacgcacttttctgctgacgtccaggaagcagccttgcagtgacgtctcgctccacaatccccggatcacatctgtcgatggcagcaccgaaacatccatgcccacaacagcaccttcgcccaccctgggccctcctcagaattacactgcacgtaagctgtacagcgcggggctccggagtccggatagcattgctgcactggaggacgagacactgctcatagaaatcctcgctcgcggctccatgggcaggtgcacatcatctgtctgctggctggctttcaactggggtgaatctccattataccaacctcaatctactcaagtccccactgtgcagcgcaagcgcactgcaaagcaagagagcggcacgagagatcctgctcggtgccaggaacatcgtaagcgccaaacgcagagaggtgcttgttccacttgcggtcgacagtctctgaactga

SEQ ID NO: 3500 - DNA, 603 bp, Chlorella protothecoides
atggactggacctttgtgtgccccacagagattatcgccttctctgagcgcatccaggagttccgcgacattggcgtggaggtgggtggcaggagcggcagccaagctgagctgcccgcccacggcttccctgtgcacgacggccatggtcccttccaggatgctccgcttgcccatcctcgctcatccacccccgccctcctcccgctgcaggtcgtcggagcgagcgtggactcccccttctcccacctgcagtggatcaacaccccccgcaacaagggtggcctgggcggcctgaactaccccctgctggcagacctgaccaagtccatctccgccgactaccaggtcctcatcgaggagggcgagaacgccggcgtggccctgcgcggcctcttcatcatctcccccgagggcatcctccgccaggtcactgtcaacgacctgcccgtgggccgctccgtggacgagaccttgcgcctgctcaaggccttccagttcacagacaagcacggtgaggtgtgcccagctaactggaaggagggcgaggacaccattaagcccagccccaaggcctccctcgagtacttctccaagcagtaa

SEQ ID NO: 3501 - DNA, 2460 bp, Chlorella protothecoides
  modified_base (541)..(550): a, c, t, g, unknown or other
gtggccgccccgcggagcgcgccccccgccgaggcctcgccgcccggcgcctcggggtcctcctccgcgatgtcggccagctggccggcgcccaggtactccgacaggctgctatgcatgctgagcacgctggcctcgctcaccgcctccgccccacccgccgaggtggtgcgcgacaggggcgccgatgcgggcccgccgcgatcgccgcccagcgacccctcgccctgcatcagcgacaggcgcaggctgggatccagcggcgccccggccatcgccatcagcgcggcctgggtgcgaggggggaggggggggagcgggggacgtcgaggtcggcaggtccgactagggatcgtgagggggcctgcgccgccgcgggcgcggggcgcctcgccaacgcaggactcgggagagccccggctcagacagcgcccggaccttccgagctcgcacggcactcttcccctcccaccagacacggcactctcctcctcacgcaacccccctccccccctcctccccccccacaacacacacacannnnnnnnnngacgcaggactcgggagagtcccggctcagacagcgcccggaccatccgagctcgcacggcactgttcccctcccaccagacacggcactctccccctcacgcaaccccccttcgcccctcctccccccccacaacacacacacacctccgacttggcgccggtgaccccctgcgcggcgcgcaccgactcgaagaaggggtgcttgagcagcgcgcgcgcgcggggccgtgcgtcgcgcggcagcaggcacaggttgatcagcgcggagagggggcccgggggcaccttctgcagacccgcgggccgcacgcccagcgacaccttgcggtagatctgggccgcgttcttgcactccgcataggggtactccagcgtgctcagctccagcaggcacatgccgaaggagtagacgtccacgcggtcgtcgtactcctcctcgtacagctcgggggccatgaactctggcgtgcccagcaccgactggggcgcggtgcgggagcggagcagcgtggccaggcccaggtcgccgatcttgaccacgccgtcggagccgttgatgaagatgttgtcgcacttgaggtcgcggtggatgatgggcgggttgtggccgtgcaggtagaccaggccgcacaggatctgccaggcccagcccttgagcacctcggggtcggtgtggcggtgccggcgccggtactggcgcagcgtgccgctggtgaacagctcggtgatgaagttgatggtgccggcgcgggggtcgtaccacgaatcgctgaaggacatgatgttcttgtgcttcagcgccttgagcacgcgcacctcggcgaagatgcgctcccgttcctcccggttctccgcgtccttgttagggggatggaaccctttgtgctgccccggggatctgggcatgcggagcacagggcacgccggcgagcgcactccatgatcgccgccgtcccagccccctccacgcgcccctcccccattgctcaccctcctgggtgtcaaaggccttgtacaccaccttgcaggccccgcgccccaggacctgatcgaactgcggtatgcagagggggcggcaggcctggggtcctgcgcgtggagtatgcatccccacccagggaaccctgccctcatcgggacacccccttcccatcccccgcatttaaagtgggacagcccatgccctgcgcccagcctccgcccccctggaccactcaccctgccatatctaccgctggggtccatctccgcgaacgttgggccgtcgtagtcgctgtcggggggctccaccccggactgggccacatctccggaggcagggtgctccgtgaggctgccctccgccatgacgccaggcctccgcggagaggccgtgaggataccgatcacgctattccgcgcaagcgagggcgacatgcgcgggctgggataggcgggacccagaaggcactgtcgctgaacgcgccgggtgacggaaacgtagttacccgtcaactccaacagcgctcccaagattctgccccggctagaggggactccaatcccgttcaagtctcatccaagaattgccacaagccgtcagctctggccgattcgctacctgtgcgggcacaagtccgggacccaccagcaggtaggggttcgctccttgccaaaacgaaggagtcagctgctccgagaatccagtcaggctggtctgacgctcgccctggttcccctgcgatgacagtgctgggtggcctggcgagcctcctcgggcgcgggaggcgggtcacgcggactggattcacgcagctcacgtcaaagaatggacctcgtaatttctataagggaaagggctgtcttccgacggggcagcataccaagaaaggtgtgaccccgtcaggagggggtcgttgggggtggtga

SEQ ID NO: 3502 - DNA, 912 bp, Chlorella protothecoides
atggcggcgctgcagcagaaggtcaacccgcgcgagcagatcgtgggctggttctccacccacgccgaggtgtccggctccgacgccctcatccagtccttctacgccaacgagtgcgccagcccggcgctgctcaccgtggacaccagcctccgcgacggcgcgctggccgtgcgtgcgcacgcctcgcgcgcgctttccatccagggccgcgagctggcgcgagagttccaagaggtggcctgccgcatcacctccaccgacctggagcagctgggcaccgacctgctggccacggaggagacgaggctgggggcccaggaggaggaggaggaggtggtggaggcgctgcaccgcctgcgcgccgcgctctccaccgctgccgcctacgtcgacgccgtcgtggtgggtggtggaatgggggaccagttgtttgcgtgtttcaggggtggggaaagggagacggatgcatgcaggcgctggccacagcacccacacgtaagccttgggccattggaagacatggcgcagcttcagcgctgcgcaccgctccagtcagcgttcctcgctacttctactgacattcctccacaccgcacccgtctgcactccattcacgcaccgagtccttcaccctcctcttcgacccgcaggcgggcaagacgcccgacaagctgggcaccatgcagctgcccctcatttgaggggctggtgtggggtgtttgtacggtgggtcggtgtgggctttgccgagtgcggcgctgccccggggctcttgtccatggcacaatgcagcgtcatcaggacgagcacccgagcatcccaggtgccaacactcctgtcctcgatatcatgttgtacacaattactctgcgggccaggcattcaagtggggaattcttcaaggagtaa

SEQ ID NO: 3503 - DNA, 729 bp, Chlorella protothecoides
atgctgcgctgggctgccgctcgcggctggctcttggcccgagcccagcccagcgccgagtgtgcctggcgggccttctccacccctgccgcccctgcagcggcggcagcgacgggggcgcacgccgccatcccccgccccgcccccaccctgtcccggcgggtgcgccagctcatgcgggagtaccgccagctgtccaaggcccggctcagcgcgctggtggtggccacctctggcgcggggtatgtgggcgccagcggcgccgccgtcgactggcccggcctgggctggacggtggcggggaccgcgctgtgcgcggcctcggccaacgccctgaaccaggtgtacgaggtggccaccgatcgcctcatgcgccgcaccgcggcgcggccgctgccctcggggcgcatgggccgaggccacgccctggcctttgccgccgccaccggcctggccggcgtgggcttgctggccgccaagaccaacggcctgaccgccgggctgggcgcgggcaacatcgtgctgtacgccggggtctacacgccactcaaagtcgtgtcggtggccaacacctgggtcggtgcggcagtcggggcggtccctccgctcatgggctgggcggcggcgtccgggggtttggacgtgggagccgccatcctggccctcggcctctacttctggcagctcccccacttcatggccatcgcctggctctccaggtgtgtttga

SEQ ID NO: 3504 - DNA, 672 bp, Chlorella protothecoides
atggccctgaagacgctggtcatgctgggagccctgctccaggtgctcgtcaagggggccaagttctcgctgttcaagcccgcggaggagatggtgtacatcgggctggacgacgagtcgcgcagcaaaggtgacgagggcagccatgggtcccccctgctgtcagggagcctcccgtctgcttggcaaccacgtgccacggcggtgcaggagccccagacggccgctcttcccaatctccttacggcagagccgggcagacatggctcatggctggcaagtttcacagcaaacgctccacctctatgcacaggcaaggcagccatcgatgtggtgggggcccagtccgggaagtcggcgagcagcctgctccaacaaacgctgctgctcctcaggccccacctcacggccgcatctcacacctcacaccgatatcaacgaccacattccaacattaccaccctttgcagtggcggccagctccccaagaccctccccatcatggccctcttcttcgccaccatgctgcggcaatggatcggcgccgtcacagtccttgccgggtatgttgggagcgaggaggcggcgcaggccgacgccaagcagccggcgggaagcgagaagggcggagtcgcaccatcgccatccgctcaggatctggggctggcctga

SEQ ID NO: 3505 - DNA, 1173 bp, Chlorella protothecoides
atgcatactccacgcgcaggaccccaggcctgccgccccctctgcataccgcagttcgatcaggtcctggggcgcggggcctgcaaggtggtgtacaaggcctttgacacccaggagggtgagcaatgggggaggggcgcgtggagggggctgggacggcggcgatcatggagtgcgctcgccggcgtgccctgtgctccgcatgcccagatccccggggcagcacaaagggttccatccccctctccccccccccccccaaaaaaaaaaattaccacaaatgcaggcatcgagctggcctggaaccaggtccgcggcatggagttcatgaacaacaaggacgcggagaaccgggaggaacgggagcgcatcttcgccgaggtgcgcgtgctcaaggcgctgaagcacaagaacatcatgtccttcagcgattcgtggtacgacccccgcgccggcaccatcaacttcatcaccgagctgttcaccagcggcacgctgcgccagtaccggcgccggcaccgccacaccgaccccgaggtgctcaagggctgggcctggcagatcctgtgcggcctggtctacctgcacggccacaacccgcccatcatccaccgcgacctcaagtgcgacaacatcttcatcaacggctccgacggcgtggtcaagatcggcgacctgggcctggccacgctgctccgctcccgcaccgcgccccagtcggtgctgggcacgccagagttcatggcccccgagctgtacgaggaggagtacgacgaccgcgtggacgtctactccttcggcatgtgcctgctggagctgagcacgctggagtacccctatgcggagtgcaagaacgcggcccagatctaccgcaaggtgtcgctgggcgtgcggcccgcgggtctgcagaaggtgcccccgggccccctctccgcgctgatcaacctgtgcctgctgccgcgcgacgcacggccccgcgcgcgcgcgctgctcaagcaccccttcttcgagtcggtgcgcgccgcgcagggggtcaccggcgccaagtcggaggtgtgtgtgtgttgtggggggggaggaggggcgaaggggggttgcgtgagggggagagtgccgtgtctggtgggaggggaacagtgccgtgcgagctcggatggtccgggcgctgtctga

SEQ ID NO: 3506 - DNA, 858 bp, Chlorella protothecoides
  modified_base (393)..(402): a, c, t, g, unknown or other
atgggaccagcgagccgtgctggagatcactcccctgagccccagcataacgtggccttttgtctagaaggaagtggcgtcgaacgcgctcgggtctcggccaccatgtcggacgaggtagtgtgcccgaagcctgaggaggaggaacggtgcaagccacgatgcaccaagtacttgctagagtatgaggtaagcctggggtcgatgaggtgggaatgcagaagggtgcggggaacgacggtggtggcggggcccggtctctctcgcacggacttgagccacctgacccattccgacaggcttgcggcgagcgagtcaagaatgacaccactggggaggcgcactgcacaggccagtactttgactattggaggtgcgtcgacaagtgcgtgnnnnnnnnnnacaggccaggtgagggtgaatcgtgctgcattgctcagtgtgtggggtgagtactttgactactggaggtgcgtcgacaagtgcgttgctgcacgcctatttgacaagctgaatctgaatgtagaatgtgtggatcaatccagagcagatgaaggggtagagtcttgggcaagggttgctgggcacctgggaggtgactggctcacttgcagggagcacattgacgcaatagacaccctaagacagagcatttccaatctactcgttgcaagatcagagcatcctggttcctgcaaagtgcaaatgacgcacattgtcgcaaaaaaaagcctaagacacagcatttccaatctactcgttgcaagatcagagcatcctggagggttgcaggctgtccaacatagtgggtcacaaacgatggaggaatcgcgaccaatggagatgattcgcatacct

SEQ ID NO: 3507 - DNA, 1110 bp, Chlorella protothecoides
  modified_base (245)..(254): a, c, t, g, unknown or other
  modified_base (644)..(673): a, c, t, g, unknown or other
  modified_base (1001)..(1010): a, c, t, g, unknown or other
  modified_base (1094)..(1103): a, c, t, g, unknown or other
atggcccccaaacccgccggcccacccaaggccaaaggaggcgggaaaaccatcgaggggggtggtgtagacgccaagtctcggatagaggcgatcgagagggagattcaggagcagcagaagctgagagtccatgctcagctcgagagggtgaggcacgcggcactagcttggcatcctcactgttacatcaagctcgcaaagctccagattggatcactcctggatcactcatctgctgaagnnnnnnnnnnccagctcgagagggactgggtgcaggaacgctgggaggcttccatcaagactgtggccgcccttgagaccgccttgcttgctaaagaggtcgaagccgaggcactacagacccaacatggcctagacctcaaggtgtatcgtgctcgcgtgcgacagctcctggcagaggtaagggatggcgctattcagatccagggtgcagcagcagccgaggctgtggacagggaggctggagctgccaccagagaggcatcgctgctgcaacagatcctgaggtgggatggcactggcggggcgccttggacccgctggaagggcatcatagcaaacatgaacaacatccccatccagaaaggtcgctggttcccaaccctctcgactcctctctnnnnnnnnnnnnnnnnnnnnnnnnnnnnnnagggggttcatcgtgaggaggccttgcaccaccagcaatcactggatgctgctgtggcatctggcacagagggtgcacgagctgcttggagaagcgctgaggagaggactgcctccctgtgccaggcgtttgcagaggagctggagcggatgtatggacaactagaggactgctatgctcaagacttggtagctacggtttcgtctgcgcaggcgtctgctgcctccctcatcgccagccatcataaggtaaaacggggccctcagtctctgcttgtttcccgctcttcgcatgccgaacgagccgaccgtgtgctttggctaacatnnnnnnnnnnaacagcgggtgcacgagctgcttggacaagcgctgaggagaggactgcctccttgtgccaggcgtttgcagaggagctggagcnnnnnnnnnncaggtag

SEQ ID NO: 3508 - DNA, 276 bp, Chlorella protothecoides
atgtacgtggagatcgagcgcgcccggctgacccgacgcctcgcccagatgaccgaggaggccgggaaggtttcagaggctgctgacatcctgcaagaagtggcagtggaaacctttgggacaatggccaaaacggagaagattgcttacatcctggagcaagtccggctgtgcttggacaaggaggactttgccagggcccaggtggggaaagcgcttgcagggcaggctcaggcatgcctgggccaggggagggatgtgcggcctgctgcctag

SEQ ID NO: 3509 - DNA, 549 bp, Chlorella protothecoides
atgctggctcctgcagccttgaagccgacatacagctcattgactgtaggctgtttgttaccagcatcacaccaccttcaccaagacaagtgccatctccaagttctgttcctgcttccaacgccacagatcctctggtggcagctgttcaccgctgacttcaaggcagagctcgaggccgcggacggcatcttcgggggatccaagggggccaagctccgcgaaggtgcggctgcgtctgcaggcttgcggctggtctggttggggccatgcgtctgtgggctggctgcccgcgacttggtgtccaatgccgagtgccagccccgccctggcccacgctttacacccctatcccctgcagacctgaagctgagagtggtggagcacaacctggtggtgctttccacctactactccagcatcaccatgcagcggctaacgcagctcctggacctgaccacggacgaggcggaggcgcggctgtcggagatggtggtggccaagaagctggaggcacgccttgataggcccgctggtaccatccggtga

SEQ ID NO: 3510 - DNA, 426 bp, Chlorella protothecoides
atgagcgtccccgaggacgcccccatcagcatggaccaagatgctcccaagtccacgagcgcaccatccaagaagcctgacatcgaccctgtgaaagtagaggaaggcattgccaacgcccgtgctctggcagcccagggctctcgggaggaggccatcaacgccctgctgagcatcgagcagaagggccgcttggccgaggacgtggcaatcacccgcagcgcctgcacggccatcctggaggattggactgggctccaggacaccctgctcctgctttctaagaggaggagccagctgcgccaggttatcacggccatcgtgcggcaggtgatggggtatgtggacgacactccagacctgcagaccaagacggccctcataaagacgctgcaggacctcacagagggcaaggctggggcatga

SEQ ID NO: 3511 - DNA, 1923 bp, Chlorella protothecoides
  modified_base (914)..(923): a, c, t, g, unknown or other
  modified_base (1177)..(1186): a, c, t, g, unknown or other
atgcagaacgccgtggccatggccatggccgcctccctttcttcggccacctacgacgacctcctgcgcgacgtctcctgctgggtgcgcgacctgcgtgggtcgtgcggggacgtggaggccgcgctgcgggaggtggcggcctcccgcgccgaagtcgacggccagctggccgccctggggggcgctggggacgaggaggccctgccccgcgcgctgtggctctcggagcagtacgcggcggtggaggggcggctggcggagctgcagcacagggtcgcacccatccaggaggccgtggcggggctggccaccctgcacgagtacatccaggaggcgcaggtgcttgtctgggtttgggaggagggggaggctggaatcgcgggatgggggtcgcgtcttgcaagggctaccagactgactctgtcctgcaccccctcatctcctcatgtccagccggcggcgagtgaggcggagctccagcgggactacatcatcgcgcacctgtttgaggcgctgagtcagcagggcctggacgccaaccacccacttggggcctggggcaacggggagcgagatggcagccaggcaggtcgggggtgccaggccagggtgccgcgtgtgaggggtgggggctcacccggtgggccagctgggtggcaaacgcttggagtgagtggggtccatggttggatggcgatgcatcctcatggggctgtcgcttctggacacggaggtgacctgcgggacattgtacagcagctcatcgaggactgccgcaggatgccgccgctcccacgctttgtcatggccgaggaggaggaggaggcagggacgagccaggctctgagggagcagcgaatcgagtccgacgaggacagcaacgacgcaggttttcgaagcgaagcctgcannnnnnnnnngtttgaggttctgagactgcctatccacaaatcttcggaggagcagctcgatggtggagaggttttcgaagcgaagcctgcagcgcccagtgtttgtcttcaccggcaactgcctgccaatgtcatccatcatgtccaccttcacccctggcacgcaggctccatcgaggccatgcccagcgctcccgtcctgctcaaggaagaaggtccctcgcaccgccccgccgtcccctctctgaacctcccgccctcgnnnnnnnnnncgcctgccaatgtcatccatcttgtccacctttacccctggcacacaggctccatcgaggccatgcccagcgctcccgtcctgctcgaggaggaaggccccttgcaccgccctgccgtcccctctctgaacctcccgccctcgagggaagaggaggagctgccggcagcagtgccggagcctgctaccgtggcagcccctgtctctgctcccgccagcgacccagatgctgggctgcccagcgatctggcactgcacgctgcgccagccagcgagcctgcaccagttcttgcgcccgacgtcagtgcggcatcactcgcttcatcagccagcagttcatcgccagccatcccccccgcagacgatccagcaccaggtgtcgcaccaccatcacacagtgcagaccatgccgggagtggggcccccacccgccgggccaccgcatcccgagcccaggaggaggagccgcccctcgtgccaacccctccgacgccaggaggagggcgctcctcgccggacaagggcgcacgggccggtcggcccctgcgctcgccctccccgctgcccacgcccgggcaccacacgccgcgggacggcctgcgccccagcccgcgcgacgccatcgtccgcctgccccccctcgtagccctgcgccacgatctgcagcgctcggcggcgctggcggggaggggcgtgcccctgcccagcccgcgcggcggcggcgggcgggcggcggcc

SEQ ID NO: 3512 - DNA, 1479 bp, Chlorella protothecoides
  modified_base (375)..(384): a, c, t, g, unknown or other
  modified_base (435)..(444): a, c, t, g, unknown or other
  modified_base (717)..(726): a, c, t, g, unknown or other
  modified_base (1442)..(1451): a, c, t, g, unknown or other
atgggagcgagcggtgacagatgcttccccctcttccccgccgggactgcaggacgagcaatatggctgagaacagagtggcaacccccctatgcaacgcatgtacgcacgccaggccgagagtacagccgggtgccattggaaagggagagattcctgttcatgaagcagggctgctcattccagatcaccgagcagatcctccaagcagacacactttcctacgagcgcgctgtatttgtgcaatttggaagtatggctgagaacagagtggccacccccctatgcaacgcagttcgtctaaccagagactacattcggccgtcaatgcattccctcatctcgcaaagtgcttgtgagcaaccatctgagccnnnnnnnnnnaatcaacagcatgcgcatcatcaaaggcagatctaccattcagccccatgnnnnnnnnnncggacctctcctttcaaggggacagggaggatgtcacaaacttgtgtgacaatgggacaacgtagtattttactccttgcttggcatacctgtggtcggggccctgcatctttcagggcagatctaccattcagccccatgcgtctggaacctagaaccagcacgcacatggccgaatgcatccttcggctgaccagggtctcgaccattgacgatggcgggcattgcctcaccaccggcaccaacatcttccactgggaactgccttcaatnnnnnnnnnncaatgcatccttcagctgaccagggtctcgaccattgacgatgggaggcattgcctcaccaccggcatcaacatcttccactgggaactgccttcaatctccggcttcggaaggcatgatcagcccaaatttcagcctcggcatgatcagcccaaagttcagcctcggtataatctgtggactgttaggaatgcgttcatgatgacatcttggcctacacagccgggtgctggctctgcgcagcatggcgtggattccgggttccggaaggtgttgcaaaatcctcgtcagagtcctcgtcacaagagcgcaccgccagccgctcctccgacgcgcatccaccatctgtgcggctggagagcgcgtccacccttggccacgacaatttccgttgcgatggaggggaccatgcaggatgacgtcccgctggtggtcacccgctgcctcgattacgctgccaagtaccatggctccacggaggtggtgtcccgcacggtggagggccccatcgtgcgcaccaactacaaggaggtgcactccagggcgcaggcctttgccaatgccctgctgagcatgggtgtcaggtgcggtagggttgggagggggccaggggagggcatgccggacaaggctaggttccgtggtcctgtctcagccccagatggacatggttttcttcttctccgccaaatcacacaggaagggcgaccgcgtgnnnnnnnnnngggttccgtggtcctgtctcagccctag

SEQ ID NO: 3513 - DNA, 1701 bp, Chlorella protothecoides
  modified_base (1380)..(1389): a, c, t, g, unknown or other
  modified_base (1676)..(1685): a, c, t, g, unknown or other
atgtacactcaccgctccaacgtgctgcacgccatggcctccgctacgccggacggcctgggcggcggcacctccgacaccatgctggcggtggtgcccatgttccacgccaactcctggggcatcgccttctccgcacccatggtgggcatgcgcctggtgctccctgccgccgcgctggatgggcgcagcgtgtacgagctgatggcggcggaggaggtcaccgtcaccgccggcgtgcccacggtctggctggcgctgcaggcgcacatggaggccgacccgtcgcgccgcctggagcgcatgcgcgtgctggtcatcggcgggtcggccatgccgcgcaagctgctggacttcttcggcgaccggcacggcatcgacgtgcgccagatgtggggcatgaccgagacctcgcccatgggcacctttggcacgcccgtgcactcggggggggtggagcccggccccgaggagcgcgcagcgcagcgcctgacccagggccgcccccacttcttgtccgacctgcgcatcgtggatgaatcggggcgggagctgccctgggacggcaaggcctttggcaacctgcacattcgtgggcccgtggtgctgcagtcctacttcaaggcggggcgccccgcggtggacgccgaccgctggttcgacacaggggacgtggccaccatgagcccgcgcggcttcatgcagatcacggaccgcgccaaggacgtgatcaagagcgggggggagtggatctccagcatcgagatcgagaacgcggcggtggggcacccgcaggtgggcgaggccgcggtgatcgctgtgccgcaccccaagtggaccgagcgccccctcctcgtggttgtgcccaagccgggacaggtttgtttgtgggtggctgtgggggggggtgtgctgggggagtttgcatcgggccaatgctgtgctcaggaatgtggaggacgctgcgcgcgatcgcatcaccgaacaggcaatctgcctcgtcccctccaaaccggtctcttacgccgcttcccacccccagccccaacacacacgcctcaccccacccttcccgctgcagaaccccagcaaggaggacatcctggggtacctggctgggaaggtggccaagtggtgggtccccgacgacgtggtcttcctcaaggagatcccgcacaccgccacgggcaagatctacaagctggccctgcgcaagcagctgggcggctacgattttggtcccgcctccaagctctgagggcagtggggtgggaggaggggagggcctgcaaggctgggagttgcgcggagcgatgcggcaggttcggcggcctagcaataccgcagtcgtacctaagactgccagcagtggaccctgcnnnnnnnnnncgtgccgcacccaaagtggaccgagcgccccctcctcgtggtcgtgcccaagccagggcaggtttgtttgtgggtggctgtgggggtaggggtgctgggggagtttgcatcgggccagtgctgtgctcaggaatgtggaggaggacgctgcgcgcgctcacatcaccgaataggcaatctgccttgtcccctccaaaccggtctcttgcgccccttcccgcccccagccccaacacagacgcctcaacccaccctccccgctgcagaaccccagcaaggaggacatnnnnnnnnnnggtgcttgcttgctga

SEQ ID NO: 3514 - DNA, 705 bp, Chlorella protothecoides
atgggtactacatctggtcctttgccgggcagctgctctacaagtgggtgctcaatggggggtcccgagttggagactgggaacaggccaggcagatgggctagatggggagggtctttgtggcacgtcgacctggccttggccaggactgatggcggaatagagcgcccgcatgggatccctgtactgagcctccgggcagcgctgcatggcacctcctcccagcacttggtcctctcctccatctgctcccagggtggagaggaatcgcttctaccagtttcagtggaggccccgccccccgacgctgctgtcggcggagaagcagaaggccatcctgaagaacctgaagcactacagcaagaagtacgacgaggaggacgaggccattctcatgcagtcctctctgcctgcgagcgtggattgagttctgccacttctgtgacctgggaaggcgcccgagccatcctgatcaccgcgccctgctcccctctcacacaggcggacaccgagttcctggccgctcgcgagaagcagatggaggagtggcgcgagtggcaggccaccaaggctgagtgggccgcggagcaggccgaggcgaagaaggcgctgcttggggacaggctgcgcgacggggacttcaccgtgcagctggcggaggtcacggtggtgctggaggtcaaggaggaggcggttaagctgtga

SEQ ID NO: 3515 - DNA, 405 bp, Chlorella protothecoides
  modified_base (19)..(28): a, c, t, g, unknown or other
atggtctcagccgcctggnnnnnnnnnnaagaaggggtgggagtcctggatgccgtagctgggccggggccgctgcaaacccagaatgggctcatggagttctgggacacggaggacatgagcctgctgtctgctggcgagcactacatggccactgaggtccagtgggaccccacagcgtaccggctttgcatgggcggaccgggtgtgatgcgcgccagcctgccagtcatggagggccttgttggcggaggggatgtgctgaacgctgggcaacccgtatcaggccaggtgctcccagctgctccctctcacacccacaaagtgtcgtcgcccagcatgctccccctctccctctccctaaaccccaaccaccgcgaatccccgtgccaggccgctacctga

SEQ ID NO: 3516 - DNA, 1335 bp, Chlorella protothecoides
atgcgatcgcgcgcagcgtcctccacattcctgagcacagcattggcccgatgcaaactcccccagcacacccccccccacagccacccacaaacaaacctgtcccggcttgggcacaaccacgaggagggggcgctcggtccacttggggtgcggcacagcgatcaccgcggcctcgcccacctgcgggtgccccaccgccgcgttctcgatctcgatgctggagatccactcccccccgctcttgatcacgtccttggcgcggtccgtgatctgcatgaagccgcgcgggctcatggtggccacgtcccctgtgtcgaaccagcggtcggcgtccaccgcggggcgccccgccttgaagtaggactgcagcaccacgggcccacgaatgtgcaggttgccaaaggccttgccgtcccagggcagctcccgccccgattcatccacgatgcgcaggtcggacaagaagtgggggcggccctgggtcaggcgctgcgctgcgcgctcctcggggccgggctccaccccccccgagtgcacgggcgtgccaaaggtgcccatgggcgaggtctcggtcatgccccacatctggcgcacgtcgatgccgtgccggtcgccgaagaagtccagcagcttgcgcggcatggccgacccgccgatgaccagcacgcgcatgcgctccaggcggcgcgacgggtcggcctccatgtgcgcctgcagcgccagccagaccgtgggcacgccggcggtgacggtgacctcctccgccgccatcagctcgtacacgctgcgcccatccagcgcggcggcagggagcaccaggcgcatgcccaccatgggtgcggagaaggcgatgccccaggagttggcgtggaacatgggcaccaccgccagcatggtgtcggaggtgccgccgcccaggccgtccggcgtagcggaggccatggcgtgcagcacgttggagcggtgagtgtacatcacgccctggggtgtgggaacggggtgggagagatcggagggatgctaccatggagtttgaatgtgcaaggtgggcgttggggttcagtggtgggggagcggggcagaggaggaggctgggaggctacacgtgcgtgcagcgtcttcagccccacacactggcgtgcaggggaacggcggcgggggagcggggcagaggaggaggttgggagattacacgtgcatgtggcgtcttcggctccacacactggcgtgcaggggtacgggcctccgctcacacgcctgatccgtctcgggatggacaacgcaagcctgcatggccctaccttgggtcgccccgtcgtgccagaggtgtag

SEQ ID NO: 3517 - DNA, 315 bp, Chlorella protothecoides
atggacatggtggtcttcctctctgccaaatcacacaggaagggcgaccgcgtggccaccatggcctggaacacgcaccgccacctggagtgctggtacgccatcatgggcattggggcggtgtgccacaccctcaacccgcgcctcttccacgccgacctggagtacatcatcaacgacgcgcaggactgcatcatcctggcagatatctcctttgcaaagtctctggaggagcttggccccaagctgcccagcgtgcggcgatacatcttcctgaccgatgaagggtgggttgtagatctgcgtgtttgttaa

SEQ ID NO: 3518 - DNA, 558 bp, Chlorella protothecoides
  modified_base (298)..(307): a, c, t, g, unknown or other
  modified_base (369)..(378): a, c, t, g, unknown or other
  modified_base (446)..(455): a, c, t, g, unknown or other
ggcgccggcgcctcgggggccggcgccgccgcgccggacctgccgcgcggcgcggtggtgcacaccacgcgcggcgacatcgcgctcaagctcttccctgacgagtgcccgcgcacggtggagaacttcaccacccacgcgcgcaacgggtactacgatggcgtcctcttccaccgcgtcatcaaggggttcatgctgcagaccggagatccgctgggggacgggacgggcggcgagtccatttggggcggcgagttcgaggacgagatcagccgcaacctgcggcacgaccggcccnnnnnnnnnnacgcacggtggagaacttcaccacccacgcacgcaacgggtactacgatggcgtcctcttcnnnnnnnnnngggcgagtccatttggggtggcgagttcgaggacgaaatcagccgcaacctgcggcacgaccggcccnnnnnnnnnntctcacagagacagggctcgggcttgcgcagcgcgcggcgcgcccgggccatcgacagccttcccgactgcacgctccaacgctgccatgggcagtcgaatga

SEQ ID NO: 3519 - DNA, 387 bp, Chlorella protothecoides
atgctgcggaccatggtgtctcagttggtggagcatgagcggatcgagaccacccttcccaaggccaaggagcttcgacgggtggcggaccaagtggtcaccctcggcaaggaggcctcccagcacgcgaggcggcaggccatggccatcctgcggggggacgcggaggtgcacaaggtcttttccgtgctagcccagcggtacagccagcgtgacggcgggtacacccgcgtcctgcgcacgcagcagcgcggcaacgacgcagcgcagatggccttcatcgagtttgtggaccggcccggggagctgcggcccgcgcgacccggccgaccagccagcctcctcccgcccgccgctcagctgctgcagcagcagcagcagcagtag

SEQ ID NO: 3520 - DNA, 429 bp, Chlorella protothecoides
atgcagtatgcccgcattctacaaaagctggagaaccccgtgatcttcaaggagttcaagatccaaaacatggtgggctcctgcgatgtccgctttcccatccggctggaaggcctggcgagctcccacagcgtcttctgctcagtgagtgggacagctaggtacgagccagagctgttcccaggcctgatctaccggatggtggaccccaagatcgtcctgctcatctttgtttcgggcaaggttgtccttacgggggccaagcgaagggaggagatctaccaggcttttgagaacatctaccccgtgctcaaggagtttaagaagggaggcctgctggaaagcgtccccgcccccccggccctcccgcccccgcaaagcgcccccgctgacgaagcacagctcggggctcctgccccccagctctga

SEQ ID NO: 3521 - DNA, 711 bp, Chlorella protothecoides
atgcggtgcgggatccaagggtggggctcgtggaagggccgggccagccgctggcctggtgtcgtggcttgcatgctccggcggtgccatgcactggcggccggcggccatgccgtgagatggcatgaggggccggcttgcccgctctatgcagccaataccaagtatggccggcactccgcctctcccacaggccggcccccggacttcatgcaccgggagataagctcccagccggagcgacccgccgaggactctggcctgggccgcaccccttttgaggtccaggccaagatcgaggagatgatggcgcaggccggctgccaacagcccaacgaggtcctgcttgcggccaagcgcctgttgaaagagggtgtgcttgggtgtgtggagggagcgcgggctcgacgtggcccccaacccccaacccccaacccccgcctgcatctgtcccacccccatccacccaccatccacgcaggcctggccgagggcggccccatctccggcgaggacgtgatgcgggtgcggggctgcggcctgacggtgctggagcggctgcggcgcgacgccgcatcgggcgacgcgcacggcctctcctccctgctcagcgaagtggagagcggggcagggcagctgccgcggccgcgctggttcaccgagagcttcaaggcgctcaaccaggagacagccaccatcatggccaggtga

SEQ ID NO: 3522 - DNA, 2142 bp, Chlorella protothecoides
  modified_base (510)..(519): a, c, t, g, unknown or other
  modified_base (591)..(600): a, c, t, g, unknown or other
  modified_base (1113)..(1122): a, c, t, g, unknown or other
atggaccgccctacctgcaaggttcccggccgggaggcctacccgtccgggcgactcctttgcttgacgctggtactgctcgccctcccctgggcatgggctgtgcccagtgcacccatggaggccctggacattgagatcgcggctgcccaactgtttagctcgcaggcctccgccagggactgcaccccggccgaggacctcccggtcgccggcctggacctgagcgcggaggagagggtgctcctcaaatacctgtgcataccccagagggacctgttactcgaggatgaggacattgccgtggtccggcggggcattccccccggcgtgaactgcacggaggtccagtggtcagtgaaaaatgatggggatggggctctcattaatgggaccctcgggactgggatgctgaagaaggaccccatgcctttgtaccatgtggtcagtacctgccagccgcctgcagtaagcaagggcctgcgtggcatgaagcacttgcaccccccnnnnnnnnnnctctcgcaatcccccccccctccacccacacccacacccacaacgcaggtgcgacggggagagccagtgctnnnnnnnnnntcaggctcgtgccccttgcacagaaggaaaccaagctttggagtccccctctcctctcgcgatccccccccccccaaaacacacacacacacaaaacgcaggtgcgacggggagagccagtgctctctggtgtgcgaacgtggcagcgtggtcatccccgactggcaggtgcacgccatccgcactcagctggacgcgcaggccgacgtgccgctctgccgggcctcgctgctgggctcccacaactcggccatcactctggcggacggctacggcaacctggacgagtactggcagggctatttccgctacatcaagtgggccatccccgccggcgccagcccccgcctgcgcaccaacaaccactggctgtcgctgacggaccagctgcgcatgggcgtgcgcgtgctggagcttgacgcgcagtgcgttacggggaaggggggggattgtgctggttgtgagggggggtgcttctgttgttcaagggaggagggtgtgcacggcagggannnnnnnnnntgcgcagtgcgttacggggaaggggggaactgtgctggttgggaggggggttgcttctgttattcaagggaggagggtgtgcacggcagggagggcaagagggaatcgaggcgtctgtgtaaaagggggaattattggatggctgagggcagaggctgtgcaaggggaggggatgggactgtctatgacgctggcgaggaacgtctgtggccgggaatgctcgcgaagatcgctggcatcctgggtcgcagcagcccttggactgctaggtccggcactggccccatgtggcttccgacgcatctccctcaccccaccctcccgcctctgtccgccccctcagggcacgacacgctccccccacccccccaccgcctctccctccttcccctccctcgcagttgggtgggcggtgcgctgcgcatcgcgcactgcggcggccttcacgtgccccagctcaacgcgctggtcaaggccctgaacctggtggccaagctgctgggccgccgcatccgctgggacacggagacgctggggtgcagcccgtcgctgtcctccattcccgcgctcgaccagcgcacgctgctggacgcgctgggcgaggtcgcggcctggatgggcggcgagggagccgcgggcgacgcgctggtcctcttcttcgacgaccaggccgacctggcgcactggggcgtggtgggcgagctgctgggcgacgtcctgcgcgccttcccccgcgcctgggtctacgaccgcgacgaccacgcgcgcttcgtggccggggtcgcgcgggagagcgaggcggcgggcctgccgccgccctcccccgccaccacctggccgacgccgcggcagctgcgcgccgcaggcaagcgcctggtgctggtgtcgggggcggactacggcgaggccatggccccgctggtcttccccaaggacgacggcagcgtgtgcgggtggcacgagccggcgctgcgcgcggcgcgcggcgcgccggcctgcgacgtgcagggcggcgacgcc

SEQ ID NO: 3523 - DNA, 282 bp, Chlorella protothecoides
atggatggcaaggaatttgaccccgagggcctgagggaggcagaggcatacctgcggggcctgatcgacgacgaggttgcggccggcatcccggagcaccgcatcgccctggtcggcttcagccaggccggtcgcctggtcctgaagacctttgcaacctacgagcccacactggcgggggtggcggggctctccacctggctggccccccaggatctggagggtagtggtagggtttgcttcccctgggaggaggcatggggtcctacgagaggctcgtga

SEQ ID NO: 3524 - DNA, 1314 bp, Chlorella protothecoides
atgtcgaacccgcctccattgctccctgtgcagacggggttctcgcacggcaccctgcacgatggcggcgcagtgggagaaggcagcgagcgcgacggcatcacgaccagcctgggccccgcgcgccgcaccccctgggccggcggctgggtggcggagtgggaggcgcgccaggcgggcgtcctgcgctacaactgtgcggacagcctggaccggaccaacgccgcgacgtgcttcgccacgctgccggtgctccaggacgcactgcgcacgctgggcgtcgacctgtgcgtcgggccggggcgggatgcggggggcgccgcgcgctcgggggtggaggagggcggcgccgtgcggccagacgcgggcgccctgggttccctgccgccgccgcttgtcgcaggccgtccagcgtctacggagcaggttccccctgtgagtctcgtgagggccaggatgcagtgccagccagctgcacgcatggctattctccgcccgacccagccatccgacaggcgccacttgccacccaatctccacgttttgtttttgcatgccattggcctctctcgggcagtgcagcagccaggtgttccagacggccaggcaatctcggtccccatcccacccctcctccccttcccatcctgctcgccaggggtgggaggtgcggggtgggaggtgcgatggcacggcggccggcccctctacatcgaccacgccaaccgcaggacgcagtgggaggcgcccagctggccagaggggccggatgcacaccccgcgcaggcggcgagcggcccggcagccgctcccgaccccggaacgggtggcagccccgcgcgggtcgaagtccccccacccggcgccacggccgtcgccctggcacagctctccctgcggcaggggcgggaggacggggcgccggacccagccccgccgccgggacccgcgcccagagaagactcggggcacgtgcggccggtggcggggccgctcggctcccccggccccgcccccccgcaggggccccagccttgggccttcttcggcctgcggggcatggccgaggtgcgggcccgcctgcgccgccctgtggtcgccgacttcgtggaggccttccgcgtgcacggcgacatcaactccttcctctacaccggctccccggccatgcactcccacgtgctgggcctggtcctccaggtgccggcaggctcagttggctcaggggtgggagggagggaatcaatggatgcgcacgccttgccccccctccaccgagaccgcaggagcgtcattgtggggtgggcttcttga

SEQ ID NO: 3525 - DNA, 1524 bp, Chlorella protothecoides
atgagcacagcttgggttgcagcaccccactcctggcacctccatctgactgatccctcctccccccctcccctccacgccatcgtccagctggcggcgctgtcctccctgcacgcgctcgggtacgaggccgagcaccggggtgacgccctgctgggctacgtcgcaacacggtgcgttgccggcgtgctgctggcgacgaggacgcgggagaagggggtgctgcctggcgggcatgcgctgctcacactcacggagagcgcctggctcctcctgcccctgtcgcaggttgaaggatggggtccctggttgtgcgcgtgtatgtgtggtggtggggggttgggggttgggaggcggcctggggtggtgaggcgccgaggagtgctttctgtggggcggggcgcatgcgtccaggccacatgccaccggggccccgcggagcaggagttctggcgcctgctccagcaggtgacgctggacggcgcgcactacttctgctggacggcggacctgtcgcgccccttcccctccccccgccctgccgccgaccccgcccccgagttcgtgtggaaccggtggctgtcggcgccgctggcgcgcgcggggctgccggggcgctgcccggtgctgctccagggcgcggccgaggtcagcctgcacgccggggtgggcgccgcgccgcccttcgccctggcgctcgtgtcccggcgcagccggcgccacccgggcacgcgctacctggcgcgcggcctgaacgaggccgccgggcccgggaacgagatcgagtgcgagctggtcgcctggacgctggcacgcgggggcgcgggcgggcgcgccagcctggttgcctggacgctggcacgcggggccgcgggcgggcgcgcaggcgtgcgctgggcctgctgcgtctggcgccgcggcacggtgcccatctggtggggcgtcagcctggcctccctgcagaaaggcctggcggcggaagtgtacgtgcgcgagcgcgacccctaccgcggcagcgccgcctacttcaggggggtgcagcgtgcctgggcgcgctacgaggccgggcagacggcggctggggcgggcggaagcgtgcgagctgggcaggcggtggctgaggaggggagcgcgtcaggcatgcaggcggctggcgggcagggaggcgggggggccacgcccgcaaaccccgctgcgtcagaggatgcagcagaggagggcctgcacgtccccgtcacctgtgtcaacctgctgcactgcaacccggccaaggcctccgagctcatgctgtcctcgcacttccaggaggtggggcgtagcatgaggcatgtgcgccgcatcctcccccccggtgctcccatccgggtcgtgaacttcgactggcacggcaacatcgggaggctgggcgaggagaagggggtggagggcttctggtccttcatggagccctttgtcaagcaggtgggcccggggaagggtcccctggtgttggtgtgttgcatttggctgtggaccaaggtttga

SEQ ID NO: 3526 - DNA, 1950 bp, Chlorella protothecoides
  modified_base (156)..(184): a, c, t, g, unknown or other
  modified_base (353)..(362): a, c, t, g, unknown or other
  modified_base (929)..(938): a, c, t, g, unknown or other
ccggtgcgggcggtgcagccgcgccgtgccgactcgaccacggcctccttcgggtcgcgggcgggggaggccgaggagggcgggcagagcgcggcggcggggcagtttgtcaaagcagagagcgccgcgcacggcggcgcggcggcggcggcgggnnnnnnnnnnnnnnnnnnnnnnnnnnnnnagcccaaccccgccgcgcagctcgcggccgccgcctggacggcagggatgaagcggcccccagggcctgtagacaaagtacggtcgagggtaggtggtgcttggcagtcctgtcctggagaagactgttgcctgccttggacttggcagcccaacagctgtgctgggcnnnnnnnnnntttttttgtgtgtattggaggggagcgcttgggcgggcaaggggctgtaggcaaagtacgggcgagggtaggtggtgcttggcagtcctgtcgtggagaagactgttgcctgcctcggacttggcagcccaacagctgccgcccgcccaaggacggcatctaccgccccgagcgcctcgcagccgcggccgcggccgccgcggccgccgctgctgcggccgccgtcatacagcccaaggtggaggggcgagaagccccggcctaccagccctggctggacatcccagagggtgaggcggcagggtggaggtctgttggcctgatcctggcagggcgatgggtgactgcctggtctgcggggtgctgcccctgtcatcgatcacgggtgtggcccgggtatcatgtccctgcgatcctgcattgcccaccccagcattctgagtgcaataccacgaagaaatatgcagcgcctccagcgcggcgtccctcctccttcggcctactcccccttttcattccccttcacacacacgctgagtcccccccccccccccccccccccccccnnnnnnnnnncgagtgcaatgccacgaagaaacatgcagcgccttcagcgcagcgtccctactccttcggcctactcccccctttcattcccgttcacacacacgctgagtcccccccccctcctccctccgccgcaggtcgctgccacgtgatccgggtacggtgggcgggggagcgctgtgcggtgtgcgacgccgatgctgacaccgactttgaccagctggtctcctgcgacggctgcgggctgaccgtgcaccagagctgctatggtgtgcctgaggcccccgcccaggacgacctctggttctgcgcggcctgcgaggccggggacgggcccgacccgggccgcgccgcgttgccgcaatgctgcctgtgccccgtggcgggcggcgcgctgcgccccgcggcggttgcgcccggcctctgggcgcacctcacgtgcatgcagtggatcggggagctgtcggtgggcgacatggccagcatgagccccgtgctgggcgtcgaggccatccagcgcgagcgctgggagctgacctgcggcgtgtgccgccagcgctgcggcgccaagatccagtgccgcgcctgctacgcggcctaccacccgctctgcgcgcgcgtggcggggtacagcatggaggtggtggaggcgggggcgggggagggcgtggccctggtcagctactgcgcacgccacgcgccgcccgcgccacagctggccgcggtcaagcgcctggacgcggcggaggagcggggggacctgccggacctggcggcggcgccgccggcgctctggaatgcgcagcccttcgagctggcgccgcgctgcgcgctgccgcgctgcgaggcaggcgcggcgcggtgccaggccgtgctgcgctggcaccgtcagagccacggcacggggacgggggtgtcctccaccgccgggttctggatcccggaggcaccggccgcgccgcctccgggcaagcctggcgaggggccctgggccccctccccccgcccgctcagcgcaggc

SEQ ID NO: 3527 - DNA, 747 bp, Chlorella protothecoides
atggtagtgcgggatctggctgaagaggtggtggcagacgtgggtgtcagagatgtggtggaagaagacgtccaggaagggggggcccatagagcgatccacggtggccatggccccgcgcagccagtcccagtccttctcgtagtagtggggcagggcggggtgggtgtgctggagcagggtgatggtgaccagccaggcgttgaccacaaagtaggggacgacgtaggtcttgaccagccaggcggtgccgaaggagcgggccagcagccccaggcccgacaccaccgccaccagcgcggcgtcggacagcgccacctctgcgcgctcgcgcttggagaagatgggcgaccaggggtcgaagtggttggcgaagcgggggtaggggcgggaggaggcgttgaaggccaggtacaggggccagcccaggagcagggccaccgcgatgtgggcaaggcgggcgggggcggtctgctcccactcaaagccctcatggggctcctcgcgctgggcgggcacaaacacctcgtccttgtccacgcaccccgtgttggagtggtgccgacggtggctgtgcttccacgagtagtaggggaccaggaggagggagtggaacaccagcccaactccgtcattgatggtctgggacgtggagaaggcctggggcagaaacaaggggggggggggagatggcggacggggggtgttctttggttgagaagggcagcggagaggatggagggctga

SEQ ID NO: 3528 - DNA, 420 bp, Chlorella protothecoides
atggcagccgtgaagcgccagagcgtggccaagccacccttcaccatcggcaccctgcgcaaggccatccctgcccactgcttcgagcgatcagctctgcacagcgcagcctatctgatggtggatgtggccctggtcgcggctctgtatgtggcgtcgacgtacatcgaccccgcccctctgccgacctggttcaagtacaccttcctctggcccacgtactggttcttccaggtaggcacatgccatgttagtgccctctcgaggttgttgcgacgcgctgcgaggggcgcggacccctcacgcccgtcgcctgtgctgaggctgtcaccctccccccccggtcgtatagggcgcggtcggcacgggcatctgggtgatcgcccacgagtgcggccatcaggtgcggagcggggttga

SEQ ID NO: 3529 - DNA, 735 bp, Chlorella protothecoides
  modified_base (343)..(352): a, c, t, g, unknown or other
atgaagggggtttggagagggagcaggatcgcgtgggaggcagttgcaggcacaggcgcgatcctgatgcaggagagcagtatggcgtcgcctgccaccggtcatgcacccgctgcaatgcatttccggcggggttgggcacccatgcacatgcccgagatgccacgctgtccgtcgagagtctggccccgacgccatgcccacgaccccgcaaccaccccctgccaaccctgtgcagggtcgcccggtcgcggtcccacgccgggcatgcggtaccacatcgacaccccggggtcggggcacctggcccccacgccggggtcatacctgcccacgccgggcnnnnnnnnnngtgcacccgctgcaatgcatttcgggtcgggttgggcacccatgcacatgcccgagatgccacgctgtccatcgagagtctggcctcgacgccatgcccacgacaccgcaaccaccccacgccaaccctgcacagggtcgcccggtcgcggtcccacgccgggcatgcggtaccacatcgacacccccgggtcggggcacctggccccaacgccggggtcatacctgcccacgccgggcatggcgcccagccccttctcgcccgccccggccctcaccccgggcctggcggccacgcccgggctgagctacgaggcggtgccggcggccgactacggcgccgcgccgcgcgccctcggcggcgccgccgtcgccgccgagggc

SEQ ID NO: 3530 - DNA, 1434 bp, Chlorella protothecoides
  modified_base (927)..(936): a, c, t, g, unknown or other
  modified_base (1076)..(1085): a, c, t, g, unknown or other
  modified_base (1268)..(1277): a, c, t, g, unknown or other
atgtcactggtgatgtgtatgaggctgacggggtgggattcgagctcacgggcgcgcgcgaggaccccacgtgatcaggaagtgcctactcgcatagtatgctcgtacaggctcgcgagcgcccatcaagaggagcgtggagtcccgccttcggagtgtggggttgagcgtatgggcaacaaggtgtcgacccgtacggtgaggtgctggtgcgtgcactcccaggaccctctcatcaagttggctcgacggagttcccagaagcatcccgtccccagccccggccagcccgggcctgcaccgtcggcccccgaggaggattcaggggaggcgcaggacggggatgaggggtacggcctgcgttttgaatcatgtccgatcattcgcagcgcctcccaggcctccctgagcgacaaggcggtcagcgactatgaaaccttcatgcaccggcagctggagctgaatgaggctcggaggagtgagatcctggccagcctgggcgtcgacttccacacgccccagaaccgcttcgacaacatcaccgccctggtgaagagcatctttggggtgggcttgtccacggtgtccatcatcgagggcgacatggcctacttcatgtcccgtgccggggactgggcccccggcgccccgcgcaagatgacgttgtgccagtgcctgtctgcttgcaacgactccaagctgctggtcgtggagaatgtgcagacggaccccaggtgggtgggggaagtgtggcgatggagtgggcaccagtgccacttgccagtcttgcgtgagggcatgcaaggttgctcaggggtccacctgcacgcacagtcgacccccgggacagtaactgaatgtagtctacggcaccctgtgagatgggttttgttttccggggcaattgtttctgggacttacatgtcnnnnnnnnnnggtccagctacggcaccctggggtttgaagcgcacgatccgaaattatcctcggtcccatggagcctatctggggcctgccgtgtgctctgcactgcaggcagaccctcagcgtcctccaatcccctccccttccccatnnnnnnnnnntagcaacagcctgagattaatgcaacgaatgacggaatccagggcataccctcagcgtcctccaatcccccccctttccccgcaactttgccttccaggtagggttgagcagcaggtggctggagggtgcagctgccgctgttacatggttgatgcgaggtttttgggtggcgccacctccgnnnnnnnnnnggctggagggtgtagctgccgctgttacatagttgatgtgaggtttttgggtggcgccacctccaaggcagggaatcgtggaggctgtactttcctttcttggggaacagcactgtctcccacacactgtcagccgtcaggatacgggtggttgtag

SEQ ID NO: 3531 - DNA, 1344 bp, Chlorella protothecoides
  modified_base (1325)..(1334): a, c, t, g, unknown or other
atgcatccctcaccaaacacccaggacctggcggattccaagcgcatcaacgccaacatccggtcggcagcccgaggcgctgcccgcggcgagcgggccgccaccgtcaccgccaccatgctctccgccctgtactggccccaaggcagcgcgcctgcccccgaagaagcggacctgaggctgccgcccgacgtgggcagctggctggaggagtacggccaggcctaccacgcgctcaaggcgccgcgcaagctgcagtggcgcccgtcccagggcgtggtgcagctggaagtgacggtgggggaccaggccctggagctcacggacttgggtggcactgcatgtgtctgtccgctgggacaaaggacggtcttggctgtggaaaatcatcctggatcagtcgatttgagtactcatggtgtcctgattgtgtcatctggaggcaacagtgcagtgacccctgcgcaagccatcaccctactgagcttccgagagcgcagcgaatggggcgaggctgagctggcagagcagacgggccagacgcccgccatggcgcgacggaatgccagcttctgggtccagcaaggcaggctgtggggaatcgtggaggaattgcacataggagtgctgcatgaggctgctcagcctggaggagccagggtgtacgccaggaacagggtccttcaggccagcaccggtggctggagcggtccacccgccgaggacgagggggcggagggcggagcgccggcactggatgcaggcctgcaggctggacccgctcctgacccagatcccaagtgctcagcacctgccagcatgctgcgatcaaccccggcgctctgttgctctgcaaaactccatcaccccgactcggacattgcccaccccatgccaggccatggcagcatacgagccgttcatcctgggaatgctggcgaatttcgacagcctgccccaggaccgcatccacaacatgctcaagatagcagcaccctgtcggaaggcctgacgcacgctccacaccctctcgcagatgtttgtgtccgatccgccctacgacaagaccctggaccagctgtctgcctttctcgctcacctggtggcccaggagcgcctcacgtgcgaggggggcaccatgtacaagcagaaactttagactgggacgcatgctggcccagtcctacttgcctaccagggcggttgtccttgtacagcagccacgttacacgttttgaggatgatgacattcggggggaagagagatatgggtggccaggtgcagcgacattgagttggacttcatgtgttgcttttcaggcacnnnnnnnnnntaaactttag

SEQ ID NO: 3532 - DNA, 501 bp, Chlorella protothecoides
atgcgtccccgccccccccaaaccttccaccaggagctgagcgtcgaggcggcggtggcggggacgctgagccacctgcaggcccacctcgaggagcgggcgacgcgggacgcttctgcgccctggctcgccgaggctcttgagtacactgcctcctggccactccgcctcctgcagcagctcctgcccgaggcgggggcgatgccaggcagagggtccgccattgccacacgatccggggtcacaatgtcaaacaccagactgcccagttctccagggttctcaccaccatcaaacctcccctcacaggcctctggctggcacctgtgggagcagcgcctgcgctactttgtctacgagcgggccggcctcatcttcaccgactccctttttgacctggtggtggacttccccgacaggtattgctcgtctggtcgaccgggggttgctggggttccctggagctttgaattcttgcaggtcggggagctgcgtgcatag

SEQ ID NO: 3533 - DNA, 936 bp, Chlorella protothecoides
atgtggaccccacaggtcggtgaaccactgttgctgggctggatcgatcatcccagggtgcagccaggcgcggccctggctgcaaggatcggcccccaggtgcgccccgcacagcattgtgagtatttgcacctactcctcccacctccctcccccccaaccgtcctcagacacggccctggccccggcacgcgcggccacacaggactacctgcgcacgcggcgggacgccatccgctgcattgtgggcctgctgacggccgacgaggagggcgaggacaacgtggtgctggaggagctggagggcgagggcgaggccggcggcgcaggggtgggctggggcatgggggtggggaggggcgcgaggccggtgttgtcaacggtgcagttgagctcggtcttccagcagagcagtatcaagctgaacgacccctgtggcccctgcgtcctcgtatgcaggtccctctgacaccctgctttgacgggccggatgcggacctccaggccctggccgaggctgagcgctggcgccccgagccaggccatgccctgtctccttcttgggggtccaagcgcccacaagccacaccctcggacacaaacaccggcttgcgtcattgccgcgcagtggatgccgtggagcgtgtgaccggcagcgatgccgtgtcgcagctggtgggcatctgggggtcaaaggacctcctcgtgaccgagtaccggtccctgctggccgacaggctgctggccaagcagggctacgactgcgaccgggagctgcgcaccctggagctgctcaagctgcgcttcggggacgccgtcctgcacaccgccgagatcatgctcaaggtgacccggcttgggcctgggagcctgctgcgctgttccacttgggtatccagggggggtggggaaggttcgggcggtgtggggggttga

SEQ ID NO: 3534 - DNA, 255 bp, Chlorella protothecoides
atgccccaggtgagccaagcctcggccatcgcgaggcaggcgatcgaggcggcgggagggagcgtgaccacggtgtactacaatgcgctgggactcagggccctcacccagcccgagtggtttgcgaagaaggggcgcttgctgccacgaccggcgcggccaccgccccgcctggaagccaagtttgagcgaaagggcgcgctgccgccgctgcgcgatcttgcggccgggctggagcaggccgcgacagcctga

SEQ ID NO: 3535 - DNA, 270 bp, Chlorella protothecoides
atggcaagcaccgcagacgcgtgtgaattgtctgctcatgccgggccctccttcccagcgccaacacctacccccgcacatcctgaccgccgattcctgtgcttgcgcaggcttgtgaagttccaacgtgtgtcggtcttgaccatctttgtggcggacaacgtcggcgacacggagagtaccgtcatcgagaagcttgccatcctaggcagcgcaggtgacagcttcaacgtcgcagaaatcaaggacgtctccaaggagcaggggtga

SEQ ID NO: 3536 - DNA, 363 bp, Chlorella protothecoides
atgttcaaagtttctgccccgactctccctcttcccctcctccccacccccaaaaggcatgtcccgctgaccaaggacaccgaggagctggacatggccgccttccacgacctcctctccccgcggacgcgcctggtggcgctagtccacgtctccaacatgctcggctgcatcgctcccgccgccgagatctgcgaggccgcgcacgccgtgggcgcgcgggtcctcctggactgctgccagtccgtgcccaacatgcccgtggacgtcggccggctgggcgccgactggatcgtcgcctcagcgcacaagatgtgtgggcccacgggcatcggcttcctctggggcaggcaagctggttga

SEQ ID NO: 3537 - DNA, 216 bp, Chlorella protothecoides
atgccgccctggatgggcggcggcgagatgatccaggacgtgttcctggaccggtcgacgtacgctgcgccgccctcacgcttcgaggcgggcacgcccgccatcgcggaggcgattggcctgggcgcagcctgcgactacctcacaactcttggcatgcaccgcgtcgacgcctatgagcgggagctgggcgcgcacctccacgaacaggtgtga

SEQ ID NO: 3538 - DNA, 336 bp, Chlorella protothecoides
atgacggtggcactggtcggcgcgacgtacggcgcagtccccgtctatcgcatgttctgtgccgcaaccgggtacggtggcaccgtccaggagggcgcaagcgtggaggctaagctacgagccagggaggagaacccgaatgcagaggtggagacggcggctgctgcccgccaactcaccgtcagcttcaacgccgatgtctcggacggcatgccctggaagtttgttcccacgcagcgcagcatcaaggtccgtagctgtggtatgctcccagagccaggaaagggcgaatggtcaaacctttctgcatcgcgggagcgttgggaggcactgtga

SEQ ID NO: 3539 - DNA, 858 bp, Chlorella protothecoides
  modified_base (82)..(91): a, c, t, g, unknown or other
  modified_base (823)..(832): a, c, t, g, unknown or other
atgctgtcaatgacccggagatggagcacctcctcctggacaggtctggcgacctcccgccccacggcgccgccggccgccnnnnnnnnnncctgcattgtccacatacgccgatttcaagcagcccatgctgtcaatgacccggagacggatcaccccctcctggacaggtctggcaacctcccgccccacggcgccgccggccgcctggcggtgctgggcgagcggtacaccgtgacgtaccgcctggtccacggtgtcctcctggccctggtcaccctgccctccgcctccgccttcctgtgcctcgaagcgctggacgccgtgcaccgcgtggtggcgggcctcctccgcggctccgcgctcacccccgccaaggtggcggtgcgcttccctgagatctatgccgcgctggacgacctgctaagcctgggcctggaccggctcccgcccggcttccgccacgcccccctggacgaccgcgtccggctgtccatgcccgtgtccaccaccgacgccaagcgccagttccggcgcctggtcaagggcgcgcggggtgggggagcgagcgaggcggggagcgtcgccggggacgaggccatgcacgctgcggaggaggccgccgccgcagcagcagaaggggggaaaagggtggattctgaagggtatcccccactcagccagttccgtccgtaccggtgttggcagctgcgctgctctcgtgcggccactgcgtcggcgagagtggatttcatgcagtcttcctcccctatgaccccccaccaccaaaaaccatgtccctctgcaggctcaacggccggannnnnnnnnncttcatgcagtcttcctcccctgtga

SEQ ID NO: 3540 - DNA, 1548 bp, Chlorella protothecoides
atggcccgtgtcgtcgccctcatgatctgggagttgcgcgctcccgggacctcaggaccccaacggaccggtggaagaaagcggaactgctgggcacatatgctcgcccggggaaggggcgtcgtacaaggtctacatttacaattcgcacataatctaggcatggaggagcgactacgggcccaggtgccgactgtggcagctgcctttcgggactcctgtcaactcgccagcgacagtctgttcgaagctcccggcttcgccatgcccgcgacgccgcgggatggccagcatccggggcagtacataaaatacagtcaggtcgagtctttcctggcgatggcggagcaggcgctgcgggcgcgtgaccgggctgtggatgctcttcgggacgaaaccgctgccctgatgtcggacttggacaatctccggggagagaagagcaagagcttcgatggcccgatttcatcccccgcagccagctggcctcacgcacccaatgatccgctccaggtggaggtggcagagtctgtggcggttgaggaggcccagcagttgtccagcctggtgcagcagctgcacgccgagaaggccgccatgcaggcggcgatgcagaagctgcagcgagaatcgcagtacctgacggacgagaacgccctgctccgaaaccagttgaccatggccatgaatggtgggtgggttgggggccgggcccaggggccaggagtgagcgcctgctgcaggtacggggtgcagttctcaggcagaaacccaccgtacagagcacggcctgtaccacttcttccaaaccatgctgaattggtagatgttcacactcatgccatgcatccgcgttctcatcatcggccccatctcgtcatcacccccccacccccccaccccccctcccgcgccgcagagcaagccagcggcgacatggaccagaacgtcagtcccctgggtccacacaccgccctgatcgcccacctgaccgacacgctgagcgtggagcaggatcgggcgacccaggtggacaacgagaacatgctgctccgggcgcgggtggccgccctggagaaggccggcctggtgagtcgcgggccgggtggagcgaggggggagaggggcggtgcagtcctggcgcgcgcagcacagttttcgacgtcctggcgcgcgcatcagagccttcgaccgtgcacttggcaggcgcaacggagcccttccgcaaaccccctcctctcacccgcgcccccctcacttgcaatcgcccctgccttcttccaggcccagcagagcgcgctggtcagctgcatcgaggagggggagcgcagcctgctggccagtgggcgccgcgcgtccctgtcgccccaggccgtcctctcgccctcgcactggcgcagcgagaacacggaggaggacggcgccgggtcggaggcggagagctcctcgggcggcggcgggggcttcagcacgcccgtggcgcgccgcctcggcactgggctcgggcctctgtcccctcgggcctccctgcaggcccaggcctcgtga

SEQ ID NO: 3541 - DNA, 594 bp, Chlorella protothecoides
atggaggtggatgctgccacgagcagcaggcacgcggcgtccagggtcgacggcgcggcgaccacgcgcgccacaggcgccccggcagcccgccccgcccccaccccgtgcgccctcccgggccactcggtggaggaggtgttctgccagtcctttgtggtggaggtggcggggtggggcgagcgccgcgcggtggagttgaagcccggcggcgcgggcatcccggtgacggaggacagccggcgcgagttcgtggacgcctacgtcgacttctggctcaacacctcggtgcacgcgcagttcgaggcctttgcgcgcggcttcctcatgctctgcggcggccccgccctccagctcttctccgccaccgagctggagcgcctggtctgcggcaacccctgcctggacttcgagggcctccagcgctccgcgcgctacgagggcggctactcggccgaccaccgagtggtccagtggctctgggatgtggtgggcgagctggacgccgacgagcgtcgcctcttcctcaagttcttcaccgggtccgaccgcgcgcccatcggaggcctggccaacctgcgttgcgtcatccag

SEQ ID NO: 3542 - DNA, 1392 bp, Chlorella protothecoides
  modified_base (369)..(378): a, c, t, g, unknown or other
atggggtccgagacccccctgcacatcatcgtgacgggtcaggcggcggggggcggcctggctgcactggcgggcccggccctggcgctggccttcccgcgggccaacgtcgatgtgatcacctttggcatgccctggaccgggttcaacccccagttctcctgggcctttgaccagctggtcagcttgtactacgtctggccctttaactccagcgacatcgtgcagatcatcaacgccacgcagcacgaccctcagcagagtctctttgatcaggccgccatggcaggtgggcgcctggttgggggggtggaggaagaggggtttattgtgggagggtggggatcacctggggactggacgtgttgnnnnnnnnnngccgccatggcaggtgggcgcctggttgggagggtggaggaggagggggttatcgtgggagggtgtggatcacctggggactggacgtgtttgggattggggcatgaaacagaacatcgtcctggatccaccgactctcatcctcagcccagagcagcatttgcttgccagtcttgtgctgctctgcctcatcccaggccttcccctcaatcccctcccaaaatcactcagcgggcgccaccgcccctctgggcgacatcgccccctcgcccactagccccggcccggccccctcggcctgcccccccatcctctgcaagtcgcgggaaggcgcggccgccgcctgcctgctgtggcgccccaacaacgcctcagccctccaggttgtttcattgtcacaggcatgccctcacctgcatgcacagtcacactcgtaatcatcagccttgccatccatgcctcacacccatccacctccaccctgtgcagggcctgccccggcgctacctgcagagcggcggcaccggcgcctcggccgccgtggcctgggacgccgccagcgagaccgcctacatagtgtttgagggcaccgacaccgaggcagactgggtgcaggacctgctggtctcccagtcctctgactttcgccccaccggcgccgacgtgtttgacggcgtgggcgtgcaccaaggcttcctgaaccagttcgagagcctgaccgacgccgcgcccagcgccgaggagaacatcaccgccgtggtcctggatctgagcggcggcctgattccgcgcagggttgtcgccgcaggtgaggagagttttttgttttcagggggggcggggggtcccaatcgaaggagcaagaaggcgcagagctgtgtggccgtgccttgcttcggcccgctgcctgggccagtgcaatcgcaggcagccctacagcgtcgtggcaggagcaggcagggacgcgggcacgcctcaaactccctctccctcgaccaccatgccctggactga

SEQ ID NO: 3543 - DNA, 1215 bp, Chlorella protothecoides
  modified_base (1185)..(1194): a, c, t, g, unknown or other
atgatcacagccgacaggaattggggtgccttgatgttcgctgccttgcttgtcgcccttgccaccctctgctggggcatcgtgctgtttgtctcctgcggggaggtggagagctttgctgtgcccaaggaggcacgggtggcggggaatggcatctcgctggggtcgcccaccgcccacaccgggggagcagcagagttccagaggttgcccatgggagcaggaattggattgccggacggcgagattcaaatttcaggcggtgagggcgaccgccttttaccctcaaaccctctggaggttgacataccattttattcttgtaacgcacacagatctgctgaagaagggtttgtatttctgagcgaaggtaaatggaagttggccacgtcgagaatgggagctgattacgtacatccccctctccatgaacgcgggccatgcaaagctgacatcttcgacaccatcgggaacgctctgggcgatgccacccggactgtcgggaacgcggtggacaccgcggctgatgccaccaccaactttgctgggaatgccgtgagcaccgtgggaggggccataggcgatgcagcgaacgctgtggggggtgccctgtccgacgctgccaacgccactggagactttgtggactcctcgctggacaccgtgcgatcgggtctgaacaccgcggtgggagctgtcagcggggctggaagcgacattcgtacatttttcagcggaggggaggtgacaccgctgttgccctccattcatgtggctgtgatgaggattggcatcttgatgtcacggagcaacacccgcatgggctccatgccacccgattctagggtctggtgccaggtttgtagacagctcatcccaatattcgattcctctggcatcaatgcctcaggcacccagcccccttcccccttgaacacacccacccacccacccacaccaggtcccatcgtcgtgaagaccctggtagcgctgcagtatgccgtgaatcttaatgccagcgactaccaggatgaggctgtgcagctggccttggccgaggacgcggtggtaacaatccgccatgccgggctcaaccaggccatcgtcgcattccagaatggagcctgctttcggtcgttcccttgtgacaccatggtttcgcatctgcaggcaagcgacgtcgtnnnnnnnnnnctttcggtcgttcccttgtga

SEQ ID NO: 3544 - DNA, 1578 bp, Chlorella protothecoides
  modified_base (394)..(403): a, c, t, g, unknown or other
  modified_base (450)..(459): a, c, t, g, unknown or other
  modified_base (747)..(756): a, c, t, g, unknown or other
atgatcgagccgtaccgggtgaagtcggaactggagaccagatgtgctcgctggtcgctccacagtagtatcactcgtttgctgcattgctgcactggattccgactcttgcctcggaatcctgagcgtgcagagcctggtgctggggcacttcagcagcagctgcagtccggctggctcagtctccggattttgggaatggattccaccatcgcggcacaagtgttggatccagagatctcacatggagggttccgggcgccaaaactcaggccaccgcttgataacgtaggagtgctacatgagcccgtacagcaaccatgcgcgcaacgccagaagcagcatcactcagcgctctctggcgctgagatgggcatcgacatcttgcgctctnnnnnnnnnncgacaacggatgagtttgtcggatccctcgcacctggaggcccagcnnnnnnnnnncattgcgataaggaagggatgagtgtgtcggatccctcgcacctggaggcccagctggcttcccagatcgtcaccttgtggaggtcccagacagcaccattccaggccatagttgacgactatgcagctgtactgcaacgagcacaggagtcgcatgtgagggcagcgcagctcgacagagaagccaatgaggctcgcgctgagaatgacaccctgctacgcgccctcgaggctgccaaacgtggagcagtgacgcaggaggagactcagtcttcccagcaaacgctnnnnnnnnnnaacgcaggaggaggtgggcatggaaatagttttgagctggagctgactgcgagttgttccaatggcgcagactcagtcttcccagcaaacgctttgtttgcagcactgcaggccgtgctgactcgcacggagacagacctgacggcggcctataaggacaaggcgatgctggcggagtccagcttgcaggtcacacagcagctcagcgtgaggcttccttggcagtccagtgcaagcaccctgctccactctacaaatgccatcccttccacctacctccaggtcgtacgcgacatcaatgagcagcagactcgggagattaaggaagcggaggcagcgatccgcacgctgagggaccaggttagagccctgcgcggcgaagtggagcgactggaagaaagcgtggccatggccggcaaggaggcagaggtggggcccggctttggcctgatgtggaggagccattcagttggggaccctgcttcatgcacagctggcactcccaaggcagatggctggctgatgggcagaagaagatatcaaatgttggcatgctgggcgcaaaggaatgacgccaccgtatccgcggctcgggcggcagcgctggaggctgacaatgcggccctggccagacgcctggtggagctcaaggaggctgagattgagcgcatgaacgacatcaaccgccagggcgaggaaatggtatcttgggagtgtatcaaggccttgagggctctatgggatggaggatgagtggcgaagaggcaggcacagcctccccaagctgcaccagaaccatgcaagccccctctcactccctga

SEQ ID NO: 3545 - DNA, 777 bp, Chlorella protothecoides
  modified_base (277)..(286): a, c, t, g, unknown or other
  modified_base (387)..(405): a, c, t, g, unknown or other
atggacagctgcgggtacgcgccgcggggcatgggagccgggccggaggtcccgcacgtcccctgcgcaccgtacgggccccgcctcgcactagcacccaaccccatccccgctccgtctcccgtcccccccaggttccctctggcgactgtgttggtggacgggagggcagcaggggagccgttccggggggaagccgcgagcgggagccaggctaaggcgtgggtgtccgccgccgacgccgtggccgccgccagccgcagccccgccgaccccnnnnnnnnnntgcacgtccccttcgcactgtacgggccccgcctcgcactagcaccaaccccatccccgctccgtctccccccccccaggttccctctggcgactgtgttnnnnnnnnnnnnnnnnnnnggacggcatcccccccgccctgcgtggccacctgtggcccgccctgtctggcggcgccgcgctgcaggccgcggcgggcgccagtgcctacgaggcgctgctggcccggcacggcctgctggcccccgccgccgacccggaggcctgggacgtgctgccgtcccacccggcggtgggcgggcgcgagggcgcggcggcggtgcgccgtctggccctggccaccgccgccagccgcggcatgctgcacccgccgcggccgctggccatgctggccggcttcctgctggctgtcatgggcctgtcgcgggaggaggcggcctactggacgctggccggcctgctggcccaccgcctgccccgcgacttctatga

SEQ ID NO: 3546 - DNA, 522 bp, Chlorella protothecoides
atgtccaactacctgaagaagagggcgcttgaacccctgcgatactatgtcccctccctccttcaggctcgggatcagctgagcggccttggcaccacgcgtcggctctccctcaggcaacctgccaatggtgccgccacgccgtctcccactcccatcactctcggcgcctccccaaatccaactttccattgccactctccagtcgaggacgccaaggaggcacgctcccgcctgcggacgggagcctttgctggtctgcgcgaggcagtgaatgcggtgggggagtacaccagccgggatggaaagcagagcactgccttcttgagaaccctggaggaccttgactttagcatcttccaggctgtcaaggggcgggactccatcggcccagcctccctgtccaaggtggaccgtgctgtggctgcgctggatgccgttctggcggctgttccgggggacgatctggactatggaaagcgcatcgtcacgcagctgcgggcgcccctgccccctgtctga

SEQ ID NO: 3547 - DNA, 417 bp, Chlorella protothecoides
atggcgctgactgcgggcaaggacaatgtggtgcgggtggtggacctgagggccctacgcgtgcaatgcacgctcaccagccgacacttcagcgtggggggcgcctggtcggtcgtggcgctcaggggagaggggagagggtggagtggagcggctctccaagcaaggagtcgacggcgggcgcagccgcgtgtacgcacgaccggcgccgacgagcaccatgcagcagccggctccgccgatggctcagtgctgatctgggacctgaccaagcccggcacagcccccagccggctgagcgcgcgccaggctgcctccccagtcacggcgctggcctggagccccatcggcgcccccatcgtcacggggtcaaaggcggggggggtcgcgttctgggatagagccgaggacgactga

SEQ ID NO: 3548 - DNA, 816 bp, Chlorella protothecoides
atgcggtttaagtccccgcggtctttcgtttcacgttgtgctcttcgattcccgggcaggcacgttggttcgatgggatggggtttgggcccgcgcgcccttggaagagggctgatggtttgtgccgcgggccgcgccatcaccctcagggctgtccgaccagaaacgcactataaaggcagatggttcaaggatgcttctgtggtgaacgcccaccccgatggcattccaaacctgaaaaagggcgttgaggtctcccggtcggcaggacgatgctctggtgggctactttcccccgcgcctcctcactcacaaattttccctcgcctcgcaggcaccctgtacactggagcaatccacattttttgtggtatcgttggtaagcttattgttctgccaagctgcgcgtgcatgttgtgctggacgcaagtgctcgacctcaggtgtccggaccctcccgcaggcgccggagtgctggcccttccccggtcactgggctggctaggatgggtagctggtccgctgctcatcattgcattctacttcatgtcattgactgctgcctgaggcttgcccttcctgtcagctcagcttctcgctcctccccgaatgtcaaccaacaggctgctcgccgactgttacgaggtggatggcgtggagaacgggcggtatcatgacatcgtcaatcacatcatggtgagccaccgtccgcttgcctgtcgatgtggggaccgaccgctcatgacatctcgcacagtgctgcccggacagagtattccctcctgcagtgtcctcctggtcctggacaccgactga

SEQ ID NO: 3549 - DNA, 1437 bp, Chlorella protothecoides
  modified_base (325)..(375): a, c, t, g, unknown or other
  modified_base (1377)..(1386): a, c, t, g, unknown or other
atgcagtcctgggccttgactgtcatttttggggcagttcaagtcgtgtcctccctggtgcccaacctggagtcggcctggtgggtgtcagccatcggtaccctcacctccatcttctatgcgtcggtggcgctggtcctgggcatgattcacggtgagaatctgccagagggaggcctctggtgtctcaaggcggccgctcgcagcgctgacctccacagccctgccgtgagcctgtgtgcaagcgagtccgagtcacctcccaccttgaacccatacagcctccaatggcctgggcaccatcgggggcatcccctccaacccnnnnnnnnnnnnnnnnnnnnnnnnnnnnnnnnnnnnnnnnnnnnnnnnnnncctgggcgccatcggctttgcctactccttctccagtatcctcgtggaaatccaggacacgctcgcccaggcaagcacgcctgggtgacctcctgcacttgcagagatgtagtgtggaatctagtgccagtgcatatcccatgtcacagaccggcacccttgacgcgcctgccctgcccattcaccctctgtgcagccgcccaaggctgccaagaccatgggcaaggccaccactttcgcggtgactgcctcatttgcggggatgtggagagtggtgatgctgttgatggggacgctgctctgaagcctggcggcccaaagagcctggccaggatctcaaggccctttctgctgtggcctttatctgccttcgtggtgcgccctcaagcatcaaaacccctgcagcccagtgatgagcccgttcaacccatcactcactccagtttttacttcctcgtggccatcggcgggtactccagtctcggcaatggtaggctgttgggtcattatgtctgggttgtggacgaggagaggattcggtgggcaaaccaccatgcggcacaggcaagatccagtgtacaccccatatcctgggcgatcactccacataccatgccacgcaaccccacagatgttccctcgtatatcctcggaggcctcgaaggccccgattgggtcatcttcgttgcgaatttctctgccgtcttcgctccacccagcgctccctgtctccgtcctgatacttcccttttcccacctcgctcgcacccacaggcgtcctgctgcacatgtggtctgcttaccaaatctatgcccaacccatgtttgacaccctggagtcccacatcaaggccttcaagtgggtgtagatgtgctgggcgatgggcaccgccccagccttccaaggtttgcatggcaagtactcatctcatcctctcaccacaccccctccactcgctaggctccgccaggcaagggccaagggcgacgccgagctgccgnnnnnnnnnncaccgtcttcttccccttccgctgctggtgcttgaaggggaaagggattga

SEQ ID NO: 3550 - DNA, 1143 bp, Chlorella protothecoides
atgatgagagacattgagtcaatgcgggtcatcaggcagactggtccttgggcagaaatgtggaccggtttggtgtgcacagcgaccccacgtggccccgcgcggtccccgggtcgacgcagcaatgatcctgtggatgtggaggagtgggagggcctccgcggggcagcccctccagacatggtccctaatctgacatcctctgccctgtatcatgaacttttgaggaccccgatctgcgtcgcgaggaaaaagtcctgcgaaccacgcacaggcgtcagaggagtactgcctggatcgtcagcaacagcttgcagactcccacccgaacatgcacggccttcacaccgcggcgccgaccagcatgctggcgggctctccgctagcgtccaccaccccacagcattgggtgtgtggtgggcacccatggcgccccacggtctccaagcggccccccaaggcacgccgagctgggtggcacccggattcggggtggattcaccgaggaaaatgtgccatgccaacccaccgtgcatccccctgctcaccctcctcgctcaccctccacccgacctccatcccaccgacctgcagaagtgcttggcgcgcgcctccgccacactgcacaagccggcgggatccgggcagtacacaggggctgtgtggccgggcccgagcagcggcgaccccaccacccccacccccctgcacggctcgtgcacgggtggcgcggaggctgaggagcacgctctgcgcctgcagctcgagctgcacgaccacttcatgaacgagcaggcggggtcgccccagacacgcagcggccgcgcgcggcgggtcatggagggcgcggcggcagacttggcgcggggcggcttcccctggtccgccgaggggctgctggaggcctaccgtcgctgcggggtggtcaccgcggagcacgccaagaccttctacctgggcacccagctaatgaccccagagaaggcgcgcgccatctgggccatctacgtctggtgccggcgcaccgacgagctggtggacggccccaacgcctcgcgcatcaaccctgccgtgagtgtcgtacttctcttgttgagatgggggatcccaatggtgacatggagtgggggagaggattcctga

SEQ ID NO: 3551 - DNA, 1875 bp, Chlorella protothecoides
atggatgagggggcggaaggtggacgactgtcccaccaccggggcagtactgacgggcatgcgctgcggggtggacgtaccaagccccccctgcgcacccctgctggtgtcctccttggacgcatccgacttccccatggcagcagcgggatgttgagagggaatggaggggagggatgtgaccgtgcgccctggacccgacaggtgagtgggtcgcgagtggctagttgccccggccatgcatggccgacgtccgccgcgccgggatctgcctggcacgcccagcacggaccctctagcgggtgtcgccattttcaggcagcgctgcggctggacgtacatcgcagaaatatatgctccgctgtgttctgcattggacttcatccttctgcccaagagcatccagtgcaggtgaacgagcatcccacccgctgtcaccttccgtgcatatctggactgcaccatagaggggattacaccgcagagcttacagaaagcgcaagcgtgcagcctttatgcaccataccgcaggatgcattgtgggtcccacccctatttagactcctgagtggattcaagaggactcggcgacaacgttgtgcttcttggcaaagcgctgcatggggaatgaaagggcggtccatcctgcatggaagcaaagggatcgacggaatgagggatgctgagtgccaggggctgccgaactcatctcaccacagcacaggcgctaagggtgcgcatcgcccaactcgacgcctcgcatcgctcgcctctccccatttccgagctggatacaaccatctccgaccattttctcccgtctccccggcaacttaccccttctgggaggagtacctttgcctcttgggcttcttgatcccgttcttgtgcgccttggcgctctggttgtgcgcggccagtctcgctcagcagctcccaggcctggtacccgggaggggtcgtcggggaccccctctacgcacacactcgcatttcaacagctgcgcatcctcacctgccgacccctgtgtgctactcgtgatggagagggagtgttccgaggcccgcacacctcttatgggcaggccttaccgagtcaggcggcctcccgggaaagcaagaaaacgggagtgtttgttctggcacccttctcgccaagcagttgttgctcatgcagagagacctttgcattcgggcttccctcaggctgcccatgcaataaagaatttgacatacaaaccttacttttcgaggatacatcctttttcgacccgctcttcaaagctcgtcttgtgcatccggagcacgagcaacttcagtgcacctggtgggtattccgcatgtcatcagccctctctctgcgccgccctgagccgcacctcgcctggcccacatcaggaggagctgacggccgctgactactatgcggacagctacgggcactttggaatccatgaggagatgctcaaggatgaggtgcgcacgaagacctacatgaactccatcctgcgcaatgggcacctattcaaggacaaggtggtgctggatgtggggtgcggcaccggaatcctgagcctcttcgccgccaaggctggcgccaagcatgtctacggcatcgacatgtcggccatcgccgaacaggccaagatcattgtgcgcgacaacggctatgcggtgaggagcgccggggatggtcgtggcggggtgcagctgggttcaggagcagtgggcagttcccagcgcacacgtccagccctcattccttaccttgctcgtactgcgattgatgcgagaccattcatattgcgcgaaggaccgcatcaccatcctccggggcaaggtggaggaggtcgagctgccagtggacacggttga

SEQ ID NO: 3552 - DNA, 450 bp, Chlorella protothecoides
atgaccaaggaggatgcatcgttcacggcaaactttgcgctcaccaccactcgcaaggactatgtgcacgcgctggtggcctactttgacatcgtttttgccgcctgccacaagcccatcgccttcagcacggggccgcgcagtcggtccacccactggaagcagacggtgttttacctggaggacacgctcagggtgcaccccaaggaggagatcacaggtggggaagggggccctgggcagagcagactggtgcatcctcacgatgcccacagtctttcccaggcgccgcacatgcgttgcaaagaggagtgtcggcaggaggggggatcacgcgacccaactcggctgccagaccatcctccagcacccaaacctgcccggtacatgtatgtgcagcatcccctttacccgatccctcacctcttccacccccatcaggaaccgtga

SEQ ID NO: 3553 - DNA, 1266 bp, Chlorella protothecoides
atggggaagtcggatgcgtccaaggaggacaccagcagggggggggcttggtacgtccaccccgcagcgcatgcccgtcagtactgccccggtggtgggacagtcgtccaccttccgccccctcatccatccttcgcagacctcatcctgccccagaaaaccacccccgccctggacaccagcaagtggcccctgctgctgaagaactatgacaagctgaacgtccgcacgggccactacacccccatcccctccggccacacccccctgaagcggcccctccaggagtacgtgcggtacggggtgatcaacctggacaagcccagcaacccctcctcccacgaggtggtggcctggatccggcgcatccttcgcgtggagaagacggggcacagtggcacgctggacccaaaggtcacgggcgggctgatcgtgtgtgtggatcgcgccacgcggctggtcaagtcgcagcagggcgcgggaaaggagtacgtgtgcatcgcgcgcttccactcggcggtggagggcggcaccgcgcgcgtggcgcgcgccatcgagacgctgacgggcgcgctgtaccagcgcccgcccctcatctccgcggtcaagcgccagctgcgcatccgcaccatctacgcctcgcgcctgatcgagtacgacgaggagcgtcacctggcggtgttctgggcgtcctgcgaggcagggacctacatgcgcaccctctgcgtgcacctgggcctgctgctgggcgtgggcggccacatgcaggagctgcgccgcgtgcgctccggcatcatgggcgagcgcgacaacatggtgaccatgcacgacgtgctggacgcgcagtggctgtacgacaaccacaaggacgaggcctacctgcgccgcgtggtcatgccgctggaggtgctgctgaccaactacaagcgcctggtggtcaaggactctgccatcaacgccgtctgctacggcgccaaattcatgatcccgggcctgctgcgctacgagtccgggatcgaggtggacgacgaggtggtgctgatgaccaccaagggcgaggccattgccgtgggcatcgcccagatgagcacctcggtcatggccacctgcgaccacggcgtggtggccaagatcaagcgcgtgatcatggagcgtgacacctacccgcgccgctgggggctggggcccatggcgcagaaaaaaaaggcgctgatcgcagagggaaagctggacaagcacggccggccaaacgaggccacgcccgcc

SEQ ID NO: 3554 - DNA, 1788 bp, Chlorella protothecoides
  modified_base (1673)..(1682): a, c, t, g, unknown or other
atgggtcccaccggacgccgtggctgtctttgtactgctgctcctggactccttctgcccgcccctctcatcaccctccaccacgaccatctccctttgcaatcgctctcgagcagcctgctgcggcgcgtgtacgccgggcgctcctgctccgtggcggcgccctcccgcgacgctgcggccgcggcgccgcgccgcgctcccgtccccgtctatgtcatgctccccctggacacggtctggctgctagagcgcgacggcggcgcccagcctgtgctgatccgggagaaggccatggcggtggggctggagatgctgagcgcggcgggcgtgtcgggcgtgatggtggatgtgtggtggggcatcgtggaacacgccgggccgcggcgctacgactggagcgcgtaccgccgcctgttcgacgcggtggcggccaagggcttgcgcatccaggcggtcatgagcttccacgccgcgggcggcaacgtgggcgacacctgcaccatcccgctgccgcgctgggtggtgaaggcgggcgaggccgaccctgacatcttctacacagacgcgcacggcgcgcgtaaccgcgagtgcttgagtttaggttgcgacgaggcgccggtgctggccgggcgcacgcccgtggccgcctaccgcgactttgccgccgcctttgcggccgagttccgcgacctgctggggtcgggcatcaccgaaatcacactgggcctgggccccgcgggcgagctgcgctacccctcctaccccgagggcgacgggcgctggcgcttccccggcgtgggcgagttccaatgccacgacgcctacatgctggcgagcctggcggccgccgccgcgcgcgcggggcggcccgagtgggggcgcggcgcgccgcacgacgccggcgcctacaactcgcgcgcgcacgagacggggttcttccatgacgtccacggccgttgggacaccgacggcggggttggcggtgctgcgcccggcgccgccggccacaggggagggccgccgcaccccgcggacgcgccaccgccggcctcccacccagcgacctcggcctcccatcagacgaccacgcccttggacgccagcgcgtcgacgctgctgcgcttccgccctgccgccgcgctgggcgtgaagctggctggcgtgcactggtggtacaccacgcgcgcccacgccgccgagctgaccgccggggtgtacaacacgcgccagcgcgatgggtacgagggtatcatgcgcgtgctggcgcggcacggcgccgccgccagcttcacctgcgtggagatgcgcgactgcgagcaccccgccgaggcggcctgctcgccggaggggctgctgggccaggtgctggccgccgcggcgcgggcgggcgtgcccctgggcggcgagaatgcgctgcagcgctacgaccgcgccgcctttgacaagatcgccgagtcagcagtgggcaggagcgtgctcgccggcaggctggaggatgggcgacatgatggtggacaactgggacgcgttcagctccttcctgcagcggctgacggggccgctgtgctgaggagtgcgcggcctgtcagcagcaccgcaggcactgtggagcttgcagactccaacatccatcatcgcgccccctcccccaaaccccaccccccaaaccnnnnnnnnnngctgtggagcttgcaggctccaacatccctcatcgcgcaccctcccccaaaccccaccccccaaaccccaccccctcgctgtcgattaccggcatggacgccttga

SEQ ID NO: 3555 - DNA, 873 bp, Chlorella protothecoides
  modified_base (808)..(817): a, c, t, g, unknown or other
atgtcacaggaaaggggactgcaggtggtcaccaacccacggccagtggtcaaagatgcgcaactggaccgactgcgcgaggagcgcgaggtgcaccgtcatcgacaaatctggaccaaggatgctcatggaggaccatacaaaaaggtaatggtcgtctcgggtgatccctctgtgcaggggcttgccatactggttcgcctcggcatcccctggcttgccccccctccctgctcgcaggtcaacgacggcaaagggtacgaccctctcttgcaaaccccggacggcaaggataaggaggtgagtggggaccgtgacatcaatgcctgggacggtctcttgggatttggacgccagtgcttgcacaagtcacgggaggagggacgtgctgagaactctctgtgcacaccaccacgggacgcgcttccaggtccctccctgccgccgtccccagtaccttgcccctccccaccaccaccacagtgggcgctggggtatgagcgtgtcaaggtgggccccaccaccaacttcgtgggcaaccacatgacccaggcggccatcgacctcgtccaggcccacctccagccgccgcgggagcccgtctcggaccccggcgccctgcgcttgacccagggcgcggagcacgggccgaagctcctgcaggtgacccctccccagtctgaacagcatgcaggcagccctataagggccctggacaggtacaggtggcaggacgcagcggagagcgtggatatcagtgtcgagctgccacagaatgggccctgggacgtaacctgcgaggtgacgnnnnnnnnnnggcggacagcgtggatatcagcgtcgagctgccacagaacgggccctgggacgtaa

SEQ ID NO: 3556 - DNA, 1455 bp, Chlorella protothecoides
atggcggacagtagagcaccagggctcgcccacccgggagaggatcatgaggcgccaccaccgcctccaccacgagtcgaggtgccagggcccctcttgtcacccactgtcctgggcgaggacagcagctccctctccatcagtctccacccagcgtctgtgctccagacctcccatgatggccggccacgacacttcggtctaaactatgacctgcagatgcagcagaggatcacatccttgctgcagcagctgcctcgcgccacgtcatggacccgtgctgccatcgcattgctgaaccttcacccctccctgccacagcttcatgaagatcagggtgtgagggaccataagtggtgcacccaggttggtcagggctggccttttgggtgggacagcgatgcgccatgctgcatgcagtaccttgggcccgagacgcacgtcagggtgaatggcctgcggcccggtcggacatacgccatccgggtcagggtccagctcgtctgcgacgaccctgaggtggagctggcgacgcccccgccctcgcccatctgcaccaccagcaccaccccgactcccccccaagcccctgctgctccgggactctccagccggcagaggaacgcgctcaaggtgcggggtgctgtggtggacacagccttgcctctccgccgtctccgtgccgggatcgggaacacctggttgcggggctgggcccgggttccatccgacctgtctgcctgccctgcacagttcaagtggtgcgaccctgacgagaccggtggcagacctatcctggagtgggtcctgcaggtggcgggccctggcgtgtctgaagacccccaggtgactgcgggtgacttctgtgacgtgtgggagggattacacggattgacgcagcatcgcagcaggagaccttgccaggtcaatttcggtggggtttgccgtgctttcctaccatacgccctggaaggtaccacaaaacccagccggtgcaccgctctgcttcaccttggcaatggtaacgtgtctgacacaggggctgcacaccgtctaccggggcgccgacacctcgttccttctgaagaggctggcgtgcgggactcggccatctcctgcattggagagagcccctggagcccgacctgctctgtttcgacaccggcggcggtgccggccgcgcccctggcgcctgtcgtcgtcgagcgcgacgccagcagcgtgacgctgacctggcacgccccgcacaacaacggcagcgacctcaccggctacctgctggagctggatgacggcgggtgcggggaggtcacgggggtgaggtggtgggattggtgtcgcgcgtcatgtctttgtgagggccactcgcatctgtgccaagcgccgctcgctgcttggggtcggccgtggggcgtgcatggctccaggggtgtcctcggctggcacgcgacttga

SEQ ID NO: 3557 - DNA, 2088 bp, Chlorella protothecoides
atggaatggcagtggggtggcctcgctgcgctgccctttcctcctagtcgtccacatcttgggggtgcgaggagtgcctgttctgggggggtcctcgtgcgggcgtggcccctcacagggtcgcgtgcccgctggccgggagggtcgccaggacggtctccgatgccgtcctggagtggctcctcccatcggcgccggcgtgccctgctgcgaccgacccccccccccgtcccgcctcagggctgtcgctggcgtgggctgccccgccccacgacggcggctctggcatcacagggtatcgattggagctggtcttcgccggctggcaggaggcagcggaggggaggcagcctgcgcaaggcatgggggagggggagatggggagtggagggctgcaagggggagtgggcgaggggcgcagaccgcaccaggttcctaccgagtgcacggacgcgcgcgcgtcgcatgcctcgtgctgccgccgtcctgcgcatgcgagccatgcagggccaggggaccagccccagcaccccatcagcaccacgcccgtggtcaggaccccccctctcggccccaccgaatgcgtgtgcaggcagcgaggtcctggcatgcgactcgagctcggctgtcgtgcaggccctggagccgggcgcgctcttcacggctcgcgtctgtgcgctgaacgcgcacgggtcttccccccacagcgcgccaggtcgggggaggtggcggttgtggggcggggggtgggcagctggtgtggtcttgcagtccccgagtgggcaggccctggaagcctcgccagcgagcaggtgcttggccccccagggctcaaacgccagggaaacagccacgatgcgcaccacaaacccctctccacacccagtcctacctgcccccctcttcccgcccaccccggcagtgaccctggagacggcgcccggcaggcccgccgccccagaccggccccgtctcctccgcgcttcgggcgccgatctgacgatcggctggagcgccccctacgggcggggcggcggcgtgcgcagcttccagctccgcatcgcgcccgccgctgcgtgtctgcgccccgagagcctgcccggggagccgcctcgatgcagcgcccaggcctactccggccccgccacgtcctgcaccgctcgaagcgggggaggggcgctggggtgctgggtggccgaggcccggcagggcgccgccgtgctgcacgttgagaaagccgctacgcatgctgggcccgcctcactcccctccacccgtcacgcagtgcctgacctgcagcccgcgacaccctaccgcgcctgggtggcgggcgagaacgcggcggggaagggggagtggtcggcgccgctggagtgccggacccagcctgtggggccctccccaccccaggccctggctgtggagccgggtgcgcatttcagccgggtggcacggtctcgatgggtcggctgccgcggcgccgcgctgtcctgggcgccgcctgcgctggacaatgggagcccggtgctggggtacgccttgcaggcggggcccgctgctcgcagggccggctggagacaggtccatgtgagcgatgcagctggagggtcctgcgtcgcacgggtgcgagacgaaagggcgcggtgcctcgagggagttgtgaatgcaccggagaaacgagtccgatggcctcgctttcttgggctgatggatccttcaaggctgatgcagactccggcatgtcgtgaaaatcccggcaggcacggctgcatctgccttttggatgttgagatgcactccatggcacgaaatgctgcgccaggcaggctgcaggtcgatcgtgggcctggaacgaggctggggaggggccatggtcggaggtcgtcaccctggccctgccacccgacgtgccagctcaagtcgggaggtggagtgtgggccacggggcaaggcgtactgtgcggtgctgcagagcactgtcccacagggcacgctcggcatttgcgtggaaaggaagtggttgagagcccgccctgccccaaagccccttctggcccagcccggcagccggcagggagtggctggtga

SEQ ID NO: 3558 - DNA, 273 bp, Chlorella protothecoides
atgagctcggtcacgcccctggagcacaccgccattggtggcgtggcggggttcacggagacctgcatcatgcagcccaccatcgccatcaaaaacgcgctgcaggagggccgtcccatcccccgatcgcccatgaccctgtaccgcggcctggcgggacgtgccctttggaaaagggaggggtccggccctcgtcatccgtgcactgaagatggacaagcacgccatactgcgctgaaattcacggaatgcccaaatctgtgcggccaatga

SEQ ID NO: 3559 - DNA, 1242 bp, Chlorella protothecoides
atgaagactgggaccggcagcacccaggtggcgagagccgtctggacggtggggcgccaccccacccacgtcctgcgcctgccctcccaaggcccccctcgcctgaacgtcctgatcatccctggcaatcctggggtggcagagtactatgagcccttcatgcacagcctgcaccagggtctgcgaggcagggcctgcatcacatgcgtgtcccagctgggcatggacggccagggcctaacctcggggcgtcaggcatgcttcaaggccgatcttcttctccctgacgtggtccagccgctcaaacaaagtggtcgcaggggacaggggcatgcagtggtagactccatgcggcatcttgccccccgccatccgagggctccttacccccggcaggtcttctccctgagcgaccagatccagcacaagagtgacctgctgcgccagcacttcagccaggagggccagccccccctggccctgctggcccacagcatcggggcctacatggccatcaaggccgcggcgggggcggccgacgcccgcgtccgcgccgtggtcgccatgtaccccttcctggagcacgacccagcctgtccccgtcagcgcagcctggcctggttgagtcggcgctggcggtgggtggggcggctggtggcccccctccagctcctgccgcacccctggctcaggtgggagggagggaaaggggggggggaggagggggcgcgcgcacgcggcccggtggggccggtgcggctgttcaagaccccgcgctgcgacggggagggcacggctgccgggcctggggccccaggtgcagcgggccgtagcctcttccctggccgcccccaacagcagccgccctttggcacactttgggccgtcactcgcccaagcattcccatcattcttccgcccgcgctgcgcagtgccgtggtgcgagtgcagtcggggatgcaggaggagcacgctctggcggcgacgcggctcgtgctgcgcccggactcggtgcgcaacgcgctcttcctggccagcaccgagtttgctgagctggaggggtcgctgccctgggatgacgttcggaggctgccctccttcacggcgtacctggcggagggggacatgtggtgccccgcctggcagcagcagctgctcgagaaggtgtattggggaggggtgaagggaatccctgcaccgcgtgagtggctgtccaccctacgggatggcacctggctttga

SEQ ID NO: 3560 - DNA, 1935 bp, Chlorella protothecoides
  modified_base (417)..(523): a, c, t, g, unknown or other
  modified_base (577)..(586): a, c, t, g, unknown or other
  modified_base (640)..(649): a, c, t, g, unknown or other
  modified_base (809)..(854): a, c, t, g, unknown or other
atggctgccgtcgccccggcaaccaccaccccggccccggccaccccctccaccgaggccgccccggcccagccccaggccaaccccgccctggccaactcctccctgtacgtcggcgaccttgaccgcgacgttgccgaggcgcagctctacgaggtcttcgcccagattgggcccgtggcttccatccgcgtgtgccgcgacgccgtgacccgtcgctccttgggctacgcctacgtcaactacaactctggcgtcgatgccggcgcaggtgcgtcagcgagggtctttggttaccatcgccctccgtggcatgctttcgcgtgcaaatgcctgtctggctggattcaggcgcaaggctgggccagccatgtcttgtgtgtcagcagcagggggctgtttgatcctctaccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctcgcaaggcttcctgtgctcttccccttacctgacatttccaccccaccannnnnnnnnnacctcgcaaggcttcctgtgctcttcccctcgcctgacacttccaccccacccnnnnnnnnnntttcgcgtgcaaatgcctgtctggctggatgcaggcgcaaggcttggccagccatgtcctgtgtgtcagcagcagggggctatttgatcctcttcccttcctgtggacgaccatgccacgttctctgcagcccgtcgcacaatctacctgttcatctccnnnnnnnnnnnnnnnnnnnnnnnnnnnnnnnnnnnnnnnnnnnnnncacttctgctgcagccgagcgtgccctggagcagctcaactatgcccccctggcgggccgccccatgcggctgatgtggagccaccgtgacccctcctaccgcaagtctggcgtgggcaacatcttcatcaagaacctggacaagtccatcgacaacaaggccctgcacgacaccttctccgcctttggcaacatcctgtcctgcaaggtggccctggacgccgcgggcgagtccaagggctacggcttcgttcactacgaggcggacgaggcggcgcgcctggccatcgccaaggtgaacggcatgctgctggaggacaagaaggtgtacgtgggccccttcctgcgtcgcagcgagcgtgcggccgagtctggcggccgcttcaccaacgtgtttgtcaagaacctggacgaatcggtggacgacgaggcgctgaaggccgcctttgccgcccacggcgcggtctcctccgccgtggtcatgcgcggcgaggacggcgcctcccgcggctttggcttcgtgtccttcgaggagcccgaggcggcggccgcggcggtggaggcgctcaacggcgcgcccctggccggcaaggagctgttcgtggggcgtgcgcagaagaaggcggagcgcgaggccatgctgcgcgcgcggttcgaggatgtgcgcgcggagcgcatcgcgcgctaccagggcatgaacctgtacgtgaagaacctgcccgacgacgccgacgacgagttcctgcgcgcgacgtttgcgccctacggcaccatcacctccgccaaggtcatggtggatgcggccagcggcaagccccgcggcttcggcttcgtctgctacgcctcgccggaggaggccacccgcgccgtcagcgagctgaacaaccacatgctgcgcggcaagcccgtgtacgtggccctggcccagcggcgcgaggtgcgccgcgcgcagctggagcagcagcacgcgcagcgcatggtgctgggcgcgccgcgcgggccgctgggcggccccgccccgggcatgcccggcatgttcccgcccggcgcgggcgcgccgctgtactacggcgcgccgcgc

SEQ ID NO: 3561 - DNA, 1008 bp, Chlorella protothecoides
  modified_base (352)..(361): a, c, t, g, unknown or other
atgtcaggcccggcttcgcttcatgctgtgacgtgggctgagaagttcgccccaggcaccgtagattggcttggactcaagatctatgcacggttatctacatggttagaacacggaacagaacacgagccacatcaaccgcttgacgagcacggccgcgcgtcgtcctcatgcgcacctgccgtcgcgctcgacaacgcgcgcagagcatggcagtacccggagaggggtggctctctagaaggtcgcagcatggatttgcacacagcaggtcattgcgcaggggcgggtcggtccagcaacacaacaacactcgcaagcatatattgcattgcttatttgctgaagctannnnnnnnnngcatggatttgcacacagcaggcactgacccgacctcgatcaagatgcctctctcccctcccgttcagtgggcacagcgcaaggacaggttgtacctcacctttgacctgcaagactgcaaggaccccaccatcgaggtgaagaacgacgaggcctcccagagtggccgcgtcagtttcaagggaaacgctcattcccatgccacaggacctgatgagcacacatactccatggacctggagctgtatggcgagatcgacgacagcgatgtcaagcaggtgaagaccgaccggacagtggtcctgatcctggcgaagaaggaggaggggccccactggccccggctcctcaaggccgcagggcgcgcgccctccaacgtcaaggtggactggaaccggtgggttgatgaggacgaggagggcacgggcggcctggaggaggatggctttgacctctccgccctccagaacctgggtggtggcggcgccggcgccggcggcatgcccgacttctcctccctcctcgggggtgcggggggcccgggcctggagggcctgggggcgggcgagtttggcgaggaggacgacgagagctccgaggacggcgacctgccgccgctggagggtgacaagcccgctgctgcctag

SEQ ID NO: 3562 - DNA, 1404 bp, Chlorella protothecoides
  modified_base (1376)..(1385): a, c, t, g, unknown or other
atggtaaagcagggcaaggccttgctcaagcatgattttgtgtttcatgtctgggaccccattggtggtgcacaaccctgccatgtcccctcttgggtgccctcggctcatggccatctttggacccattgtgcaccatcacgaggccacggtccttctctcctgcctgcacatgtgcgcatgagctggcactgccttgcaacctgtcgtgccgcgtctgacgaagcgggatgttcaggatctcggccatcagacggggccatgccgctggtccagagattgcggcatggcgcggcggccgccctgaagactggcgccctcgtggcaacgctgctctcacccatggcagcccaggcctacaccccagcagctctcttcggaggtagcacactcactgcgccacgggaggcacccagcatccaggagaacaaggtgggacagcggatagtctgcatcggggtgcagctgccgatgggagtcacatgcactggggtggcaactatcgactcaggcctgcattgccacttaggcagcatcgctctggacatcagtatcaggtttttcctcatgtatgcatcaatgcaaccccacagcaacctgagccgtctgacctcacgcccgaggagcagcagagtgttcacatcttcaaagaaaacacgtagccctgccatgtcccctcttgggtcccctcggctcacggccgtctttgcacccattgtacaccagcacgaggccacggtcctccccacctgcctgcacatgtgcgcatggcctggcactggaagactttgtctcctcattctccaacctcacgctccacaggccggcggtggtgaacatagccaacatcgccaccaagcgcgcctacctctccaccgacctcctgcgcctgccccagggccaggggtccggcttcctctgggacgaccagggccacgtggtgaccaactaccacgtcatccgcggcgcttcagaggtccgcgtcacgctcatcgaccagagcgtgtacagcgcgaggctggtggggggcgacccctcgcgggacattgccgtcctccagctggacgccccgcccgccagcctggccgccctcaaggccgtggaagtgtcgcggtgggccttccacgtctggaagtgagggggcaaccaaacgtgccaagtcgtctctggcatccatgctcgtcatgctcacccccagcccatcgtccacctcgcctccagggaaagagcagcggcctagctgtgggtcaaaaggtgtacgccatcggcaacccctttggcctggaccacacgctgactagcggcatcatctctggcttgaatcgggagctgggagcgggtgaggcggggcgtaaaggggatagttgggtggtcgnnnnnnnnnngggagctgggagcgggtga

SEQ ID NO: 3563 - DNA, 1065 bp, Chlorella protothecoides
  modified_base (322)..(331): a, c, t, g, unknown or other
  modified_base (737)..(746): a, c, t, g, unknown or other
  modified_base (840)..(936): a, c, t, g, unknown or other
atgtatcattctgacaacgccacactttctattggtacatctgcccactccttctcccccccctcggcaccgcagctggacaatcctgctgtgttcccgcagcgatacggtgcagcattcccccgcgactttctgaacactgtgaagacaatcctaaaacgactgttccgagtgtatgcccacatatatcactcccacttcaagtacgcggtggcttggtacacagggaaagggggtgctttctgggtggcaaggagttttgcccaacggagcgaatatgattctgcgcacacattcagcactcctggcgggccaatctccnnnnnnnnnnacttcaagtacgcggtggcttggtacacagagaaagggtgtgctttcttggtggcaaggaactttgcccaacggagggaatatgattctacgcatacattgagcactcctggcgggccaatccctgtcttgcaatgctcctgtgcaggcagatcagactgctctcccaacccaccagggtgggatccagtgcctctactccttcattgtctccctccctgtgctccctgtcgctctggatgctgctcgacgtgtcatttccactctacgccccctgttcctgcagggcaatcgcctcatcgacgatcgggaactggcgcccatgaaggagctcatagacaagctgacaaggggggggccatgactgccagcccattttgctatggcggtaaacatcctgctgaaannnnnnnnnngggtgggatccagtgcctctactccttcatcgtctccctccctgtgctcctgtcgctctggatgctgctcggcgtgtcatttccactctacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagctcatagacaagctgacaagggggggcccatgaccgccagcccgttctgctatggcggtaaacatcctgctgaactccttctcactgtgcctggcgtcacctctcatcatcacacccacctttga

SEQ ID NO: 3564 - DNA, 1254 bp, Chlorella protothecoides
  modified_base (128)..(137): a, c, t, g, unknown or other
  modified_base (259)..(268): a, c, t, g, unknown or other
  modified_base (329)..(338): a, c, t, g, unknown or other
  modified_base (874)..(883): a, c, t, g, unknown or other
  modified_base (950)..(959): a, c, t, g, unknown or other
atgtcccccaggcccaacgactttggccgggagcggagccgggatcgcagcaggaatggacatggggatggggagcgacacacgcaggggcctcggagggtgaagggggcagttgagattgctccacnnnnnnnnnntgagtggggcacctttggaatggattggaatgggtgtgacctgctgctggacgctgcgccgaccgtcccaaccactgctcctggccctgacgtactgacccccactcgtatctctctactgnnnnnnnnnntgcctgggcggagcggatcacacgagcagttcaggcgcgagactataccgaagccgctcgnnnnnnnnnntgagtggggcacctttggaatggattggaaagggtgtgacctgctgctcgacgctgagccgaacgtcccaaccactgctcctggccccgacgtgctgacccccactccgctgcacgaaccaagtgctgtcctcgaggggccaggatcgtgcgatggcgagcttcttcaatttctccaagtactgcacgggttggtgttgatcctcgcagcgaatgttgtaatgcacctgtattcagatgcagacttaatcacaccgcaatcgcaggaagggcggcaccttcagctcaatacacgagcatcttcgcagggactgacactgaagcagcacatcgagcacaccctcggcactgggaccatcgaggaggcagtgcgcctgccaccaggtgagctgggggcacctgggaggagagtccagagggcagattcacgcccaaatttgagcccatgcctgccgccaggtggtcttacatgttccacagcaatgcattgcatccacactctcccagcaaactccgcatctgtcgttgtatacctgnnnnnnnnnnaggaggggaggcctgcagccctatctcttgacattcgtaaattgatgtgcatatcacacttgggtannnnnnnnnnaccctgtttgactgggtggaggaacaggtttgtggcagacaggagaaattggcctcatgcaaacctcctggcggctggcagctctgacgcaggatgcttactgtggcttgcacgcattgcattctttgatcgtgatcgttcgcattatgagtacctctgggcagacggtgtccgtgtcaagcaccctgtcaagctgtcggcgcccgcctatgtcaacaccctgtttgactgggtggaggaacaggttagtggtagacaggagaaagtggcctcatgcaaacctcctggcggctag

SEQ ID NO: 3565 - DNA, 2709 bp, Chlorella protothecoides
  modified_base (194)..(203): a, c, t, g, unknown or other
  modified_base (1427)..(1444): a, c, t, g, unknown or other
  modified_base (2585)..(2594): a, c, t, g, unknown or other
atggtgtcacggacacgcaaagtgccggggctctgcatggtatcgcctgtgacgcatacacactgcaccgcagtttcgataccctgcatgcccgcagtgttagtccggccaaaaagacgtcctgggccagacccagacattcagcttcacaacatacccctttggggaacgcgccatgcacacacccagagggnnnnnnnnnncccagacattcagcttcacaacatacccctctggggatcatgccgcgcacacgcccagaggtatgcccccacctttcagctgggccttgggcgccgtgtcgatgagcttggagaccacaaacttgccgtaggggctcttggacagctcttggagcttgggcttgagctccgccaggatctcagcgcgctccgcatcgctgccgtgcttcacgcaggcctgcacgatcctggaggcggtgtgcgaggaagcgagctccaccaggcgccccttgatcttggacagcacctgggtggtcagctggctccgtcgctcgggcgttacgtcgtgccggcgcagctcctcccagagggaagtagcatcctggcaggggggggccgagtgagagcagtggggtgcctggatggagtgacagcagcagctgtgcttggggagctcagcgcatgtttctccattctaagggcttcctcgacggctgcaagccggtcacaacacccaaccaggcacctgaatgaggtcaaagttacgcttgaccttggacttgcgctcgcgcagggcttccttgcgctccttgctagggtcgtggacggattcaggatactgtcaagtggctgggatgtgttgcagatgttcctagcactggggagtgatccctctatgttgcgcattcttaaagcatctcccgccttccatacagaccttgattgtggcttgctggggagggacggcttggcaggcgcagacttgcggtcgctgtggccgccggcgtgggacgacttcggccgctttgcatccttgccaggaccacttgcaggccttttactactcttgacaggcttggacgcttcccttgccatgtcggcgccagaggtgggggaaagttacttgtctaaggtcgctgcatcccttgggagcagccgcgaccgagtgctcgagcagtccggtttgtacggatttcaatcgaacactcgttcaaagtgcgatgtttatatactgaagccagatgttaagagccacgcgcaccagttggagctcccatcgcctgttctctgcgatgcacgtcagcggcgtgacagcgctggcgggaagcaacccacatccctacgacaagaattctccccagccggccgggaccgagtgctcgagcagtccggtttgtgcgtatttcaatccaacactcgttcaaagttcgatgttgatatactaaagccagatattaagagctnnnnnnnnnnnnnnnnnnacgcattcaacatacggggaataccgctcgggaattgtgagggaagagacgttggccatcaaggggcagtgcccaccgaacagagcgctggagtggggcctggcgtgagggcgacgccatggatttcgccaagaagtacgcttcaacagatggttcttctgccccagtccttcctcgcccagcgcatcgatgagaagaatcgcatgaaggacagcgtgacgggtcatcgcaccggtctcaccgagcgcctgctgaagcttttcgctccccggccacctctggagtcagtgccggtgccaccccccaagcccaaggccgtcccgctctccggcatcgcccagtacatggacaagtttgccgggcccggcgatcccgagtaccacggcgcccaggagataaaggaagagacccgcttgttccgcagccctgagctccagtatcaggccaggatcgatgtggagacgctgcctgagcggggtgcatggagacgttgtttccctgctggcaggctggcctgggggagatacatcaccgtcggcgccggggagcctgctgccaggagtgcaggacccctgggttgcccaccgctccgcctggcgcggtccgtgtctctcccccccccccgcgcgcgctcctccacttcaccccgtcgcacccctctgcctccctgcagggacatccggctggctgcggaggcccaggcagccgccgccgcggcgatccgggagggcctggaaacatgggacccgaccaaggaccccaacgtgcagggcgaccccttcaaaacgctgttcgtggggcggctgtcctacgacacctcggagcggaagctgcgccgcgagatggaggagtttgggcccatccgccgcatccgcattgtgcacgaccgcaacacaggcaagccgcgtggctacgcctttgtcgagttcgagcacaagaacgacatgaagcaggcgtacaagctggctgaggggcgcaaggtggaggaccgccgcatcctcgtggacgtggagcggggccgcgccgtcaccgggtgcatcgaggcccagagggcctcgatgctgcatgcacgcccaatgtacaggagcctcaccgctaaccctgccatgcgcccggcccagaaccctggccggatgaccgnnnnnnnnnngcatgtcgaggcagttgactctctcctgagcaaagacaggagtttagggcagctcagatccccagagggcctcgatgctgcatgcacgcccaatgtacaggagcctcaccgctaa

SEQ ID NO: 3566 - DNA, 798 bp, Chlorella protothecoides
atggtccttggctgcaaggcaccaagagcgggagctgtggatggcaactggcctgcacctgacagcctgcatgcaggcgcaccggctgtggctgtgcctgctgatctgtatgcagtgggatgcctacttgcagaagttgcaagcaatctcttgtttattatcgagtgttgcccacgcaattccgccaatcctaccactcatacacatatactgctcctcctgtgcgtcccagggactaacaacggacccagtctgcgcaacgtgatccagaccgacgccgcgatcaaccctgggaacagcggggggcccctgctggactccaagggcaggctcatcggcatcaacaccgccatcgccgaccccacaggttatctgtacctggactgcccagggtctttcacctgcctttccttttccgcccacgtcaaaccaccccccccttctccccaaacacctgccacaggcaagggcgccagcagcggcatcggcttcgccatccccatcgacgcgtgccggggcctggtggaccagatcctgacctatggacgagtggtgcgaccgatgctgggcatcaccctggccccgccccaggccctgcgccagctgggcctctctggggtgctggtgctggacgtgcccccaggcggccccgctgacgccgccggggtcaaaggcaccatgcgcgatgggtttgggcgcgtggtcctgggcgacgtcatcgtgggcgtgaacggcaggaaggtggccaacgagggcgatcttttcgatgcgctggactcgtgcaaggtaggcgtgtga

SEQ ID NO: 3567 - DNA, 270 bp, Chlorella protothecoides
atggcgccctttgacccctataataccctgggggtaccgcacggtgcaggggaggcccagatcaagcaggcatacaggtccctgtccctgcagtaccacccggacaagaaccccgacccggaggccacaaagtactttgccagccacatcaccaaggcatatgagacgctgacagatccggtcaagtttgcaaactggcaggagtatggacatcccgatgggatgcaggactacgacgagaggtctgtgcccatcgtgttggtggggtag

SEQ ID NO: 3568 - DNA, 690 bp, Chlorella protothecoides
atggcaagggaagcgtccaagcctgtcaagagtagtaaaaggcctgcaagtggtcctggcaaggatgcaaagcggccgaagtcgtcccacgccggcggccacagcgaccgcaagtctgcgcctgccaagccgtccctccccagcaagccacaatcaaggtctgtatggaaggcgggagatgctttaagaatgcgcaacatagagggatcactccccagtgctaggaacatctgcaacacatcccagccacttgacagtatcctgaatccgtccacgaccctagcaaggagcgcaaggaagccctgcgcgagcgcaagtccaaggtcaagcgcaccccactgctctcactcggcccccccctgccaggatgctacttccctctgggaggagctgcgccggcacgacgtaacgcccgagcgacggagccagctgaccacccaggtgctgtccaagatcaaggggcgcctggtggagctcgcttcctcgcacaccgcctccaggatcgtgcaggcctgcgtgaagcacggcagcgatgcggagcgcgctgagatcctggcggagctcaagcccaagctccaagagctgtccaagagcccctacggcaagtttgtggtctccaagctcatcgacacggcgcccaaggcccagctgaaaggtgggggcatacctctgggcgtgtgcgcggcatga

SEQ ID NO: 3569 - DNA, 579 bp, Chlorella protothecoides
atgtccggcgtcgtcaaggtcctgcgcctgcagaacttccagattctccggcagttgaagctggaagaggcgctactccgcgcatccaacgacaactggtttcttgtgaatgacggcaccccagaccccgccatcgtgctgggaatctcgggaggcctgtcctgggtggttgagggccccgagtggctggggcgtctgggtggccgtggacctccacaacagggaatggcaccccgtgaagactcacttcactcgttccactgcaggaagcctgaggtgatggtccacgaggtggctgcaaggaaggcgggtgtgaccctcattcgccgtttcaccggtggaggcacggtggtggtggacagcgacaccctcttcaccggcctcatcatgggtgtggacgaggtgccaggcctggaacccttccccaggcccatcatgaagtggacggaggacctgttcaagcctgtatttggcaagtatggcgattttgcccttcgagaacatggtgagtggaacgtgttggtgtgtgggtggtggtggacggaaggatacagcaccattacaaaacatctgacatag

SEQ ID NO: 3570 - DNA, 765 bp, Chlorella protothecoides
atgcggatgtgttccggcccttcacgttgtcacccgtcatcctcccactcctccccaggccaaggtcagtgcggcagcaatggcttcacttgcctcgactgcagcagggcctttgaccgctggacggtggcagggcacacctcctgcgtcaccgagcacgagaagtatgctcagggcgccaccaagccagggggctatgcctccaagggctgttttgcgagtcaggcggcgcaccaggcggcggcggaaccctcggcggagggccttgtcggaccgcagtttctgtcggaaagggcgccctggaggtgtagcgtctgctctgtgacgtgcaccagtcgcgagtccctggagggccatgcctctggcgctaaacaccagcgacgggcgagggctgcaatggcggctgccgccggcccacttcctgagggaggaaaacctggttcgggtcacgacggcgcggcgccagtctccgaggccgcggctgcagctgtgtcagggaagccatcgctggagacaagtgggaagcggcccagggatggggaggaccttgcaccaacagggcctcccaagaaaatcaagtggaaaaagcttgctgctgcagagctgaaccggaaggggggcagcatgaagctgaagaagctcaccgcagctgttctcgccgcggctggccgaggggaggacagcgctgcagagctgcttcagaaactggagagctcggggcgattcagcctgaaggagaaccgcgttgccctggttgacgagtaa

SEQ ID NO: 3571 - DNA, 1128 bp, Chlorella protothecoides
atgcccaggtgggcaggcgctttgtggtggggacttgagcgtgccgagggctcagctgtgcgggctgcagccctgaaatggctgcctgcttcgtcggcaggtcatatgcctacgctgagaggccagggtcttcacctgatcggcctcttctccttctacgaggacgggcacggcgagtgctgtcgcgtgcgcaaggtgcgccccctgcgccgccagctggcgggcctgggcgcctgggtgacgggccagcgcaaggaccagtctccggggacgcgccaggcggtgcccgtggtgcaggtggatccggtgttcgagggtgcatcgggcgggcccggctccctgatcaagtacaacccgctgtccaacatgaccagcacggaggtgtggaacttcctgcgcgtcatgggcgtgcccaccaacgccctccacggcgcgggctacgtgtccatcggctgcgagccctgcacgcgccccgtgctgccaggccagcacgagcgcgaggggcggtggtggtgggaggacgccgccgccaaggagtgcggcctgcactccggcaacgtcgtgcgcagcgcggaggagcaggccgcgcgagaggcggcggccgccgacctctggcagagcggggacgtggcggcgctgagcaaggagcagctgagcgccgcgctggaggacgtcgcggggcgaggcgagcccaccctggtggtactctacgcgccctggtgccccttctgccaggtgggcgggcggggcggggccgtttcggggtgtgcgcctgcgacccggggcgggggaccgtttgtggacgagtgcgtctgtaggagcggctgggaacgacggcccctcaccctctcgctcatgcccccccgggtgaagcttcagttgcctgccagagggcaggatgggcaggcaagcctccgacctcgctgccacctgggcgccatggagccggcgtatgctgaactggcgcgccagctggcggggtcgggcgtgaaggtggccaagttccaggcagacgtcgagcgcgagtttgccgcaaccaagtttggcctggagaccttccccaccatcgtcctgctgccgcagaagacccctggtgcgtgcacagggagcggccagtggcttttctag

SEQ ID NO: 3572 - DNA, 1596 bp, Chlorella protothecoides
atgaccgcgtacctctcctccaagctgatccttgaccttgatgctcagtacattggggtcggacgcaccctcgggcttgatgttggccttcgagtcctcgcccgtgtcactcatttttcaaacgccgtgcacgataagctgcccacagcctgtgttccaggtaatcgcccactcctcgaagaagccacaggctcctccttcacagatcgtcggagttattcagcactcgaggaaggttcctatcacaggagctggcaaggtaatcatcggggagcttccgctgcaccagagatctgcgagatgcccgtgcggggcgtgcggtcggacaacgctcaggccgcgcgccacttccatgcgctcgacctcgcacacaggatggacagtcttggcgttgagcctactcataacagtcacatctgccatgacaaatcggcccgtcgggcgagacctcacaagatctctggagccatggtgagtctgggggttgccagcagggccgtacggactttcccacagccctcccctatttcctggttggttgccagctggtgtcccagtgtgccagccctaccctgcaatccaccacgcggcaggatcgagcagctgtcctggaaaccgcgagcgtacctgtaccataacttcctgacggccgccgacgcggatcacctggtggcgatcgcgaagcccttggtgcgccacttaacttgggggtggtggggtggtccacacttcaggtctttctacatgtgtttggtagagtgcatcctcaagacgctgtcggaggaacccttcaggcttacaaagcagtggtggaggctcgttcggaggagaagcgcattgtactggcagcgcatcgcggtccagggaagggcgagagccactcagcacctttcctccctttcctccacctcctgcagatgcagcgctccacggtggttggactgggcgggaagtctgtgctggacaacgtgcggacctcctacggcaccttccttcgccgctaccaggtggccccccgggcagggtccagtctctgaatcggcaatcgggtggcaggagagctgtggccccgggggctgtttgcggggccatggaggcacggcggcctctgcaccaccaggtcccgacgttggcccaccctttcctgcccccgcacctgcactgcaggaccccgtggtggcagccatggaggagcggctggcgtcgtggaccaagctgaacattacgcaccaggaggacacccagatcctgcgctacggccctgggcagaagtacggcgcgcactatgactcgctggacaacgactccccccgcaccgccaccgtcctcgtctacctggccgacaccgaggagggaggcgagaccgcgttccccacggtccgcggggctgcaaggggatgggttgtgtgtgtgtctcctgggcaggtcgtgggccgggcccagttctggcgctcgccgggagcaggagtacatgcgcaccggggtgcagcccggcagggtgctggcgcccagcgtgtgccctgctgccctccgccatgcgcccaccctctcgaactacgaacagcacgagacttggccatgcatgaaagggcgtga

SEQ ID NO: 3573 - DNA, 627 bp, Chlorella protothecoides
atggtaatctctccccgacatcgcaaacggtgccgaacgtgctcacctccgcaggtcgtgttcaaggtgaagaagtccaccaagttcgaaaagatcctgaacgccttctgtcagaagaaggctgtggcgatctcggaagtgaggtttgtgtttgatggcaccaggatcaacccaagtatgacaccagaggacatggagatggaggatggggacacggtcccgacgccttggctcctgcacccatcccatcgatgcaggcacccctggctatctgatgtgtcagggccctctctttcctgcatagtcggtcacaggttacgctcggcttcaatcagagttggagtggggtctggcggggtgcagatcatgcgaggagcccttgctctacggcagagaattatgcaagctggtcaaggacgagtagatattcttcccggaagcacaagcgcgcctccagcgccgccctggacgcggcatcctcaggggagaggcatgctaatgcctgtgctgcattgtccagctggtcatgtggaaaggattggaggtgcctcagcaggtttgacttcagggtctccaccagtcgcctgggggtgggggagcgcggatgtgggttggcagggggtctga

SEQ ID NO: 3574 - DNA, 450 bp, Chlorella protothecoides
atgcacaccggctgccctgtggtgaagggcaccaagtggaccgccaccaagtggatccacaccaagcccttccggcccgagggcttcccggaccacacggtgagcgccgagcctgggtgtgaccggggcgggtggttgcgcctggtcgtccccggcatggcaaggctaaagagcctggacgacacatgtctcgcccgcatcgcccacacatcagcttctgccggccaatgccctgctgagcgtttgtcctcccacccatcctcccaccatcacgcagccccttccggaaatccccgtgccggaaatttgctcggacagggacgagcggtgtccaggctgggtcgagtcggggcagtgcagcagcaactccggcttcatggtcggcgacatgttccagtgagcctggggttgtgggatttacagtggttccgggaagagtgggcacgttga

SEQ ID NO: 3575 - DNA, 1899 bp, Chlorella protothecoides
  modified_base (182)..(191): a, c, t, g, unknown or other
  modified_base (563)..(572): a, c, t, g, unknown or other
  modified_base (1020)..(1170): a, c, t, g, unknown or other
  modified_base (1508)..(1517): a, c, t, g, unknown or other
  modified_base (1695)..(1704): a, c, t, g, unknown or other
atgctgaccacgcctggtgtgcattcgagcttcccatccctcacccgatttgcactgcccacccctgaccacaggacggaggctctgggggtgggatccaccatcgagtgcgtgcccgcggcaatgcagggtctgactgggggaagcacagcgaaggacctcgagacggcctggccctgcannnnnnnnnncatcgagtgcgtgcccgcggcaatgcagggcccgactgggggaagcacagcgaaggaccctgagacggcctggccctgcgacgcgcccggcccggggcagcggctggcggcagggttccagatggacgaatttgtcgtcagggacgccgacgctggcgtggaggtcgcgcgggatttcagcgtccttcgctcagccatcctccaaccccctctccacccccccttgcccagcgcagattccctgcggcggctggcggcggccctgctgcttctgggcggagtcggcggaccgcatggacttcatgcacgcctccggccgccagatcacgcggcagcggcgtcggccgggcgcggcgcggccgctgcgaacgnnnnnnnnnncatgcacgcctccggccgccagatcacgcgtcagcggtgtcggccgggcgcggcgtggccgctgcgaacactgcgcgccgcctggcacggcatggaggccaacgcggtgcgtctggtggccgagcgcggggtagggggcacggtgcggcgcctgcgctgcatcacggccggcgaggacggcgcgctgcgaacgctggacttcgggccgggcgacggggcgaatgcagagccgtttcgtgggcccagtgcgcgcagcgtggacggcgcggcggtgcgcgcgctggctcttgccccccgtgcgaacctgctgctggccggcggcgccaaggaggcgctggcggcctggcgcctggcagggaatgccttcgaggcggcggcgcccccgcccgcgcccaggaggccgcaccgggcgcgggacggcgccgccgccctgctgcgcgccgacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctggcggacggctcgctgcgtgcgctggcgctggcgactgggggcgataaccctcgcgccccgcgccacgtagcggacctggcgggcggcggcggcgttgcgctgtgctgcgctgggctggcccccccggacgccggcgtgcgggtcgtggcggcgggggccagcgacggcagcctggccttctgggacttgagcagcctggcgcgcgaccttgctgcgcgaggcggtgctgccgacggggccgaggaaagcgcggcgctcgtcacgctggccccggcgctgcggctggaggcggtgcaccagtccggggtcaactcggtgtcccttgtctggannnnnnnnnntcacgctggccccggcgctgcggctggagggggtgcaccagtctggggtcaactcggtgtccctcgtctggctggaaggtgcgcgaggtgggtggctgcaggccgtctgctgcgtggtctgctcatgtttcacctggggtcttcaccggctgtggacttggggattcgggccagctgnnnnnnnnnnccccccgccgccgtgaccttcacccccgcccgaccggctgtcaaccacctgggcagatttgggccagctcctggcactcacgggcggcgacgaccaggcgctgcacctccaggccctccggccgcccggcgccccgcccggcccgggcccacgctggcgagccgccggcgccctgcgcgtgcccaacgcccacgg

SEQ ID NO: 3576 - DNA, 822 bp, Chlorella protothecoides
  modified_base (18)..(27): a, c, t, g, unknown or other
  modified_base (157)..(166): a, c, t, g, unknown or other
  modified_base (375)..(384): a, c, t, g, unknown or other
atgaagaaacttttgctnnnnnnnnnnttaccaggtatgaagcctagggttcggttcagtgcacgaggatcaacttccatcctcgattgcacctcaggcagctgctgttccacacaggtgcctgagacattgagcgaggaggttctggccaagctcnnnnnnnnnnctaccagctgctgttcgacacaggtgcctgaaacattgagcgaggaggttctggccaagctccatgctccacccaaggatgtggatgtccccatcattgatgtggccaagctccccgagttcgacggcttcatctttgggttccctaccagcttgaaaacggcaccccacccacacgacgacacaggtttggcaccgcccctgctcagnnnnnnnnnncagcttgacaacggcaccccacccacacggcgacacaggtttggcaccgcccctgctcagttcaaggcgttcctggatgccacgggggggcactgggcctctggagccctggtgggcaaaggcgcctccatcttcacctccaccggcacccaggtgggtccgagggatggtaggaaagacattgttggcaagggtgggtggtggaccaccgctgcatcctgtgcttctgtccatgttgagaagtggggtgcaggctctctacctggtaccaatgggccttcaccctcctcacttcacagggaggcggcagcgagaccacggtgcttaccagcctgccggtccttgtccaccatggcatcgtcttcattcccactggctactcctatggtggctccctcttctccaacgacgcagtccgcggcggcacggcttacgtga

SEQ ID NO: 3577 - DNA, 606 bp, Chlorella protothecoides
  modified_base (232)..(241): a, c, t, g, unknown or other
  modified_base (589)..(598): a, c, t, g, unknown or other
atgcctctccttccgcagggtgtgtccaccctggcaggtgccgacggcagtcgtcagccctcagagctggagcttgggtatgctgagcaccaggtgcaactggagtccactcgcactgaggtgaagaaacccgccctcaggcatccaattttcccgcacattaccagggcaaacgatcgcagtttcgggattcgtgctcgatccttggtcgccgcaaggcgagctggaatannnnnnnnnntctgcagcagcaatgtgttgttgcccggatgtttgactaggatccactacactcgcaccatcatctcgcaatgggaaccatacctccatgggacatcctttgaaagcattacagcattaacaggttatcttgtaataattattgacggtttggagagacgatcgatgtttcgggattcgtgctcggtccttggtcgccgcaaggcgagctggaatagaagatacggtcaacgcgattccgggcgaacgggcaatgataataatattaccgatgactctacagcttcacttcctacacaaactgatggatggaacagtgcatggcgcatcgagtcggtgatgacacctnnnnnnnnnnaacaataa

SEQ ID NO: 3578 - DNA, 1278 bp, Chlorella protothecoides
atgggtaattgcttcagtacgcctgagccttcggcacccgttgcgcctgcacctgcgacggccgcaccagccgcccgccctgtggaggccggcccagtggtggcagcagaggatgccgctcccgctgcaaacggggccgtaaccagagccgattcgaccaatggagtagctccagcagcacgcatagccgtcatctactactcgacatatggccacatagcgacactagcgaagaaagtactggagggagcaaactctgtaccaggagtaaaggcggacttattccaggtattatgcggggggatatggggggtttatgtgcatggggcgtttgaattcgatcagctgccaacgggtacacatcgcacagcatggacccttgccttccctttcctgtcgctccaggttgcggaaactctccctgcagccgtccttgaaaagatgcatgcgccacccaaggatgcctctgtgcccatcatcgaagcctctcagttgcccgaatacgatggattcatctttggcttccccacaagggtgcaagaggaggaaggccagtcgcgaagaccatgcgtgcatgcactgcacctgacacctccatcctccatgcactccttgccccaggtttggcaccatgcccgctcaattcaaggcgttcctggatgccacagggggcctctgggcctctggggccctggttgggaagggcgcttccattttcacttcatccggaacccaggtgggccagggaaccttggtggtagtctgacatgctctgcccagcagagtcctgtatctcgaaaggtcatgtgcttgttgttgggtgccatgcccgccgccctcgacaacctcgttcgccacgccgcctccccacctgcgcccctcaaaccacaggggggcggcatcgagaccacggtgctgaccagcttgccagtcctggtacaccacggcattgcttacatccccactggctactcctatggcgcctctctcttctccaatgatgctgtccggggcgggaccgcctatggggtgtcaaccctggcgggtgctgatggcagtcggcagccgactgagctggagctcggctatgccgtgcaccaggtagatagtgattattgtgtgggcaggcatgggagcaccgtacaggaaaaacagtgtaagccattggtcaaccccgtgctgcctcaacctgtctgcagggcaaatatgttgcgggggtcatcaggaagctggcagcctgaccaagtagtgttttcttctggcttgccacagaactga

SEQ ID NO: 3579 - DNA, 561 bp, Chlorella protothecoides
atgaccatcgacgttggaactgccctcgcggccatcgccgctgcgaatgatgtggacacgctggagaaggcactccaggatgcttcgttcatcgacgctacgccaggagatgatcgtcaaaagtacaggggtgcgctgggggttcttgctcggatcgtgagggccctcgcaagactgcaccggccgcgcacagggcacgtagttgaccccacctgcctgcacacctgtattcggcccggctcgcgcacgcttcagtcctccctgctcgcagccggcaaggccaagctgaggaagctcaagaccgagcaggcggccaagggaggggctgccagtgcgactgccaagcctgctgagaagtcaccccatgccaaggaggtgcgtgaaggtggccggaactgtttccgacggatccctgggatgatgtcatggtccgacaacatcccctcctgccaatctcgcacagagctacgacgcctccgagttcgggagcctggtggagaaatacgagaagctgaactggcgcatcatctccaagcccggcggtgcaacggtcaagcctga

SEQ ID NO: 3580 - DNA, 612 bp, Chlorella protothecoides
  modified_base (282)..(291): a, c, t, g, unknown or other
atgacacaggggaagggacatgagctcagagcgccttgcatcctggcacccctgatccccagtgtatattcgcggtgctgcaggtaccacatgcaagcgttgcagggggacaacgccactgagcgccccatgtgggcagagaagggcgggctcgacttcgaaggccgtgcacgctgggatgcttgggcggcgctcaaggtgtgtgggggaagggtgggtggttgcatgggcgtctgcatgccaagtggaatgcggtcttgtgtcttttcctccaacctgcannnnnnnnnnggggtgggtggttggacgggcgtctgcatgccaagtggaacgcggtcttgtgtcttttcctccaacctgcagagattccctcccatttcgcacatcacgatcgaagaatgcccgtgccatcttgcagggcacccccgaggccaaggccaagctggagtttgtccgactgtactacgaattcccggtcaagtcgttgtactccgacacccgtgcctgagtccacccggcctcaccccatatctgtctgtccacttgaatgttgcaggggaaatgcatgttctgccttttccccaggtgctcgcggctaccaccctcctgtaa

SEQ ID NO: 3581 - DNA, 492 bp, Chlorella protothecoides
  modified_base (264)..(273): a, c, t, g, unknown or other
atgtccccgccctccacacaaccccccacccccctctcccctcgcgccttccgacagctgcccatcagcgacaaggggctgcgccggctgagcgagtcattcaagatgtaccggcgcacgctgggggatgccgaggtggcggccgcctttgccagcattctcgccaaggcgaagcgatccgccgccaagggcgacgtcaaggtgatgctgctcgggaggaaggctcatcggggcttgcgggagccagctttgggcgtgccaaannnnnnnnnnggcgaagcgatccgccgccaagggcgacgtgaaggtgatgctgctcgggaggaaggcccatcggggcttgcgggagtcagctttgggcgtgccgagtgtcaggcacaagggatctgctcggatctggacattggcgcaatgtcctgcccatcatcgacacctgctcagatgcgaggcagccatggcacccgatgcctcctccactctcctctcccctga

SEQ ID NO: 3582 - DNA, 654 bp, Chlorella protothecoides
  modified_base (176)..(185): a, c, t, g, unknown or other
  modified_base (642)..(651): a, c, t, g, unknown or other
atggtgggaggaggggtcattggagggttctgtgcggcaaatcggctgacgccctctaaaagggaagggggggcgcaaatcgctgcagccagagtgctgttctgcagggcgcctgcctgtctgcctccctgcgaccccccccctgtgctgtacccactggtggcgctccatgcatnnnnnnnnnnggccgacttccagagcatcatgcaagcagtgagcagtggtgggaggaggggtcgttggagggttctgtgcggcacatcggctgacgccctcgaaaagggaagggggggcgcaaagcgctgcagccagagtgctgttctgcagggcgcccgcctgcctgcctccctgcgacgcccccctgtactgttcccactggtggtgctccacgcgcgcgtgcagctgctggggtacatcaagaaagacaagcaaggcgacgcactggtggagaagctgtgccagcgctttgcggcaagcgagagcctgacgcagtggcacaacgtcgccttctgcctcacccaggcgagtgtcggggttgcggtggagggattggtgagtgttgaggttccacatgccgtggtgctgctccgcatgtccccgccctccacacaatcccccacccccctctcccctcgcaccttnnnnnnnnnntga

SEQ ID NO: 3583 - DNA, 594 bp, Chlorella protothecoides
atgcaccagccgatgagcccgcccagctgccgggccctgctgacgggggacccggggctcagggcctcggccctgctctgcctcgtcaagctgatggcggtggacggcgccttctgctccgcccacctccagctgctcttcacgctgctccagaaccggtgggcaagctggtgctgggatgatggtggtgtgtccctttgggggaaggagggccagaggaagggtgggctgttggagtatgagcggggggcatcaggggaatccgaggagggagactgtatgtcttcgaggtgctggccagagacctggcgtgagggtgcttggtgttccttcccaatcgcgccctcagtatctcactgggcacgcaccatgcccagcctcccgcccaccaccaccatcgccaattttccggactctactccacgcaggggcgtggagccggggctgaggtccacgcttgccgtggcactgggcgacctggccctgcgcttcccaaacatgctggagggctggacggagcgcatgtaccgtccgctgcaagacgccgacaccatggtggggtcgattgcggtgggggactctgtgcagggatga

SEQ ID NO: 3584 - DNA, 1122 bp, Chlorella protothecoides
  modified_base (641)..(650): a, c, t, g, unknown or other
atggagcgtgtgtggatgacgagcagggacccctcgcatgccccccaattcctgcgccccccacatacttctactatcaacgtgcagggctgtgcgccacctgcggtccgcgctgaccctgctttcctacgtcgtggcagcggcccccgagggcgtcacaagcggccagctggacctgctcctcggcgcgggcctgggctcggccgacgcgctggcggtgcgtgcggcctgcgcctgcctccgcgcgctgggcccgggcctggcgagtgggcctctggcgccgcgccgcgccgcggccctggctgccctcacgcgtgctctgctctccgacggcgcggtcccacggcagcagtggtactgcgcggcagggccggccgtggacgcgctgttcgcgctgcacccggagccgggccgggtggtggccgccgcgctgcgcgcactgagctcgcgtgccgccgccggcgacggccgcgacctggggcccttcttcttcctcctgggccacgcggccctggcacagctggtgagatgacgtgggtggacaggggaaaagggaggggggggagagatgggctggggggtgaaggggcacgtgggggtgacgagcgggtgccttgcaaggagcagcatggccggaggtnnnnnnnnnntggcacagctggtgagatgacgtgggtggaaaggggaaaagggagggggggagagatgggctgggggttgaaggggcacatggggttcctgggcgtctgcatccccggctgccctggcagcggcatagtgagcagatactccgcgtggcaggcaagcccaatatgttccccacccactccatcatccctgtgccaggtgtacgtggacggccaggcaaagcgtgcacgtcgcgtgctggctggcgtgggccgtccggccggccaggcaaagggtcaggaggcagatgcagaggacatcaacgcggagctgggcgtgggctccgtagctgccgacgctgagctggaggggcagcgcgagcgggccgaggctgagatcctggggccggcgagccccttagccccccacgcccgcctcgtctcggcgggtgagagtggagtggagtgtttgcaaggagagggggaggggatgtga

SEQ ID NO: 3585 - DNA, 1032 bp, Chlorella protothecoides
atgactgggcgatgcggttatcaactggataagaaatgcactcttgccacttcctgcgtcggctcctcgcccggcgatgatgtgggtgccacggggacggccaaaagtacccacccatcctcgcccccctccctcccaggcatcacattccagctctacgaccgcgaccccctaggggtggtggaccaggccttcttcgatgacctggtgggcctcgtgcgggccttccccctgctgtccgagtcccggaggggcctgctggtggacggcctggcctccagcctaacctgcctcaccagctggactgaccgggcgctggcgtcgcgggagcaggacgcagcgggcacggcacatcaccgttccgccctccgcgcccacgtcttcttcctctcctggctggtgcggcagtggctcagcctcagggagggggacgccgcgtcgcagcccgccgccttgcaggcggccaagcccggccccaggaagcggacagtggagggggctgcggccgggtcggaggccatcctccccacggccgtcaaggcggcggctgcctccctgaacaccgacctctgggccctgttcaggccggcgggacccgatgagcagctgctcctgtgctacagcctgctggtgaggccggccacctcgctcctggaccgccccgccgcatgccgggatggtgtggcggtgggcaacgccgggcacgtgctgtcggccctggccctcaagtacggccgggaggaaagcgtggccgcgggcctggtggagctcatcagcacgcgcgagcacagcccgggcccagtggcagatctcctccgcgactcggtcgccaagtggggcagcgccagcctggtgagggttggacagggggaggcgggggaacctggctggagggcctcggcggtggtggggggcctggccgcggtcgaccccgcagagtacgctcgccagcagtctgccaccggcgagaaggcgggcgtgcgctcggtggcggtgttcttcgaggagctggccgccaggctgcccaagtag

SEQ ID NO: 3586 - DNA, 1173 bp, Chlorella protothecoides
atgttgtccaccgagtgccaggttcgcaaaggcacccacttccctttcccaaaccccgtccttcaggggcacaccgggcgcggcatctggcagtgcgccgccgcctgcgaggggaaggtgctgatcacggggggcgctgacggcgcggtgcactcctggctgctgtccgactgggtgcatgggccccgcagcgcaagctggaaagcgcggcacgccgatggcccgcctcgtcaggaaacggaggtctgccgcctgcccgacccgggcacctccgacccggggtctgcctgggctgccccggctgatgcaacccccacggggccgggcgtggcagacagccgcggcgagtacgtgcggtgcctggcgccggcgggcggcggcgcgctggtcgtcgccaccaaccgcggccgggtgtgggcgctgctcgacgccgctggccccggctccgagtggcggcagctgtgggccagcccgcgggtctcgccccccatccacctgcaggccgcctgctcgggcggcctgctggcgctgacggagctcagcgggcgcgtcgtcgtgctgcgtcgtgatggagcatgcctccgtgccgactcgggccccgcacaagcctgcgtcctggccgactgggcgcccggcccggacgacgcgccggccctgggcgccttctggggcccgcccctcgacgccgggcggcgctgcctcttcaccaccgacgccggcggcgtgacggtggcgtgggccattcctgttttggccgccacgccgccgcccgcctgcctcgcgcggctggcgtcgcccttccggcagcgggtgaccgcgctggggtccgccactgcccagagaggcgccgcgggcagcctgctgacggtcgtcgccggggacaaggacggcgcgggcgtggcgtgggaggtgccgctgggggaagatcggccctgtgagcctgccccgctggcggcgcgccggcacctgcacgccgggggcccaatgcggatcgcgcgcgtgctgccgggtggccgggtgctgacggcgggcaacgacggctgcgcgcgggagtgggccatgggcgagggaggcctgcatgtcctcaggcgaggcgctggattttgggggggggattgccgccatgtgcatggccaagcgctgtattctcacaaagttgcggtcatcctgtga

SEQ ID NO: 3587 - DNA, 342 bp, Chlorella protothecoides
atgaagagcttcttcgacgccactggaggcctctgggtcaaaggcagtctggttgggaagggcgcctcaatcttcacatcctcgggcacccagggaggcgggcttgagtccactgtgctgaccagcctgcccaacctggtgcaccacggcatcgtcttcatccctgtggggtacaccttccccccccaaaccgacctgggccatgtccacggtggcaccgcctacggcgcctccacctttgccgggtctgacgggagccgccagcccatcgatcaggagctggaccatgccgagcaccagggcaagtacgtcgctggcgtgatcaagaagctggcggcctga

SEQ ID NO: 3588 - DNA, 678 bp, Chlorella protothecoides
atgtcggggggtgggacaggaccctgcccctcctcacatgcttatgtgggcgacatcactgccctgtgtgcggtgcatgccaccccctacctcctggtggcctcgggctccaccgtacgagtcttgcacatgtacaatggtgctggcatcagcagctgcatcgccatgccagacgccattcgagtgcagggcctgcgcgtgtgtcccttcgccgtgccgggcgccgaccgagtggtgctggcgcatggcgaccgcctcgcctccctcctctccctggacacacagagcggctgcatgagtctgatcgtccccctgccccgattgcggcattggatcctggccgcctccctatgggctgcgtcccccgccaccctgcacatcgtcctggggctggctaataacagcctgacatgctttacatgctccccagagcgggactggaggcccgacctggcttggcaggtggatggccaggagcgctccctcctctactccatggccatccacttggactgggaccgggaaggctttggtggggcgagtgacggcacgcggcctgcacccaaccaggtgagttcctgctgcgcggggagattcgtatcgggccccggtcggacaacggcgaggggtgtcggctgcacacaggaagcctggggccgcgatgtgcagcccccctaa

SEQ ID NO: 3589 - DNA, 189 bp, Chlorella protothecoides
atggtggaccccgcgaggatcgccgagctccagaagtactaccagagggctggcgggtctccctacatccacctcaggggcaaggctgacaggctgaccagcgtcgtcatccctctgggtgtcggtgccgtcggtgccttcctcctggcacgcggttactaccatatgatcaccggcacgggtgcgtag

SEQ ID NO: 3590 - DNA, 537 bp, Chlorella protothecoides
atgtcggggcgacgaggcctgtggcgggcattctccgccatgccacgcagaggtccacccccgccccctcccaagttcgtgctccccggtatcaagcacatcgtggccgttgcctccgggaagggcggtgtgggcaagtccaccaccgcaggtaggaggttctggggggtgtcctgccagtggtcattcccaggcatgaaccagcacccggccagggggcacacccctcccttcccccgcctccctgcagtgaacctcgccgtggccatgtctcagtccctgggtctgagggttggcctgctggatgctgacgtcttcggtcccagcgtgggacacatgctgggactgagcgggaagcctgagatcggcgaaggtgggtgtgcttgtggccgaggattcctgacggggggccaaggtgggtccttggatcggctttgtatccagagcaagtcccttcccaatcctagctcccgccctcgtcaacaacgccaggcgggctcatggtgccgcgcagcgcgcacggcgtgcgatgcatga

SEQ ID NO: 3591 - DNA, 1206 bp, Chlorella protothecoides
atgccggggcctgcagggctggccctggccgggcggcaggccgaggatggcatgccacatccggcgcgctatcctctctgcatgcagctgctccccgggcaagctactttgtatcctggagatagggctaatcctgtgcaaacttacacctctgaactctcctcaacaccccccaccctgttgccagccactgccgcccgcctgcgtggaaagcagcacctgctggatgtgctgacgcagcgcgtccgcgacaccagctcctacacccgccgcgcctgcctggccgcctggcagggcctggcggagacccggacgctgccgctgggccactgggcggccgtcacggacatcgccgtcgggcgactggaggacaagagctcgctggtgaggcgggaggccctgcgcctcctgcagtgcctcttgctgcacaacccctttggccccgccttgccggtaggggcttttgcggcctccctggcttcccaccgtgccgctctggaggtgttggcccctgaccatgccaaggacgagttccagggcctgaagctggagggcgggcgggacggcgccacggagccgggtcaggaaggcgagcaggggggtgcggaggcccctcgaatcaagcccgagcccggcacgggggaggtgccactgccttcacaacccgcaccttcttcgcagcgccgtgcgtcagcctccgaggtcgcgccggcggcgtgggagggcagcctggaggagctgaaggccctggtggcctcgctggagctggccacgggattcgcaaggaccctggcgcataccatgcccctgctggcccagctcctggcttccgcctccgtctctgacgtccaggcaagagagacggtggccttcctgctgacctgcaagcagtttggggtggacggcgttgaagccaccacccggcgcgcgctgccgctggtcttctccagggaccctgccatccgcacgcggctggtggaagccgccgaccagctttttgtgacggggtgggcggggaacctgttcacccctgcggcggctgccaggaacctgatggacctggccagcgacgccaccctgggtgagacggtggcggcggggctgttgaatgagggggagcagggtgtggggagtggcgcttactctgaggtcaaaggtgcattgggaagaaagaggtgcggccaggatggcaggcggctagggtga

SEQ ID NO: 3592 - DNA, 273 bp, Chlorella protothecoides
atggccttcctgctggcgcaggacgcgcccgccatctggcgcgggccgatggtcatgggggccctggagaccctcatgtccaaggtgctctgggcgccactggacgtgctactcctggacctgccgccggggacgggggacgcgcagctcaccgtcacccagcgcctgcacctgtcgggggccgtcatcgtgtccacgccccaggcaagaagggggggagtgggaggtggggcgggcggggtctgcggaacgcaagggggaaggagaaggtag

SEQ ID NO: 3593 - DNA, 888 bp, Chlorella protothecoides
atgcacccctccgccccctccttaccccctgtgagcaggcatgcgggcttcagcaaggtggggtcactccgcacctcaatcctccacatcatggggctctccatgtcaactattcgcgtgagcaactttgcgatcctgtcggatcgctccacggagatcctgaccgccgtggagtgcctgaagccaggacagaaggcgtgctcggcagacagcgatggcaacatcggctccggcaacaggggcaagaacaactttggtaccaacaacattggcaattctaatattggcaacttcaacatcggcaccgccaattgggggaataacaatgacggcacgggcaatcgctgcttcaacaagacaggagatcgcaaggtctccaatgactgcagtctgcttgaattccggaagcaggcatgggttcttgccttcccgccgcctactgtcaggaagtcatccccaccacccaagaaggcacccccgccggctgccaagcaatcacccccgccgccctccaagaagtctccactgccacccgccaagatgtcgccggccccacccactaagaagtctccacctccatctgccaaggaatctccaccccctcccacaaagaagtctccacccccacctgccaagacattcccacctccactcgccaagaagtctccacccccacattcgaacccgagttctcctccacccaccccctctccactacctacgccccctctttcactgagcctccctcctccaccaagcctccctccatcaccgtctcaacccagccctcctccatcgccgcctccgccatctccccccagcccccctccatctccaccgccgccctcgcccccaagcccccctccattgccacctccgccatctccg

SEQ ID NO: 3594 - DNA, 1881 bp, Chlorella protothecoides
  modified_base (1059)..(1068): a, c, t, g, unknown or other
atgatggggtgctcgcgaggaggtccggaccaaggtgatcagtcgctgccgttgctcgtctacagggatcgtggggacgtcgtgatcggatgtattcaggtatgcctgagaagttttattcccgcgctgtacagtcgccgagcaccactctttttgactggaatccctccccactctgtcctagtggcgcgtgctgtgctgcgcagggaaggattcacccagctatacccgcgagtgcatttacccgcacctgctcaacgcgatgacgtcgttgtgcggcgccttcagtggcctgcacattggcaagcaggtgggtggcaccgagaagtcgcgctgggtgcctttaaggctttcgtgcccgcccagcacctctccgctcggcggagtgcgttcctgtgtgcctcccggcctgtgacagtgcgggcccccgtcacggcttctgctaccatggccgcatcccagctcacgatagagtgcgcagatgggaggaggggcggcaagctgaagacgcgcaaggtcagtggctggtctggcatgcagtcaccacttctggtgtcctaccggactcctgagtcccttgttgagtttcccatgtcccaggcggcggtcaagcgttacaaggtgacggggtctggcaaggtcctgacgcgcaaggccggcaagcagcatctgaacgagaagaagcggcaccagcacctgctccgttgcaagtgcgtgtgcttggtcatgcggaggtggcagggggtgatgcagtgctgttggactggagggcctggacatcctcccaaccccgccatgtgcactgtctgtaggaaggagcagtctgtgtcccccggggacctcttcaagatcaagcgttgcatcccttatgctggcggggagagcacagcgaatccaagcattctaacggctgagttgaggtataggagctctggggtcgcgtcagggcacagcatgggatactggcttccaactctcgacgggatggctcgcaatctttgcagcagcttcttaccactgcagcaggggacggaagcatctgtccagatcctggagggnnnnnnnnnncagcatcgctgtccaatcctagacgttcatggccgtgatggcctctgggctgtagggcttgagcacccgctgcggcaggttcacgcgcctgacgccggccaggggcagcgggtgcgcctcggtgttgaacacccaggtgtcgagtggaaagagggagggccggcctggccccgcgcgggtgcagttggccacggcgcaggcgtccggggcatcggcctgcaccagccagaggtacttgagcgtctccgacaggaagaagctctcctgcgagtcgcgctgcgacgagggcgccgccgccacgttgtccaggctggcgtagttggcggggtgctcgtggcaatcctcgcccgcaccctcgcacccaccgccgtggggggggtgcgcccccgcccgcacccgcgcccagcgctgcaccgcgcggaagatggcccaggcctggtcctggtaggcggggtcccccgtgaccttgtacagcaggtagagcgactccgccgtctcggggcgcagcaggctgtgcgcgtccaggctggtgatgctgaactcgcccatgccgcgcgggttgtcgtcggggacgtgggcaacccagtgccagacctcgggcgccaggcccgagggcgtgttgcggtacccctcatagcagctgcgcgccagctcccgtgccagccgcaggtcgctcatgcccggggggtggtcgcgctgcgtcgcgccggggacgcgtgtgtccacgccgtggtagtggcccagggccagcacgcctgtggtgagtttgagtgtggttctggcacttcaggaggtatctgtgtgcagggatga

SEQ ID NO: 3595 - DNA, 1554 bp, Chlorella protothecoides
  modified_base (1078)..(1087): a, c, t, g, unknown or other
  modified_base (1499)..(1508): a, c, t, g, unknown or other
atgcgcatggggcaaggacctcgtcaagcctctcacctgccagtccgccgattggttcgacatgggcctgaccctggtggacggtctgtctacactgaagatgatgggcctagactcccgcttccgggaggggctggcctgggtcgcctcggggctcagcctggacaacggccgcacggtgaatgttttcgaggccaccatccgcctcatcggcggcctgctgtcggcgcacgccctggcaaccccggcagacggcgccgagctcacccccgccctgctggagcgggcggtagagctgggcgcgcgactgctgccggccttcgaggccagccccagcggcattcccttcatggacgtcaacgtgagcagcgggcaggcctcaacctccccatggacgcacatgagctacctgtcggaagccgcgacgctgaccctggagtggacgctcctctcgcgatactcaggcaggtggagggcgggcatgcatgcgggaaggctctccttggtgtggggtggatctcaccgaggtgcacaccagctggaggggcaggaggggcgacaggatacatctccaagacccaccgacccctccaccacgacatccatgcaggaaaccctgtgtttgagaagcacactgacaaggtgtacgaggtgttggccagccagacggccaagtatggtggactcttaccctacgagctggatcctgccacgggggaactgcagggagaccgcgtgacactcggtgaggcagtctgcatgggtgcaaggtccatggtctccctcagccgtgcttgtttgggaggagcgatgccgcggccagtcgtgccgtacggtgtggctccaccaacacgcccccccatgctgcacaatggtgcaggtgggagggcggattcgtactacgagtacctgctcaagcgctggatccagagggggaagaaggacaagaccctccttcagtggtacatcgaggtgaggctgcccattgtggagcgggttggctgcgttcctgagcttgtgaataaagattgtgcgattgatgcagagccaccacgtctcaggttcgaagcactgatcnnnnnnnnnntgcccattgtggagcgggttggctgcgttcttgagcttgtgaatcaagattgtgcgattgatgcagagccaccatgtctcacgttcgaagcactgatgacaggctcaggccatgcgcagcgtgcggtccaggctggtccagaggacggtgggcaacctctggtttgtctccgagctggacctgacgcagaaccggacctggcccaagatggaccaccttgcctgcttcttgccgggtgcgggggaggaggagttggggtggcagggacgcagcaaatgctggatcttttgtgcacccggagccttgggtcgattgcaccccaggttggactggaaggctctgtggctggaccggctgccctcttgtcttggcctgacgggctgcacattccactactgcctgggccccccannnnnnnnnntggaaggctctgtggctggaccggctgcccacttgtctcagcctga

SEQ ID NO: 3596 - DNA, 1836 bp, Chlorella protothecoides
  modified_base (338)..(347): a, c, t, g, unknown or other
  modified_base (888)..(897): a, c, t, g, unknown or other
  modified_base (1739)..(1748): a, c, t, g, unknown or other
atggtcacggtcgctgcatatctggcggacagcggactctcatcggcaggtattgcacccaacaccccattcatggaggctggcctggactcgctggacctcctcaaactggccaggtgtgcctggtgctcagggattatgcagaatcgtcaagtaaaccaaagagatgggccgatgtacagctgctgttgtattgaacattggggtttcagaggtcacatgctcctagatatacctggcatttggcacgagaaacaacagtgcatcccctctactcccgagcgcagtgtggtgagtcaagagtttgaggcgaccctcccgaccacaatcctctttgnnnnnnnnnncgattgcatcccctctactcccaagcgcagtgtgttgagtcaagagtttcaggcgaccctcccgaccacaatcctctttgactttccctctgtggcaagcctgagcgcccacttggtagctgccggcttggggatggccaagggaggcgggagcaactctacgcggcctgaagccctgcacacaagcgctgcggcacatgctgacccaaaagcccatgcgagcattgaggccggaagcttctctgtcatcccagcgctccgacccgctcctaccactatagtcccaagccgaggtgctgtgctgatgcagagcggcgccatacaggttggggatgggggagacatgctggcgccagcagactggagcaacgcatatggacttcactggagccttggagccgagtgtcctcggccaattccaccagagcgctgggatgccgaggtacccggtggtgtcgtggctggaccacggtttggagcctttctcaagggtgagttgaatggtgaaacgggagaagaaggggtgttgttgactttatgnnnnnnnnnntcggagcgctgggatgccgaggtacccggcggtgtcgtggctggaccacggtttggagcgtttctcaaggaaccttcaccgtccctcgcatgcacagatgttcacggattcgacccgggtgcctttggactcggcagcgcagaggctgccctcatggatccccagcagcgcctcatgctggaggcggctgcctgggtgattggagcttgccaagcaactgcggggtgggagccctccatgggcggggtttttgtgggatccacacatgctgacttcctggttgccagccggacgcctgggagtgcaaccagtaccttcagtgcaacaggctctagcctgtctgtcatacctgccgtgggtgttgtacaggtcgacctttccggcggcgacactgggccctgtgctcaacctgcactctacagtggctggcacaatgctgacccacaggtcgcatctcctacacatttggtctgggggggcagtctgtcctcctggacaccgcctgctcgagcagcatggtggcagtgcacgctgcttccacagccctccaggtgcacatcttctgtcatctgttccggtttgatcccagtgaattcctttcagcaggcaggcagcctcacgtggggagtggcaggaggcgtgaatgtcatgctatcacctgccaccatggccagctatgatgcagcaggtggagcgagcgttgcatgcaccttctgggatctgggaagcaggctggccatggctccacccatacagccatccactcgaggaggggccattgtgattttgatcacagccaactacaaacacgatgttcaactgttgcagtggcccctatcttnnnnnnnnnnccaaggaggggccattgtgattttggtcacagccaactacaagcacaatgttcaactgttgcagtggcccctatctttgcagggatga

SEQ ID NO: 3597 - DNA, 924 bp, Chlorella protothecoides
  modified_base (334)..(343): a, c, t, g, unknown or other
  modified_base (549)..(558): a, c, t, g, unknown or other
atgagtctggatgcagcggcggatggctatgttcgggccgaggcagcgggcctcttcctcctgcgtgctgtcagctcaatggatgacacccatgcagggcagacgagcgcctggtggtgccctgggacctccatcctgctgggcacagctgtcaaccaggacggaaggtccagcagcctgacggctccaaacggtcccagtcagtcagccctgatcgctgctgctctgcggtcagccttgtcggatcctgagcaggtggagagccatgagtgtgttcctggctcgataatttggcaatggattgtgtctcactgctcacccgcggttggtccannnnnnnnnnagacagccttgtcggatcctgagcaggtcgagagccatgagtgtgttcctggctcaagaatttggcaatggatggtgtctcactgctcacccgcggttggtccaggtcagcatgttgaacgtggcggcaccagctgtactgctcccgtgcatcaattcctcatgcaggtggacatgctccaactgcatggcactggcacgcccctnnnnnnnnnnaacaccagctgtactgctcccatgcatcaattcctcatgcaggtggacacgctccaactgcatggcactggcacgcccctgggggatcccatcgaggtgggagctgcactctccaccctggcccccaggcaccgaggtgcgggtggtgctatgatgatacagggtgctttgtcgctgcctgctctccctgggcacagcctggcgctggcggcggtgaaggcctccaccggccatagcgagtcggccgctggcctcctcagtttggcagcggccagcgctggggcgggctccgcctacctggccccgctgaggacgctgcggtgggtggtggtgcaggggcctggtaatcaatatgcacgctcatga

SEQ ID NO: 3598 - DNA, 378 bp, Chlorella protothecoides
atgaagccggtccatgaccccagtcttcaccgcccttacgacagggcccgtgtctaccgtgcaaactttggcgggggacagcacccctttgctggccgccctcgggctcagcagcatgcggaggtcaactccctgcccccgcagatcaggcagctcctgcagctggcgcccctcctgctcctcctcctggtcaccttcatgtcgcggccctctgcccccgtcttctcgctacacaagaccgcggactacccggtgatgctgtccacagtgaggcacgaggtgccctactatgtgcccaacctcaaagctttcgagaaggagtaccctgcgagatcacaacccaggtccgtgacgggggtggcagctaaagtgggatga

SEQ ID NO: 3599 - DNA, 276 bp, Chlorella protothecoides
atgcgcagggcataccgcaagctggctctgaagctgcaccccgacaagaacaaggcacgaggtgccgatgaggctttcaagatggtctcccgcgcctacgcctgcctctccgacccccagaagcgcgcccactacgatgtgcacggcagcgaggacgccctgtcccagcaggcgaggccgaacggcggcggcatgtacgcccagggtggcatcgaccccgaggacctcttcaacatgtttttcgggggcaaccccttcatggcccagcaggggtga

SEQ ID NO: 3600 - DNA, 429 bp, Chlorella protothecoides
atgggggatcacgccaacaaggacgagggtacgcggtgcctgcacatcgcagagcaggccctccaggctggggacctgaccaaggcaaccagatttgctgaaaaggcgatgcgcctattccccaacgacgaggtgcgcaagtttatcaccaagctggagcgagccaggagcagcaacggttcgtcttccagcacgggggccaggccggccggcccagtccccactgccaggagaggcgccgcccagccggggggcatgggtcctcagccaggcctgaggcagcgcggcgcaccagcttccagcggcgctcatgtgcacgagactccggatgaggatcacaaggtgggggcctggttgggcatcctgctcgggctgaggagcttgctccctgggttccagacgatgggttctgagaatgcctccttgtga

SEQ ID NO: 3601 - DNA, 312 bp, Chlorella protothecoides
atgtgcgactttggctactccaagcatgagctgaacagcctgcccaagaccagcgtaggaaccacctgctacatggcaccggaggtgtacctgggctacacaacctacgatgccaaggtcgccgacatctggtcgctgggcatcatcctctttgccatgctctttggcgccttccctttcaaggggcgggataagcggtacatccaggccgtcctgctggggcggtatgccattccgccagacgtccaggtgtgccactgggatgagcatgcattcattggggtgaggggaggggaatctgggctgccctga

SEQ ID NO: 3602 - DNA, 180 bp, Chlorella protothecoides
aagtaccacatggatgagtacccaaacggtacaaatgcggttgtagctgtcctcgcatacacagggtatgacatggaggatgccatgattctcaacaaatcctcaatcgaacgaggtttcgctcacgcttccatctacaagtccataaatgtcaatctgcgggacgagcgtggcaggtga

SEQ ID NO: 3603 - DNA, 891 bp, Chlorella protothecoides
  modified_base (876)..(885): a, c, t, g, unknown or other
cccccaacccccctccccagattcgtcggccagatcccgacggaccgccaggagccggacctgctccccgtcttcgccccctacggcgccatcgagaagctgactttggtgcgcgggcccgagggcaagtcgcgcggctgcgccatggtgcagtacaagcgctgggcggacgcggagcgcgccgcggcgggcgtcaacggcacgagcccgctggagggcgggcgcggccgcccgctggtcgtgcactttgccaacccacggcggctggtggggtcggcggccgcagagccggccatcacgccgcgcaagctcttcgtgggccagatccccaagaccgccagcgaggcggaggtggccgcagtgttcgcgccctacggcgaggtgcagggcgtcagcatcctcaagtccaagggcatccacgcggggtgcgccttcgtgcagctcaccacctgggctgcctgcgaggccgccatcgagggcctgcacgagcagcgcgtcatgcccggctgcgagcatgcgctggtggtcaagtttgccgacgccaagcgcctggacggcctggcgggcaaggcccgggcccagggcctgaacctgctgggcatgctgggccacccgggcatgctggccaaccactcatacatcaccggcgcggagctgggcatgggcccgcccctgccgccgcagctgggggggatgcagggtgagcccgggtgggggagggaggtgtgggccgatgggggactggggacaggcgactgcagcgtccctcctgtgggcctgtgggaggttgtgcgtcggggacgctgcggggccagggtgatcagccgcatgtggggcttcgagctcagtcaggaggaccggcctccgggtgccacnnnnnnnnnntggtga

SEQ ID NO: 3604 - DNA, 2637 bp, Chlorella protothecoides
  modified_base (654)..(663): a, c, t, g, unknown or other
atgtggataaaaagtctgggggttttcggcgatctgtcgtgggggatttactactttgaatcccgcgcgatctgggactcctggagcgaaaaatcggggtgtcaagcccacgtggcgtgggagcccgcacggcgcccttccggtgcccggctgccacctcccgggcggtatctcgcacgcctcggggccccctgcgccctcgggccattgccgccccctcggcggtaccctttctgcccagtgcggaccacctccaggaatggggacctcagagctggaagcagcgcgaggcgctgcaacagccgaactaccccaaccaggtgcgacgactcccgggcaatgccagggcgctcgaccatgcgcaaatccggtccatcatgctgcgtcgggatttatgtgaggcgcacagatcgtcgtcgcacctgcgcccctgtttgggcctccccacagctcgtcatgtctatccccagcatggctcttttcgcccccagtgcatctcaccccatgatggggcacgaattggtcgatcctgcatgccaccccccaaaaccccccaaagcccctggaggcctctggctagggcactccctcctttcagttcgtgcctccccccctcactcttcacacctcgcaccctctcttcttcttgccccnnnnnnnnnnacccctggaggcctctggctcgggcactccctcctttcagttcatgcctcccccctcactctttacacctcgcaccctctcttcttcttgccccaggctgagctggacgaggctgtggcccagatcgcggccttccctcccctggtcttcgccggcgagtgccgcacgctgcagtcgcgcgtggccgcggcggcggcgggcgaggccttcctggtgcagggcggggactgcgcggaggccttctcccagttcaacgccaaccgcatccgcgacctgttccgcctcctgctccagatgtcggtggtgctcatgtacggcggcggcgtgcccgtggtcaagatcgggcggctggcggggcagtttgccaagccccgctccgccgacctggagacggtggacgggcagtcgctgcccagctaccgcggcgacatcatcaacgggcccgagttcacccccgaggcgcgcgttcccgacccggcccgcctcgtgcgcgggtacaaccagtcggcggcgacgctgaacctgctgcgcggctttgccacgggcggctacgcggcgctggaccgcgtgatgcagtggaatctggacttcacgcgcgggagcgaggaggggcgcgcctaccgcgacctggcgtcgcgcatcgaggagtccatcaccttcatgcgcgcctgcggcctggacatgcactccgccatcatgcgcgagaccgacttctacgtctcgcacgaggcgctgctgctggactacgaggccgcgctgacgcgcgaggactccaccacgggcctctggtacggctgctcaggacacttcctgtggtgcggcgagcgcacgcgccagctggacggcgcgcacgtggagtacctgcggggcgtgggcaacccgctgggcgtcaaggtgagtgacaaggccgaccccgcagacctcgtggccctcatcgccgcgctgaaccctgaaaacacgccggggcggctggcggtgattgtgcgcatgggcgcggctaagctgcgcgagcgcctgcccgcgctgctcgccgcggtgggtgccgcggggcaggtggtcacctggatctgcgaccccatgcacggcaacaccgaggcggtccaggggtacaagacgcggcgcttcgaaaatgtgcgcgcggagctggaggccttcttcgatgtgcacgaggccgcagggacggtgcccggcggcatgcacctggagatgacgggcgacgacgtcaccgagtgcatcggcggcggtgccgcggtgaccgagctggacctcagctcgcgctaccacacccactgcgacccacgtctgaacgcggagcaggcgctggagctggccttctacgttgccagcaggttgcggcggcggcgcgccgcgcgcgacgcagagcagcaacgcgccgacggcgcgccggccgcggccgcacgcaacggcctgctaagccccgtggatggagctgtgccgtcgcacagcccaaaatcccttggtcgccatctgtttgccttggtgacctggccgctgcgcaatgccgctactggccaaacatgtctatcgcttctcctggcaaggaatgtgtgtgtacaggtgcaggaagtaggagcaggaaggcaagacacgatgggaaaagggatttacggaggtgtgattggcctggactggcaggcgatagacaggatcgtcgaccaccgtcccgccctaccagaggctcttgacggggaccctgaactcgacgcccgcacccgggccccagtgcttgtaagaggcaatgagcttctgcagcgcgccctcgctgtgctgcatggggttcagcttcaggtccatcatcatggcgcgggtgtcgtcgccatgcgctgccaccagccgcgccacgatgtcgcgctggtgcttggtcaggcgcttgggcgcggccgggcccgtgctgcgaaccttgcccaacacagcccgcaggtctggaggttgagggcggcggggcgaggctaa

SEQ ID NO: 3605 - DNA, 390 bp, Chlorella protothecoides
atgcctgctgccgcgagccctttcctgggccaggtctcccaggcgcccatgccctcgcaccgagccgcctcgccacctgggccccaaccccctgcaggcatgggcgtccttggcgggtacgaccacctggcactgcagcaattcagcggcatgatggtgggcggcccacccccgcagctgcgccccatcaagctgggccgcggcgtcgccgacccggcggcctatgcacacaagctgttcatcggccagatcccgtttgaggtggggcggggtgcatgcgcgctgcaagccggatcatgcgcatggggaagtttgtgcgggctgcggtacgctaccaggcacactcatcgtgacttagaggtcgtgcatgatgcccccaccctcgcgtag

SEQ ID NO: 3606 - DNA, 1446 bp, Chlorella protothecoides
atggtggttccggggggcactttgctgatcttcacgccgagcgcggtggtgagcgaccacttcctcgtccgcccgaaacactcacagcaggccgttgcgtgcggccgcggccggcgcgccgtcggcgcgttgctgctctgcgtcgcgcgcggcgcgccgccgccgcaacctgctggcaacgtagaaggccagctccagcgcctgctccgcgttcagacgtgggtcgcagtgggtgtggtagcgcgagctgaggtccagctcggtcaccgcggcaccgccgccgatgcactcggtgacgtcgtcgcccgtcatctccaggtgcatgccgccgggcaccgtccctgcggcctcgtgcacatcgaagaaggcctccagctccgcgcgcacattttcgaagcgccgcgtcttgtacccctggaccgcctcggtgttgccgtgcatggggtcgcagatccaggtgaccacctgccccgcggcacccaccgcggcgagcagcgcgggcaggcgctcgcgcagcttagccgcgcccatgcgcacaatcaccgccagccgccccggcgtgttttcagggttcagcgcggcgatgagggccacgaggtctgcggggtcggccttgtcactcaccttgacgcccagcgggttgcccacgccccgcaggtactccacgtgcgcgccgtccagctggcgcccgtaccagaggcccgtggtggagtcctcgcgcgtcagcgcggcctcgtagtccagcagcagcgcctcgtgcgagacgtagaagtcggtctcgcgcatgatggcggagtgcatgtccaggccgcaggcgcgcatgaaggtgatggactcctcgatgcgcgacgccaggtcgcggtaggcgcgcccctcctcgctcccgcgcgtgaagtccagattccactgcatcacgcggtccagcgccgcgtagccgcccgtggcaaagccgcgcagcaggttcagcgtcgccgccgactggttgtacccgcgcacgaggcgggccgggtcgggaacgcgcgcctcgggggtgaactcgggcccgttgatgatgtcgccgcggtagctgggcagcgactgcccgtccaccgtctccaggtcggcggagcggggcttggcaaactgccccgccagccgcccgatcttgaccacgggcacgccgccgccgtacatgagcaccaccgacatctggagcaggaggcggaacaggtcgcggatgcggttggcgttgaactgggagaaggcctccgcgcagtccccgccctgcaccaggaaggcctcgcccgccgccgccgcggccacgcgcgactgcagcgtgcggcactcgccggcgaagaccaggggagggaaggccgcgatctgggccacagcctcgtccagctcagcctggggcaagaagaagagagggtgcgaggtgtaaagagtgaggggggaggcatgaactga

SEQ ID NO: 3607 - DNA, 1266 bp, Chlorella protothecoides
  modified_base (183)..(192): a, c, t, g, unknown or other
  modified_base (382)..(391): a, c, t, g, unknown or other
  modified_base (701)..(710): a, c, t, g, unknown or other
gcttgccagcgtgtacatggtcatggggcggtacgtcagacgaaggagcggcgggaaagggaggggcatgcggggatgcgtgcgccgggcgtcaggaaggggcatcgctgcggcgacgcgcgaggccggcagaccgctgcgtgggccgccgtctctgcgttgcacgcgcagggtaccgcgcgnnnnnnnnnncacctcgtccacgttggcgttgctcttggcggaggtctcgaagaagggcagcttgtattcgtcggccagcgcctgtgtttgaggtggcacgcgatggggccggtggcggcggcacttgcgcaccgacacgtcgacggtcgataccatgggctgcagggaggtgggatgcccggcgggcacacgagaggtnnnnnnnnnnagtgtttcccttttttctttagatcccttgtgggggcctcgccacgccccccttcccccgccgctgcagtttcttcagccccctcagaactagttcgtgggcagcaccccgtgcctcttctttcattcctagtcaaacttgcttccccggtgaaccccacggaatttagtccgacgtgttcccctacactcagcgctgtagatagtcaggctgacccttctgccgctcaaaataggaaaagaattccacaagggatcagcgagagctcccaaccagcctcccggagcagtggggggacgggatggcgagnnnnnnnnnncagtgggaaaagaattccacaagagatcagcgagagctcccgaccagccacccggagcagtggggggacgggatggcgaggcgccaggattacgactacctcatcaagctgctcctcatcggggacagcggggtggggaagagctgcctcctgctccgattcgccgaggactccttcacctccagtttcatcaccaccatcgggtgagggggtgtggacaggggcgggccacgaagggggtggcccccttggaccggtggcagttgaggtgcagccctgtgtgcatcgtcccacactccagcccccccacccacccactcccagcatcgacttcaagatcaaaaaggtgctcatagatggcaagtgggtgaagctccagatctgggacacggccggtcaagaacgcttccgcaccatcaccagcggtgcgttgtgggcacctcctcgtttgtttctcttctctttttgggaccgctcctcatacctgtgtgtgcaggcaaacttgcgatcccctgcatcaccaattgcatgcaggccaacccatgattgggcgtga

SEQ ID NO: 3608 - DNA, 252 bp, Chlorella protothecoides
atgcggcgtctggagtttgcccttgcagtcggtccatcccctggccccgacccactccactccattgctcatgatccccctttccaatcgcgtgaatcaatgcctcaggaagcggtggccaccatcagtgggcccctgaccccccccgagattgcgctgctggcggaagccgtcgcgtgggtgggcgatgccaagaatcgctgggagctcatatgcaaggagtacctgcccgctcggcagcccaaggtgtaa

SEQ ID NO: 3609 - DNA, 1011 bp, Chlorella protothecoides
atgctggccagtgcgattcctgggcagtgggctctgcctgtggtgcaggcagcctgcatcagggccgcggctgctgccggggcgtgcatgctcaggatgagagatgttcccttcctgcatctgggtgtgcacacgcccacccccccgctcgccgctgaagaggcagcttcaccccaccacccacctacaccgggaattctgagccacctcctccaccctccaaccccgtcacaggaggaaagcgccgccaccgcgctcaccaacccgcgcacgcttctgggcgccagcctcggccgattcattgtcaaccgactgtcgctgcgcgtgcgtctggatgagcgccgcatcgccgagatcctggaggtactgcgatgccggggcgggcgggggcgctgggccatgggtggaaggtgccactgccgggcttccctgtgtcggccgcctcgccttccttgctgggtggagcgtcacactgcatgcccggttctcgcttctcctgagaccccccccctacccacacacacccaaacacacacacgtacacaaatcacatgcgcacatcacagggcatggactcgtccaccctgggcgaccagtttgtgccgacggcgggccggatcctgggtcacctgggggacgtggtcagcttccgcttctgccccgccaccctggcagcggggcgggcgggcgcgggcagcgcggcgcggcccaccgcctacctgctgcaggccgagagctccgacatcagcaggctacgggccgaggtccagtccttgggctaccaggtggggaacatgttttcggcttcctgagcaatggggggggcaggggggagggggtggcctgggggcctcatgcaaggctgcaccatcttttctccctcccggtgcctgcacgtcaggcgggccagcaagggcgctggcgccaccaggcggcacgctgcacagcaccaccaccctcccgtccccgccggatcacagtctggcatcggaccccctccatccctgctga

SEQ ID NO: 3610 - DNA, 1368 bp, Chlorella protothecoides
  modified_base (762)..(771): a, c, t, g, unknown or other
  modified_base (1097)..(1183): a, c, t, g, unknown or other
atgtcctcctgctcagggctcctcccgcctggaggctgtccacacctgaccctgctcctccaccctctgctcacaaggtatgagctcatcgaggacccctccaccgacgagatcatctcctggaacgaggatggcactagcttcatcgtgtggaagaacgcggagtttgcgcgcgacctgctacacctccacttcaagcacagcaatttctccagcttcgtgcgccagctgaacacctacggcttccgcaaggtggacccggaccgctgggagtttgccaacgagctcttcctgcgcggccagcgccacctgctgggcggcatcgtccggcgcaagcccgccgctgacgtcggccgtcccggcggcagcgctcccggccgcgacgccggcgcgctgtcagcggtggagctgggctcctacggcggcctggccgcggaggtggagaccctgcagcgcgacaagcgcctgctggtcaccgaggtcatccgcctgcgccaggctcaggcggggaccgaggccacgctgcacggcctgcaacaccgcctggacgtcaccgaggcgcggcaacagcagatggtgggcttcctggcaaaggccatgcaccacccggccctggtccagcagttcatggggggcgcccccgccctgcaacgcatcgacgacgggaggacccagccctgggggctcggcggctgcgagccttgggtgcgccccgggttcccgtgttgcatcagacccgagctcggaatcctggccccaacnnnnnnnnnntgtgacatcttttggggtttatggagggtgtggtgtgtgtgtgtgttggcctgtgtgtgtccccatcagcccagccctggggcctcggcggctgcgagccttgggtgcgccctgggttcccgtgctgcatcagacccgagctcgcagtcctggccccaacacccacggacccccccaccccatcaccccccagggcgcaagaagcggcggggcgggcgcgcgcgggcggcgggcgccgactccgacagcgagggctccgtggaggacagcgtggcggggcagggcgccgccagcagcacctccactgccggcgccgactccggggnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcggcggcgccccccgccacgaccagcgcatgatcgtgcacgggggcgtcggcgcgggcgatgcgccgggcgagcccgggtcgctggccgagctggcgcaggccttcatgcagctgctgaacacccagtcacagcccatcggccctcccccgcccttcgcgccgcccgcgcccgcaggcggc

SEQ ID NO: 3611 - DNA, 1002 bp, Chlorella protothecoides
atggcggggctgtgtctacgtcacggagtgatcgggagggtagtcttcctcggtctgctgtgcgttggggctgcctcggcataccgtgccgcccacccagagcgtctgagcatgcaacccatatcactaccgatgggccgccccaccaagggcctgggtgtcgggaaggagcctgaacgctacagtggctactacgacctcaacagaacaacggatgggcacatgttctttttctactttcaggccagggaggatcctgagaatgcaccactcgttctgtggatgacaggcggcccaggttgctccagcgagctggccgtcttcttcgagaacggcccttaccgcctctcgcccaaccagacggtggaggagacgacctatggctgggacgtgtcggccaacatgatctttgtggaccagcccctatacaccggcttttcctactccacctcggacgacgaccgctgtttcgacgagaagtgcgtgtcaaatgatatgctggacttcttcctcgccctttatgaggtccggccggagctggcgggcaaggacctgttcatcacgggcgagagctatgcaggtgggcggggaagtgcggttcttgcagggcatggcagggtgtcgaggggatggagttgctggcatggcagggtgttgaggggatggagatgctgtgctccgctggcatacaccacccgcctgtgtcccctgggccctgtctgttaccgcgagtgccacgctgctgctcctcctgccatcctgtgtcagcctcacagcggagtcgtcaccatcacaggccactacgtcccggccgttgccagccgcctcttccgcgcatccaaatcgggggaggttgcgacgccctttcccctcaagggcctggccatcggcaatggcctcaccaaccctgcgatccaggcaggctggtggagagtagggaacgagggcaggccagggagagcctgctatggccaggagggccagtcgccgctcctgcaataa

SEQ ID NO: 3612 - DNA, 1605 bp, Chlorella protothecoides
  modified_base (746)..(755): a, c, t, g, unknown or other
  modified_base (1385)..(1394): a, c, t, g, unknown or other
  modified_base (1481)..(1490): a, c, t, g, unknown or other
atgccttgcagaaccaaaatcaacgctcagcagcccctgcttcatcctcccacgcagtatggcgcctatgcagactacctgctcgccaacgggaagatagggcgcacgctgtacagctacgtgtctctggtgcgtgcctcacctccaaggggtggctggtgggtgcggtgtgaccttttggttgcgacgggcacctgccggtgtctgcccccagcccacttgccccccccctcctcccctcccaactccccagatcaaccccctgtgccgctggtcgctgggcgtgtgcgaccagttcaagtggcagtgggagtgcctgctggcagtcaacttctgccaggccgtcacctttgttcccctcatggcgggtgtgtaggtgctgaaggggtcccggcctgtggctggaccgtgggcgccctgggtgtcgggattgcttgcacatcttggtggacttgtagccgagactgtcttgcaaggctctctggtcgcaggatgatcgctgtgcgggcatccaacccgggcatgaacgtgtatgacatccgcaagccatgcgtgggccccctgtgctacgccgagtttgaggtgctggacacctacctgaacctgcccgaggtgcaggagggtctgggcgtcaacaggaacatgctgcaggttccttgccaagcatggtgcaggtcggtcgataacccgtggccgcgtctggtcctggctcgccctccaatccgcttccccaccctttgccgacnnnnnnnnnntttcgtcagcatgctgcagattccttgccaagcatggtgcgggtcggtcgacaacccgtggcagcgtttggtcctggctcgctctccaatccgcttccccaccctttgccgacaaacacaagccaaacctccctgcccttccctacccctgaaccccccgctcactctcctccctgaaaggtggaagtcgtgcaacatgcgggtgcacgcggagatgatggaggactggccccacgacttcagccacgtgctccccgagctgctggcgggcggcgtgcgtgccctcatctacgccggcgaccaggacttcatctgcaactggctgggcaaccggcgctgggtggacgcgctgccctgggcgggggcgggcgactggcgcaccgcccgcgacgcgcgctggaccgtggacggtgagcaggccggcgtcttccgcgccgctggcccgctgaccttcctcaaggtggggggcgccgggcacatggtgcccatggaccagcccaagcacgggctggacatgatcacccgcttcatccgggacgagccctttgggccccagccggaggaggacgaggacgatgtcgtgctgggacagcccatctctcgcgcgcgggccgtgtcccgccgccaggnnnnnnnnnntggcaatctcgtcgcggactccctcctgaaacaagcgatatcgtcgcggctccacgccgaacccagagcagaatacctcaatacccnnnnnnnnnngtttgggccccagccggaggaggacgacgacgatttcgtgctgggacagcccatccctcgcgcgcgggccgtgtcccgccgccagggggagtctggcctgcatgttgtccagtga

SEQ ID NO: 3613 - DNA, 1551 bp, Chlorella protothecoides
  modified_base (1108)..(1117): a, c, t, g, unknown or other
atgtaccgtggtatccacggactccatgggaggtgtgaggtttccttgcaaggtgagaaccctggggtttcggacgccaagcacggaagcggcgatttcgtcgcggactccctcctagaacaagcgatatcgtcgcggctccacaccgaacccagagcagaatacctcaataccctcagattcatttccttcaaagcatggcgcggtactaagcctagcccgggctgcacggcgatgagctccccgtcgcacacccagtcgtcggtggcctccaccgtcttcgccgtggggctgggggtgggggtggcggccgtcgctggcgtggctgtgggcgccatgttcggggcaagcgccctaagtatcgccgcggccagtaagcagcaggcccgcccccctctgaccgccaaggacctccggcgggacgaggagggacgcatcctcaactggcgcagcgccctgcgcatcatccagcagggggtgaggaaaccggagggatcgccgatgtgctggtcccgtggcgacatgcacatctcccggttgggaggtcattcccagccaccaggcgctgaccatgcaatcctcacacccctcgcatcaatccaaccccccccccatcagggcatctcccccgagctgcgtggcaccctctggcccttcctcctgggtgtcttttcccccgactccacggagcaggcccgggcccgggagctggtgcgcctgcgcggcgtctacgcccagctcctccgcgtctgcgagcggctggaggccgaggcgcgagccgccgcagccgccgccgccgcgcctggccaccccgactcccccagcaaggccgcacgagcggcggtggcctttggcgaggcgcaccgcatcatcgtcatggacggtctgcgcaccgatctgcgcggcggtgcaggccgcggcgtcgacccgggcgcggggctcagcgtccttcccatctctctggatggcggcgcaccggacatcctgcttgtccggcgcgaggaggatgaaggggatgcggcggcgcgcggcgcggcgggggcgggggaggcgtgggacggcgcctcagagtgcgatggcggggggacggcggcccacgccgctgcannnnnnnnnnaggatgcggaggcgcgcggcgcggcgggggcggggggggcctgggacggcgcctcagagtgcgacggcggggggacggcggcccacgccgctgcaggtccggcagggtcggggtccccgccctccgctccagagcctcggcgctgggacagccgcgccgcgcgcgacgcgctggccgcgatgccggagggcgcggcgcacgcgccccgcacgctgcgcctgatccgcctgctgtcggcctacagcgtgcacgaccctgagacggggtactgccagggcatgtcagacctggcggcggtggtggtcatgctcgtccccgacgaggccctggcctttgcctgcttcgagcgggtcatgcgccacgcgcgcaggaacttccggcacgacgagaccggcatcaagtgcgtgggtgggggggtgggagggtgggggtaa

SEQ ID NO: 3614 - DNA, 765 bp, Chlorella protothecoides
atgtgtggactggcttcacaaaaagaagcgtgcagaagggggagcggaaaggaggtagagcggggagaggggaatggcagtgtacaggatgacggcgggggtgggtgggatatcgagcaacccaggcgccgtgccgccgccaaagtaagatacagcgtgatgaaaatgagaaatcagcttggctcacacgaggaggacggcgttgatgcagccgtcgttctcggggttgttagtgacctgggcgtacttgccccacaccaccttgccgccaggggtcaccaggcccagctccgacacattcacctcgatgatggtgccgcgcgtgatcacgcccaggctcgtgtacgcctggccgttggggttcttcttgatgccgatgatggccagctggaaggtggccttcagctcggggtgggtcacatgcgccttgttcatgcgcagaccggtgggccggatgaagcgctcgtacttgggcggcttgcgcgtgaacccgggtggcacaaaggtcacctggaaagacgttgtttggggggaggaggggggagatgttgggtgcgaggtgctgacagcggtggtgtaacctgggggaggggaccaggctgcgagctgccaagtatggccgggagggggaaagggcggcgcacacccctcccccaaccgccacacactgcgatcagagggtctgcaaggcctgtcatactccaaacaagcaactcgcacaccaaaatagtctacccacgccccccccctgcctcaccttggtga

SEQ ID NO: 3615 - DNA, 441 bp, Chlorella protothecoides
atgaccaaggcgtctctcaccagccccaccttccccacccagcacgcaggcggctggcgcttcagcatggatgactcggacccacatgtgctagcgctggaggtgcacatcggcaaacacctggccaccaccgagatagagacggaggtcctgccgcgtgcggtccagctcctcatctcaggacgcctgctgagcctgcaccttcccgacgaggtctgccccgatgcctgcagggctgtacggagcagggccacaggaactctggtcctcacccttccccgggagggcaatggcagggtggcggcatcgaagcaagcagggatatcatcagggcgcggaaagtccgcgggaaacaatgcggcggttgttggcgccgcgcaggccacgcccgccatgactgctgccgtggtggcctgcggagacggattcccacccctgtag

SEQ ID NO: 3616 - DNA, 342 bp, Chlorella protothecoides
atgcgccaaaacttccacgtcccatgcatcgccgcagagctgtctgacagggtcggcagggtagctcagaccaacaatgtggtgttggggactggtgacgagtcggagtggcgagaactggatgctcaggtgaatgcataccccgctgatcgaaccttcaaggctatcggctctggcggcgacgacttcgtggcctccatgaccagctgcgtggagcgggtggttggcgtgcggctgccctcctcccgggtcacccaccgcctctcggcggggggcaagtacgttagcgtgaccatcgggcctgtcctcgtggagacgccagaccaggtgcgggagttctga

SEQ ID NO: 3617 - DNA, 672 bp, Chlorella protothecoides
atggtgctcattacggaggcactgctgcgccagcgggctctacccgccggcgacgtgggcttctcggaggtccgggagatcgccctgcacgggctcggcatagaacgcatcgacttgctggggcatcgatgccgagagctacgcgtcctcatgctccagaacaacgtcatacctcgcatcgaaaacctccatcgcctcaaggtgctagagtacgtcaatctggccatcaataacatcaccacgatcgaggggctgcaccgctgcgagtcattgcagagggtggatctcactctcaacttcatccctgccagtgccctcccaggcctcagcaacctcaggcacctcccagacctgcggcacctgagcctgctggggaacccatgcacgcgaacctccccagcgcagcgccgacagcgaccccttcagaatgcccatgcacattccctgcgccattctcgacaggatggggtagaggtgacggaggacgagcgagacggggctgcctgtactgccaaggatctggaagcagcgctggacctctgggtgctgcaagttgagggccaggcagggaccgtacaggaggacgctgaagacacccaggaacacgatcggctgccgtggagcccagagcaaaggttgcaagacttcaggtatgctttacagcttgggtag

SEQ ID NO: 3618 - DNA, 837 bp, Chlorella protothecoides
atgcccttgacaagactatccacctcgcttcgcctcaacttatccaatcccgcccgccacaggcaccagctgctgcagctggcgcacatactgtcggataccgacccgccgctctacgcgcggcttcgggcgctggactccggggactgcatgtttgcctaccgcatggtggtggtgatgctgcgccgggagctgcccctcccgcgtgtgctcctggtctgggaggcggcgtgggcgcatgcggccgcggccggccggggagacggtgtgccggtcgcggcggggggatgggggcggggagaggcgccatgcgacggcgccgaccaatcgagggggctctccgatgtggaagccacggacgcagctctgggcgccagtttgctgagggatggtggcaaagtggcaggcggtggcgaggccaggcacgctgcagatggggccatcagtggttcacaagccgccagcgtggaagctgcggccctgccagccgaagcgccaggcccccccctgactgccggggctgggcaggcagcagacaagaccactgcaggtgggcagccgccggctatcgcgaagcgcaccccttcccagaccggctccgctgccgcgtacgccggcggcacgtccatcccgcctccagactttgtgctgcagttcattgcggcggtggtccgaggccagcggcgccaggtgatgagctgctgccacggcacggacgatgtgctgcgcctcttctccggcgtgcagatcgatttctggctgaccctggcccaggcgcagaagcagtacaaggcgtacagccagggagggcgggtgccgagggctggcgcgcagtaa

SEQ ID NO: 3619 - DNA, 540 bp, Chlorella protothecoides
atggacacacacacagaccaacacacacacacaccaccctccataaaccccaaaagatgtcacaccactgcactcactcctcccgtcgtcgatgcgttgcagggcgggggcgccccccatgaactgctggaccagggccgggtggtgcatggcctttgccaggaagcccaccatctgctgttgccgcgcctcggtgacgtccaggcggtgttgcaggccgtgcagcgtggcctcggtccccgcctgagcctggcgcaggcggatgacctcggtgaccagcaggcgcttgtcgcgctgcagggtctccacctccgcggccaggccgcccgcgccggcgtcgcggccgggagcgctgccgccgggacggccgacgtcagcggcgggcttgcgccggacgatgccgcccagcaggtggcgctggccgcgcaggaagagctcgttggcaaactcccagcggtccgggtccaccttgcggaagccgtaggtgttcagctggcgcacgaagctggagaaattgctgtgcttgaagtggaggtgtag

SEQ ID NO: 3620 - DNA, 1860 bp, Chlorella protothecoides
atggagcctgacgatggggccagcacccctcgctgcatgctgccgccgggcttgagccgccgggcgggcgggtatcggaagccatccttgagccagcgacagatcctagctctcacctcgccgtccggaccccgcagtcgggacctcgcgcctgatggaggcgaggctgcctctcttgaacgaggaggtgacgcgctgggatatgaggggtgtggggatccacaaactgccctgtgctggcgtggactaggcgcctggtgcgggatggaggagtcgccgagtccatgcaagggcatgggtggaaagccattgccccgcccttctcagtatcctcaacgatgcacatggcctctcgctgcaggttcggggtacggagggcatcagggccttctccaagcacttgcttcaaccctacagcgtggccgagccagggagggaggaactggaggcggagctggccgtgaccaaggccaggttggcgaccgggagctccctcaaggccatttcactttatcaaggtttagacgggtatccgagcacccccctctcgcgacctgcaatccaagcaatcgcatggccagcacgctctcccccgtgcatggcaaagtggtgctggtgctgggggcgagcggcattgtcgggggtggggcagccctgggccttgtgcagctcggggcaaacgtgatagcaccctttcgatctggcgaaagcaaagaggcattttcaaaggaattcagacattatccgagttcacagcagtgggatgcgccggtcgtagactacagcacagagcagggactgcaggacctggctgagtacattcgcagcgagaggggcggggtcgtggaccatatcttcgcatgcatgggaggcagtgtcgcgaaaggtcccctgacggtcctgccagctccagagctggaatcggcactctcgcaccgtgtcttcagccaggtattggcagccaagtacctgttacctctagtgcgacccacacccgacagctgctacctcgtcaccacaggaaggctcggtgcgtgtgatggagcaggagggttggctgcagggtatggcacaaaacatgctaatctgctttgcatcagagcagaccctccacatcccatacacataggcgagtcctgcccagctccggaatgggctatatacacactcgtcaatgctgcagtctacggtgtcgtgacagccttgcgcagcgagattaagacccatcgattgcaagaggagcttgagcgaaatagacccttcatcgtttcacatctcatcaagcccgctatgatcgcaagtgcaagtcgccaagccgctgcggatcggggcggtcatccgtcgagattcggagccttttcaccaccagtggccggatctcaggtcacacccggccagcagcctggtgcccagcatcctgaggatactcagcggcgaggttcgcgacgacatcgtgcgctggactgccgaggagcattgaagcacttttcgcttgacgcagggggggccgcgtcgccactcagcactgaagtcccatccgctggatgcattgcgacactcgcaaggacaggcgtgcgctgcgaaaccctagcgtcccatgaagtcggagctggcgggaggaggcgcagtctcgcccagaaggactctatcccaaggtgtggggcgttgggttatgggaatatggaggcccaagcctctcatgatggcgtacgcccacatccaatgtgtaaacgagttgcccatcaagaccagggcctccccctacccggtgagtaccaccgagatgacgtcatgacacccccccccgccgatgcctcgtctgcccgcccgcccaggcatgagcctttctcccctcactga

SEQ ID NO: 3621 - DNA, 1200 bp, Chlorella protothecoides
atgtttgggagggtggttgtaatggtgggcacccgccactcttccaccatactgacgacccagctttgtgcccagtgtcgacacccccctaatgcattcctaaccacagagttctttgcgctcaatgtccttcctgatcggacagcgggtggactgaggctggccaaagttccgggctggggtgccacaatctattcgcatgctgcggcagcagatgaccacatcaaggtgggtgcccgcatgcgagggggtaggtttgctcaaaggcacatagtgacccagagcctgggtcagtgcgattgtgaagccattggctcgcctgcgtgctgtgggggttttcgggagagagggtgctggattgggcatttgtttgctccattggggtcgacagtcctggggccattcccaggggtcagtccagccaccgggttcgtactcctcaacaaccactccattcacatgtgcaacaatatgccctcgcatccactacaccaggtgctcctgctcgaggactctggcgacccggtggcggccgacatcactgacgaccgtcttgccattcgactgcccaatgcacccgacgacggcgacaactttgtgacaggtctgggcgtggacctcacggcaggcgtgcaggtggaggtgtcgcacccaaccgacccggaggcaggggacctgggtccccagcctctgctgtgggtgagtgatggagggtggcatcgggcgcctgtgcggggcctggggcttgccaggtgggggcggttgggggcatgtttatcctgcaaggtggcaaccagcgacggcatgctccgcgcgtacacctttgggtcgaccgagggccggcccagcgtcgtgctgagtgtcgcacatcccctggaacgcctcgcgctgcctgcaacctctggcggaacccgcgagctggggcaggactccggtctgggtctgggcgccccgccctcagccgccgctgcagcagccgttccgctgggagacgagagtgacgacgacgacctggaggaggaggaggaggaggattccgaggctgctgctggcagcgagaaggagggaagcgggccaggcgaggacgaccaggactcgggcgcatcaaacagcgagcgagaggtgcgagggccgagcggggctgctggttgcatctgctcggctctggtagctgccacgggcctgcgatggtgggactga

SEQ ID NO: 3622 - DNA, 384 bp, Chlorella protothecoides
atgcaccctccttcccctcatccgcgccgctcatcaggttttggagcccctgcctcaccaggatttggagccccagcgtcgcctgccacccctggcttcggccagcccggatttggagcgggagcagggaaggcaacggcctttggtcagcccacgggcggcttcggtgccttttcgggagccggcagctcccctgctgcctctgggttcggaggttttggcgccgccgcagctggcagtgctcccgctgcatcaggagttggaggctttggcgccgctgctgcgagcagctttcccgctgcatcagggtttggaggctttggcgccgcctcaccccgaccccccgcaccctccggagcgtcgctgtgggccccgcgaaagtga

SEQ ID NO: 3623 - DNA, 576 bp, Chlorella protothecoides
atgcaggaggtggaccccaaccccggcaccaatgagctgtcggagctggcagggcccggctcctttctggcagacatctccagctccatccccggcatcgatgaggccatgagcttcgccgaggtcatcaagcaggtcaacagtttggactacagctgcatcgtctttgacacggcgccaaccgggcacacgctgcggctgctacagttccccaccaccctggagaaggggctgggcaagctgatgagcctgaaggagtcgttcggggggatgctgagccaggtcactgccctgctgggtgcaggcggtgagggcgacatcattgagcaggcctcccagaagctggttgctctcaaggtggggcaccggcgatggtggcgtatgggagaggtaatgggtggggtcggggccaggattgggcctggcggccggcaggcgtgcacctcaatcaaggcagctcctccttgccaacggcaccatcttcccctctgggggcgccaggcctgtggcgcccaccttgcatcccatgccctcttgcctccggagcgcccgccctttcccaaagggttagcgtga

SEQ ID NO: 3624 - DNA, 540 bp, Chlorella protothecoides
  modified_base (235)..(244): a, c, t, g, unknown or other
  modified_base (305)..(314): a, c, t, g, unknown or other
atggctgagtgcagctgggggcctctggaatccacatcaagccagggtcctcgtcgtggtcatgacagcagtggcttggcagaagtggcaggatccaacattcataagtttccacctgccattgcaaggattgaggcagacctgacgatgctggtcccagtttgcaatgggaagaagatggagggggggtgcagcagaggaaatcaatgggctctctctgatgcaggaacagtannnnnnnnnngctcctctatcgcacgagaggttgaaaaaggtgggaggagagcactgcatcctggcaagtnnnnnnnnnncctgcacacccagggcgaggaaccgctggtgcgtcacaacaaccagcctggcaacatcgccaccgctgcctttgtgctgactgagttggggatcaacatcatgactgtggctcacggtgggcccggcgctgacgccatcatggccatcggcattgacggctcccccgacaagcagctgctgggggccatcagctgcatacgcaccgcgcaaggaccgcagccctga

SEQ ID NO: 3625 - DNA, 1188 bp, Chlorella protothecoides
atgctgagagacgcgtgcggtgcagcgaagcaaaaacgaaggagaggttcacctcatgctttgcatgacgcgctatgtttcccgcgctcgcttcaagacaatacaaagcgccagacggacattggcagcgcagaggataagcgcaagacactgctcgccatatttcacgagaccaaggacgtcttcgtactgaagaattggagaggatcccacccccatcgcgagaccgtaggatgtggagaaaattggagcgaaacgaggggtggtcctgcaaagcatcaaggatgtgctgcaggtgagggagcagggatcgtttctaccaataaaatccatgcagtccggccacaggctacacgcagctctgcctcacttccacagacactcgtagatgatgacctggtccacatggagaaaatcggatcctcaaactacttctgctatcaagtcgtacaggacatccagacaacagtttggccgttcaccagattgcacaaggatcatgcgtgcaccgcccgcgtcctgaatcatgaaccccactgcgctcctcctcgaaaatgctgcaggtcatttcccagcgaggcggcagtcaagctgcaagtcgaaataaccaaactggagacacagcttgaggagcgaagccaggaggcaaaaagcctgggtgcacagctggaaagcaagaaggttggaaacaccgatacggaggagagatcctgtctggtgcgccggctggctgagctggatgagaagctggctgctagctcagcagagctcagacaatatgcagccagcgaccctgaacgatacgaggccctgagtgagaagatggcttggtgtttggcggagacacgggaggggggcgcgatggcagccatgcactgtgcactgttgttaccgtatgctcatcaactcccagagcaagccacccccgtggccatcgactcggcaaaccgatggattgacaacctccacgccctgcacgactggctccggaagaagttccagggaatggacacccaagtgacgaacttgttcaaggaggtacgcgcttgtgtgcagcgtggtgcagtttgggtctggcctgccttgcatgtgcacgtgttcatggggaaggttgggaggctgaatattgggcgggagagccctgggcaaggctcgtcaaaccctgccacaacttgttgttcccgctga

SEQ ID NO: 3626 - DNA, 624 bp, Chlorella protothecoides
atgcgtacttacgcgcgggccgcctcgttggtccttgccttcgccattgctgcatgcctgctgcagcatgcggaggcccacggctatcttgccgtgccagcctcgaggaatgccctgcataacaccgactactgtccgcagtgcctcaatgctggaggaccggcggcagtcagcgctggaaatactttgcaatggccgctttctcaccacggaatgtgcggggactcttacactggggagcggaagcacgagtacggtggcgtctcagccaccgggaccatcaccgggacctacaccgaaggccaggtcgtcaacctgacgaccgtgatcaccgcaagccacaaggggaggttcacctacagggtgtgcgtcatcgaggatccagcctcagagctcgcggagctcactgaggagtgcctggacaagcacgtcctgccctcctgggagccctcaaccccttctaatcccacacctggaccctgcctccccaggtgcaagccgacgtggccggagctcagaaccctggcagcccctactggtacgatcggggaaccggttcctacaccatgtcctaccagctgccccagggtctcacctgcgacggtgtcaacgcgcgctgcgtga

SEQ ID NO: 3627 - DNA, 549 bp, Chlorella protothecoides
atgttcaagctgtggtacatggccgacgccgacatgctgcacccctccaactactaccgcctgcagaacacgggccagggtttgcagcgcgtgcaggcagcgcccggcgtcggccgcgccatgcacgccatcctggcgcggtgccagcgccggctgggcggctgggtgggctcctcggtggtgcacctgggcgaccacaacgtgcccaacgccctcctcttcatcgacaagtacacccaggtgccgcgcatcctggggcccctcgtgctggtgctggaggcgctgcccacgctgtgccgcgaccgcgcggtccgcgcctacgtggaggccgtgcacgggtcggtggcggggtgccgcggggcggtgctcctcgacttcttccgccacgcgtttgacgggtctggggccgacaacttcttcgacgccggctcctgcatcgacggccggctgaccagcgcctggaactggtgtagcaagctggaaaagaaggaatacgcccacgtctttgcgctggcggggttcacctccttcgacggcgacttcaagtga

SEQ ID NO: 3628 - DNA, 441 bp, Chlorella protothecoides
  modified_base (122)..(131): a, c, t, g, unknown or other
atgcgatgcatgggctcaacacgggagacattcgtcggtggtgatgcatgggacgggaatggtcagtgccgtccagggagtgatattcaagtggtaaggggcctggtgtcaaccagactcgnnnnnnnnnntattgagatcgtgggcgcggacgaaatcgcatgcgatgcatgggctcaaaacacgggagacatgcgtcggtggacggcaatggtcagtgccgtccagggagtgatcttcaattgtgatgtgccgctgaaggagtacatccgatccctggacgatgcggcatcggctgcagagaagttcatcatcgccgagctggacgatcagaacctatttgtgaaggtggctcgcgcggagttcgtggaggccaaggtgaagcagtttgtcaacgccctgcacttcacaaagccggaggttgcgccagggcaggcctga

SEQ ID NO: 3629 - DNA, 567 bp, Chlorella protothecoides
  modified_base (319)..(328): a, c, t, g, unknown or other
atgcaggtgcacgatgacatagaggcattcctggcgttctacgagtcattgccgggccccaaacgcctcatcggctacagcaagtttgcagagcgccactatgctcaggatggactgtatggtccagggacgtggcttgtgtttggcagcgagacttcaggcctgccgaccatggtgcgtgcgtacggggatgcagcattctgcaggaaagaagggtgctgtgccgccttcaggcagcatgccgtggaggccgtcaacaatgacgcagggaatagtgccatggtgaagatacccatgcagcagcagcatgtgcgcagcnnnnnnnnnntacatgccttgagttccaaaagctcttgcgtgtccttactgtgctcacactaccactgccgtacctcccaggccgtggaggccgtcaacaaggacgcagggaatagtgccatggtgaaaatacccatgcagcagcagcatgtgcgcagcctgaacctggcaaccagcgtgggcatcggcgtgtatgaggcgctgcggcagctcgacggcgccgtcctgccggacgtgaaaaatcactga

SEQ ID NO: 3630 - DNA, 2316 bp, Chlorella protothecoides
  modified_base (508)..(517): a, c, t, g, unknown or other
atgtcttcgtggacgagtgcccaaaggctgccactaatttcctcaagtgcgcctctgtgtgtgtgtgtgtaccgggggtatccctactatgtgtatgtcgagccttgctccccagctaaaaagctacaatcactatcttcatggtacccctcccccttcatcagactgtgcaagatcaagtactacaacaactgcctgttctacaacgtccagcggaacttcatcgcccagacaggcgatcccactaatactggcaagggtggggagtctgtttacggggtgctctacggggagcaggcccggttcttcgaggatgagatccgaccagcgctgaagcacaagaagaagggcatggtcggcatggccagtgagtgccgctgtgggggtttgtgggtggcgcgggataccgggcctgatgaatctgctggggagtgtttttctctggatgccccttgcagaatgactggaagggtgacgatgaagtatggcttgttcgacagtcaccccnnnnnnnnnnaaatctgctggggagtgtcacccctcctgagattccccatccccccccaaaaaaaaacacactcaccactaggcgtcggccccgacgccaacgcctcccaattctacatcaccaccggggaggagctgcagagcctggacgagaagcacaccatcttcggggaggtggcggagggctgggaggtgctggaggccatcgacgacgcgccgtgcgacgacgagggtcgcccgctgcagaacatccgcgtgcgccacaccatcgtgctggacgaccccacccccgacccgccggcgctggctgtgcacgtccccgacgcctccccgccgccgcagttcgcggaggacgggcggctggaggacgactgggagccgggggaggacgcgcggccggcggaggaggtggagcgcgcggggcgcgaggcggaggcgcacaaccgcgcggtggtgctggagatgatcggggacctgccggaggcggatgccaagccgccatccaacatgctcttcatctgcaagctgcaccccgtgaccagcgaggaggacctggagaccatcttttcccggttcggcaacatcacctcctgcgacatcatccgcgactggaagacgggggactcgctgtcctacgccttcatcggcttcgacaccgagaaggcgtgcgaggaggcctacttcaagatgaacaatgtcctcatcgacgaccggcgcatcaaggcaagctcgtcattggcaggggggggcgcagtgagaggggtgtggaatgaggaagtcgttcgcatggggagggcgtgcatcctgagtgaggcggtgctccaacaatgcggtgcggcaccaggaccggccgccttgatggcttgcaaagacctgtgcagccagagcgtgcaccacctgtggcgccaattcaagcgctttgggaagaaggggaacgctgagctggcagacgcggcagccggccacgaccgcggcggcagggacgcaggtggggcgaggggctcacattgctggcaggccagccggcgtgtccttgcaacagtgccgggcgaaacgcagggcccttggagcggtcccaggcgacgctgctgccatggcgccctgttgccgggtggcgattctgtgactcatcctgctctcccctcccatgcaggcacatcaggccggctggagctcaaggagcagttccgtggcccaacactcagtcacgggaggggcaacagggagggctacggcttaatcctagatcattacgagagactctggcctgaccaaagcggcggcctgcctcaagcccaggagcatgatcgaggcagtgcaggcaaccgctcctcgagcttgtggcaagaagctggagcaggagcagggaggggaggcacgggaaacccaggagcaggagccgggaggggaggcacggcaaccacgggagcaggagccgggaggaggggcacggttgtcacgacagcaggagtcgggatgggcactccgagcatcgagagcgctctgacaggcgcagggagtccgaacgggaggggaggagggaccgcagcggggacaggaagcgtcgcgggcgctgcaggtccctgggcaggagcgatcctggagaggtggagactgagaggcggcctcacgcccatcggcatgctgatcgccactaatacggattttccacccttggatggaaacaaatggagcatggcagttgggatgcgtcttgcagaagctgcgcttaaaacgtgggcgactccccccatccgcgggtcgtcccgggaacaaatcggcgggcagggcgtgccaagtgttttctga

SEQ ID NO: 3631 - DNA, 513 bp, Chlorella protothecoides
  modified_base (406)..(415): a, c, t, g, unknown or other
  modified_base (482)..(491): a, c, t, g, unknown or other
atgcatgccaggtcggccacagcgccgagaggccatgctgatcatgcaagttctcgcggggagggtcctcaccaagtcccatgttctagaagtaacacttccaaccccaccggccgccgggagcaggggttttccagtgccatcacgtgcacggtggaagcagggcagaccctgtacctgccggctggatggtggcatgaggtcactagccagggggccggggattcaaaggacgctcccggggagcacatggctctgaaccactggttccacccccctgacaacctggatgcagaagcagagtccttgcatgagagctggacggccactactgacaccatcccaaaggtcagctcctcccatgacaaccccctcctcattgcagctccgacttctggcctgcggnnnnnnnnnngtggtggcatgaggtcaccagccaggggttcgggggttcaaaggacgctcccggggagcacatggcnnnnnnnnnncctgtgcagcctggtgatgtga

SEQ ID NO: 3632 - DNA, 1212 bp, Chlorella protothecoides
  modified_base (62)..(71): a, c, t, g, unknown or other
  modified_base (883)..(892): a, c, t, g, unknown or other
atgcctagcacttccgtggcggctgctgcaaaagtgggaatggaccgtgtcacccagcagcnnnnnnnnnnccagtccgttcactttcgtggaggctgctgcagaagtgggaatggaccgtgtcacccagcagcactgactgcacaagttgttactgcattccatgcaaatgttggtgagcccagcgaatccgggcagcttggtcgaggatcgcaccaacacacctccctctcaaggaggtggggacacaatgcacacagccctgtacagggccaatgcgctactcacgtatgccggatcagtgctcgcagtcctgtgcgtgctggctacgataacagatgtgttccatactgcacatccctccgtaacatgcgagttcaagggcatcgacggcctgcaaagagagtatggccacgacagggtgcgctggggctgtgggtgggtcatggcctcgggcctggacaggcagcgacttccaggcatttacaggcctacccagtgctgagcctgaggggtgactggacaagcgagttcacgtggaacacaaaacagatcttcgtgtatgccaatgtggagtttgagacacggcagaacaagcggaacgagatgctcatgtggagcaagctgctgaccagcaaggtgggtgatgaagggcggcttgactgtggtgtcgagggcgcccttgtaatgtctgttgacccaagatgggctgtcgggtcgaatggtattacaagcgggatgagtgtgccttccactactgagcgagatgggggcactcgtcggaccttccttgcgacacagtgccacagctcacccctccccattgcccctctgcaggacgaggcgactgttgacctccctcgcctggcccaggagttccccnnnnnnnnnnctatcgcaagcgggatgagtgtgcctgccactactgagcgagatgggggtactcgtctgaccttccttgcgacacggtgccacagctcacccctccccaattcccctctgcaggacgaggcgactgtcgacctccctcgcctggcccaggagttcccctatgctgtcacggaccagggttacacgctgcggggcacgctcttcaacatcagcatcacctggaacgtgatgccacgtgtggggcgcctctacacccgcacgcaggcgtttgggccctgggagctgccgcaggactaccagaccctccagaaggagggctga

SEQ ID NO: 3633 - DNA, 1740 bp, Chlorella protothecoides
atggatggccaggggtccagtttacccacacacacacgaaacccgatcccccggaccccacagatccaagcagtaggaagctccggaaccccttctactcaccaggatgtgctcgtcgggcttcaggctctccagcctcttcaccagcatgtcgaagtcgtcgtcgctctcagacatgcaccacgcctgggagagcgcaaagatgacatccaccttgttggccagctgggggtggtggtggcggaagacagacaggaaggtctggcgcagcaggtcatcgtcctccttcaggagggcctggttgacctccagggcgtaggcggaggggccatccttggacatggacagggcggtggcgaagccgtcccgcctggtgctgaggaggctcatgctgctgaggcagggggtggctcgggggtcgctggaccaggagtatgctcaaacaatcgatgcgatgcagggatccgggtggagcggggacgaaggcaccctcagcgcccaccgttcgaggggcaaacccgaagcgagggtgggttagggctttcgagggtagggactctggcggcgtcagcacgagtcacaaaggtgcgccgacgtgctttcctctcgcggattgatgcccgacgcgcgcgaacaggtccctggctaggtgctgttcgggagagcaggcatccccccccacccaacaactgcgatctgacccgatcaatgttctgccggaataggatgtctaccaggactctgacctgtcctgtgggaacatccgcggtcgatgcggcatatgactgcacgaatacctggctggcggtgctgtcgtctgcccacattcgcgtgcttcgcagggaggacccctcccgctccttccatccccatggcgtgctgcagctggacgacagcgataaacacgtgagcagcctggcatgggctccccccgatcagggccccctcctcgctgcgggaacaggtgctggctgcctcatgctctgggcctgtgacccgacgtcccccgaaccatgctggacgcgcatcgcccgtctgcaagctgggaaggcctccctgcgccagctagccttcgatcccaacccagctacccatgcctgcacactggccgctgcctgcgaggacggcttcgtgagattcttcgagcggaacgaccgcgacccgtcccatacggcctgggagccctgcaacagcctacggtgcagcggcgccgccggcacccccacatgcctcagctggcatgacatcggcgacggcgcggcgcatggaaccgcgctcccgtccctcctcctggtcggcacctcccgcggccaggcggcggtgtggtggctgaggaaagagacggcgtcctgggtcaaggccacagacctacccctggccggcgatggggaaggcacgggcccggcgcacgcaggtcgaccaatcgcagcagcgggactggagagcgtgaccagcgcggcgtggggcccggccctgggccgggcgcacgagacggtggcaacagcatccgggtccgtcgtcacgctgtgcacgctgcgcggcacaatcgatgcgctggaggttcggcgctcggccgtgctgccgcacgacagccccgtctggcaggtggggtggaacccgctggggacctggctggcgtgctccacccagcgcggccaggtctgcctctggcggcccgacttcgggggcgagtggcagctgtgcaacgtcgtcgccggcgaggcggccatgcaggagtga

SEQ ID NO: 3634 - DNA, 3129 bp, Chlorella protothecoides
  modified_base (149)..(158): a, c, t, g, unknown or other
  modified_base (2148)..(2157): a, c, t, g, unknown or other
atgcgtcaagggcttagggtttggcccgtgtccttgcctgctgtggagccttgccatgcactacccttaggacacatgcctggtatagcaggagtcatggggagctccgggttccagtcccctgtggccagcgccttctcgcagctccnnnnnnnnnnttttcctctcacccttgcacctcgccatgcaaaccaccttcccccgccttgtcccccccaggtggccagcgccttctcgcagctcctcaacctgcacaacctgaccgaggagatcgtgacggcgcgtgtggagaaggcggcgcgcctgggcgaggtggagcagagcacgcggtccaccaacaagtcgctggagcgccttgtgaacgagctcggacagaacccggaggacatcttcaaggcgctgtgccgccagcgcgtggacatcgtgttcacggcccaccccacccaggccatccgccagtcgctgctgaagaagtaccagaagatccggagcgagatggacgcactgcacaacacgcgcatgacgccctacgagcggctggagtgcctggacgagatcaagtcccagatccaggccgcctggcgcaccgacgagatccggcgcaagaagcccacgccccaggacgagtcgcgccaggggctgagctacttccacgacaccatcttccacggcctgcccgtgttcctgcgccgcatcgacaccgcactgaagaacatcgggcagcccatgctgcccctggacacaaagctcttcaactttggcgcctggatgggcggcgaccgcgacggcaaccccttcgtcaccgccgccaccacacgcgacgtggtcctgggcgcgcgcctgtcggccaccatgctgctccagagccagatcagccggctggtatacgagttgtcagtctggcgtgccagcgacgagctgaccgccgctgccgcccggatcctggaggcgcgcaaggatggcctgtacgcgcacaccacgcgcgagtcgtatgagactgagttcgggtcggtgcgggagcccttccgcgtggtgctgtcggagatccgggagcgtctgaacagcaccagcaccacgctgcgctacctcatgtcgcacccgcacctgaatgtgaaggagacgctggacaacgacccgggcgcgtactccgacgcggaggccatcatcacccccctcatgctctgctacgactcgctggtggccacgggggacagcaccatcgccttcagcgagctgactgacgtcatccgtcaggcccagacctttggcctgcacctctgccagctggacatccggcaggagagcacgaagcacgccgaggccatcgacgccatcaccacctacctgggcctgggctccttcaatgcctgggacgaggcccagcgcaccgccttcttactgaaggagctggaggagcggaggccgctcctccccgccgacctgcccatgagcgaggaggtggccgacgtcatcggcaccttcaagatgctggccaccctgccctccgactccctgggcgcctacatcatctccatggcgcacaccgcctccgacgtcctggcggtgctcctcctccagaaggagtgcggcatccgggagacgctgcgcgtggtccccctgtttgagaccctggacgacctggagtacgccgagaccgccatggagcagctgttcggcaacgcctggtaccatgcacacatcgcgggcgcgcaggagtgcatgatcggctactctgactcgggcaaggacgcggggcgcctggccgccgcctggggcctgtacgaggtgcaggagcgcctggcagccgtggccgccaagtatgacgtccacctcaccctcttccacggccgcggcgggactgtgggacgcggcggcggccccgcccacctcgccatcctctcccagccgcccaagaccatcagcggcaccctccgcgtcaccgtgcagtacgccgttgtatcgaggatggaggaaagggggcggttgcatgcggtcatccgggggcgagaactggggtattggcgggggcgatccgcagaccctgccccccttccaaaaccgcttcccccctgctcgtacttccccacccactcagggcccccccccttccccccaacacctccacagggcgaggtgatggagcagcannnnnnnnnnagggcgagaactgaggtactggcgggggcgatccgcagtccctgccccccttccaaaccccccttcccccggctcatacttccccacccactcagggcccccccccccttccccccaatacctccacagggcgaggtgatggagcagcagtttggagaaaaggaaattgccttccgcaccatggacctgtacacctcggcggtgctggaggcaacgctggcgcccatggaggagccgcaggcggtgtggcgcgaggcgatgcgcgagatgtcgcgcacctcctgcgaggcctaccgcgcggtcgtccgccacgacccgcgcttcatcgagtacttccagaccctgacccctgtgaatgagctggggcgcatgaacatcgggtcgcgccccgccaagcgcaaggcccacggctccatcgacaccctgcgcgccatcccctggatctttgcctggacccagatccggttccacctccccgtctggctgggcatgggccaggccctgcgcgccatgatcgacgcgggcaagctggagctgctccaggacatgtaccagaactggatgttcttccgcgtcaccctggacatgctggagatggtgttcgccaaggccgacccccgcgtggtcaccatgtaccagcgccagctggtggacgccgggctgcacgccctgggcgacgagctcctccgcaccttctacgaggccgaggagctggtgctcaaggtgatgaagcacaagggcctgctgtccagctccagcaccgccttcctgcagcagaagctgcagctgcgcgcgccctacgttgcgccgctgaacatcctccaggtctactgcctgaagaccatccgcgacatcgaggcggggaaggaggtggatgagtcgggctacaagcccgaccccgccgccgtggcgctgatgagccgcgacccggagaagacgcccttcgtgggcgccgtggaggacaccctgtga

SEQ ID NO: 3635 - DNA, 1437 bp, Chlorella protothecoides
atggaggagccgacctggtcggacaacgactaccctgccattgactaccaggcctacagctactactctgccccgcgccagaaggagaagaaggggtccctggaagaggtggacccagagctgctggccacctttgacaagctgggcatccccctggccgagcagaagcggctggccaacgtggccgtcgatgccgtgtttgattcggtgtccatcgccaccaccttccgcgaggagctgggaaaggccggcgtcatcttctgctccatctccgaggctgtgcgcgagtacccggacctcatccgcaagcacctgggctcggtggtgcgtctgggatcgaggttgggggaagtgtcgtgggtgggcgggaatcgggtccccaccagcgacaactactttgcggccctgaactctgccgtcttctccgacggctcctttgtctacatcccgcgcggggtgcgctgccccatggagctgtccacctacttccgcatcaacgccgcggagacggggcagtttgagcgcacgctgatcgtggcagaggaggggtcccacgtgtcctacctggagggctgcaccgcccccgcctacgacaccaaccagctgcacgcggcggtggtggagctcagcgcggccgcggatgcagagatcaagtactccacggtccagaactggtacgcgggggacgccgcggggcgcggcggcatctacaacttcgtgaccaagcgcggcgtgtgcgccggcgcgcgctccaagatctcctggacccaggtggagaccgggtcggccatcacctggaagtacccctcggtggtgctggcgggggcggactcggtgggcgagttctactccgtggccctgaccaacaaccggcagcaggccgacacggggacaaagatgatccacgtgggtccgcgaacacgctcgcgcatcgtgtccaagggcatctccgccggccagtcgcgcaacgtctaccgcggcctggtcagcatcggccccggggccgacggcgcgcgcaaccactcccagtgcgactccatgctgatcggggacgaggccggggccaacacctacccgtacatccaggtgcgcaaccccaccgcgcgcgtggagcacgaggcctccacctccaagatcggagaggaccagctgttctacttccagcagcgtggcgtggcggtggaggaggcggtgggcatgatcatctcgggcttctgccgcgaggtgtttaacgagctgcccctggagtttgccgcggagggggcctgggacaccgccttgccggcatggaggcgggccggccgcagcggctccctccgggtctccccatcacctccacatcacgaggtcgtggccatcgcggaggtggccgcgcaagccatcctccgggtgtaccatgccaaggcgagcgggggagccctggtcgctgggctgtga

SEQ ID NO: 3636 - DNA, 516 bp, Chlorella protothecoides
atgcagttcgccccctcggcccgggctaccctgcctgtggcgagctgccggccccgactggtggcaactcgccccattgctcgtgtggcaagcctgcacaccgccaaggcggcaatggtgccccagccgctggtgcgccttgggggtctggcgtctgcactcgttgggccggggccgagcagccatgacgtcgctccgcgtcggtccatatcggaatgtggtcggccagagtctgtctactttttcaggaagttcgagtggccgggccggatgtccccgtgtcctgggtcccgcgccttaccctcccatccccatgcaccctgtccccagatggctaggcctctggggctggcgtccctgcccgcccagcagcgcgccaagcccactagcgtgcgcgtggaggccagcagcagcgcagctgcccccgccccggcccccaaggagggttccttcctgggcatccctgccttcacctggcagaaaatcgtccccctgggcatcatgttcttctggtga

SEQ ID NO: 3637 - DNA, 558 bp, Chlorella protothecoides
atgctcaacaccacccccctgtggcccctcctcctgcagaactaccagtactgctggtgcgtcgaccccttggatgggaccaaggagttcctcaaacgcaatggccagttcaccgtcaacatcgccctgctccagggcgccaagccggtgctgggcgtggtccacgtgccagtccagggcaaggtgtactgggccgtcgccggcaagggggcctgggcgcgtgagtcgccggcctcgcctccccgccagctccactgtgcgaccttcagggagacagacccgggcctcgtgatcgtgggatctgccagccatgccagccaggagacggcggagtttgtgggcgagttccgggcgccccagttccgcgccgtcggctcctccctgaagctgctcatggtggcggagggcgcggcgcacatgtacccccggctggccccgacgtgcgagtgggacaccgcggcggcccatgccatcgttgaggaggcagggggccgggtgctgcaggccggcagatgcgactccagcggcaatgccctggagggctggagggtgtgttga

SEQ ID NO: 3638 - DNA, 1521 bp, Chlorella protothecoides
atgcctctccttgcatcactcgccactccacctgctccctcccttcccccccacccgcaggccaccgcggtccccaccgacaccccggcggccaagaagctgtggggcgggcgcttcaccggcgccaccgacccgctgatggagaagttcaacgagtccctgccctttgacaagcgcatgtgggccgaggacatccgcggcagccaggcctacgccaaggccctggccaaggcgggcgtgctgaccgacgaggaggcggccaccatcgtggagggcctggcccgcgtggcgggcgagtgggaggccggcaccttccgcatcgtggccggggacgaggacatccacaccgccaacgagcggcgcctcagcgagctgatcggcgcgctggggggcaagctccacacggggcgcagccgcaacgaccagtgcgtcaccgacacgcgcctctggctgctgggcgcgctgggccgcgtccgcgcctcgctgcacgcgctcatcgccgcggcggcggaccgcgcggcggccgaggccgatgtgctcatgcctgggtacacccacctgcagcccgcgcagacggtgcgctggagccactggctgctgagccacgcggcggcctggcagcgtgacgaccagcgcctggcgggcctgctgccgcgcgtggccacgctgccgctgggctccggcgcgctggcggggaacccctttggcgtggaccgccagttcctggcgcgcgagctgggcttccacggcggcgtctgcccgaactccatggacgcggtgtcggaccgagacttcgtggcggagaccatcttcaccgccagcctgcacctggtgcacctctcacgctgggcggaggacctcatcatttactcctcagggccctaccgcttcgtgcagtgcagcgacgcctacgccaccgggtcacagcaggcgtcccactcctccccctgccgcttccccccaggctccagcctgatgccccagaagaagaatcccgacgcactggagctgatccggggcaagggcgggcgcagcatcggcggcgtgacctccatgctggcggtgctcaagggcacccccaccacctacaacaaggacttccaggagtcgtgggagctcatgttcgacgcggtggacacgctgcacgactgcgtgcgcatcgccacgggcgtgctgagcacgctgcgcatcgatcccgaggccatgcgccgcggcctctccgccgacatgctggccaccgacctggccgagtacctggtgcgccgcggcgtacccttccgcgagacgcaccacatctccggcgcggcggtgaagatggctgaggaccgcggctgcgcgctcagcgacctgacccctgccgacctgcgcaccatccacccgctcttcgacgatgacgtggcagaggtgtgggactttgcgcgctccgccgacacgcgcgacaccgagggcggcgccagccatcgcagcgtggcagagcagatctccaagctgcgcgcctacctggagcagaacgcggtctga

SEQ ID NO: 3639 - DNA, 546 bp, Chlorella protothecoides
atgtggcatgctaaggggcttggtacctgccctgacttcttcccactctcaactcgagtgcgccccttgcgggtgctccgattcctcttttctctccgcaggaaccagcccaatgtgcacgaacagaagctgctggacaaccccgaccactggcatggggcggagctgagcctcatcatcgccgggaactggcagtactaccgctcaaaggtgctcaagtacctgcagctcatcgctgtcatcactccgtacacccaggttgcggacttagggattgcacaccctggaataccactgacacccgagtcggatgtgcaccttgaccggagagccctcccggctgggactgcttcccaacctgtgcttttcactcagttctgcaacccctcccacgctgtgcagttcaacttcaagtacgtggcagaggaggagaagcagtccctcaacatcgtgtttgctcgcaggaccgatgtgatggcgccccctcccaaggtgatgggttgccgacagacacatcttgctctacatgataaatcagtctgctga

SEQ ID NO: 3640 - DNA, 705 bp, Chlorella protothecoides
atggcagaaggacccgtaaaagtcacccccgctgagctggggctcggccccagcgaggaagtagatgcgagactggagtttgaccttgggaatctgtgtgcctacgaccccagtcccgtggatgcggaagcctacgcccgggacgcctccggtgcttgcgcctccacggcatcccgcatcatgcaggcgctggtgggccgactcttcgccctgccctcagagcccgccgacgtgggccgcatcgcagaactaccagcccccaccacagccttgccccgggagaagccaatacccaggcccaggcctcccaccaagtgggagctgtttgccaagaagaagggcattaccaaacacaagcgcagcaagctggtgctggacgagaccagcgacacattcaagaggaggcacgggtacagcaaggccaacgacccggcggccgtccccatcattgacgccaaggacggcgaagacgtgggcgatgaccccttctccaagcagaagcgtgataagaaggcacgggtggccaagcaggagaaggcgcagctggccaatctgaaggcggctgccaagagcgggggcaagggggccctgccgcccacgttgaggctggcggccgccctgccagagcatgggcggggccggccggtgcgccacaaggactacaagcaggaggtgagagccttgagcatggtgccaatgaactaa

SEQ ID NO: 3641 - DNA, 969 bp, Chlorella protothecoides
atggcccggtgcctcctcctcgctgccctggccgcgctgctgatctcaggcgcccaggccgggtgcaagctgcgccgcgaccccaacctgaagccggaggaccggttctacaaccacgtccccctgaactcccagctccccctggaggccctgcccaagaactttgactggaacaacaaggacggccgctcctacctggcccccagctggaaccagcacatcccccagtactgcggctcctgctggctgcacggcaccgcctccatgctccaggaccggctgaagatcaccaaggacggtgccggtcccgatgcgatgctggcgcgccaggtcatcctgaactgcgccgccttccacggcttcggcggcggctgcgacggcggcgacgtcatcgacgtcctgcgctacatggccgcctacggcctgccggacgagtcctgcatgccctacgccgccacggaccacaccaagtatggcaagcatgccaaggcctgccccgcggaggggtactgcatgaactgcatgcccatcaagggcaaggacacgtgctgggcggtgaagacccccatccgctactatgtggagagctacggccagatcacggagaagggcgaggcgcccatcatgaacgaggtgctggcccgagggccggtggtctgctccatcgccactcccaccgtcttcgactacggctaccacgccggcatcttccacgacaaggacaactccaccgacgtggaccacgacatcgagatcgtgggctggggcgaggaggacggccaaaagtactggatcgtgcgcaactcttggggcacctactttggtaacctgggcttcttcaagctggagcgcggcgtcaactccctcatgatcgagaacggcgactgctggtgcgcgggagggggcctgtggtgttcagggcggggccgggcgcagggactcgggccgctgcagcggggtgtggcctag

SEQ ID NO: 3642 - DNA, 291 bp, Chlorella protothecoides
atgtatcccatcgccaccctgcaggacggaggcgagcggacctcccagagcaagctggtcgaccacatcctgcggaaaaacgccgacgacatcgtggatgtgggccgcgcgattggcaaatttgagagcgctgcgcgggaggaccgccaccgcatgaagatgaagggcgccaacaagaaggggcgcatcagcaagggcgcgggggcgcccaccggcaagaccaaggccggaggcgtggcgaagaagggcgggcgggagggcagtgccaagggtcggggcaagaaggcgtga

SEQ ID NO: 3643 - DNA, 384 bp, Chlorella protothecoides
atggcgggtagcccaggctctggaaaccttcctgaaccattgcagaagggtgaaacaggcgatgccctggacggcaagcggcgggatctggaggcccggcaggcggcggcgcaaggcggcaggtccgacaaggtcttctacagggtgaccattaaggacaatggcgcgggcatggcccacgcccagatcccagacatgctgggccgggtcctgtcaggcaccaagtacggcgtggcccaaacgcggggcaaatttgggctgggagccaagatggcgctgatctggagcaagatgagcacggggctgcccatcaccatccgctcggcgcgcccacggtccgccaccatttcttactacaagctggacatcgacatccagaagtag

SEQ ID NO: 3644 - DNA, 327 bp, Chlorella protothecoides
atgcacacacaggcgctccagggcgcgagcctactgacctctagtctatgccccgcacgccctttccgggcaggctcacgccccgcccgcccctcaaggccccagtgcgcgcgagtgcgggccaccgccacggacttcgtgcgtgagccggccacggaaatgtcggaggagaagcgggacctgcagcgcatgttgagcaagccgtacaagtacggcttcaagacgttcatagagtctgacgtctttcccaagggcctggatgaggacgtggtgcgggctatctccctcaagaaggaggagccggagtggctcctggagtttaggtag

SEQ ID NO: 3645 - DNA, 459 bp, Chlorella protothecoides
atgctggaggtggagttttccgacgagggagcagcgcggaagtacggccaggggatgaagcagaccatgccctttcgccggttcctgcagtccattgctgatggggaggactcgcggtacctcaccacccaggatgtccccaccgagattgacggccaccccgccctgtacggcagccccctcgtggcgctggagggggacttcccccggctcccggagctggccggcagcctcgttcccgcctccatcaacctgtggatgggtctgtcggcgcagggcaccagctccggcctgcaccacgatttccacgacaacctgtactccctgctgcgcgggaggaagacctttaggctgtggccgccctcggcgctggactccatgtatccacacggccggccagtcaagcgctggcccaatggcagagtggtgtacagcgaacaggtaccgcgctgggtttga

SEQ ID NO: 3646 - DNA, 480 bp, Chlorella protothecoides
atgcaggcggccgtcaagtctgcactccaggcctgctgcctgcagctccgatccaagctggtgaagcaggcggcagctcgggagcaggcgcagcgcaagcgcgcgctgaccaagtacgtgcccaatgtggcggcggccgtgtacgccatcgtgcaggggatcgcggccaggccaggcaaacggcccaggctggccccacccgagaaggatgtgatcgacaaggtggccagcggcgacgtaacccagaagacgctggccacgcgcctgatggagcacatagagcgctttgacacagacatggcactggagtaccagatgcagcagggcatcaccgaggggcagagggtggatgccttccttcgaccccagaccgaccgccatcggtacacggcgctgctcacgactggcgtggcctccatccagctgctctgcccctctgctgctgcggcttcaagtgctgaggtcatcgatgtaacctga

SEQ ID NO: 3647 - DNA, 1194 bp, Chlorella protothecoides
atgatcgtcaatgcgaccctgctcaagcggatccctggcgtcgagccttgcgtaccccgcccgcccatcctcgagcccatgcatggggtcccaagcgcatgctggcccttccccccagaccgccccttcacccctgtacaccacacgcccaccccccacagcatcctgttcaactacaccatcctgcgcgacaccaaggatgtgctggtggtgaccgcccccgggtccggcgcggagatcatccccttcctgaagacgtgggtgaacctccccatggccatcggcttcaccatcctctacaccaagctggccaacgtgctgaacaacgagcagctgttctacacctgcatcatccccttcatcgccttcttctccgcatttgccttcctgctctaccccctgcgcgacgtgctgcaccccaccgcctgggccacccaggccctggcccagtacggcccgcgcttcgccggccccctggccatcgtgcgcaactggaccttctgcctcttctacgtcatggccgagctgtgggggtcggtggtggtgtcggtgctcttctggggctttgccaaccagatcaccaccgtggacgaggccaagcagttctacccgctcttcggcctgggtgccaacgtggccctcatcttctccggccgtgccgtcaagtggttcagccagatccgggccagcctgcccccgggcgtcgacggctggggctacagcctgaagggcatgatgggcatggtctccgcctttggcctggtcatcgtcgcggtgttctactacctcaaccgcaccgtggtgccgagggtgcaggacgccatcccgaagcgcgccaagaagaagaaggagccgatgtcggttggcgagtcctttgccttcctggccaagtcggcctacatccggaacctggccacgctggtggtggcctacggcatctccatcaacctggtggaggtaacctggaagtccaagatcaagcagcagttccccaaccccaacgagtactccgccttcatgggcgacttctccaccgccacgggcgccgtcaccttcaccatgatgctggtgtcgcgctggatcttctcccgcttcggatggggcatggccgccctcatcacccccaccgtcctcctcatcaccggtgggtggcggcgcgtgtgtggtggtggggttgagggcggggtgttgtga

SEQ ID NO: 3648 - DNA, 789 bp, Chlorella protothecoides
atgggcatgacgcgcgcgcgcgtgcgttccggaagcagggggcgatactgttggatcacttggtccctcgctggtgcacgaactcatccgatgactcttggcatgttggacccctccggcggaggtcaaagccacaagctcagcgtgctctcggagcatggtctgacaatcgggcatggagcccatagagtgcagatggatgttccaagaaggctcgaggatgccagggagggcctgaacatccgatcatggctctccgtgtaccagcgcgaccggtctggaggggcttctcatatgcatgcggactcagggtccgaggcagggctgggcaatgcctctagatctgggacctggcatgctgaccggctggcacctgcatgctcaccccagcacctccgctcgtacgccaggctgtcccacctggcactggaccccggcaccttgctgcggccccttcccctggggggcgtcaactggcttgacctggagcgggtggaggacaggtacctgttggcagccagctctgacgcctccgtcgtgctgtacgacacgcaggggcaggaggaggaagctgctgggcaggtgcctcccggccagggcccggcgctcccgggcctcgcgccgctgttgagcctgaccaaggccagtcccggcgggcacaggttcagcgtctccagcgccgcctggtaccccctcgacaacggtctcttcgtcacgggtgcgtcacgggttgggagggggaggcctcgtgcgcttgcctgcaggcctgcgcccgcgactctccagtag

SEQ ID NO: 3649 - DNA, 1113 bp, Chlorella protothecoides
  modified_base (509)..(518): a, c, t, g, unknown or other
  modified_base (1004)..(1013): a, c, t, g, unknown or other
cggcgggcacgtgtactttgtcaagcagctggacgcgcgcgggtctgggcccggcggccccggcgcggcgccgcccgccgccgccgagtcacgcgcgcaggccgcctttgtgctggccgcgctctgcgacggccacccgcgcggccagctgctctgcgccaaggccggcctgctgggcgcggtgctgggccagatgccagcggcgctggcggcgctggccgccggccccggcgccggcggcgacggtcagagccggcgctccagcgcgctgctggtcaagtggctggccctggtgctgggcaaggcggtggagggccagcccgccctctgcgccgccgccatggcagagcaggtctgccgcaggtctttgtgtggtgtgaggaggaggggggcggtgagagggatgtctttgacggcggacgggcgctccccgccgacgctgcgccgggccgtccgcctgcgtgcgccagcctcctcgccgtgccacatgtcgccacaggatccccgcnnnnnnnnnncgccccgggccgttcgcctgcgtgcgccagcctcctcaccgtgccacatgtcgccacaggatccccgctccttcctttcctgcaggcgcacgacatcgtggccaggctgctggccagcgccgacccggaggtgcgcggggcggcctgcttcgcgctgggcgcgctcatccaggtggacccgggcgaggaggaggcggagggcgagggcgaggccgccggcgcccagcccccggcctcggagcgctggaagcaggagcgcgccatcgcctgcagcctcatggagatggtctacgacgccagccccgtcgtcaggtgggtgccggggcctgttttgtggagggacatctctgtgtactcttggaggggccatgtttttgttttcaaagtaggtatgtggaggggtgggtgcaggggagcgagggggatcatggggcgacagagcacgggacccctctcccccgagggctcgcagccggccagcgacgnnnnnnnnnncggtaggtgcaggggatcgagggggatcatggagctaaagagcacgggacccctcccccccgagggctcgcagccggccagcgacgccgaggccgtctga

SEQ ID NO: 3650 - DNA, 1860 bp, Chlorella protothecoides
  modified_base (384)..(393): a, c, t, g, unknown or other
  modified_base (851)..(860): a, c, t, g, unknown or other
atgcgagctgcgtactcatgggatcccgcccctctctgcagtctgcggccggtgaggtcgaagctcgtctttcaggcttttagagcatgcccgaggcgcagcctccggtcggccgtctccatgaaagcatgtaatgccctggtgccttgtgatggggaattccatgcagggtccctctggagcatgctgctggtgggatctgccactgggccagcactgtcacaggcaccttcactgtcgcttggaactcggctggtgcaggctggcatcgtgccgttcccatggcgagcaccgtcatgggctgtgctatcatgtcagccaagccctaaccccccctcctcctcccggatgcagccacacacgagcaccaccccatccctccgnnnnnnnnnngcatccacacatgagcaccaccccatccctcccacggtggcggacaccaaggctgccttcctagagggcttcaagcgccctctgccgggcatctactccaccgtcatccaggagctactggtgcagcaacacctgttccgctggaacgtgacctactcctacaacgccatcaccgccctcggcgtggtcagcatctttgaccagctgctggaggggctgccggagcaggaccccatctttgaggcgttcatcaaggcgctgcaggaggacccggcgcaataccgtggtgatgcacggcgcctcgaagaggccgccgggagcctgggtggcccagagaacctgaagcctgatgcagctcacgcagccagctggtgggttgggcccgctcgcgtaagcagcatcaagtgcctcctcaatcagaacgctgaaccctcctggggatgcccgagtgcatgccnnnnnnnnnnatcaagtgcctcctcaatcagaacgctgaagccttatggtgatgcccgagtgcatgcggggggagggcagcgagatccagaagacactggcacagacggccgaggccatcaagtccggcaacttcctgtacacccgcttcttcgccgtgggcctcttccgcctgctggagctggcgggggccaagggccccaaggccctctccggcctgacgtccgccctgggcgtgccgttggagcgcgtgaacgccgacctcctgacctacaagaacgtgctgtccaagctgcaggccgccaaggagatcatgaaggtgtgggcagcggactggagatggtgtggcgcgactggagtgggggccgactggtgggatggtcacctcccaaccccctcggagcctctgtcgctgagccggctcgccataccacccccaatccacaggagttcctggagcgtgagaagaagaagacggcgcaacgtttggccgagaagcaggcgaaacaggcggcacagagcggagagagcgcggatgggaaggccgcggagctgagaatgtacgaattcaagtatggcaagacaccaagattcgaatttgctgccatccttgcacatttcttgtcggtgtaccgtgtgagggcgtcgctgggtgcgctgacatcctcgcctgccaagcacaggtgggtgtcactctgcagttccgctcgcgcggtgcgtaccagctcacggcgcccgtgtgcatcacgactggatcccatcaccatgggcgcagcgagaacccaaattcctccccgtcacagggtgcgtctggctggggctacccccacaaccctccggtcatgtccaagcgccagcccgctgactccagcggggatcggagcaacagcaagtcctcgagattggatgaagggagtcgtggagggtacaggagaagcggtgcgtttcgctggcactgcgtcgctgcgttggcgactgggatgtgggaatgtcggggttcatggcatctga

SEQ ID NO: 3651 - DNA, 1014 bp, Chlorella protothecoides
atgggaggcagctttggggcgtggcgcgctgcggacgtcgtctgtcatgaggtggcacaccagtggtttggcaacctggtgacggggaccaactggacgcagctggccttcaacgaggggctggcctccttcctggagtaccactgcctgacggcggtgggcgcgccgggggaggtgttgcggtaccgcgcccccctgccccaggcccgactgcccggcgtgcatgaagggcccacgctgcgcgcgctttgcaccgacgcctcgcccttcaggccggccatggtcgccgcctcggacgcggccatcggcacgggcggcgtggaggtatactccaaggcagctacatttttgcgcatgctggaggtggcgctgggcggcgaaacactgcagatcggcctccaggcatcccgtgccgtcccctcacactgccattctgcaaccagccagactccttggtccccatcacccatccaacaggccctgctgcgtgagagggcgctgggatccgccgactttggcgacatcctggccctgctgcatgagagggcgctgggatccgccaactttggcgacatcctggtcgcggcagcggcggcgcaggggaccatcatctcgaccgaccccctggccggcggcctgccggagacaggcacggcgtgggccacccagcccctgctcccgctgcgcaatgccagtgccgtggccgcggtgggccagctgcccgacagggcgggccccttctgctccacggcccagcttcccgccgccggcctgggcgccgaggaagccgcgcggcaggcgctgtgcctgcccgcggcgggggcagcgtggacgctgccggccggcacgggcggcgtcgcggaccagtctgcctgggcggggagcgtgaacgccaccggcctcttccggacgctgcacagcgccgcgcagctggaggccctggcggcctgggccacgcaggtggtgagtcgcggtgtttggaagggtgggaacaagggggatgtgtggcggtag

SEQ ID NO: 3652 - DNA, 306 bp, Chlorella protothecoides
atgtacaaggagaccgagcccctgagagatctcagcctcagccacgaacgtgagggcggcgccgaactcctcgaggtgaggaggctgaggctcatgccctgcagcgctgctgctcccttgcgtgggcattcgtggcagggatgccacacagtgatccaagccaccctccccaccccacgccgaccaccgccgcagatccgcgtgccggcccactgcctcaccagcaacaaccggcacgtgaggtcccgccagctctggggctgcgacttgtacaccgacgattctgatgagctcggaggggactga

SEQ ID NO: 3653 - DNA, 348 bp, Chlorella protothecoides
atgggtccccctttgtcagcctgtcgaggctgctcctttgcggtggaacgcgcctgggtggtgctgcgcagtgggcagagcgtggacctggcgtccaacttggacgggctgccgctgggcgcgcccaccttcaccccctcccaccacgagcgcatcctcacccgctcctcggcggggagcggagcccgcctgcgcaccgcgcaggaggtcaccgtggtcttcaacctggccaatgagccgtggctcaagtacagcgccgccgcggtggcagaccgcggcctgcggccccacgagtggacctcagcgcgcatgagaaccgccaccctgtacctggagagccacacgtga

SEQ ID NO: 3654 - DNA, 1743 bp, Chlorella protothecoides
atgctggactgcctggggcgggagatcatggtcaaccgcgacgtggcccaggacaacgacggcacgcaccgcgagcccgacgccacgacaatcgtggcggggtccacggtggtgctgaccaccgacaccagccaggccttcagcgccagcctgtttcccatctcctaccccggcctgcccgccatggtggagcccggggacaatctgtttgtggggcggtacctggtctccggcgccgacgcctcctcgctctacatgcgcgtcgaggcggcggacgagaccagcatcacctgcaccgccctctccggcgcggtcctgtcgggcctgctcaccgtcttccacaccgagcgctccagcgagggcctggccaacaagcagaacgacctgcccctgctcaccgcctacgaccgcgaggcggtggcctccctggccgccgacttcgacgtcgacttcctgtcgctgtcctactgccgcgacgcggaggatgtggagtccgcccgcgccttcctgtcctccgtcgggtcggggcacaccaaggtgctggccaagtgcgagacgcggcagagcctgtttgccttcaagcagctggtccgcgccgccgacggcatcatcatctcccgcggcaacctgggcctggacgtcccgcctgagaagatggccatgatccagaagtccatgatctccacctgcgtggtgctgaacaagccggtcctgatcacgcgcgtggtggacaccatgatcgacaccccgcgccccacccgcgcggaggccaccgacatcgccaacgcggtgctggacggcgccgacggcttcctgctgggcgccgagacgtaccgcggcaagtacgcgctggagacggtgcgcaccgtgtgcgccatcgcgcgcgaggcggaggccgccttcgaccacgccgcgcactttgaccacctggtggacgaaggtgggcggctggccgccgagggcgaggcccacgcctcgcgcgtggacatgatgcgcaacctgtcgggcgccagcctggcctccgaggcggcgggctggggtgcgggcggcggcggcggtggcggcggcgcgccctccgtccctcgcagccagtcggtgctgagcggcgggtcgggcggcgcggcgcgcctgtccaagctggaggccatcgcctcgtcggcggtgcgcgccgcggacaaggtccgcgccgccatgatcatcgtggtgacccagaccgggcgcgcggcggggctggtggccaagtaccgccccgccatgcccatcatgacgctggtggtgccctacctgaagcgcgaggggctgcgctggcggctggagggccggtcctcggcgcgccaggcgctgctcacctcggggctcatgcccgtgctggccgcgcccacgcccagcgcgggcgagtcgctgctggaggaggcggtggtgctggcggtgcgccagggcatgctggcgccggaggaccacgtcgtcactgtgtcgcgcacgggggtgggcgagtacatgatcaagatcgtgtcggtgaacgaattcgggtccggcatcaagcacatccggcccaagagcctgctcaccatcctgcgcggccagggccagaacgtgccggacgaggaggagggggaggagggggagcagcgcgagtcgggtgagggtgtggccatcggcgccgcgcccgcgccggggccccagtaccgtcccgagctcagcaggtgggcgggctggtgtggaagggggagtgggacagggtag

SEQ ID NO: 3655 - DNA, 789 bp, Chlorella protothecoides
  modified_base (748)..(757): a, c, t, g, unknown or other
atgtcacagatggcggagctggagacccagctgttccgaggtgaggaggacgtggcagccgagctgctcagcaccggcgacccccagcagctgcccgtgttccaggaccgtgagcccacggaggaggcccgggcgcccgcctggcacgacccccaggacgccagcctgcgtgtgaacgtggccgacgtctcccgcgcccgcaagctccgccagcggaacggggagaaggtcttggacggcgcggcatactccgagcgcctgcgcgcccagcacgccaagctgaacccgcgcgtcgggtgggccaggcgcggcgcgcgcgcggaggcggggcccgactccgagaccgcggccctgctgcagcggtcgggcgggttgctggtcaagggcagggcgctgcccgcgggccagctggaggccagccgcatgcgcgacgcaaacgccgccgacccagcccagggggtactgcgcgcgctgcagtaccaccccaacggccagctgctgctcaccgcctcgctggacaagcgcctgcgcttcttcgccgtggacggcgacgcctgccccctggtccagagcctgttcctggaggacctgccggtgcacgccgcggccttcgccgccggcggcaggaaggtgctggccacggggcggcgcaagtacttttacgtggcggacctggagagcgcgactatggagcgcatcccacgtctgtttgggacccaggaccggagcctggagggttttgtggccnnnnnnnnnntgtccctttgcgcgggccgcggcaaccgatga

SEQ ID NO: 3656 - DNA, 1101 bp, Chlorella protothecoides
atgccaggcagtccgctcccacgtgcagcatgctccacctaccctggcctcctcatccgctgtgatacgggggcgcttatcgccgggcatggctgcagacgctttcggtggaccgactatatgtttgcacaccgggaacagtggaagactgacgctgcggactggccggcgacacctcagttcacggctagcattctattcacaacatggcgcccatcataccgcttcttcttgaagcatgttcgaaacccttctggtttcggaaagggtcatggtgtcgacaaaagattccaaactggagtcaacgagtcgcacattcgttttgatcgggaagtagacaccgatggaatatttgtacgtgcaaggtccgtgccactgaaatctgtagagctggaaattctgcctgagggccgtcagttatcagcactgctcggctggtcgttacaagaccgatgcggggaggtgaggattcgtgatcgtgccccgagaagatgtggtgggattgcatggtgtgggtgttctcaaggccgtgatgctcgcattgctcgatttaaacccaaagcacggtgtcctcatcatgtgcaagccccattccatctactcagactggatggaaagctgaatgtccatctcgtctgccacacccatgatgacgctgggtggctgaagaccgtggaccagtactattggggacgtttggcagcaacttgtggatactctgtgtgtgctgagccccagactgtggagcactcaagaacgtactcctccttccttctctcaggatgccggggtgcagtacattctggatgccgtggtggcggcccttgctgccaacaaggaccgcaaattcacctatgccgagatgtctttcttccagcgctggtgggatcagcaggaggaggacatgcgggacctggtccaccacctggtggcctcgggccagctgtcctttgcgaacggcggctacgtacagcacgacgaggcggccagccactatgtggccatgatcgaccagaccacaaggggccacaggtgtctctgctgctgtggagggcttgggcatgtggggcagaggctctggacctggagcattgcaaatga

SEQ ID NO: 3657 - DNA, 741 bp, Chlorella protothecoides
  modified_base (464)..(473): a, c, t, g, unknown or other
atggcccatcacctcaatgcattaaaaccatacaacttcctccttacttcctcagatggcttccaggtgatgaatgactggaaccgggtgatgtccacgatcttcaatggagcctccaacatcgctcaggcggggggcctggcagccctgtctgacaagggctgggccgaggtccaggatctggtggccttttacaaggagaatgcttccatcctcaagtgggtggtgtggatgattgatcttggatgtggcaggccggtatggtgggggcgcacagacgatggcgtgagggattgggtgaagatttcaagcccagggtgtatccacatggaaatggaccttggcttcacggtgtatggaggcagcgatgcgccctacatctggatcgagtttccaggtgtggagcgtgaggcttgtgttccatgcaatgcactcttgctctctcgtccctgcttgcgtgtagnnnnnnnnnncgccgtgtttaccgctttatgcgagtctgacttggtgaaccccatcgattctgtcccccttaccccagcccccacacctcctgccttgccaggccgcaagtcctgggatgtgtttggcgagatcctggagcgctgcaacatcgtcaccacccccggctcgggctttggcgcggcgggcgagggcttcgtgcgggtgagcgcctttggccaccgggaggacatcgaggaggcggtgtcccggttcaagaccgcctacaagtctgcttga

SEQ ID NO: 3658 - DNA, 621 bp, Chlorella protothecoides
atgctgcaccgccgcctgctggcggacgacggccgcggcgtggcagaggccctgaacgagacggcgtgcggcgacgcgaaccgcgaggcgccccacgcctgcggcgggctggtgccccacgcctgcggcgggctggtggcacgcggcgtgcatcgggtgctggtccagcgagagggaagcggggaggggcccgcccatgccgccgcggtgcgccgcaccgcccaggccctggtcaacgacccgcccttggtcatggtcggacccgtgcagctctttgagccgccgccggcagcgccgcctgcacccacactgctcgcgctgtccctgtcgggtggcgccaccctgccccctgacgtccagctgctgactttggctgagctggcagggcgtggcatcgtcagggtggcgcacctccacgaggcgggggagggcggggacgccgcgaccccggcgacctttgaccttgcgcctttgctgaggagcatcaagttctccgaggcgagggtctggtttgaaacggatggggggcatgtgtgcgctttgccatcggcagcgggcgaggagagtccggttcgtacatttgagctgcgcctcgacagccgttcagccgcagcagcgtga

SEQ ID NO: 3659 - DNA, 795 bp, Chlorella protothecoides
atgtgcagccgtgagttcggtcaccgcgtgaagggcatctctgtttcccgattcacccctgaggaggcagcagcgttggaggagggcggcaatggggtgaggcggcgggagttcagggtccagcgcaggactatggagtggtggggcgcccctgctgccagggccttacgatgcccacctctttccgatgcacaggcctttgctgccgagtacctggccacctggcaggcttctaccctgcccaaacccaccaaccgggtcccggccaagatcaaggagtggatccaggtggtgttccaggagcagcgattcaggggccccccaaagaaggcctcctcgccgcagcagcgtgcaccctccctgggtcaggaggctaagccagcccttttcaagaccccgtcggctggccggtcccctgcccccctgtctacctcaaatggcaacgtaaacggcatgcttgccagtgctcgctacaagcccagggccccaggcgcgagagggctgatcgggatgggcaacggtgctctgcttcagctcgtgctccaacagtgtcccccttccctgccctccctccagggccacgccgccgccgcttcgccagactcggcggaccgcagcaacggcgacgcctcccacgtcatcgagcgacgcctctcggatgtgctgggcctgagcatgccgaagctgagcgtgagcgaggtccactcccccgcagcctccccagccccagccactgcaaggtcagacggtgccggctcatctcgctggtggcccggggggagctgcacgaggtga

SEQ ID NO: 3660 - DNA, 1077 bp, Chlorella protothecoides
atgctgacggtttggtatctgacagtagctgcgcgacttggtgccacacaaaccactggctccaccatacatggacatcacacccccacccgccctcccccaggtgaggtgaccacccgcgtcgagcgcaacaagaactttgccaagctgcaggccgggtacctcttccccgaggtggctcggcggcgcagggagcaccaggcagccaaccccgacgccaagctcctctccctgggcatcggcgacaccactgaacccattccccccacgatcgtgaacgccatgcgcgacgccgctatcggccttggaactcgggagggctactccgggtatggctcggagcagggtcagagcaagctccgcgaggccatcaccgagcgcctgtatgcccatgtgggcaggaagcccaacgagatcttcgtttcggatggttccaagtgtgacatcgggcgcctccagctcatgtttggcgctgatgtcagcattgcaacccagtgcagcaccccttctgcgctgaggcgactgacccccggtgaccctccaatctcccaggaccccgcataccccgtgtacgtggactcgtcggtcatcatggggatgactggtgggcacaatggagaggactttgacggcatcacctacatggtctgccggccagagacccagttcttcccggacctgtccaaggtaatgcctgtgcaacccaccctgcattcatttgagcacggagctcgccctcacccaaccgcgcctccgtcctccaccctgtcccaggccgagcgcacagacatcatcttcttctgctcgcccaacaaccccacgggagctgccgctacccgctcccagctgacggagctggtagcctttgccaagaagaatggcagcatcatcgtcttcgacgccgcctacgccctcttcatctccgaccccgactgcccccgcaccatctatgagatcccgggggcggaggaggtggcgctggagacgtgctccttctccaagtatgccggcttcacgggggtcaggctcggatggacggtggttccggagcagctgcgatacgctggtgagcattga

SEQ ID NO: 3661 - DNA, 603 bp, Chlorella protothecoides
atggacaagctcatccactatgtgaatgcggatggtagggtgaatgtgctctactccacccccgaggcatatgtcgacgccaagcatgggtacaaccacacctggtctgtcaagcgtgacgatttcttcccctactcggactcttcgcatgcatactggacaggtgtcgcagttcatctcttccttggcaaagtagctcctgcgctgtggctggcatgcctacaagcgagcccacttctctccctcacccctccaggctacttctccagccgccccacgagcaagcgctacatccgccaggccacctccttcctgcaagctgctcggcagctggagctgactgtcggcggcaagtccagcggcggcccgaccacagatggcctggaggccgccgtgtccctcacccagcaccacgattccatcaccggcaccgagaagcagcatgttgccaacgactaccatgagcgactgagtgcaggtctggcggttggtggtgtgggtgtcgtcaagtggctccgtgagcccgtagcatcatgtgagcacttggactgccagcccgtccatccttgcatgggatcagcgtgcattcttggtgtctcttga

SEQ ID NO: 3662 - DNA, 570 bp, Chlorella protothecoides
atgctgcgcttctgcaactacgccaacgccacgatctgcgagcccagcgtgcgcctgagcagggaggggaggagcatccgcgtcgtcgtgtacaaccccgtggcctggacagtgagagctcccctgagggtggctgtgtcgacacacacctcctgcgagtggatcgtgcaaggccccaacaacgaaaccctgccctcccatacggtgtccgtggatgcgaccactcgcaggctgcagcacctgctccacgagacgaatgcgagctctgaggcggcaggggacgcggaggtggcctgggtcgcagacctgcagcccctcggcctggcaaccttcaccatgctgccggcaagtgttgggcgtgctgaaagggacgtggtctcgggtgcagggcctaggaggcggcgcgacgaggtcctcgacaacggcatcctgcgcctcggcatcggcatcgatggcgcggagcccatccagctgaccacctccctggcctggtacaactccagtgatgggttggatgtcccggagggtaaggacaggggccaggccgggggcgcctacatcttcaggtaa

SEQ ID NO: 3663 - DNA, 1314 bp, Chlorella protothecoides
  modified_base (22)..(31): a, c, t, g, unknown or other
atgatcacttgttacaccttgnnnnnnnnnngcatactgcttatgcgattggactcggtggagagtccgaaaacgatcacttatcacaccttaacttttgcatgcaaaggtatatcttgtcgtgaccaggcaacagacaaacacttgtacatgcctcatgcaatccaagccaaagctaaacaagaaggtatatcaacagttgttatcgaccatatactcatggagaccattgatattcagctggctgtggtgctctgggatgccctgggtagctatgtattgctcgagttggagcatccccgatttcctccaatccccagcacggtccgcaggggggcctccgtcccaaatggacccaggcaccccacgaatcccttcatcagctgcggaccagtcccaacgactctagtgccaacgcttgtttctgggccgatcaaggtctcgttacattctgagatggccgggtccgcccagccatcagcggtgggcgatgcggcacttccccagctgggcgaggcccagcaaggggaagtttccgtgcctgtaaggctaccagcgcttgcagacctgccgaggcagtactcagcctgcgtgctggccgcgggggcgactggggagcggggagcggaatacaaagcggtaggtagtggtgtcacaagagcgcgagggcatgacctgtggtgcaccagggttgttcgcccatcgcatgcaccggcgtccctcgctttcccgggggagaccatgacgggctcccgtccacctgaaccccacgacccgcagacgcagcgcaagctcctcatcgccctggtcatcgccttcctgttcatgatcgtggaggtggtgggcggcatctacgcccactccctggccatcatcaccgacgcggcacacctgttgtcagacgtgtctggcttcggcgtctctgcgctggcggccgtctgggcggcccgcatgagccacagccacttttcctatgggtgcgaggacgtgggcttgagctggtgtcgtcacaaggggcggcggggtcggtgtgcggatggcaccaccgtcctgcaccctggctggtgggcggttgctggtcttgcacacgcccttgcgacccccagggaagcccatgctgccggcccctgcccgcgctcactgggccccaacctcctggcacctgcaggtaccaccgcgtggaggtgctgggcgccctggcctccatcctcaccgtctggctggtcaccggcatcctgctggtggaggccgtccagcgcatcctcgtcccagagcccgtcaacggcaaaggtaatcgactcggggatgaggtga

SEQ ID NO: 3664 - DNA, 786 bp, Chlorella protothecoides
  modified_base (489)..(498): a, c, t, g, unknown or other
  modified_base (744)..(753): a, c, t, g, unknown or other
aacgcaggcgcgccgctgccgggcgccgcgaccctcgaccccggcctgggcctgacccaggaggcgctggacgcggcggtggccgctgtcggcgccgcgctgggcgcggggaccaacgccatctccgccctgcgcatcctcaagctctacatggagcgcctgggcgtggacctgggcgcaggcggcgaggacgcggccgccgccgtcggcggccgcgcgctggccgatgcgcacgctgcgctagagagcgggcatctgctggaggtcacgccctccctgggcgccgccgcgctgctcatccacgcgcgtcgtgaggccggtgagattctttgggggggtagatggcggggcggcgtgtggaagaaacggagggtgggaggcggaagactgcagtggtgcgccgcaggaactctctgtacccccgtcctctctgtacaacttgccaaaggcagcaggaaagtgcatgcaatctgcccgcaatcctcagannnnnnnnnncgtgaggccggtgagattctttgggggggtggatggcggagcggcgtgtgggagaagcggagggtgggagggggaagactgcagtggtgctccgcagggactctctgtaccccagtcctctatcctggtgggcctgacggggctcacgctggaggaccccgggctgcagaacgcgctgggcgcgctgcacgggccccgctgagcagggagcacggcggcggcaacccacacctcctcaatcgcctnnnnnnnnnnggccccgctgagcagggagcacggcggcggtaa

SEQ ID NO: 3665 - DNA, 396 bp, Chlorella protothecoides
atgatgggcgcggtcgtgcacgtcatcggcgacctggtgcagtccatcggcgtggcggtggcgggcctgctgatctggatccaccaggtgaggcccggtcagtccccatcgtccccacacgacccgcgccgaatcgacttggtgccacacccctcgttcccaccccactcgaccccgcaggacgaccctcgctgggcgctggcggaccccatctgcaccttcctcttcgccgccctggtgctgtggaccaccaagcgcgtgctgcgtgacatcgccgacgtgctgatggagcgtgtgccgcgggggctcaacatcgccgacatcgaggatgacatcaccgccgtgagtgcccgggggtgtggggtgtttgaccagggtgctgtgcggcgagagtga

SEQ ID NO: 3666 - DNA, 276 bp, Chlorella protothecoides
atggtcgtacttgcaatgcatagtatgccagacaagcaccttgcctctcttccacgcacgcacgcacagaaagtgtcttcgggcctgagcgatcgggtggtgttcgtcaagatagacaccgacaagtaccctgccctggcatcccagtaccgcatcgaggccctaccgacgctggtcctcttcaaggacggcaggcccatcgacaggatagagggcgtgctcaatgtgggccagctgcaggcccgcctgcagctggccctcggacccacaaagtga

SEQ ID NO: 3667 - DNA, 417 bp, Chlorella protothecoides
atgtacagtcgtgttggagggagggatggcggacaccctggccgaggtgggcgtggtggaggcggtcgcagaggcggtgggcgtggtggtcgactcccgcctgggagccgcccagtgacggaaggggatcgcatcagcattgccgagcagctgaaagagttccagcacagcgaggagacaggcaaagcagtgatcagggatcggctgtttgtctgctttaatgtggatgttgggatgcttcccaaagccaacaggtcgttcccccacgccacctcacccacggcagagtacaagttcccgccgggcctgtccaaccacgaccgggcggtggtgcatgcagagtgcaagaagtatggcttcaccagcaagtcctacgggtgcggaggggcagggtcggagggcctggcagcggcctga

SEQ ID NO: 3668 - DNA, 903 bp, Chlorella protothecoides
atggtcaaggaagggtacacgccccccttgtcccagacctcacccccacacacagaggggccctcggacagctggcgcaggcagtacgtctttgtggccgccacaatgcccgtggatggcaagtacgaggtgggcaccaagctgcgccgcgctttcccgcaggccgtgtggctcgcgggaaagcgcctgcaccagcagacccgggacctacagcacgactggcgtcgggcggagggcgagcaggagcgcgcccgtgtgctgcaggtggggccatgctgtgatctggctgcagggtttcgtagggtggggccagtccaccattgtttactgctttgtgaggatgatgtcagagtgcttgtgtctcaggatggcacttgcattcatattccatgctcaggagggccttccccccaagccttgcacctggaaggcaaccatacccttccccatccaacccccgcgtccactcgtgcactcgctcaggaggtcatcgccggggacaaaaccatgggccccggcacgaccacgctggtcttcgcacgcgacgtgtccagcgccgacgccacgctgagcgcgctgcggcggacctgcgcggcgcgcggcgcggcgctcctgcgctaccacaaggaggtgccgcaggcggagcgcgaggacctgctgcgcaccctggcggcgccggggtcgagcgcgcgcgagcccatcgtcctcgtctgcaccgacgctgcggcccgggggctggacctgcccagcgtcaaccacgtcgtgcaggccgactttgcggcatccgccgtgcacttcctgcatagggtagggttcgggagagtgggggggcgttcatgggcgaggacttgcgtgggatcaggccacagtgggagccaccctggtcagttccttgccgcttga

SEQ ID NO: 3669 - DNA, 279 bp, Chlorella protothecoides
atgagcgattgctgcagcccaatcccctccctgcgctcccaacctcccttctcgtcacagatcgagggcgtggctggggtgggcgacctgcacgtctggtcgttgaccccaggcatcccactgctctgcgcgcacgtggccacccagcctggcgccgagggggaggaggtgctgtcccgcgtcacggcatacgtgcggcggctgggcatccagcactccacgctgcagattgtggggccggaggaggctgacaagccgcatgtgcaccaccagcactga

SEQ ID NO: 3670 - DNA, 522 bp, Chlorella protothecoides
atgctgtcgctggacatcaagctgcgtgacggtagcacagtcacggtcggagagaacgatgtgcgtcatgcatgcgatcgccgatttgggcctggagaggggcttcccatcgatgcccgccaagccgccacgctgtgccttccccaccccacccttgctcagctggtgcaagggcagctgcagtacggtatccacccgtcgggcctgccttccctgcgtgactgggccacacgacatgtcgcagacctgcacggagcaccccgacccaccaccaccatcatcgtgggaggggccagccagggcctcagcgccctcttctccatgctcttcgaccccggcgacagcatggtggtcgaggagctgtcctacccccaggtctcggagtgcctggcagcgcccgatcgcatcaacctggtccccatcgccacgaacgatgggggaatgtgtccactggcattgaccaaggtgaggagcgcgatgcagcgaggactctggttccgtcctttgccaggacctgtgtga

SEQ ID NO: 3671 - DNA, 1047 bp, Chlorella protothecoides
atgatcagcgacggcagcatcccgcaggcggagggcgtggacctgaccggggtcaagggctttgccaccatcgacggcgtgtcgctggtgaacgtggagggcacgggcatggtgggcgtgcccggcacggcctcggccatctttgccaccatgcgcgacgcgggggtgaacgtgatcatgatctcccaggcctcctcggagcactccatctgcttcgcggtgaaggccgcggactcggcgcgcgcggtggccgccctgcgcgcccgcttccaggaggccatcgcggcggggcgcatctcctgcgtcgccgcgctggacgactgctgcgtgctggcggcggtgggcagcgccatggccagccgccgcggcgtggcagccaccatgtttgccgcgctggcccaggccaacatcaacgtgcgcgccatcgcgcagggctgcagcgagtacaacatcaccgccctgatcgacgcgcgcgagtcggtgcgcgcgctgcgcgccgtgcacggccgcttctacatgcaggcgctgaccatcgggctggggctcatcggccctggcctcatcggctccaccttcctccagcagatccaggaccaggcgaggaggttttttgggggggccgccaagctgcgcgacgagtaccacctggacatccgcgtgctggccatcgcctcctccaagcgcatgctgctgtccgacgacgccatcgacctggccgcctggcgcggcgagctggaggcgcggggcgagccgctggacgaggagcgcttcgccgcacacctgtccgacaacttcatccccaacgtggtggccctggactgcaccgccgccgaggggcccagcgagcgctacctggagtggatgcggcgcggcatccacatcatcacccccaacaagaagatgaacagcggcagcctggagcggtaccgcgcgctcaagcgccaccagcgctcctccttcatccactacctctacgagggcactgtgggggcgggtgggtgggtgtggggaggggacgggaggtggaggggggagagctggggctga

SEQ ID NO: 3672 - DNA, 714 bp, Chlorella protothecoides
atggggtcccaggctggactccgatcacgcctcctacggcgctcaaccccacaccgtcgacaccccctcctcccgcaggccgaggctactcaggtgggatccacctacgccaacgccctgatcgaggccgctcaggccgaaaactccctggaggatgtgcactccgatgtggatgccctggccgggctgctgagggagaacaagggaccatggatcctgctggcactcctttcccacgcggaaatcccctcacgccctcgccatgtcccacacctctgcctcatgcaggacatcgcggagttcctgtccaaccccaccatccgcgtggaggccaagaaggagctgctgaagcgggtggggggcgaggtcgggttcaaggactacaccctcaacttcctgaacctgattctggaccgtaacaggatggactcgctggacgacatcgtggaggcctttgagaccgagtactgcaagctcacagacacgcagttggccacggtgcgcagcgcggtgaagctggagcaggagcagcagttcctgatcgccaagaagctgcaggagctgacggggagcaagaacatcaagctgaagcccgtggtcgacgagtctctgatcggagggtttatcgtggagtacggctcctcccagatggaccattcaggtggggggaggaagggaaggagtggcatgcatctgccagctggccccctttga

SEQ ID NO: 3673 - DNA, 1740 bp, Chlorella protothecoides
  modified_base (124)..(133): a, c, t, g, unknown or other
  modified_base (1056)..(1065): a, c, t, g, unknown or other
  modified_base (1363)..(1372): a, c, t, g, unknown or other
  modified_base (1591)..(1600): a, c, t, g, unknown or other
atgtgtgtgtccgaggtgtttggtaatggctgctactgtcgccacactgtggtacttaccgccactatcacattccgcaactgcctcttctgtttccagataccccttacaagcacatcccccnnnnnnnnnnggtgtccgaggtctttggtagtggctgctactgtcgccacactgtggtactcaccgccactatcacgttccgcagctgcctcttctgattccagataccccttacaagcacatcccccatgcttaccacgccaccaccaggcctttgccggcatcgtcactgtctcggtgggacactgccaccccgaggttaacaaggcggtgatcgagcagacggagcgcctgcagcacaccaccgtgatctacctgaacaaccagatcgccgagtatgccaaggagctgaccgaccgcatgccaggcaacctgaaggcgcgcaggggaggaaagggagggagtgacctgggacggtttctggtatataagaggtggtcagggcagggagcactgtggctcccatgcacattcagagtgcctggccttgcctctgccttgcccagcccagcccctgggtgtgtgacagcacccaccaccctcacccccacctccctctcattctcaaaccaccccgccgctcaggtggcctactttgtgaactcggggtcagaggcaaatgacatggccatcatgatggcccggctgtacaccgggcagtacgacatgatcgcgctgcgcaatgggtaccacggcctgacgggagccaccatgggactcatggggctccacacctggaaggccaacatcccgcacgtgaggcctgggggacgggtgggtgggcgccctcagagtggcttcgcattggcttcgcgtgaggtgcccagggcctgcagggatgaggggagcatgccctgcaagttttgggaagcttgtggctgtgtcgacccatcccgtcggtgcggctgggcatcaccccatcctgcctcggcgtggttctcggctgatcgccagagcggcatgcctgacacaatgtcccctccacctgcaggnnnnnnnnnnccgcgttggtgtggctgggcatcgccccatcctgcctcggcgaggctctcggctgatcgccggagcggccggcctgacacaatgtcccctccacctgcagggattcggcgtgcaccatgcactgaaccccgacccctaccggccggcaggggcggggatgaggaattgaacctgtacgctgcttgcaagtatgtgaccggggtccagcatactccgaggccaacccttggccccttttttccccctcgtacagatgtgacggacatcatccagagctcgaccccgggtcgcgtggccnnnnnnnnnnagccaagccttggtcccttcttttcccctcgtacagatgtgacggacattatccagagctcgaccccgggtcgcgtggccgggttcatctccgagaccatccagggggttggtggcgctgtgccgctggctgacgggtacctccccgagggaacggaggctgctgctgcgatgtggtgtctcattggtgctatgaaatcggtgctgagccagcatcctnnnnnnnnnntacctccccgaggtctacaagggaacggaggctgccgctgcgatgtggcgtctcattggggctatgaaatcggtgctgagccagcatcctcggccgttgcagctccacgaggctgcccaccgcgtcccgtttccatctga

SEQ ID NO: 3674 - DNA, 537 bp, Chlorella protothecoides
atgtccatcttcccatcctatcatccccagaccgttcgcgaggccggcggcatctgcatcgccgatgaagtccagaccggctttgggcgaaccggctccaactactggggccgcatgtcacctgccttcatctggactgctgcatggctctgcagacagttgcccctcccagcccccatggaaattagcagtttgagctcagcagcccaagtcctggccaagcagcccctcacccgctgtcccgcgccgtccatccaccctgcagggtttccagaacgctggggtgacccccgacatcgtgactatggccaagggcatcggcaacgggctgccgctgggcgcggtagtcacgactccggagatcgccgccaccctggcccagcgcctgcacttcaacacctacggcggcaaccccgtctgctccgctggcggccgcgcggtgctgcgtgtgatcgaccaggagggcatccaggccaaggccgccgacgtgggaggccacctgctgaagggcctgcgtggcctggccgccaagcatga

SEQ ID NO: 3675 - DNA, 231 bp, Chlorella protothecoides
atggcaacaaaatttccaaaatttagtcaagccttagcacaagatccaactacacgtaggctttggtatggtttagccacagctcatgatttcgaaagtcatgatgcttggcaaggaaatttcgagcagtgggttcaagatcctcttcatatccgaccaatagctcatgcaatctgggatccacattttgggcagccggccgtggaagcttttacacgtggcggtgcttca

SEQ ID NO: 3676 - DNA, 1623 bp, Chlorella protothecoides
  modified_base (973)..(982): a, c, t, g, unknown or other
  modified_base (1566)..(1575): a, c, t, g, unknown or other
atgaacaacaaccccaaccccaagatgaaaaacccaaccaacacccctcccaggtacgtggtgggcgactcccgcttccagcgctactgcaagtccaatccgcgcaagatggtcaagatgtgggcggagaaggagctgcgcaacctggcgcgcctgcacgccgccggtgtgcgggcgccgcagcccctgcagctgcgcatgcacgtcctagccatgcagttcctgggctcgggcggcgtggcggcgccgcgcctgcgagacgcggggctgcccccggcgcgcatgcgccaggcgtacggcgagatggtgctgctcatccgcaccatgtaccagaagtgccggctggtgcacgccgacctctccgagtacaacgtgctggtgcaccagaacgagctctggatcatcgacgtcagccagagcgtggagccggaccacccccgcgcctttgacttcctgcgagaaggtgtgggtgttctgtgggcttgtctgggggatggagaggataggggggggtgggaaaaggaaggcaggggctgtagcgctgcgagccccagcgtccaagccacaccttcccccgcggtcgcctcagacagcgcccagctgttcccccccttcccacccacccccccctcacctcttgcagactgtctgcatgtgaacgactactttcgacgccagggtgtggccacgctgacggtgaaggagctgtttgactttgccgtggaccccgcagtgaccgacgacaacctggacgataccatggacgccctgatgcagctggctgccgggatggggggtcccggagccactcgccgtcagcagcatgtgctcagcctgcttccatgggtgcatcctgtccttctacttgtgtcacatcacaacgaatatcaacgggtgcttgtggcgggaaagaagcgaggcaggtcagtgctgcatccgcactcccctgtctgcttcctccctccaccctatnnnnnnnnnngtttcacgtgcatccacccacctgggcgccattcaattccctgcaaaacacacccatcacacccactccctcatccgaaactgccccacccccgcagccggccgatcgacacgagctccgcgccagacagctcagtggcggacgcggtgtgggcccaggccttcatcccaaagaagctggacgaggtggccaaccacgagcgcgaccacgcgcgcctgcaggccggcgaacccgtggagggcatctactaccaggccctggccgggatgaaggctgacatgagcggcgcgcgcacgctgccgctcgcgctggagatcgcggaggagaaggtggtggaaaggcatggcgctgcgtccggcagcgaggccgggagcagcagcagcagcagcagcggcagtggcgacagcagcggcagcgatgccgagagcggagacgaggccggcgccggggcggggtggacggacggcaagccggcgcagtccaaggaggagatccgggcggcacggcgggagcacaagaaggcggtgaaggagagcaaccaggagcggcggaagaagaagctgcccaagaaggagaaggcgcgnnnnnnnnnnggagctcgtgtcgatcggccggctgcggggtggggcagttttggatga

SEQ ID NO: 3677 - DNA, 216 bp, Chlorella protothecoides
atggtgctgttcaagatgctcaaccgcggcgtgtttgcggagatcaacggcgtggtgtccacgggcaaggaggctaacgtgtaccacgccaccaaccccgcgggcgaggagctggccatcaaggtgtacaagacctcgattttggtgttcaaggaccgcgacaggtggggggaagggctttggaaggacaggaagggggatggccaggtgggttga

SEQ ID NO: 3678 - DNA, 543 bp, Chlorella protothecoides
atggtctcggagtccctgctgcgcgcgctgggcgccgccccggccatcaacatgtttggcatgctgcgcctgctgtcggacgtgggcggccttcgggccgtcgtggaacgggcgggggccgaccccgagcccctggccccggtgtgcctcttcgccgaggccctggtgtttgggcggctggggccccagggcgtgcccggcatccaagccccacgcctgctgcagctgctggagaggtaccgcgaggtgccacgcagctccggcctcgccggccagcacagcacgcccagcgcgggcaagggcagccccgagggaaggtggagggagggcctgtgtgtgcatgcgggacagctccctggccggcggcaggagccctggtccgactgccagatgctgcgcccccctcctgagtttccatgcatgtgttccccacgacattgcctggaccccgccgcgcacatccccctgcagcgattcctgagcaagaagtctgtggaggacgtgatgaaggcactgaggagcccgaccaagcgtgccaagtag

SEQ ID NO: 3679 - DNA, 483 bp, Chlorella protothecoides
  modified_base (252)..(282): a, c, t, g, unknown or other
cgctggggcgcgccggtcctggcggcggccgccgacccggccgctcacgcgccgctgctgggcgcgctgggcgccgcgctgcgctacctgcgcgaggcgctggtggaggaccaggtgctggcgctggctgaggtcgaggcgctggacgtcgtcgtcggcagcgggtcgggggagaccgggcctggtgtggactcagcaccgaatggcgacgcatgcacgcaaggccccggcccggcgcacaccagccacctnnnnnnnnnnnnnnnnnnnnnnnnnnnnnnncaaggcccccgcccggcgcacaccagccaccttgccatggatgcggcggcgctggagaacctggaggtgctggagggcggcgagggcggcgccggcactcacgccggcgccggcctggccggctcgctgctggcggccgtggaccactgcgtgacgcccggcgggcgcggcgcgctgcgcgcctggctcgcgcgcccgctg

SEQ ID NO: 3680 - DNA, 1299 bp, Chlorella protothecoides
atggccagagcggtggaggcaccacagcctcctggtgcccagacagaggctcttggttctgctgctggtggcacctcacctgatgccaatggcccaggagccagggctggtgcaggtcctgcttcactgtcccctgaggtgtcagccttggggtcgccgccgcccagcccgaaccccaagacggagaggaggaggagcggcggtgagcaggcgccatcggcctcggatgccacccccgacaaaggtgtcccaccaccggagcagcatgcccgacgaggccctgtcccccccgccccccgcttcctgcatgtcctggaccggagcggccgcatcctctccagcgacgagctggacgtgggccccggcgccacgctggcagtgttctacacggaaagcgcgcacagggccagtgaggccgtggagaagggcaccggcttggcgccgacgctcgtcctggaggcgctgccgaagggcggcgacagcagagtcgcaggcgcgggggcggccgacgcggggactgcatccagcgaaccttccagcgacgcgagtgcccttcctggagcgcctgacgaaaacgcatcgcatgacagtccgtcggacaggggcagctcccatcctgccgcgtcagccaatgccagccctgctgccaccacggtggacacggccagccccgtccatgcgctacccaccccacatccagccccgcctgccacccccccaccggctctgtcgcagccgtacaagtggtggcgggacggggacgagccgctgtactttctaacttccggctcgggcaccgtggtggggcgcccacgcgacggcaacgaccgcgtggcctggatgatggagcgggggcgcatcgcggaggccctggccgtggcggagtcggatgcgacagtcacacgccccgtgcgcgaggcggtgggcgagcagtacctgcagtacctcgtagaccgcgatgaatgggcggccaccgccgccgccgcgccccgcctcctgcagggtgggacctggaagatctatacgcctggcagcagtggtgtcgccaacctttcgctcgacagcaggtcgggccctggcgtgggagcggtgggtgcacgtcttcgcgggtgcgcgggagctgcggcgcctggcgccccacctccccgtctcggagccgcagctgcgcacccgtacctacgacatggtactgcaggccctgctggtgtctcccaacggtgtgtgaaggaggctggatggtcgtccgagtactcagatgattgcaaggatcccaagtggtggggggaatgtgatgaatga

SEQ ID NO: 3681 - DNA, 525 bp, Chlorella protothecoides
atgcaccagatcactcccgcagcgcggctctgcttgttataccctgtgcgaataccctccagccgtgtgttccgctgtgcgacggtgcaccgcaagcatgcctttgtgagaaggctgcgcgctgggtatgctcgagccgaggcctcgccgggcccaaaccaaacgccggcgagcgaagacctcaatctcctgcacacggagctccacgccgctgtggcttcccaggatttctcgagggccagtcagctgcgcgatcggatagccgcgaccacaggaacccctcctcctggctcctgggaggagctggggctacccccctggctcgcagaccgcgcccggcagctggggttcaccctcccaaccaccacccaggcccgcgccattcctgctctgctgtccggcaccgacgcctgcgtcaccgcccagacagggtccggcaagaccctggccttcgtgctccccgcgttggcggcactggatgcgtctccagctctgtaccccgaggacctcgaggcgagtttatga

SEQ ID NO: 3682 - DNA, 873 bp, Chlorella protothecoides
atgggggttggggtcgctgctggggcgtccacggggggcgggggtggcatcgcttcccacttccctccgcgaatgcagcccacatgcgagctctgctgcacaccactccccacaccccctccctgccgaccatcctaccccaatccaaccacactcacccatcgctctgctgcccctccaggcgacatcatggccagcgtgcaggccgcgcgcgccgcgcgggtgcaggtgtcggtggtcggcctctccgccgaggtgtacgtctgccgggagatgacgcgggtgacgggggggaggtacggcgtggccctgggggagagccacctgtccgacctggtactggagcatgcggtgccgccccccatggcgccggggtcgagcaactacagcctggtgaggatggggtttcccaggagggagccccaggccccgggcgccgccgtcttcacaggtggggcttcgatagatggaaggtggcaggcaggggaggggaagggggcccacaggtgcgacgggatgaagcatgagtgcagtgtggctttttgtattcttggtgttattgaggcaaggggaagatgcaaacctgtggtaaggaaatcctgccatcatggagcgcacaggagagcctgcactgtctctagagacagggacgggatgtcagctcgcactgtaattcaattgccatcccgcaggtccggaggctgtgctcctgtccggtgggtacacatgtccacaatgcgcggcgcgtgtggcggagctgccctcccaatgccacgtgtgtggactgacactggtgtccgcaccgcatctctcgcggtcctaccatcacctcttcccagctcccgtttttgtggagactggggccgaagatga

SEQ ID NO: 3683 - DNA, 303 bp, Chlorella protothecoides
atggcgcaggcggtcgatagcagcgacgagccccgcctcaagtactccgccttgtccccagacgcctcaatccctggaactgcactgctcctggctgtctcggataaggtcttggcgctcgggaccagtactggagctgtccttgtcctggactacaatggcaaccaggccttcaaggagcatcatgccgctgtaacagacctgtcatttgatgccgaggcagagtacctggcctcctgctcggctgacggctgggtcgtggtatgcctggtgcatgggtggtgtgcctgcatgcccacctaa

SEQ ID NO: 3684 - DNA, 318 bp, Chlorella protothecoides
atgcctaacctcaactcccttcgcctccacggtctccctccacagggctggctggggagcagcgagacccccctgttcagggggcggggtgccgtccaggtggctcgcatggccggcaccctcctcgcctgggtcacggccacaggcctccgggtctacgacaccgccacacacacgcggctggccaagatcccggccccgaagacgcccgcgggcgaggccgcggccccagcctccctcctctggttgggcatccgggagctctatgtgggctggggccgcacggtcctggtgaggtggggtggaaagggcggatag

SEQ ID NO: 3685 - DNA, 939 bp, Chlorella protothecoides
  modified_base (621)..(630): a, c, t, g, unknown or other
atgcgcccgctgcacgtggtccagcccgagggcccctccttcacggtcaaggggtctgccgtggagtggcagaactggagcttccaggtgggcttctcctggcgcgagggcctggtcctgcacggactggggtacaaggacggcggtcgcgtgcgccccgtcgtgtaccgcgccgcgctggcggagatcatcgtgccttacgcggagccgcggccgccgtacgagaccaagtgcgcgtacgacatcatggactacggcctgggcttctgcgccaactccctggagctgggctgcgactgcctgggccacatccactactttgacgcgtcgctgaacgacgcgctggggcgcgcggtcacgctgcgcaaggcggtgtgcatgcacgaggaggacgcgggcatggcctggaagcactacgactaccgcaccgacgaggtggaggtgcggcgcatgcgccgcctggtcctctccttcatcgccaccatcgccaactacgagtacggcttctactggcacctgtaccaggacggcagcatccagttcgaggtgaagctgacgggcatcgtgtccacctcccccctgcatgccgaggaggtcctgcgcggtcccgactacggcacnnnnnnnnnngacgggcatcgtgtccacctcccccctgcacgccgaggaggttctgcgcggtcccgactacggcaacctggtggcccccggggtcaacgccgcgcaccatcagcacttcttcatcacccgcctcgacatggccgtggacgacgaggacggcgggcgggggctgagcgtggtggagatggaggcggtgcccatggggccgggggacgggcccaaccccttcaagcacggcttcaaggccgtggagcgcgtcctggagacggagctggccgcgcagcgcgactgcgacgccgcccgctcccgcgcctggaa

SEQ ID NO: 3686 - DNA, 2388 bp, Chlorella protothecoides
  modified_base (935)..(944): a, c, t, g, unknown or other
atgtccccgaaggccgggagcggggatgcacggcacgcacacagtccgtcagactgcgcagcagcatcgcgcgggacgcgccacctgccctgcccgacgacggtgtggtgggtggcccctgtggcccacaggtcatacggtgcctcccacgcccgcgcctggcacgcccatgtgggggagggcgccgatttgggaggacctcgtggcgctttgcatgcgttcggaggtgcaggggtctgtgaaaggggtaacaacgacaggagtgcctgtggtcaggtctgtgagctccttgacaattctcctcttacccctcaacagcaacacccctctgccccctcagagtccgcccgggacgccgggcatggggaaggccgacgcgaactcctcgacctcggccgccagcgcggccaggtcagcacgctggccgcgctgcgcctccaggtgtgccacgaagtcgcgcagcttgccctcgcccggcgtggaggcggccaggtcgcgcgcgatgccgatggcggcgtggaacatgtcgcccacgcgctcaaaatcggcctcgcgcaggccgcgcgtggtcagtgcgggcgacccgatgcgcacgccgccggggatgaccgcggagcggtcgccgggcacgctgttcttgttcaacgtgatgtggacggcatccagcacgtgctgcgcgcgcgcgccgtcgatgcccgccggcttcaggtccaccaggagcaggtggttgtcggacacgaggtgtgtgtggggagggaagggtaccttcagtcagggtgtcgggccttccaccaccacctccaacctcggttcagacaagcaggcttgaactggaaaaccacctgctcacctggctgccagggcccgcgcgttggcgaccacctgctgctggtaggcgcggaactcggggctggcggcctgcttcagggccacgnnnnnnnnnnagatggtgtggttgtgcggcccgccctggatgcctgggaacacggcctggttgatggccgcctccagggccttgcggaagaagatgaggccgccgcgtgggccccgcaggctcttgtggctggtggtggtcaccacgtcggcgtggtggaagggcgaggcgaccacccccgcggccaccaggcccgagatgtgggccatgtcggccatgaggtaggcccccgacgcgtcggcgatgccgcgcatgcgggcgtagtcaaagtcgcgggagtaggccgaggcgccggcgatgatcaggcgcgggcggaagagggcggcgctgcgcgccagggcctcgtagtccaccagccccgtggcctcgtccaggcggtagggcatggactcgaagtagacgctggtggcgctgacgcggcgcttggccgtccagaagccgtgcgtcaggtggccgccgtggggcaggtcgaggcccatgatgcggtcgtggggcttgagcagggcggtgtacaccgcaaagttggcaggggagccggagtggggctgcacgttcacaccccactctgcggggtccaggccgaaggccgccagcgcgcgcgactggcacagcgactcggcctggtcgatgaactcgttgccgccgtagtagcgcgcgccgggcagaccctcgctgtacttgttggtcatgcaggagcccaccgccgccatgacggcgcgggaggtgaagttctcgctggcgatcagctccaggcccgtcacctggcgccgcttctcctggcggatgatggaggcgatctccgggtccacctcgtccagggatccgtcctcgaaaaacatggcgctggcgtccactgcagggcaagggagggggggtgtgccgatgctggggcatcgtgctattgcatggaaccatgcagcctgggccctggaccgaggacatgcatgcatgcacgacggagaaaaatgccgggttccctgcccgcacactgcacacgacagcagcaacccggaccaggattatgtgctcgggctgaacattattgggagcggaggaaatttgaaaccgcaccgctgcttcccccatccctcacgctcatagccgggcgcacccttgcgctccagggtggaggcgcggcatgccgtccggctgggagcctgagcgaccaggcgtgcctggtgaggccgggacgccaggcgctggatgccacgctgggccggcgcaccctgtgggcgagccgcgctggcgccgggttgggcgaaggcgacgccctgcattgttgccgggagctgggctcgggaggagggaggtgcgggcaggattgggaccgagggtcccggggatggactgtgagctggacgccgaatgctgaccttccgccctccaatccagtgccacgttcaagagcgcctgtcggattggttgggcagaagcgttctggcgcctggacttga

SEQ ID NO: 3687 - DNA, 945 bp, Chlorella protothecoides
gcgcgggagcgggcggcgtcgcagtcgcgctgcgcggccagctccgtctccaggacgcgctccacggccttgaagccgtgcttgaaggggttgggcccgtcccccggccccatgggcaccgcctccatctccaccacgctcagcccccgcccgccgtcctcgtcgtccacggccatgtcgaggcgggtgatgaagaagtgctgatggtgcgcggcgttgaccccgggggccaccaggttgccgtagtcgggaccgcgcagaacctcctcggcgacctcctcggcatgcaggggggaggtggacacgatgcccgtcagcttcacctcgaactggatgctgccgtcctggtacaggtgccagtagaagccgtactcgtagttggcgatggtggcgatgaaggagaggaccaggcggcgcatgcgccgcacctccacctcgtcggtgcggtagtcgtagtgcttccaggccatgcccgcgtcctcctcgtgcatgcacaccgccttgcgcagcgtgaccgcgcgccccagcgcgtcgttcagcgacgcgtcaaagtagtggatgtggcccaggcagtcgcagcccagctccagggagttggcgcagaagcccaggccgtagtccatgatgtcgtacgcgcacttggtctcgtacggcggccgcggctccgcgtaaggcacgatgatctccgccagcgcggcgcggtacacgacggggcgcacgcgaccgccgtccttgtaccccagtccgtgcaggaccaggccctcgcgccaggagaagcccacctggaagctccagttctgccactccacggcagaccccttgaccgtgaaggaggggccctcgggctggaccacgtgcagcgggcgcatgccgccgcggaagggacgggccagcacgtggcgggagaagaagggagcaaggcaggaagaggcggggaagttgggt

SEQ ID NO: 3688 - DNA, 996 bp, Chlorella protothecoides
atgtatggtgctcacatgtgtgacacagatgtcgtgcatttgacgctggacctggccaccacccgccggccggcactgaccctgccacccccacccgtgcagcacaagccgctgaggagcgccgcggtgctggaggcggtctatgaacccgacctggacctctgcggtcccgcagcagcagcactcaccgagggcggggacccagcacgccagccccgcatcctgctgcagaagtggcggggcggccccgccgcgcgctttctttaccacgagctgagagagctgcggggcttagtgggccagggggcggtgctggtgggcgtggtgcagcccagcggcagctggaaggccgggaagcgcgacgaatggtccctcaccgagcaggggcaccaggtgctggcgggcggtgaggagagcgtggcggagctgcgcatgcggggcgggctggtgcaggccacctacagcgcgcggggcagcctcaagtccaacgccatggcggcggcggcggccaaggccctcaagaccctggagggcctcctgcgaccatctgccactgccttcaacccctcccctcacacaggccgcagaggcaaagtgggaggatccgctgccggagggagtaagggggagccagggcccaggctccctgccctacctcgaggccctcaaggtagggtgcggctgcggcccgtgtgtgtgatggcgggagcctggacccctggatctggggaaaacgtgtggcagcctttcctgctgcgctcgtcagaacagggaccagccagccgattgcggtgggggcttgctgctggagcgcattggaagcaacatgtccgacccacctcaccaccaaaactgcaccaaacacagggcatccattgtccacgaagcgaggcagacatcgccgcagcgcgggagcgcctggccttccaggagctcttcatgctgcagctcaacctactcctccagaggtccctgctcaggtggaggaggttataa

SEQ ID NO: 3689 - DNA, 1404 bp, Chlorella protothecoides
atggtgcgtcggctagccctaccccaagggttgccttccggaccatccgggtccccgacaccttcgatcacactgaccctggcaaccctccgtctcggtcctgcgctgacccttcctcagcccagtgattccagccggaaacatctcgcggcctccctgcagtgctatctgcagtcctggccgcccaacccttccatccctcgccctcaccccttccttcccctcctgcagtccgacccacaggcagcattccagcgctgggcccgtttctacggcaagacctactccccggcggaggagagccagcgtctggaggccttcatggccaatgccgcgcgcgtggcggcccaccaggcccagaacgccggcgcctcctacaccctgggcctgaacggccacgcagatctgaccaccgaggagttccgcctgcgctactttggcgagcagcccagggacatgctggccctgcgcgcggccgcaacggccgccgacaacggcaagaagtccaagtacttccgcgactggccgtacgggcacaccgtcccccccgcggccgtggactggacggcggagggcatgatcaccccggtcaaggaccagcacgtgaacggctccaagtgcggctgctgcttcgccttctccggcgtggccggcatcgaggccgccaacgcgctctacaccggcggcgacctggtcacgctgtccgagcagcagatcgtggactgcgacgcctacgactggggctgcgacggcggctccttcgtggacgtcatgcgctacaccatcgacaacggcggcctggtccccgacgccgagtggccctacgcggccaaggagacggtgtgccaccgtcgccgcgagaggaagcgcgccgctgtgaccatcgactacatcgtcaacctgccggaggccaacgagacggcgctggagcaggcgctggcgcacacccccaccaacgtggccatgtgctgcggcgacttcatcgacgcatggcacctgtacaccggcggcatcttcaacgagagcgcgcactgcaccgagcccatcgaccacgcgctcctggcggtgggctacggcaccgagcccaacggcgacaagttcttcaagatcaaaaactcctggggcgcacactggggcgaggccgggtacatgaaggtgcgacgtggcatcgccgaccccaagggctccaacggcgtcgcccttatgcccggctacgcggtgaagacccgcgacaacccgaggcctgatgcggcgctcgtggtgagtcgagcgcggggcagtggggaattcttggtgatgttgggggtgggaggacagggaatgattttttccgcggggtccaagactggcgtggccaggagcacccgcgcatcccctcctggatgtaaattgagggaggattga

SEQ ID NO: 3690 - DNA, 933 bp, Chlorella protothecoides
atgcgggcagcatctgccctaagttgttacctcggcttgtcccccccacccctccctacccgataccctgagcagagcaaggtccagcagcacagggcgcagcaggcacagcaggactgcatcttcttcttgcagggctggtgcagcaaggggtccctctgcccctttcgccatgaccaggcatgccgaggtgttggtggtggtgtgtcggcagggccttaccccaccatgcattctgttgtgatggcacccaagtcccgcgccggccacgcctctcattcttcagcaaaggctgatgcgctgaaggcgctgaactcgtccactgcgcccagtctccagcaggtggcccgtgccccccctgcagcgccctcccccgcagcacccggccccacgctggcctctgcccccgccccaacgcggcagcaggtccgcctcgcccccgttccgccggcgccccagaggaccagccttgccgccggcctcatgggcggcaggacgtccccggtcccagcggcagccagtggcgacgcgcggcgcggcggcgctacctctgcgagcggcgcgtctgcgagcggcgccgccactgcgagcggcttagccgcgcccgccccgggtccgccccgggccccgcccacgctggcggggcggctgggcccccgccagggcgccagggaccaaggcgcctcgcccctccccccccgcctgcagcagcgcctgggcagggagaggagcgggtcggggcccgatgcgccgactggagctgccagctccctgtctgatagactgggatcgaaggtgcgaggtctatggggtggagtggggcggggacggtggtctgcaggagccatgggatggaggagcacactgtggcccggtcatgctgagcatggtcgcagtcccatctactgcagaggagcagcgatggcttggtga

SEQ ID NO: 3691 - DNA, 858 bp, Chlorella protothecoides
atgtttttcgaggacggatccctggacgaggtggacccggagatcgcctccatcatccgccaggagaagcggcgccaggtgacgggcctggagctgatcgccagcgagaacttcacctcccgcgccgtcatggcggcggtgggctcctgcatgaccaacaagtacagcgagggtctgcccggcgcgcgctactacggcggcaacgagttcatcgaccaggccgagtcgctgtgccagtcgcgcgcgctggcggccttcggcctggaccccgcagagtggggtgtgaacgtgcagccccactccggctcccctgccaactttgcggtgtacaccgccctgctcaagccccacgaccgcatcatgggcctcgacctgccccacggcggccacctgacgcacggcttctggacggccaagcgccgcgtcagcgccaccagcgtctacttcgagtccatgccctaccgcctggacgaggccacggggctggtggactacgaggccctggcgcgcagcgccgccctcttccgcccgcgcctgatcatcgccggcgcctcggcctactcccgcgactttgactacgcccgcatgcgcggcatcgccgacgcgtcgggggcctacctcatggccgacatggcccacatctcgggcctggtggccgcgggggtggtcgcctcgcccttccaccacgccgacgtggtgaccaccaccagccacaagagcctgcggggcccacgcggcggcctcatcttcttccgcaaggccctggaggcggccatcaaccaggccgccgccagccccgagttccgcgcctaccagcagcaggtggtcgccaacgcgcgggccctggcagccaggtga

SEQ ID NO: 3692 - DNA, 591 bp, Chlorella protothecoides
atgtccattcctcaagctccgaccttcgacaccaatgcggtgaagactcgcttccccggccgagagctgacccctggaaggaaccaccaccccctcgaccagcttaccgccgaggagattggcgccgctgctgcagcctgtagggagcgggccgcgagcctcgggcttcctgtcctccggttcaattccatctctgccaaggtgggtatggtgtgggtgtcgtaccccatgtcacatgccctggctaccgcgaccgggggacgagggtttcggaccgccaggccggcgcgaccctattcagccccacacgatcaccccatgactccacaggagccccacaagtacaaggtcttggcgtacctcaagggtggcgcaaagcccgcccgccaagcgctgtgtgtggtgcaggcccctccccgcaactccgtgttcgaagcgctcgtggatcttgatggcacccgcgccagcatcctgtcgtggcaggaggtgcgcgggcctgtggatgctctatacgaaatccactcgtcgttctcaccgttgggatgggccgtttcggggggaaggaaaccgcaaatgtccgtggccacgtga

SEQ ID NO: 3693 - DNA, 282 bp, Chlorella protothecoides
atgcagggcgtcgccttcgcccaacccggcgccagcgcggctcgcccacagggtgcgccggcccagcgtggcatccagcgcctggcgtcccggcctcaccaggcacgcctggtcgctcaggctcccagccggacggcatgccgcgcctccaccctggagcgcaagggtgcgcccggctatgagcgtgagggatgggggaagcagcgggcccaggctgcatggttccatgcaatagcacgatgccccagcatcggcacacctttctggaacatgcccgtctga

SEQ ID NO: 3694 - DNA, 521 bp, Chlorella protothecoides
atgggaccacactggtcactgggtttggctccctgtatggccagcccgtcggcatcgtcgccaacaacggtgaggaggcatttaaaggaggcggcgcgcagtgttggggaaggaatgagctggggcaaatcctccactgcctgtaccaatgcaaatggcattctggtcgccgctgtttttccgttcagcagtggcaagggctcgtcacaccagagtcaagccttcaccaggcacgcgcgatgcatgggctcccctcgccaaaacaccattccctcccctcgcccaggcatcctcttctcggagtcggcgctcaagggggcgcactttgtgcagctgtgcagtcagcgcggcattcccttgatcttcctccaggtgctgtttgggtgccggcccgtcgcactccaccacccccacgcccaggcacctcgaccttaccgcccagttgcatcaccctcccccccaaacctttcccatcctctcccacagaacatcaacggcttcatggtgggcaaaaaatatga

SEQ ID NO: 3695 - DNA, 276 bp, Chlorella protothecoides
atggggggtgagcaggcagccgccgtgctgcacctcctggaaagcgagaagcgggagcgggaggggcggtcctggcccgccgaggagcaggaggccttcaagaaggcgatcaaggacaggtatgacgcggagggagagccgtcgttctcctcggccaggctctgggacgatggcgtcatcgaccctgcggacactcgcatggtgtttggtctgagcttggcagcggcccagaaccggggaccccggtcatcgcagttcggagtcttccgtatgtag

SEQ ID NO: 3696 - DNA, 217 bp, Chlorella protothecoides
atggccgagaacgagcagcatgccctcagcctggcacgcaacatagtgaggaaccttggcccggggaccagggccgccgtgccgcttccctgggccgagggttcgtgggaagagccccgcttccccgccgccgagctccgaggtggggcgcggtgtggtggtgagcgaggcgggtttgctggcggcgtgaggccggcctggagaggctgtgaggcct

SEQ ID NO: 3697 - DNA, 1608 bp, Chlorella protothecoides
gcgtgcgcccccggagacctggtccgaggctgcgccgggcggccgccggtcacacagggaggggcgagccggacgccgctcccgcgccacctgcagagtcccgctgccgccctgggacggaacaccccccccccctccgggccccaccttggtgtggatccaggcggcgggccccccgggcgtggcctccccgccgtgcaccacccgctccaggaccagcggctcggcgttggggggggtgaacacgcccatgaactcctccaccgtccagtggaaccagcgcatgaggaagatgcgcaacgccaggccgtgcgtcaccaggaccagggtggcgtccgggccgaagcggccggcgtttatgtcacgcaccagatggtcctcgaagatagtcatgcggtcgtacacgtccgcccccgactcgccgttggggaagcggtagaagaagcggccgaagcgcaggcgctccgccttctcgcgctgcttcccctccgcgtcttggaagttgccaaagtcctgctcccgcagctgcacctcctcctgcgcgcccatgatctgccccggatcgaaggccgccgccacgccctcaaacgtctgcttgctgcgcaggtagggcgaggtgtagaagaagaggcgcggcgggtgcgcgtcgccggagctcacctcccgcacgcgctcgccggcggtcagcgcctgctgccagccgcacccgggccgggcatgggccagcgagccgggaagaaaggcctggcggccctgcactgccgaggggcgagcggggcgctggccaggctcgggcctggccatgtgctgccgcccctggggtgcccgtacgaaaacttggtgcaatcaacccctggcacccctcaccagggggaccctgctgtcgggcaggtaggtgtaggcaatgttgtccacgttgccctcgctctccgcatgccggatgaggacgatgcggatgggcagggtgcgaaagtcgcggggggtcgcgcccctacggcaccaggggacgagggagatggtggtgaggtgggagcagggggtggagcagtgcacagcgccgcaccatgcactgcagaacactggtgcccaccgtgccagtgctggcaggccaattccaatcagagacccgtgatggtagctccccaagcattccccacaacatactcgacaccccacaactgcaaggcatcagacggccagacctgcagccttgaccaggatcacaccatcccccagccaatccgactcacgaggaggtgctgtgaaagcgggagtcaaacatgccctcctcccgtcgatccggcatgcccgactctatttgccgggtggtattgggggtggggcatgcgtgggccccttgctggtgggcccacaggagctgtcggagctcctccacctctcgccgcaagctgttcagttctgccgctgtggccaagggagttggctccgccacgccatgcagatgcccattccgactcccggaggcgtggggatgggtgggacccgccatggtgcgacgggagaaggcccggtcgccccgacgggagaggggtgccgggacgagcaggcgctcagcctggcccgacaacatgcgggcccgggagctag

SEQ ID NO: 3698 - DNA, 1488 bp, Chlorella protothecoides
atgttgtcgggccaggctgagcgcctgctcgtcccggcacccctctcccgtcggggcgaccgggccttctcccgtcgcaccatggcgggtcccacccatccccacgcctccgggagtcggaatgggcatctgcatggcgtggcggagccaactcccttggccacagcggcagaactgaacagcttgcggcgagaggtggaggagctccgacagctcctgtgggcccaccagcaaggggcccacgcatgccccacccccaataccacccggcaaatagagtcgggcatgccggatcgacgggaggagggcatgtttgactcccgctttcacagcacctcctctgcatggtgcggcgctgtgcactgctccaccccctgctcccacctcaccaccatctccctcgtcccctggtgccgtaggggcgcgaccccccgcgactttcgcaccctgcccatccgcatcgtcctcatccggcatgcggagagcgagggcaacgtggacaacattgcctacacctacctgcccgacagcagggtccccctggggttgattgcaccaagttttcgtacgggcaccccaggggcggcagcacatggccaggcccgagcctggccagcgccccgctcgcccctcggcagtgcagggccgccaggcctttcttcccggctcgctggcccatgcccggcccgggcgctgaccgccggcgagcgcgtgcgggaggtgagctccggcgacgcgcacccgccgcgcctcttcttctacacctcgccctacctgcgcagcaagcagacgtttgagggcgtggcggcggccttcgatccggggcagatcatgggcgcgcaggaggaggtgcagctgcgggagcaggactttggcaacttccaagacgcggaggggaagcagcgcgagaaggcggagcgcctgcgcttcggccgcttcttctaccgcttccccaacggcgagtcgggggcggacgtgtacgaccgcatgactatcttcgaggaccatctggtgcgtgacataaacgccggccgcttcggcccggacgccaccctggtcctggtgacgcacggcctggcgttgcgcatcttcctcatgcgctggttccactggacggtggaggagttcatgggcgtgttcaccccccccaacgccgagccgctggtcctggagcgggtggtgcacggcggggaggccacgcccggggggcccgccgcctggatccacaccaaggtggggcccggagggggggggggtgttccgtcccagggcggcagcgggactctgcaggtggcgcgggagcggcgtccggctcgcccctccctgtgtgaccggcggccgcccggcgcagcctcggaccaggtctccgggggcgcacgcactgcctccgccgtgcgatcacgtgctgggatcgcgcgatcatgtgctgggatcgcgcacctgctcgctggtgccagcatgcgggggggccgtggcgcccagcagacc

SEQ ID NO: 3699 - DNA, 456 bp, Chlorella protothecoides
  modified_base (157)..(240): a, c, t, g, unknown or other
gcggcggagcgtggcgcgtcccccgaccgcgtggcggcgcgcgaggacgcggcgagcgcggcggtggcgcgcacgcgcttccgcggcgccatctcccccgtcttcgcgccctacctgggcgcctacgtggcggcggtggagcgcgacctggcctggnnnnnnnnnnnnnnnnnnnnnnnnnnnnnnnnnnnnnnnnnnnnnnnnnnnnnnnnnnnnnnnnnnnnnnnnnnnnnnnnnnnngcatgctggcgggggagagctgggaggcgctggccccgggcacgcccctcctccgctccgccgacgagctggtggaggctgttcgcggcgagctgcgcgactgctgcgcgcgcgtcggccgcggcgccgtcctccgcgacctggcccgcgcctttgcccgcacctactccgcctacgccgcgcgcctcttggcccgcgtgcccagggtggcgggcg

SEQ ID NO: 3700 - DNA, 2604 bp, Chlorella protothecoides
atgaagtccaactcttttcagtcatggaggatgttcttgctgacagtctggcttgaggtcgagcagggagggtgcatcgccgccctcgcctgcttgctgctgggcctggctgtcgcgtggacctctcgcctccgagggtctcccggactcccacaaccgccaattattcctgggcttccccttctcgggagtgttctggcactgggtcggagaggttcaaagtttatcgctgcctgtcacgcacagggtgctcggtcagaaaatgacctggctcctggcacccgaggcatatgccccctttttcacggccccagaggaacaaataagctttggacccgctgtacaacagaagtcgtgctggatgggggccatgggaaccaaccactccccattggcgcaacctgctgggctgcattgtgcccaagggcacggggttggcctgtcggtctcccacctttggcaaatggctgcactctcgccccttttccaattcatggcccattccctatccccacagttcacggaccgggtcttcgggctccctcctcagcactttgttggcaagcacgggctcatgctgcgcacgctgcggtggcagctggtcccaggcacgctcccaaacatactccacccccttcactccttcctgcgccgggagctggaggtcaaccccctgcgtggccgggtagggtgtggagtagcatggggggggtaccatgccgctgtgctgcccgagctcgccgccatggccatgggcccgctgactccatccccgcggacccccctcccaccacaccagatggctgcctcgccggtgccactctgcctccagtggcccttcctccgggcccgatcaaggctggtggagacgttccggtgagcgtggtggccctggtccatcgctggaggaagggcttgccagcggtggccagcctgtttgaggtccctgaggccatgactggcagccagcctgaacccgcagccggcagagcaggcaccacctcagacccgtctgaccagctggcccccctccatcctcgctccttgcaggcaagcgctgctcagggacagcatcggcaaggggacggtggtgaggagaaggggatgaacctgggcgatcccaaggcagcgatgggttgggaacttgattccatagagcctcgcgccgagtcgcaagcctgcgatgcgaacgccacccccacggccttctggacacttgcgttcctgctgctcccagagaatgctgcatatcgggggcgcgtggaggcggagctgcaggcgacgcgctccagcaccgaccccgcggccagcctggtggacctggcctgctcccggagtagcgcgctgaacaagtgcatcgcggagaccatccgattgcgggccccctccatcgacgtgcggatcgcggcctcggacgtgatgctccgactcccaggccgggagggcctgctgcttgagaaggtgggtgctgggtggtgggatctgctcgggtctggtccccgtgaggtgcggggggcagccgacgagagcgatcgcgctggcgcctgggccggcagcgcctgggcctttggcacagtttgcaaggccccctgctgctgcccgactctgcttcatctcacccaatgcctgccgtgcccaccgcgacaggggtctgtgctggccacgtccccctttgagagccacagcgatgagaggctgtttgggccggatgcccggcactacaacccggaccgggagggcatgctcctgtgtgggaagacggcactgcactccagcatcttgggcgtcggcggggtggcgggcctagcatttgggggcgggaagtacaggtgtccagggcgctacttcgcggaggcggaggtcgcgctggtcgtgggcatgatcctgctgtcctgcccgacgctggcgctggacgacctgcagcagcagtgggaagggggggtgggggatccccatggatgcctccctgcccccgacttccaaaagctgcttgggatcaaggttcccgttgctccctgctgggtctcagcaaaggagaagggttgctaggccggcacttacactgctcttggtaggcccagcacatgtttcattccacactccaaggcgcttggaagaattgtccacggtgcctttgcaacgattgtaaccggctgcaactctgccgagtctcccacgtggacctgcgtggtcgaaaacccagttcactccacgacagacatccaagggcttcgtgccagtcccttcgtcctaaaattgtcttcatcgatctggcttgggcatgtgagatcgagtttcgggatgtcgtcgctcgccaggcaagtctcgggctggtctcgcggtagcaggactatcaagactgccttcagggtcagcagtgcaagagcaatgtgtccatctcctcctcaaataatgctttatctattctcatccacgcagagatcgtcgggcccctctgtttggagcgagctctgccccgcaggtgagggggggctcaccaacaccgctgggccagtggggtttcggtcgttgtacgccaaaacttcagcattcacggcgtcccgtgcaggctgtggatccggagtccctcgagaaggagaatga

SEQ ID NO: 3701 - DNA, 1185 bp, Chlorella protothecoides
atgtgcagacccccacaaccattacgccaggtggtgcccatcctacgggccggcctgacgctgctggagagcgcggcgacgctgctgccctcctcccagaccttccacgtggggtaccgccgtgacgaggagacgctggtcgccacgccctacctcaacaagcttcccgccagcttcacaccagaggaccgcatccttgtcacagaccccatgctggctacaggcaaggcagcaaggcatgggaatgggatatggggggaaagaggggcccattccccaccccctgcgctcaatcccgtgtgtccccatcccacaggaggcacgatgcggcaagtgatccaggatctggtggatcggggggcggcgcccggcatgattcgcatcgtcagcgctgtctgcgccccgccggccctcaagctcctggccgacaagtttgtgggcctcaagatatacactggtgagggatggagggcagtgcgcggcggcacaggatgtgctgctccaggtgtgaggagggacagcatagcaacccagggtcaaacaatgtcagtgcctgcctgtacgggtggccgccactgtctgatcagaaccccaggtgctgctttggccgagggaaggggagcggatgtggggcagtctgatgctgacgtagagctctgccgccgtcaaatgttgaacggatccctcccccacaggtatcatcgacgccgaagtaatactggggtttgcgacgggattgccgcacacaaacttgcgccttgccacatctgtgaaggacacgctgaaggaagcctgcccggcaacactcctgctcttcgcattggttcactgaagaatgcgctgcggttgttgaccttggaagaaatcttcttaacatgtgaggggcagaggttcagggagaggcatgcaaggacaagcacacatcgaattcttggctgcagtgggatcggcctgcatccatgctgggcgctatggcgaactcaccatcgtagtccggttgatgctgcagtatgcactggaaatgtgatccccgttaagaacagccaaccatgggacatgaaatcagggggatgggattctccactccatcatctcatcaggccagtcccaccaggcgctcagaaacttcccagagtcggcggcccttctctccgtcggccacttcgcccgacacctggagggtag

SEQ ID NO: 3702 - DNA, 1266 bp, Chlorella protothecoides
atgcaacaagccatcgacttctggttagtcagtacagcaaccagatcgcaatccaccgccaaaaggcagcttcctgaaacccacctcattctcaaatgccccagtgtcgttattccagctccagtacacgccagacttgcccagtgcaggatcgctgatgacctgcgaggtcatgaacggaacagagtcaggctgtctaattgggcaactcactgcgataatcatcccatatccaccgacaaggtgcagcggactgtgccagtcctgaacacgcctgatcgttgttggggctttcaagaacatgtgaaatccgtcataatttcgatggattgcccccccaaaaaactgggtggcccctcctactcccagtcaacaaatgcccaatctgagccagaaggcgcacctgtgccaatcgcttgccggcctcctcctcgctcacataccccttggggccctgtcatcaagatcatggcgcaggtggatgctaccctaatacatgcattcactgctgtgggcagcttgacaaaaggggtgttcttgtgcaggcaggccatccttctggaggtctcacatcccagccatatctctgcagggcccagcggcacctgtcataaccctgtctccaccctggcctcctcacccggggtacagggacgagaaggtgatccccgtggagtcgtggtagcggcggtgcagctcccgcaccgtcagcatgttgcagagcttggagtccttgtaggccttggccccgtcaaactcgccgccgtcgatcatgggcgaggcctggcccaccttgaccccggcctccagcccgctgaggtctcccaggtccgccttgggggggacgttccctgccagagtgttggtgttgccggtgatggacccgacgatgacgaggcggggggcggggaggggcgacttcttgggcgcggccttcaggtcctccagcagcaggttgaccaggaggaagtgcgcgaggtggttggtgcccacagacagctcgaagccgtccgcggtgggagtgggctccttggcggtgggcaggtagacggccgcgttggccaccagcgcgtccagtcgccggcccgaagcgcggaagctctccacgaagtcgcgcacggagtcgagggaggccaggtccaggtgcaggatggagtaggagtcccttgggatgcccagctcacgggccatgcgggcagcctgggtgggcatgaagggagggagagggattcaggtggggtttcaaccagacatgtgcgagagtag

SEQ ID NO: 3703 - DNA, 189 bp, Chlorella protothecoides
atggagcgcgcggtgctcctgcgcgacctgcgcgagcgcgacgtcatgcccgccgacttcgaggcctcccagcccgcggtgtgccgcctgatccgctggatgctggcgcgcagccctgcggagcgccccaccgcccgccagcgtgggcgacgaggagctggcggacctgctgcgctcgctgccggataa

SEQ ID NO: 3704 - DNA, 303 bp, Chlorella protothecoides
atgtcccttggcccgggcaggacgctgcgggatgtgctggatgcggggccactggaggacgccgatcgctggctggtgctgcgccagattctggcggggctggcccacatccacgaccagggcgagatcaagctgggcgactttgggctggccaagctggcgggctccgacccgggggctgagccgctggaagggccgccgggcgccgcggccgggccggcgcccggcagcctgggcaagatggaggcggcagagcacacgacccaggtcggcacctcctactacatcaggtgtgcgacttga

SEQ ID NO: 3705 - DNA, 792 bp, Chlorella protothecoides
atgccaaactcgtgcccgccaggtgtcgtacctgggattgagcctgttggggtcctggctgatcctacgctgggcgctcaaacaaatggaccccaccaagaagaatgtcgagacggtgaggcgggcactgggctggggaggtggggactgcccatggcactaggcggcagtgaagtgtcccacctgcgcatacgatctttgattgcagcgccgatgccgggccctgggcctggtggtgggtctgggagcacgagctgggacttgcttctgcgcgctggatttcggccagccagcgtctcgaccctgcagcagccgaacggtactctcacggccaccccctctgcacctggtccaaacaggcaaaacagcggaagaaggcgttgtccaagcgcctgggtcgcccgacagccacgagcgcgccaagcatcgtggtgcaccactgctggagagcgtgatgtagaattgcctggcaccttcacatgggctctgttatggactgcgtgtgccagatggtctggtcccctcgctccttacagtatttgtgtgccgcccctgcctccgtcccaccatggtcccactgcgcggctcagccctgttccccttccccctcccacgcacaaaatccgccaggtgatcgcccaggaggtggtcaacccggctcacatcaacatcaccctgcaggatgtgggtggcctggaccacatcattgaggacctggtgggtgtgccaagtcttggtactaggatgggagctgtgcctgctgagatctcacattctacagtagggctgtga

SEQ ID NO: 3706 - DNA, 447 bp, Chlorella protothecoides
atgatcccttgggtatcttggcgggggaacgatcgagctctcgaggcaggattgccttgctcaccaggggcggggtccttccaagactctgaacggcacaatcctcctccaaacgggtgctccttccggtgcccatgtcctctgctgaagattcccccaaatgtccctggtcacaattatgacttggcggctggggccgcactctgcgtcagacctctcacccctcacccgctccttccatgccagggcgtatgccaccgtgacctgaagctggagaacaccctgctggatggccgacaagccccgcgcctgaagatctgcgactttgggtacagcaaggtgcggggggggggattctcgcccttcacgggacgcagtgcatacagatgcagagtggcgcagcctggtctgaatgcttctgtcacaccatccttgacattgcaatga

SEQ ID NO: 3707 - DNA, 1059 bp, Chlorella protothecoides
atgggtctgataagtggagacggttttgggaatcaaacactgcaggcgacagaaccaggcattacaacgcaattccaggagctacatgatgttttagtcggtctatgtctcgcagagggaaggctatgtcacaccctgcgatcagctgattttgaagggacgtgcccgaggcgggaaggcgccactacgcgtggtaggtctcggcgagctggaaggcgggaccccggcagcagaggcaagcccaagaggcctgcgaggtggagcaggaggcatgcacacccttgcgctgcccccttgctcggtcccgcattgccgctgtacacaccccctggaccaggcccagaccccccgtctccctcgggcgcgagatgttctaggagtgggcacgctgctcggggagggttaggaccgcgcaggtccattccttctgggtgtgcagaaacctcggtcgtgtacccgagtccctgccgtacacccctccagatcaaggacataggatccggtaactttggcgtggccaagctgatgcgagaaaggtctacaggggagctgatcgcgatcaagtttattgaaagaggcgagaaggtgagccgggcgtgccgggatttcgggcaggtatcaccggcgtgtgatcggcggggcgtcctcatccccggcatcccctggcctccatgcacatcacagatcgacaggaatgtggagcgggagatcatcaaccacagggagctgtccggtcatcccaacatcatccgctttcgggagaccgacctgctcaaaggcgcggcagaggcaccaccatccacccctgccccactgcactcctccatcttcgggcgcgccccctcgccatcaccgcaggtgtttgtgacgtccacccaccttggcatcgccatggagtatgcggcggggggggaactcttcgagcgcatcgtggccgcggggcggttcaaggaggacgaggcacggtatttcttccagcagctcatctccggggtctcctggtgtcacaaatgggtacgggaacgggctgccaagggtggtgtcaggcatgctgcctga

SEQ ID NO: 3708 - DNA, 750 bp, Chlorella protothecoides
  modified_base (662)..(671): a, c, t, g, unknown or other
atgctcttgatcagatgccaggaaatacaaggtcgagacttcatcattgtcactgtattggccctgcacaggttgacccccaaggagcctctgtcactgtggtgggagacactcatggccaattccacgacgtctgccacatgtgggtgctggtcggtggagaatggggctcagccccaggagtgccacagggggtggaaggtgcacagtagagtttgcatcagcgcatgtgatcacgtattctcttcacttggcccgttctcaacaatccattgccacagattcaaggttgctgggtacccatcaccaacatcactcttcatcttcaacggtgactttgtagacaggggttcctggggcctagaaaccctgctcctcctcctggcatggaagctggcagcaccgcagcatgtgcatctgttgcgagggaatcacgagacagctctctgcaccatggtgtacggcttcaagggcgagctggttgccaagctgggccgagggaagtggaaggtgagaggcagccttgagtgtgctgctttcttgcccactcatggtcaggaggcgcaaccttgggggtctggttgtgaggttggacatcgtcgagaacggccaccgcatggccttgctcctcgttctgtaacatcgattgacccctctgcacnnnnnnnnnnacgcaaccttggcggtctggttgtgaggttagacatcgttgagaacggccaccgcatggccttgctccttgttctgtaa

SEQ ID NO: 3709 - DNA, 219 bp, Chlorella protothecoides
atgaaggcgctgatggtggagtcggccgcctcggccgcctcccactcgttcctcctggacgaggactcggccctgcccttcacccaggacgacgtggcggccttcatggacgacaaggacttgctgggggagatgggcatcccggccgccctgcgtgatcaacccagctttgcgttcctgaacaaacgactggaactggcgctgcagagtgcggcgtag

SEQ ID NO: 3710 - DNA, 789 bp, Chlorella protothecoides
atgcgccggccggagctgttccgcacaagcctgctgcgccagaagcgcggggtcctgctctacggcccccccggcacaggcaagacgatgctggccaaggcgcttgcgtcggagtgcaacgcctgcttcatcaacctcaaggccagcacgctgctgtccaagtggtacggcgacaccaacaagctcatcgcggcggtatggtcgctggcggccaagatcgcgcccaccatcctgttcatcgacgaggtggactcgctgctgggccaccgccgcgcggtggagcacgaggccaccacggccatgaagaccgagttcatgcaactctgggacgggttcgagtcggcatcggactccaacatcgtcgtcctgggtgccaccaacaagcgcgacgacctggacgacgcggtgctgcgccgcttctcgctgcagtacgaggtgcgcctgccgcagcgcgcgcagcgcgagaccatcctgggcctgctgctggcacggcacgcgcgcgagctgggcgcgcagtacctggaccccacgctcatggccgaggtggagggccgggtacgtggtactgcggggcctggcgtggcggcggcgggcgcgggagcggcggcgggcgcgggtgccggcggcgcgagcaatccaggcgccgccaacggcaccgcggcgccgacggggggcagcgcgctgcgcgcgctggcggagaggaccgaggggtacagcggttcggacctgacggagctgtgcagcatggccgctgccatccccttccacgatgccgcgcccacgcagtga

SEQ ID NO: 3711 - DNA, 618 bp, Chlorella protothecoides
atgcaggggcctgtttggaggcaccagcaagaccgccgggtttgggtccttcttcagccgcgccgggtacggtggctctcccggcggggaggcctccatccacggcggggctgccggcggcttgcgccaggtgggagggcaggggtcgtgccgatggtgtttggcagtgggtcggaggggggtgcccggctgggctctcggcccctcgtcgtggtccgtcgcacacatccagcgcagaacgcacccctgcgcgtcggggcagggccgtgggtgcctgcccatgcgctcccctggatgaccatcgattctcgaagagctgcctccgagatactgctgccacgccaccttggaccacaggtggaggccaagtaccctgccctgctgttcaagcagcagctggacgcgtttgtgcagaagatcttcccctccctgcgcgacaacatcaagaaggacatcatgcctcacctggcggcctgcatccacgccccccgcagcggcgtggggcggacctcccgccccggccgggggtccagccacggcgtggaggcgccacccgcccgctcgcccctgggatcgtggctgaggcaatgccagcaggaatgccgggaccctgcctga

SEQ ID NO: 3712 - DNA, 1527 bp, Chlorella protothecoides
gccgcctcgcccgaggccgtccgcacggcgacgctgcgctcggccgccggcgcggcggtgggcctgggcgcggtggtcggcctgggcgtgctgtccccctcccccgccttctcctccatgctgaccaagtttggcctggcctcggtgtgcggctaccagacggtgtggggcgtgactcccgccctgcactcccccctcatgtccgtcaccaacgccatctctggcctcacggcggtgggcggcatggccgtggccaccggcggcctggtccccgccggcgcggcgggcggcctggccgccaccgccgtgctggcctccgcggtcaacatcggcggcgggttcaccatcacccagcgcatgctgggcatgttccgcaggcccggcgacccgcccgagttcaccggcctgtacggcctggccggcgcaggcgcgctggcggcctacgcggccggcgcggcggcggggtacgccgaggccacccccgccgcctacctggcggcctcggggttgtgcatcgcctccatcggcgcgctggcctcccagcgcaccgcccgcctgggcaacgtgctgggcgccacgggcgtgggcctgggcctggctgcgacgctgggcgccgtggtggccaccccggggtccgacgcgctgctccccgtccagatcgtcggcgcgctgggcgtcggcgcgggcgcgggcgcgctggtcgcccgccgcatggccatcacctccctgccccagatggtggccggcttccactccctggtgggcctggccgcggtgaccacctccatcgccagctacatggccgccgacccggcccacctggacgccgtgcacgccgccagcacctactttggcaccttcatcggcgcggtgaccctcaccggctccgccgtcgcctttggcaaactgcacggcgtcctgccctccaagccgctggcgctgccgggcaagaacgtgctcaacctgggcctgctggccggcaacgccgcggccggcgccgccttcctgaccacaggcgacccgggcgtggcgctggccgccctgggcgccaccaccgccctggccggcggcctgggcgcgcacatgaccgcctccattggcggcgccgacatgcccgtcgtcatcacactgctcaactcctactccggctacgcgctctgcgccgagggcttcatgctgggcaacgacctgctcaccaccgtcggcgcgctcatcggctcctccggcgccatcctgtcctacatcatgtgccgcgccatgaatcgctccctggccaacgtcatcctgggcgggtacgccaccgccgcggccgggcccgccgccgaggtgggtgggacgcacgccgaggtggacgcgcacggtgctgccgaggtgctgacgtcagcgcgcagcgtgctgattgtgccggggtatggcctggctgtggcgggagcgcagtacgccatcgccgacctggtcaagcgcctgcgctccaagaacatcgccgtcaagtgggggattggggggcgaaagggggatggtgcttga

SEQ ID NO: 3713 - DNA, 300 bp, Chlorella protothecoides
atgcaggtcatgtcgcgcgagatgttcaacccccagttctcactctttgcgccggtgccggaggggggcaccaccttccagcccaacccctcttccgtggtccagaacgacgaggcgcgcggcaccaaccacctcgacttcttcaagttcgtggggcgcgtggtcggcaaggcgctgcacgatggccagttcgtggacgcgcacttcactcgctctttctacaagcacatgctgggcgagcagctgacctaccacgacatcgaggccgtggaccccgacttttacaagaaccttacgtga

SEQ ID NO: 3714 - DNA, 396 bp, Chlorella protothecoides
atgttcaacgaccacgagctggagctgctcatctcggggctgcccgagatcgatgtggccgatctgcgaaaaaacaccgagtatacgggtgtccagggcaccgtgccgcgccatgtgtcggcctggcatcaggtgcagggcccctcacctgcactccccctcaaactcacccacccaccccggaccaggctacacggctgccagcgcggtggtgcgctggttctgggagattgtggacggcatggacaaggaggacctggcgctgctggtccagtttgtcacgggcaccagcaaggtccccctggacggctttgccgcgctgcagggcgtccacggcccccagaagttccagatccacaaggcgtatggggacgtggagcggctgcccacaggtga

SEQ ID NO: 3715 - DNA, 240 bp, Chlorella protothecoides
atggcaggacctgcgcagaggaacactcctaaggccgatgaacccaactggccgtgtccttcccacccccccatgccctgcaggtggatgctggagaatgacatcacagatgttctggacctgacgtttgcggaggagacagacttcttcgggcagaaaaacctggtggagctgaagccgggggggtctggcatcaagggcacagaatggaagcatccctgggaatcctcgctggcttga

SEQ ID NO: 3716 - DNA, 1869 bp, Chlorella protothecoides
  modified_base (283)..(292): a, c, t, g, unknown or other
  modified_base (970)..(979): a, c, t, g, unknown or other
  modified_base (1543)..(1552): a, c, t, g, unknown or other
atgggtcggaccgacaggtactccatacgggttttgcaacacggcagatcaaccctgtggaatttcaggggttcaggtccaggtcagcatgttgtcaagttcatgccatccaattatcttctgctgtcgaagcattgtcccgaacggtatctggctgcacattgcagcatcgtagctccaatcctagtgcagcccatcggggagctgagtctcgacggccgagccgggatggggtctcggcgagggttcccagctgtagcgatcttgctcctcctgggccccnnnnnnnnnncagccgggatggggtctcggcaaggattccccgctgtagcgatcttgctcctcctgggccccgcgctgtctctggcagcccggactccagatagcgcgcagactgtgctcaggggcgagccccaagcccccgtgtggccggactcgtactccgtggagtacaccttttccctgccctacactgccaagatccagccccatggcatcaggcagggcacggggtatgggcgttgcgattggcgggcattccctgcttgctgcatggcttggtgcctgatgagcagttcggctggggtctgcttggcaatgtacaagatcccccggccagctggccatggcacccacagattccctgagccactcctgccaggtaccccgtcgtcttccatcgcgacggcaaggcccagcgggtccgcatggagacatacaatggcaccaacgtcatcatctccaccaaggaggctccttgcctcggccgctgggaccggcgtggcacccccttctgccctgccgctggcaccccccgctgcatacgctcctgaccaggacgccgcccgcccgttgcacgggcccaccccttctcccctctgccccactccatctcctgaagcccccctcgcacgcccccgcttcctccaaccacagtctgtgcagtacgagctgctgccccgcatcgacnnnnnnnnnntgaggctccttgcctcggtcgcttggaccggcgtggcaccccctcctgccctgcccctggcaccccccgctgcacacgctcccaaccaggacgccgcccgcccgttgcactggcccaccccttctcccctctgccccactccatctcctgacgcccgcttggcgcgcccccgcttcctccaaccacagtcagtgcagtacgagctgctgccccgcatcgaccgtcagcagtgtctggtctgggccgagccggggctggccgacgcgcaggcgctgcccgacctggcgggctggtcctaccagggcgccgaggtgctggaggacggcgccgcggttcacgcctggcactacctggcacggcaccaggccaagagcctggcctaccgcttctacgcgcaccccgacggcgcgccccgccgcctggacatgctgggcaccgacgcgctctccggttcccacttcgaccgctgggtgctggactacgcgagctacgtccccggccgcccgcgcgcggagctgttcgaccagccgcggctgtgcgaggggcgggcgccggtggatggcnnnnnnnnnngccgcgcgcgcagctcttccaccagccgcgactgtgcgaggggcgggcgccggtggatggcggcgtccgcggcggcccacgagccggggcccgcccgggctccggctccggtgcgctgcgcatggcgggcctgctcccgcgcgtcgcctaccgcgggcaccacgcggggtacgacgccttcctggactcgccacacggccgggagcgggcgcacggcagcctggccgactacgccgcgcgggcggaggccttcgagcgcaacgcggcgcgcatcgcggcgcacaacgcgcgcaacgcctcctacaccatggccatga

SEQ ID NO: 3717 - DNA, 966 bp, Chlorella protothecoides
  modified_base (337)..(346): a, c, t, g, unknown or other
atgccttgcgacttggagctccgaacctgccgtcgtgtgagtgggcgcacgcagtggcggcatcagaatgtactgcatcaaggatacaaagagagggaggggcgccacgccttggccccggccatcagcacgtgcgcgcgcgcgattcaggttccggggagactcagcagtccacagccgtgcatggcactgagcctgggcggtcattggatccctactgcaagtaaatattcgattgaagtgcacagttccatactttggatcggtttggggaagcagtggacgctgggcacacgcgctgcgcgtcacgggcatgatgtcccggggggcggggtcnnnnnnnnnnccgtgccaggactggccagaaagccatgcactgtagtgagtggtataaattcatcgcagggcatgatgtcccggggggcggggtcctctcgcaccctccaccaatacctccctgactcctcacacagcacgacccacatggccaaaaagagctggggcacgagcgacaaggtgcaggaggccagggagcgcaagaacagctccaagaaagaggcagctgaggcagaggccaagcagaaggaggaggcatactggagccagcatgccaaccccaagggaagaaaggacgccaagcgcgaggagcaggagcggagccgagaggaagctgctgcccggcgtgcagaagccaagcggcttgctgctgaggaggaggctgctctggcggggccctcccgcaaggctgctccaaagcccaagcttacccatcaccagctagcgcagcagagggagcgagaccaggcggcagctgccgctgccgccgccgaggccgccgcggcagcccaacgagcgccgcagcggcgtgccatatgccgaggcttatgctcgatgcagcagctatttgagcagttgttgtgcaggatgcagcgctgcggaatgatgctctcggtcaaacctccttga

SEQ ID NO: 3718 - DNA, 4089 bp, Chlorella protothecoides
  modified_base (182)..(191): a, c, t, g, unknown or other
  modified_base (854)..(863): a, c, t, g, unknown or other
  modified_base (1882)..(1891): a, c, t, g, unknown or other
  modified_base (3259)..(3268): a, c, t, g, unknown or other
atgcctgcggtgccgtgcgtgtgtaggaggtgggaaatgcacccagcagtactggagaggccattggagagcttggacgctggtagagggtggggtccgggggacgggagagcagctgggcggtcgtcggtgactgcatgccctcccacgcacgagcgcgccatcacatgcgtctctggaannnnnnnnnncgggtggaggggagggatgctggggtgcggcgtgactggggcccctcgacaggccgcgcagcgcggcgtgcctgctgtgccgtgcgtgtgtaggaggtgggaaatgcacccagcagtacttgagaggccattggagagcttggaagctggtagagggtggggtccgggggacggccgatcaataagctcgctcggcacccaacgcattgctgcacgctcgaccagcactctcaccccgctccgcgcccgacactgtgatggccgcagtcgccttgacccacgtgcccttcgcgttttgatcctgatacatctggatatgtcgcgacgaactctcactctgcagcagctcgcctgcttctggcgccaggccggggcagggggtggcaccccctcggctcctgccacgcccgccatgcccgcgggcacatgcgccttcaagcatcccttccactcgggatcgaggcctgacgagaggcaggaatcaatgggaagctccggtcccaggcagccggcgtccctgagaggtgggctgggcaggagactcattcgtgaccaacgcacccgcccaccattaccttgctgcagactgggtccagggaggtgccaaggccacgacgcatgccgcccagccaccacgccgcggtttcagggcctccgccccgnnnnnnnnnnggcccagaccacgacgcatgccgcccagcccccacgccgcggtttcagggcctccgccccgctcctcaaggactactactccgtgctgggggtggggcgcaccgcctcggactcggagatcaagaaggcctactaccagctggccaagaagttccatcccgacaccaacaaggacgacccaggcgcggcggccaagttccaggaggcccagcaggcgtacgacacgctgcgggacccccaaaagcgcaccgcctacgaccagtacggccacgatgcgtatcgcaacatggagtccgggggaggccccgggccgggcggcttcggcgggccctttgggggtggggtggaggtggaccccgaggacctctttggcgcctttttcaggggtggccagggtttccaggtggggctgggtctgttgcaagggggcaggacggagcgtggtcagaccgttttgcgaccgtgttgcggtctgtggggttccgggtttggaagcagaagcgacaactctgagggaggcaccctggctgtgcccctggtactgatgcaggctgaactacatcctgtgttatgccgtcctctccttccactttggccacggctttggcaacgcgggcgggcggactcgccgcccgcagcgcggcgcggacctgcagacccgcctgcgcatcagctttgcggacgcgatgaagggcatcacccaccggatggacctgtccggcacgggcgcaggcggcccctcccaggtggaggtcaggatcccggcgggcgtggacacgggccagcacctgcgcctggcgggcagcggcgcgccgggcggccccggctgcgcggcgggcgacctgctcgtcttcctggaggtggcgccctcccgcgtcttcacccgcgacggctacgacctgtacgtggaggcaccggtggacatggtggacgccgcgctgggcaccactatcgagtgagcacacggggccgccctcagcatggacgccggtggcccgtcgcggcaccggctgctgctnnnnnnnnnnacgctggggaccactatcgagtgagcacacgggtggctgaagacgcacaggccgccctcagcatggaccgcggtggcccgtcgcggcaccggctgctgctgctgggctgcaaggcagctgctgcgcggagtccatgtgaggccaggcacacaatgctccacccctcgctcccctcctcccgccgcccatgcagggtgcccaccatcgacgggcgggcggaggtgacggtgcggccggggacgcaggcggacgacaagctgcggatgcgcgggtatggcgtgccacaggacgctgccggcctgcctggaaagcgcggcgaccagtatgtggtggttcggctgcgcgtgccgaggaccctcaccccctttcagcggcagtgcctggaggactaccgccgcggcgagcggcaggcggcgccgcagcaaccctccggagcggcgacgggagccaagggcgggtctgacacggcgtcagggaaggcgtcagaggggaagtcgtccgggacgtcggccagggcggacgagccggctgacaagaagaatgcggacaagggatctggaaaggccgggagctgtaaagggacatcgttgccaggcctgtctgagaccagggggaatggcaggcgagtatcaatccacggctggctgcccgtgactgagctcagcgtcctcctccagatgccgacaccatttccaatcacaatctgcccgcttccagccctggccctgccaacacggtgtgagcggggtgaagggatggaggactacaagcggtggggttgtcctgcggccttacaatttcaagcagcactcatcgctggtcgggagcagctgcccccggcagagcaaatgggggccttggcagcagggagagggtgtctattgaagtggccatggcccccaggtcccacaaaaaaacttcaagagcaagcgttgcgcggtactctccacgcaagagccatccgagagacgcggcacggcccgtcgcccgaaacggccgccgccctccatctcacgggctcaggcggtgggcgtgagcgcggggggcggggcgggtgtcaccccccagatgtcctttgcatactcgttgatggtgcggtcggaggagaagaagccgttgcgggcggtgtagaggatggagcgccgggtccactcctcctgatccccgtacagctcatcgacgcgccgctgcgcatccatgccaggccgcggagggttgacagcgggctggcgactgcctgtgtcaaggctatccaacatgaatatatacctcaccatcctacccctctcccgcccccacccttcggcccctccacacacacacacacactccaccccaccccccctccaccccaacccccctccaccnnnnnnnnnngtccaacatgtgtatatacttcaccatcctctccctctcctgcccccaccctttggcccctccactcacacactccaccccaaccccctcccgcccacccccctcccgcctacacaaaccccagaccactcacccttggtcatgtcggtgatggagtcgaccaggtcctcaaagtagtcggcgtcgccaaactcgccgtccttgactgctttcagcgccttggtgtagcgcgggtcatagtcggtgaagtccttgcgctcggcgcgcaggcgaggcacatcctccgccgcctcgccgaagatgaacaggttctccagccccgtgttctccccgatctcgatgttggcgccgtccatggtgccgatgatgaggcagccgttcagcgcgaacttcatgttggaggtgcccgacgcctcagtcccgccggtggagatgtgctggctcagctcggcggcggggatgatgacctccgcctcgctcacgttgtagttgggcaggaagatgaccttgagcaggtcgccgatctcagggtcggtattcacctttgcgccaatggcgcccaccagcttcacgatcttcttggccatgtagtaggcggacgcggccttgccgccgaacacagacacgcgcgggacgacctggatctttgtgcgatatcccgtgtgtctcctggcgccatcacagcctcgtgctgcggggggtgtcccatcgccagcatgtgcaatgggcagggcaacacacctggtcatgtgcatggcaaacctgcggccacaggcctcagcacagaccatggacccccgggggcccactcgacaccatga

SEQ ID NO: 3719 - DNA, 1065 bp, Chlorella protothecoides
  modified_base (169)..(178): a, c, t, g, unknown or other
  modified_base (740)..(749): a, c, t, g, unknown or other
  modified_base (992)..(1001): a, c, t, g, unknown or other
atgcccgaggccctggagaagtggcccgtggcggtgctgcagaagctgctgccgcggcacatggagatcatccagcgcatcaacgacgagtggctggcctccatccgcgagcacgtcgaggccaaggtggccaaggccctggccaggccggcccccgccgaggaggggnnnnnnnnnnagcacgtcgaggccaaggtggccaaggccccggccaggccggcccccgccgaggaggaggcggacgaggcggacgatgagagtgacacctccgccagcggcaagaagcccgccaagaaggcccccctggacccggtggaggaggcgctgaaggagtacagcatcgtgcaggagaacccctggaaggcgggggagatgctggtgaacatggcctacctggcggtggtggggtccaaggccgtcaacggcgtggcggccatccactcagagatcattaagaccgacctcttcccccagttcgtggaggtgttcccctccaagttccagaacaagaccaacggcgtgacactgcgccgctggctggcatactgcaaccccgcgctgtcggcgctgatcaccgaggcgctgggctccgacgcctgggtcaaggatgctggccagctggcggggctggagccgcgcgcggaggatccggccttccgcgcgcgctggcgcgaggtgaagaccaccgccaaggccgcgctggcggcgcgcatcgccgagaccacggggtacgatgtctnnnnnnnnnncaccgccaaggccgcgctggcggcgcgcattgccgagaccacggggtacgaggtgaccaccgacgccatgttcgacatccaggtcaaacgcatccacgagtacaagcgccagctgctcaacgccatctccctcatcgtgcggtaccaggagatcaaggccatgtccccggaggagcgcaagaaggtgcacggggggtccgggagggagggggcgcgtcgttgtggcagggaatatttgatcannnnnnnnnnaaggtgcacggggggtccgggagggaggggcgcgtcggtgtggcagggaagatttgatcggtga

SEQ ID NO: 3720 - DNA, 468 bp, Chlorella protothecoides
atgggtggcgattgttgcggaggcaagcccacgcccgccgtggctgaccagttggcaggcctgagcctggacaatctccccaagtccaatggctctgctgcatccgagaggccatgggcagagatcgccaaggagaaggcggtttacttcaataagcgcgtggagctttttgagaaatatcgagagcgggaggtcgcagcgctcgaggctgcccgcgcagccgctgtcccggtgcagatcacgttgcccgatgggcacgtgcgtgatggcgtaaaggacgtgaccacccccctggacatcgccgcggccctctccaagagcctggcgaagaaggcggtggtggcggaggtcgacggcaagccctgggacctcttccgccccctggagcaggactgcaacctggccatccacacattcgacagccccgagggcaaggatgtgcgttgttctggttgtttgtgcctgtga

SEQ ID NO: 3721 - DNA, 675 bp, Chlorella protothecoides
atggccaagaagatcgtgaagctggtgggcgccattggcgcaaaggtgaataccgaccctgagatcggcgacctgctcaaggtcatcttcctgcccaactacaacgtgagcgaggcggaggtcatcatccccgccgccgagctgagccagcacatctccaccggcgggactgaggcgtcgggcacctccaacatgaagttcgcgctgaacggctgcctcatcatcggcaccatggacggcgccaacatcgagatcggggagaacacggggctggagaacctgttcatcttcggcgaggcggcggaggatgtgcctcgcctgcgcgccgagcgcaaggacttcaccgactatgacccgcgctacaccaaggcgctgaaagcagtcaaggacggcgagtttggcgacgccgactactttgaggacctggtcgactccatcaccgacatgaccaagggcaacgactggttcctggtggccaacgactttgccacctacatggatgcgcagcggcgcgtcgatgagctgtacggggatcaggaggagtggacccggcgctccatcctctacaccgcccgcaacggcttcttctcctccgaccgcaccatcaacgagtatgcaaaggacatctggggggtgacacccgccccgccccccgcgctcacgcccaccgcctga

SEQ ID NO: 3722 - DNA, 297 bp, Chlorella protothecoides
atgcagcaggagacgtcgcgcaagctctgcttgcaagcgggtctcgttggcctgcgtcgccagttccgggtctggcgtgctggggatgcctgccacaaagcgcccaagccgcatcccaacgccttccctcgatccaggcgggccaaggctgcatgggaggcctactacgaggagcagctggctgtgctcaaggaggacaagccgggcctgaggctcatgcagtacaagagcatgatattcgagaactggcagcgcagcccgctcaacccccgcaaccaggctgtctccaagaaatag

SEQ ID NO: 3723 - DNA, 1392 bp, Chlorella protothecoides
atggcgcgctcgtgcgtgggagggcatgcagtcaccgacgaccgcccagctgctctcccgtcccccggaccccaccctctaccagcgtccaagctctccaatggcctctccagtactgctgggtgcatttcccacctcctacacacgcacggcaccgcaggcatgccgcgctccgcggcctgtcaaggggccccagtcacgttggaccccagcatccctcccctccacccccacccctcaggcctgcgcctggcccggtccctcgccgaacagggaggtcagggagcgcgcctcccgctcctccccgatcacgcgcaggacgtcgtccagctggcgctgaccgtgcacctggttgtcgcgcgtgcgcacgttgacggtgcgctgctcgcgctccgcggcgcccaccaccaggatgtagttgaactgggccacctgcgcctcgcgcaccttcttctgcatcttgcggtcggccaggtccacctccacgtggaagcccgcgccacgcacagcgtcccgcacctccagcgcatagtcgtacgacgaaaaacgaccgacgacaacccaccagagatgggcacgaccatgacctggcggggtgagagccagagcggccaccgccccgcaaagttctcggatggcaaacatgcgctccacggagcccagcacggcgcggtggatgatgacggggacctggaagccgccgtcctcggccacgtactgcaggccgaagcggaggggcagctggaagtcgagctgcacggtggcgcactggaacttgcgccgcagcgcgtcgtgtacggtgatgtcgatcttggggccgtagaaggcgccgtcgccctcgttcagctcccaggcgtggcccgaggcgtccagcgcgttgcgcagcgcgccctctgccgcgtcccactgccccggcgtgcccaggaagccctcgggccgggtgctgagcaccagggagaagctgaggcccagctggccgtagacgtcggccaggaaggccagggcgcgctcgatctcggccgccacctggtcggggcggcagaagatgtgcgcgtcatcctgctggaagcggcgcacccgcgtcaggccctgcagcgcgccggagaactcgttgcggtgcagcacgccgaagtcggcgaggcgcagggggagctcgcggtaggagcgcgtgcggtggccgaaggccaggcagtggccggggcagttcatgggcttcagcccgaattcgcccttctcaatgtcgaagcagaacatgttctccttgtagtgcgcggcgtggcccgaagtcttccacagggcttggaaaatgtacaacgatgctcagagacggttgatcagtgcatgcaatacctcgacggcagggagggagtgcagggtgcccggcttgtgtga

SEQ ID NO: 3724 - DNA, 1050 bp, Chlorella protothecoides
atggacctgtggaagacttcgggccacgccgcgcactacaaggagaacatgttctgcttcgacattgagaagggcgaattcgggctgaagcccatgaactgccccggccactgcctggccttcggccaccgcacgcgctcctaccgcgagctccccctgcgcctcgccgacttcggcgtgctgcaccgcaacgagttctccggcgcgctgcagggcctgacgcgggtgcgccgcttccagcaggatgacgcgcacatcttctgccgccccgaccaggtggcggccgagatcgagcgcgccctggccttcctggccgacgtctacggccagctgggcctcagcttctccctggtgctcagcacccggcccgagggcttcctgggcacgccggggcagtgggacgcggcagagggcgcgctgcgcaacgcgctggacgcctcgggccacgcctgggagctgaacgagggcgacggcgccttctacggccccaagatcgacatcaccgtacacgacgcgctgcggcgcaagttccagtgcgccaccgtgcagctcgacttccagctgcccctccgcttcggcctgcagtacgtggccgaggacggcggcttccaggtccccgtcatcatccaccgcgccgtgctgggctccgtggagcgcatgtttgccatcctgaccgagaactttgcggggcggtggccgctctggctctcaccccgccaggtcatggtcgtgcccatctctgactcgtcgtacgactatgcgctggaggtgcgggacgctgtgcgtggcgcgggcttccacgtggaggtggacctggccgaccgcaagatgcagaagaaggtgcgcgaggcgcaggtggcccagttcaactacatcctggtggtgggcgccgcggagcgcgagcagcgcaccgtcaacgtgcgcacgcgcgacaaccaggtgcacggtcagcgccagctggacgacgtcctgcgcgtgatcggggaggagcgggaggcgcgctccctgacctccctgttcggcgagggaccgggccaggcgcaggcctga

SEQ ID NO: 3725 - DNA, 597 bp, Chlorella protothecoides
atggaagccgcctggtttgtggccacgggcgagcgggtcagcctctcggagcaggccgtcatcgactgcgcctggggcgcggcgccggggcacgaggaaagcgcggcggcctgcgacggcggcgacgcctgggcgggcgtggcgtacgcggtgggggcggggggcctgccctcctcgctggagtaccagtacaaggggcagtcggggtactgcgaggccaacgacacggcggccgtggcgcggttcgcgggcttctcgcgcgtccccgcctacgacgacgccgcgctgatggaggcggtgtactcgcgcgggccgctggcggtgtcgctggacgccagccacgactccttcaccttctactccgcgggggtgtatgccgagcccgactgcttcttcaaaaaggaccagctggaccactccatgatgctggtggggtacggcacgagcgcagagggcgactactggctcatccgcaactcctggagcgaccactggggcgacgcggggtacgtcaaggtctcccgcgaccgccatggctgtggcgcgcccgccgatgccatgtacgtcgtggccgacgcagacggcctgaggccttga

SEQ ID NO: 3726 - DNA, 846 bp, Chlorella protothecoides
atgtctcttttccccccttgctctcccgtctaccaggccttctggcactccagtgcccacatcctgggccagtccctggagctggagtttggtgcggagctgaccatcggccccgccctggaggagggattctactacgactgctacctgggggaccgcactctctgcgagcccgaccgcgacaccatccagaagcgcatgcagcaggcaggggccatcgttacgaggatcactggtgtacattgggtagaggggagagttgtgccggcctgcatgccacaggagctctgccgccgcagcatgaggtctccgatcagcccctcaccccagatcttttcacccccctccgcacaccattttctgggctctcttcactcactcacgcagattgtgaaggccaagcaggcgtttgagcgcgtcacagtgtcgcgcgcggaggcgctggagatgttccaggagaacaagttcaaggtggagctgatccagggcctgcccgaggacgccagcatcacctgctaccgctgcgggcccatggtggacctatgccgtggtccgcacgtgcccaacaccggcgcgctgcgggcggtggcagtgaccaacgcctcgcgcgccttctggcgcgccgacgtgacgcgcgagccactgcagcgcgtctacgccatcgccttccctgaggacaaggagctgaaggagtatcagcaccggatagaggaggccaagaagcgcgaccaccgtctgctgggcgcgcaacaggagctcttcttcttccaccagctgtcccccgggtcctgcttcttcctccctgccggcacccgcatctacaacgccctcgtggaggtattgtga

SEQ ID NO: 3727 - DNA, 423 bp, Chlorella protothecoides
  modified_base (200)..(209): a, c, t, g, unknown or other
atggcgccggctgcagcggctgcaaggccaaggagtgtctgcaggcgcggagctgccgcgtccatcgtgctcgtgcttggcccaccaccgtgtccaccaccaaacccattccgatccctgtgtctcctcttcaccactagttaccccctctccctgcgcagacaccgggcgcatcgtcccccgccgccgcaccaagctannnnnnnnnnccaaacccattccgatccctgtgtctcctcctcaccactaatcaccccctctccctgcgcagacaccgggcgtatcgtcccccgccgccgcaccaagctctccgccaagctgcacaagcacgtggcgcgccagatcaagacggcacgcgccatgggtatcctgcgggccgacgccgcgccggcgcggccctgggtccagcgcgggtctcagtga

SEQ ID NO: 3728 - DNA, 1386 bp, Chlorella protothecoides
  modified_base (324)..(380): a, c, t, g, unknown or other
  modified_base (575)..(584): a, c, t, g, unknown or other
atggaaagtgcggaattggtgtgtgtagccttgtcgactgagcagcatggtgtagactaccttgacgcggcactggcgatgggattaagaactagtatatttctgcaaacaaaattgcagcgcatcccgggtgttggcagctctccgggagagtatgctccctgccgcactgtcccgctcgcggctgtgtggcctgttggtcagccgatctttgcgagggtatgggtgtgcagaggtacagaatggatggatgcgcctgagtactctgcccccaggcgaggactccaactcctcccagtccctacccacgagcgaggcggagcnnnnnnnnnnnnnnnnnnnnnnnnnnnnnnnnnnnnnnnnnnnnnnnnnnnnnnnnngtgggctgacgggcagctcgacgacctgaacaaaggtggatgcgattgcatgcattgtgtcggtggtaggccgtggccaacacttgtgctgggggggagactctggcttggccggtgctcctcgtacgaacattcggccccactctctggccaacgactatgtgcgcttccatacatcaatccaggtgcagctannnnnnnnnngccgtggccaacacttgtgctgggggggaggccctggcttggccggtgctcctcgtacgaatattcagccccactctctggccaacgaatatgtgcgcctcctcacatcaatccaggtgcagctgcagaggcatcatcgagccagggtggcgttcaggcatcgccgccgagcgagtcgtgcctgcgccgggacgccgctccagaggcgtcagttgacgctgcgtctggcacctcctctggcgaagccgcagcggactccagcgggccggccctgcgacccgccggcgtgcagcagcagcagaccggcggccggccccttgacgagctgctcccggggcggggcgccgcgcggcacgccacggccaagggcaagggcaagggccccgcgaccctggaccgtgctgggatcatggaggtcatggcccagtcccgtcccaccccggcccccggccggccggagggcgagtttgccagctacgggctgctggcccaggccacggatgcgccgcgtgccgtgtttggcaacaaggcggaggagcagtcgccctcgcgggtgcaccccttccgcctcttctaccccggccagacctactccccggagctcccgacgccaccgaccccctctacaaacaccacaggacctggatccgtaccaggcggcccccccggagtttggacgcagcgtcacccgccaaccgccggccatccctgccaaggtcgtgcttgcacgagcagacttcagggacgcggccttcctctcctccttcatcacaggcaggcgctagagtggggtggcgactga

SEQ ID NO: 3729 - DNA, 615 bp, Chlorella protothecoides
atgtcaccttctacaccatatcccaactcgatgcccgtcgccccagatctgccactcccggagccgctctctgcggcagcggccaaggatgccgacgagctggtccagttgataggaccgtacgcctcagcctgcctcctatccaagacctggcagctacgcgttgcggcattgcaggcgagagggcctgaatggctgctctgcattggcggggttcagtgggaagaggtggtgacggatcaggaacaccagcgcacaagacagcccctgggctgccctggcatgctgctctattccttggcaggcacacgcattccctggacaatgacttctgcctggacggtatactcacccagacccacccccttccgcttcccctcgcagtggctggaggccggggcaggacgggcgccgggcctgctcgccgacccagacaactttgggttgctggcccgcacgctcagcgctgctctgcacgacagagtggcggccgcctacctcgccgccctgcctgctttgctgctcctggcccagtgccaggtgtgtctgctgtggcgcagggcgctgtggttgggagggttggggtggatggtgtggcagttgccggagccatga

SEQ ID NO: 3730 - DNA, 606 bp, Chlorella protothecoides
atgctcgccgtcgcgcgcggactcgacgggcacgcaggcacgcactctggcggtcgggcgcaggacccccgacgcgagggagccaggatcgccgggctggaggccaggaaggcggcggccgtggccgccgaggactacgacctcgccaaagaaatcaaggcggaggtggacggcctgcgccgcgtctcccagcgcggctccccggcccgagcccacggctctgggcaggagggcgaagacccccgcgaccccgggccgcggcccccctccccgcccatcccgacgcccgtgcggcctgacctgcagcaggcgccgcccggcggcctcgccggcctgcgcgcttcgctggtggccgcagcctcccacatgggcgccgaggtggaaaggatgagcagggaaagggccgcggagaccagcctcggtgacgagggttcgagcggagacctgggccccggttcgagtggggcgaggccagccccgggcgagcgtggggacggggagggccgcacctcggcctccactttgtgggcagagcacccgccgcccccggggttccctgccggtgagggtaattggaagggagggtttcctcctggcgcggcgtga

SEQ ID NO: 3731 - DNA, 1131 bp, Chlorella protothecoides
  modified_base (468)..(477): a, c, t, g, unknown or other
atgcttgagcggtgcaccgtgcctgagcatacttcttcctcggatcccaaagccacaggaatcggaactcactcggcacaggcactctcacacctcgcctgtgcaccagacctgggtgtcgtaactgtgtttcgtaggaaccctcctccgatgagctacaaagcgcaactcaaggcacgtggtgcactgcgacccgcatgggacaagctgctggccaccgtgcagtatgtggccatgttcatctccgctggccagccaggcgatgtcaagaagatccaggcgtccgtggctgctgcgcgcaaagttttccgcatcatgcggcccctggagagcctgaaccccatcatccagaaccccacactgaactccaaccgccccttggtgctggagcttctggccaagatcaccccagcgtccagactccacgccatccctcgctctcctctccctgcgcctcagctcaagttnnnnnnnnnncctggtccaggtgagggcacacgcctgttttcaggcgcctcttgtgatgggacgtgcgactgctctggcacatacagtcatccttcgcacgatttcaggcctgaccgcgcggcgcgtaggcgaggtggaggaggtctaccaggcgcgactggagaagaacggtgccgagatcacacgccacctgctcctcctcgtgcactccctggtccaggtgagggcacacgcctgtttccaggcgcctcttacaatgggacgtgcgactgctccggcacatacagtcatccttcgcacgattccaggtccgagcacaggatggtcattttccctgcgcccccccatgttctctttgcaggccttgctggcggtgggcctgctggagctgcgaccctggaagccacgcacggtgggcatgctggggatcatcgcctcagccctcaactgctacatgctgttcccggctctccccgccccagccaaggccagcaccaagtcctttgccaaggtggcatgatgcctggcctcctccgaatccgcatcaaaattagtgatcatctcctttgcactagtctcccagtcacaccctcctgtcgcactgcttgcatacaaggttgttatacagcccagctcatactctggcgtcacgagggggcatga

SEQ ID NO: 3732 - DNA, 1887 bp, Chlorella protothecoides
  modified_base (1009)..(1018): a, c, t, g, unknown or other
  modified_base (1418)..(1427): a, c, t, g, unknown or other
atgggtcgaccactgccccagggcacccctccagctcccggcgccccaggcccccagcatgcttcctccagcgacgaggagggggagtctgacgaggggtggcaggtgtattccggctcagagacggaggatgagaccgacaacgaaggggctgagggggctaccgagcggcagcagctgtctgacgccatcaaccgtggggacgccgccgccctcctggccctgctggaggacgaggcggtggccgcctgcctgaacgacccgaaccgggaaggggacacccccctccacctggcctccctgtacggacaggcagagtgcgtgcgggtgctgctggaggccggggccgacgccggggtgcgggacccggatgcctccaccccgctgcatgacgccgctgcgggcgggtacaccgaggtcgtccgcctgctgctggcctcggacccctgtctggccgcgagccgggacgatgacggcgacacgccgctgcacaacgcggcgcggggctcccacgccgcctgcgccgagctgctgctgggcgcgggggccgacccccgtgccaccaaccatgtgggtttcggagggctgggtggccggggcgctggagacccccgtgcagatgacggaggagggcaccctgtgtcgcgaggtcctcgtggccgcagaggagggcctgcaggccggcactgccccgaccaccgcgtgatcgagagggtattgacccgcgggcgcgtcccaggcccaggcgaccctcctgctgcagacgccgggccttcagcatccggctggttatgtttgcaggggctctcaccgctcggcgggggccagcctccccgccccgccgcccgcagcgcacgtgactgtgacgagatgaatgaagggcccgggccaggggccaccgaggtgtggcttgggcctcgctcggcttcgccggcggcgtggttccccccccttcccccgccccctgctcagtggggccgacggccggtggtgtcgccgtacaggaggnnnnnnnnnngttccccggcggcgtggatccccgctcctccccccgccccctgctcagtgggggcgacggccggtggtgtcgccgtacaggaggagggccaggcacaccgcgacggccagccccaggaagtgcgcagtctggtaggcgatggccatgtaggccgcggccgtgcccttgagctcgggggggacgaggcgcggggccaggaggttgacgctggtgttggaccagccgcccagcagccagaggacgcacacgaggagcagcgcgccgatgtcgctgcgccaggcagggggggccttgagggtttcgtcgcctttgaccgtgtaccaaaacttatgaccacggctacttggaaggccatgcgccgagcaggcgagaaccctgcacggtgggcagcctgggattnnnnnnnnnntatgttgcgtgtgtttgggggggagggggcgggggggggcgtcagaaaagggtttcgtcgactttggccgtgtaccaaaacttatgagcacggctacttggaaggccatgcaccgagcaggcaagaaccctgcacggtgggcagcctgggattcaccaccacaccctggcaccagggtatccctacacgcacgcacgcacatgcacagccccccacagccatgccaccggcgccgcacgcacaggcgagcttgaagagcgcaacccctagcagggcgcgaggtgaggagggcgtggcgaagcgggagcgcggggccaggcgccccgcgatgtcggcaaagacgcgggcaaagaagaggatcttcagggggggggagagggggcttgcttgcacgcatccaggaatactgaatgcctggcccgtgggcaggaatcaaagtgcacgagggtgcccagtctga

SEQ ID NO: 3733 - DNA, 1185 bp, Chlorella protothecoides
  modified_base (99)..(108): a, c, t, g, unknown or other
  modified_base (935)..(995): a, c, t, g, unknown or other
atgcattctatgatgcacccaccacaccccaacatcccccccctcccttcaaaccttgtttcccctctctctcctccactcgccccaacagcgtcctgnnnnnnnnnnacctcaggtgggcgaggttggcggcctgagtgtgggtggtggtctaccactgccatgcattggtcccaactgcccactccatgttctcttcctacagagcctgttccacggtccacacacatgcattctatggtgcaccccccacaccccaacatccccccccctccctccaaaccttgtttctcctctctttccaccactcgccccaacagcgtcctcatcatcaccgtggtggccctgggcctcttctccggcctggccttctccgcctcctaccagctggtgtcccgctttgccaacaagaacgtcatcgcgctgggcatgggctgccccgccgccggtcccctggtgctggccctggagctctgcgctggcatcgggccccacgcctcccacgccgacatggtcctgctctacggcgcggtggccctgatcgtggccgccggcgcggcggctgccgcctcgctcgtcgcgcggcactgggcggcgctggatgccggcgcgggcggggagccggcggcggggttcacgagtgcaggtgccgcgccggagggaccccgcatgcccctgctgagccctgggggcccgctggagtgcgggccccgcagcgggtcggggagtgcgctgatgcacccgctggtctcctactccagcctggagccgtaccgcacgtacatgtccacggacggggaggtggtggcggacgacggctccttccacggcgccctggagagggccgcgccggacgacgcgtggaaggcagactgcgcggcgcacggcggcgcgggcccgggggcatggaaccccgccgcgccgcccacgccgcnnnnnnnnnnnnnnnnnnnnnnnnnnnnnnnnnnnnnnnnnnnnnnnnnnnnnnnnnnnnncggcggcccctgggtctcctgcgcggcaggtgggcgccggccgcgaggtcctgcacgccatccgcctgccgctgaccgcgcactttgtctccagcaccatctcgctcaccgtcttccccttcttcacctatgtgccctcctcgggcctgctgggggagtccttccccagggtgaggtggcgcagggttga

SEQ ID NO: 3734 - DNA, 1341 bp, Chlorella protothecoides
  modified_base (112)..(121): a, c, t, g, unknown or other
  modified_base (623)..(632): a, c, t, g, unknown or other
  modified_base (1259)..(1268): a, c, t, g, unknown or other
atggcgcccgtcgttgtgtgcggcgctggggtcattggtgcctcagtgtcgtatttcctggcacagaagggcctaacccctaccgtcgtcgacgctgtggggcctgcatgtnnnnnnnnnnccctcaaccatggcgcccgtcgttgtgtgcggcgcgggggtcattggtgcctcagtgtcgtacttcctggtacagaagggcctaacccccaccgtcgtcgacgctgtggggcctgcatgttcagcttccggcaaagctggtgggtacagggtcatgcgaggtgtttgaacatcgcttcgcctcccatgccaatgcacagatcatgcagccccatgacgctgtgctgctcggccctgctgcttgcaggagggttcctggcgcgcgactggtgcgacgggtcccccactggacccctggcacaggccagctttgccctgcacgccgacctggccgacaaactgaatggcaaggagcggtatgggtacaggcgcatgtcaacctacaggtgtggctgcatgcagggagggtcgggtttccatcgggacctggaccttgatgctaccattgagaaacaatccttcccttttcatttctccattccagtgttagcctccgtgccggnnnnnnnnnnggatgctaccattgagaagcaatccttcccttctcatctctccattccagtgttagcctccgtgccggcggcgggaagaagggaggtgcaaagggccggaagtcggcgtccctgggctggctggatgctgaccatctggtccaggacagtctcatcgccactccagaagattgcgcccaggatgaccagcatggttccctggctgtctctagctgtggctggacaccctggagcccccttctacagatcgttggacaatttcggccccactcctcccccttcccaggtgaatccggagcagttcacacgcacgctgctggaggagtctggggccgaggtgcgcatcgccacgctggcgggcctcgtggtggaaaatggggcggtggccggcgtgcggctggagcctcgcgacggcggcccagccaccacaatgccggctgacacggtcatcatcgccacgggcgcttggacaggggccctgcgggccgccatccccggccttcctgctatcaccggccagaaggtggcggctacgcgcagtcctgccctccccaagcgtgggcgaatgccgaggactccagaaagcaaactgcccaggcccacaccagtgtctagaaccgctgcagnnnnnnnnnnttgccttccccaagcgtgggcgaatgccgaggactacaagaagcaaattgcccgggcccacaccagtgtctag

SEQ ID NO: 3735 - DNA, 1635 bp, Chlorella protothecoides
  modified_base (456)..(465): a, c, t, g, unknown or other
  modified_base (1554)..(1563): a, c, t, g, unknown or other
atgtacggcatggcttacatccgcctcgccatagtacttgcagcggtgtgcagcgtgacagccgtggccggtgaggaggcgggtgaaggggccggggaggcccgcacccttgtgaagggaggcaggcatgcgccctgcaccgggcctgcgtccatgtcggcgaatcataccggcccaattgcatgtcgtgaaggcgcggcctcttacgtggcgtttccggagacggcccaacgaatcctgcctccccccctgcaggctcctgccccaccggcttctccggcccccagtgcggcgtgtgcgagtcggatgccgcctgcgccgctggcaccaacgactccggcgctacgtgctcccacgacgtcgcctacacctccaacagcgtcaccaagtcctacacctgcgagatgggcaccggcttcctggcatccatcgtggcgcccaacaccacctacgtcnnnnnnnnnntaccgccgccaccaacgactccggcgctacgtgctcgcacgacgtcgcctacgcttccaacagcgtcaccaagtcctggcgcccagcgccgaggctccggcgcccgaggccgggcaggctccggcgcccgaggccggcggcgccatcgggacaggcaactgtgacatcggcttcgtgctgaacaccacatccgtccctgtgctctgctcggccacctcctgccagatgagcgcgggcgcgctggacgtgtactgcggcgacgtgacctgcgcctgctccggcgcctgccccgccgggctgatccagggtctggtgagctcggtggcgggcaccgcgaccatgacctgccagcccgggggcgcctgcgccatcgccatggaaggcctgcccatcgcctccatcgacgtgcagtgctcagtgggggagtgcctggtgcccgtggtgcggccgctgggcaacgacacgctgccggagggcgacgtggcgcacctgagcatcaaccccttcatcgccgccatcccgctgctggcgctggtcacgctgctggcgggcgtgggcggctacgcctgggcgcaccgccgcctctgggcaccggcgtccggcgcgctggacgccgccgcgctggccgcgctggccgacggcccggccgcgctgccgctgcgccgggtggccacgctcaccttcctgggcctgggcgtgagcgtgcccatgaacccgcgcctggcggccaagaagcgcgcggccatgcaggacgcggaggtgcccgcgccgcgcggccgcgcctgggcgcccgcgccgcccgcgcagagccccgcggtcgaggccgcggctgcggagttcgtggcgtccctgcacgacgtgcccggccagcgcgggcagtgggcggtgctgggcggcatcaccggcaccgtgcacggcggcgaggtcgtgggtgagcgaggggttttcttttttgttttggtgggtgagtgtgtgtggagggatgggggatatagtaggggggatagggttccaggcaaggggtggcttgctgtgactctctcatcgtgcgcaacaagctccccagggccaggcggctgtgacctgagnnnnnnnnnnatttttgttttgttttggtgggtgtgcgtgtgtggagggatgggtgatatagtaggggggaaagggttctag

SEQ ID NO: 3736 - DNA, 870 bp, Chlorella protothecoides
  modified_base (29)..(38): a, c, t, g, unknown or other
  modified_base (203)..(212): a, c, t, g, unknown or other
atgccaagccccggtgaaacccttacacnnnnnnnnnnggtgcgagagccaaccctgacacacgcaatcagtcgcgggatgccaagccccggtgaaacccttacacagacgtgccacgacgcaagtcggcggcaccaactctacctgctcacgcgttcctcctgcacacccccaccatgtaggcttcctggtgaacgtatctnnnnnnnnnngtacggccccaactctacctgctcacgtgttcctcctgcacacccacaccatgtaggcttcctggtgaacgtatcttccatcccggcctaccttcgctggattcattacctcagtgtcttcttttacgcttttgaagccatgattacgaatgaaatgactggacggaccttcacattcatgctttacttgccgctcacttcgacaccctgcaccctaagccttcatatcatcgtcccattcccaatcccgacaggcctcggggtatgcccaaatagaaggcatcaacggcaacacctacctgacgacactagggttcgatgccggcgccacaacccgagacatcggcgtgctcgtgggtctttacgccggcttcaccttgctgtgcctggcatcgccctcgatggttgcaccctgtcgcttcacgcagtgcagggaggggttcaacagtcctttaatgctgcacgtgatgtgtatagtaagcacccttctgaccgagggcagacggggaaggatcggcgccgttctcaacagcttggtgtgagattcgcaaacggaacattggaggaaagaaggacagatgcatatccagcagaatccttgtctgtcggaagcagtatcgtcacaaaggtccacgatcgacggagaagcaagagctga

SEQ ID NO: 3737 - DNA, 2715 bp, Chlorella protothecoides
  modified_base (413)..(422): a, c, t, g, unknown or other
  modified_base (1493)..(1502): a, c, t, g, unknown or other
  modified_base (2477)..(2486): a, c, t, g, unknown or other
atgcatcaacctatgtatttgtggccatccaagcctatgaagaatgtcttcagcaccatgtgcccgccctggatcccatcggccgagggtgcagcccagagtcttgcgacaggccgcgcccagagtgccgcagacagcagccctacacgaatcctccgaggaaattatcaggcatacatcaacagcagccctacacgagtcctccgaggaaattatcaagcatatatcagtccacgttgcagcttttatagagaccttggaccttgtctgatattctgtggcctcattatttgtgaactgcgaaagatcgcgcgcacccagatcgacaacgagatgtacgtctcgtctcgactaggcgtaaaggcctgcattcattcaggctgctcggaacagcaattatttacaactgatcnnnnnnnnnncgtctcgactaggcgtaaaggcctgcattctttcaggctgctcggagcagcagcctgcatagtccatgacacggttgtgacggaggccccacgaggagatgttcctcttctacgaacaccgaggcccgacgaggaaatgctcctcttctacgagcaccgagatactgacgcggctgaagcacctgagcgtgtcgaaggggctgaacaaagatggcaagacctggctgcaagcctccatgccctcttgaaggtgagcacaggtccatggccaagggggacactcgcacatttaattccacagcgtactggccagggccatccaggaaggcagggccatccaggaaggcagttcagggcgcccatccctgttcctctcctcccatcacagagcgatccctccctgcacctggaggccaagcaatggctcatgaactccatcagtgacctggacatggcgaggtacggccatccctccggccactcggacctcctggcccagttcatcccgcagtgccgagcggacgtggaggcatccacctctgattttgccctggctgccacacaggcaatttgccgagcggacgtggaggcctccacctccgattttgccctggctgccacacaggcgattgtggagacggagcctgccaccctgggccccgtgctgagccgacacccggccttcctgtcccgctgcctgcggcgcaggccctccctgctcgagtggtttgctgcgttccaccccgatggcctccagcgctcgggaatgggggcacaggccctggcacgctatgccctggcccagcgtggcagcgcctgggcgcacctcgtctgggccgggaagcacgcgcagtcgccggtggcggtggcgcagaggccgcactactggtgcgagctggacggcgccgccagcgctgcggggctcgcggcgcgcgaccccggcttcctggcctcccctgaggtggagggggcggtggcggggggaacgctgctctccgtggacccaggcttcttcgcctcggtatgggagcagcgaggagtgtgggcggggcaaagggaggtgtgtgcatnnnnnnnnnncaggcttcttcgcctcggtatgggagcagcaaggagtgtgggcggggcaaaaggaggggtgtgcaccctttccatggaaacgcatgatgtcctgcctcacatcacaggtcatgtccaagactttcctgcccagctgcagtcaaagtttggttgtctagagattttgtccaccccccttccgcccagtgacctcaacagcccaccaggcctctcgctcgtcgtcccctccacaggcgctgcacgcctgcctggtcgacgaccccggcggccacatgggcagggagatccatgccgcattgtgtggcgccctcggtcgcccggaccgctggagggcactgacccggcggctcctccccagcttgtcgccggagcagctcctcgccctcgtccgaggcctgagggcctccgctgctggtctccaagacgacgccccggaggacctggtgttcctccacccagcctggccgacgctggacggggcggtcctggcctccgcgctggggtgctcgccccgcaagcttctggcggccctgcgagagagcgaggaggttgcctcggtccaggggcaggtgtgcctggctggggttgcgcactcgcagtgcgccgggctctcgaggcggtgcaggaggaaaccgtggaggggcatgccttcttgcgccagaggctcacgccagacgcaacagcgctggcgcggcactacctcctcggcctcttcgccgcacgcgccgggctgcttgccagccgggacctgttggcggcgctgcgggcgggcggcctgaccgtcggccccctcgggcaggccactcgcaagcgggggcgcatcgacacgcaagggcgctccaagcggcgcaggcggcggcgacggggtgatcccgaatctgacgaagatagcggcgggggagcggctgcctgggagctgagctggccgtcgggcgagtccctgctcgtgcgcgccgacacggccgtcgaccaggnnnnnnnnnncacgcaagggcgctccaagcggcgcaggcgacggcgactgggggatccggaatctgacaaagatagcggcggggtagcggctgtctgggagctaagctggccgtcgggcgagtccctgcttgtgcgcgccgacacggccgtcgaccagatcctggattgcgctgcgatcctgctggcgcgcgacgtcaggcgctgccgcttgagggcggcgggtgctggggagtcttag

SEQ ID NO: 3738 - DNA, 1116 bp, Chlorella protothecoides
atggccctgccctttgcacagtcgctgaatgcaacggccaccggctgcatgctggccctgtccatggacccgacctcccacctcctcttcgattaccatgacggctctgtgccggttgggaagagggaaggcggcccggtcttcatcactcccttccgcctgggcctggctgcggcggtcatcctggtcaacggcctggtctccgtttggctgcgcctggccatgcacaagaagctggccatcgccaccgtcagggtggtcctgcagctgtccatcctgggctacatcctggtgcccatcttcacggccaacagcgcgtgggtgacggccgcctacctggccttcatgctgctggtggcggggctggaggcgctgtctcgccccgccctgacctatgacggcatgctgtggcaggtgctggcctcgctgggcctgccctgctccgccatgctggcctacggcctgggcgctgtcatccgtccccggccgtggtacgacgcgcagtacgccatccccgtggcgggcatgctgctgggcaacgcctgctctggcgttgccatcggcctcacctccctcctcgacgacctgtcctcggggcgggaccgggtggaggcgctgctggcggcgggggccacgcgctgggaggccgcggaggacggcgtgcggcgcgcggtgcgcatggcgctgacgcccacgctgaaccagatgaacgtggctggcatcgtgtccatcccgggcatgatgacggggcagatcctgggcggcgccgaccccaccaccgccgcgcggtaccagatcgcgctgctcctcttcatcgccgccgccagcggggcgggggctgtggccgccgtgttcctggccgcgggcacgctgctggacggcgcacaccgcctgcgcggtgaccgcctgtcgccgcgcggcaccacgggcaagggcgtgctggtctggctggcctggcaggcgcgccgggcagggggcggcgcggcgcgcgcctggaaggccggcgtcgggcgggttcgtgggggccctgagcccggcgccgaccccaccgtggtcgtgcatagggggggcgaggtccgcgacggcctcgatgaaagcctcctgcgcgggcgctag

SEQ ID NO: 3739 - DNA, 666 bp, Chlorella protothecoides
atggccctacccgcccacagggagtttcttaccccctcccacactctctcctgccaggtggtggagctcctgggcaaggccgcgttctgccgcgcggtgcaagcgctcgacaccaagaccggcctccgcaacagcaaggattactttgaccagagcctggacgagatcaaggtactgcgctacgtcaacgccgccgacccgggggatgaggaaggcatcctgcgcctctacgactacttttactaccgcgagcacctgatcctggtcaccgagctcctgcgcgccaacctgttcgagttccagcggcacaaccgcgccagcggcgcgccgccctacttcacgcggccccgcatcgccagcattgcgcgccaggtgctgcgctccctggccttcctgcactcccttgacctcatgcacgccgacctgaagccggagaacatcgtcatgcgctcctactctcgctgccaggtcaagatcatcgacctggggtcctcctgcttcctcaccgaccacctcagcacctacgtgcaggtgggtgttgggcggggggggggcgcggggggggctctcagaggttgggcaaggagcatgcttgttggtgagggcaagtgtcaccagatcacccgggaatggaggatggccaggcaggggttcaggggggggtga

SEQ ID NO: 3740 - DNA, 789 bp, Chlorella protothecoides
atggtggcacactacctgctgcccctgccgctgattctcttcgcgctcctagccctacctggaccaaagcagctgcgtgccctgcgtgaccagcagcaactgggcatctacggatcccccaaccaggagatcgccctgctgtccaagaaatggcgcacagagcgcaacctctggtgtgcggggctgccggccgagtgctgggcggccgaaggagatcgcggcctttgcctttgctgcctgggccggcctggccgccttctaccgggagacgcagcgccgtgtggctctggaggacgaacttcacggcacagccccctacccttccacggggcgcggtggcgccggcacgtcgggcgcagcccgtcagtcacggtgatcatctggactgtggcctgggggtcgggtggaggaggggcagccgtgcatagaacggagggcgatgcagtcgccggcgactttactataacccctccaagcgactcctcactctggacattgtactgcccctctctcagacccggcaaggatgctgccacgaagggcggagccggcctgacagccatccccctgcccaagatcgtctccactgagagcggggacctgggagtggtggagccctcccgggaccttgccaagcagctggaggtgcagttcgaggatgagcggaaggagctggaggagggggagcagcgtcggcggcagacggatgccctcgaggccgaggcggaggccggggagggggagggcggcgccgccggcaagcagcccctggagaagaaggacgactga

SEQ ID NO: 3741 - DNA, 678 bp, Chlorella protothecoides
atgtgcttgggttccgctgatcctgccaccgcgtccaggccgcccaggaggttgccgtgcgcgctcacgcccactctcttctcctgcccctgcccacagagccggtcgtaccgcgcgccggaggtcatcctgggcctgccgtacgaccagaagatagacctgtggtccctgggctgcatcctggcggagctcagctccggcaaggtcctgctccaggtgagcgccgtcgctgggctcgtcagatgcagggtttcgaggggggggttgcaagctgcgctgccgagcccggcgcctcgatccagggcgacgaaacgtttcagcgccctgggcccccccgccatcgccccccccgccccgtctcctccccccacagaacgagtcgctggtgacgctgcttgcgcggctggagagcatcctgggggccgtgccgcggcacatgctgcgccggggcaggttcagccacaagtactacacgcgcgacgggcgcctgttcgagcgcaaccgccacacgcaccgcctggagtacctgaaacccaagcgcacctgcctggcacggcgcctgccggacgccgacgcaggcatggtctcttttctccagctcctcctccaggtgtgtttaggagggggaggtgggggcccaaggtgggggcaatgccgcccctcctctgggctggatga

SEQ ID NO: 3742 - DNA, 396 bp, Chlorella protothecoides
atgcgtgcaagcaagccccctctccccccccctgaagatcctcttctttgcccgcgtctttgccgacatcgcggggcgcctggccccgcgctcccgcttcgccacgccctcctcacctcgcgccctgctaggggttgcgctcttcaagctcgcctgtgcgtgcggcgccgcgacatcggcgcgctgctcctcgtgtgcgtcctctggctgctgggcggctggtccaacaccagcgtcaacctcctggccccgcgcctcgtcccccccgagctcaagggcacggccgcggcctacatggccatcgcctaccagactgcgcacttcctggggctggccgtcgcggtgtgcctggccctcctcctgtacggcgacaccaccggccgtcgcccccactga

SEQ ID NO: 3743 - DNA, 660 bp, Chlorella protothecoides
atggagcgccacgcgacgcacccctgcacggaaggccggcccaacaggcgcgcccacgccactccttggcccctacccacccccaccctaaaaacccctctcacgcagaacgtgggcctggcggtgctgctggacgcgcccgacgcgcaggcgacgctcctgaacgtgggcctggcggtgctgttggacgcccccgacgcgcaggcgacgctgctggtgcccaccaactcggcgctggacgcggccatcgcgggcggcagcgtgcgcgacgccgacacgctggccgcgctgctcaactcggcgccggacctggccaacccgctggccgcctaccacgtggtgaaggggctgtggccctcctggaccctggcccccggcacgcgcctgcccacctccgccacgctggacaaggtcaacctgctccagctcaacgtgaccgccgggcccgtgatccgcggcgtgggctcttccgccaacgtgctgcaggccgacctgctggcctgcgggccctccatcatccacatcattgaccaggtgctgctgcccttcaacttcgaccaggcctccctggacgccatcaccgccacccaggtcccggtgccgccggcagccccctccccggccgtgaccccggcggggcgcaggctgatgcgtgtgtga

SEQ ID NO: 3744 - DNA, 462 bp, Chlorella protothecoides
atgccgcccagcaccgcccactgcccgcgctggccgggcacgtcgtgcagggacgccacgaactccgcagccgcggcctcgaccgcggggctctgcgcgggcggcgcgggcgcccaggcgcggccgcgcggcgcgggcacctccgcgtcctcgctggcgcgggttcatgggcacgctcacgcccaggcccaggaaggtgagcgtggccacccggcgcagcggcagcgcggccgggccgtcggccagcgcggccagcgcggcggcgtccagcgcgccggacgccggtgcccagaggcggcggtgcgcccaggcgtagccgcccacgcccgccagcagcgtgaccagcgccagcagcgggatggcggcgatgaaggggttgatgctcaggtgcgccacgtcgccctccggcagcgtgtcgttgcccagcggccgcaccacgggcaccaggcactcccccactga

SEQ ID NO: 3745 - DNA, 192 bp, Chlorella protothecoides
cgtccctttgaggtcatcacggcgcgatccaccaagattttggtggccgtcgagtgcctcaaggccggacagaaggcgtgcacagcagacaagaatggcaacattggtaccgggaacaagggaaagaacaactttggcaacaataatgtgggcaacaacaacatcggtgagcaggatgtgggaagtagttga

SEQ ID NO: 3746 - DNA, 720 bp, Chlorella protothecoides
  modified_base (651)..(660): a, c, t, g, unknown or other
atgaaggagcgggctccgagggtctatactaaaccacttaggtcttgtgaattagacacagtccttttcgaggagcattcagtttccgagcttaagcaggggacccgggggcccaccccgctcgcaatgaccccactgcgccctcacatcctgatcagcaatgatgatggcgtcacggcccccggcctcgtgtccctcgccacgctgctgcaccaggagaacttctgcgacttcagcgtctgcggccccagcggggagcgctcggcccagagccactccatcaacatccaccaccccctgcatgccttcccaatctccgtgccaggcgcggaggaggcttgggccgtgagtggcaccccggcagactcggtcatgctggcgctctacggacccctgctcaaggtatgcgctgacgggcagactgcaaaagggggcccgagtggccaggcctgtgccacccaccaactctcccggaccccgtccttgcccagaacaacaagtttgacctggtggtctccggcatcaaccgaggcgacaactgcggcctgcacatcatctacagcgggacagtgggcgccgcgcgcgaggccgcctgcaagggcgtgccctccatcgctctctcgctggacaaccacagcgcgcgtagcgtgnnnnnnnnnnggccgcctgcaagggcgtgccctccatcgcgctctcgctggacaaccacagcgcacgtag

SEQ ID NO: 3747 - DNA, 1335 bp, Chlorella protothecoides
atgtcgcctcactccctcccagcgctgctcgcacagagtgccggcatgcgcatcgatctgacggcagtgtttgacatgaattcatccctactcatgccccattccacaccagaccagcggcttgctgaacgctcaggcacacctgtcgcccgatcagcgggaagtctgcatgaagatcgtgaagaggctgcacgaggacttcttcccggatcggaaggcgagactggtggactctgtgcgtgcctccctggagcagactgcgaatttggcagtgctggtccaggctgccgagagcagcagggaagctgtgttcatattcagctcagacgccaggcagctattgcaacagctggagacgctgatgctggggagggtgcggcaatgtcacctgaacaccatgggatgccagatgatggacaggaacacatgccagcaggaaggagcgtacacatcagcacaggcctgaaaacgctccaccccatcgaatccagcaggctgttgaagcagacatccgttgggcgactcaagcctgctcctcagtatgcaacacattgcttgcatgcatgcagcaacgactggtttcaggcccgctgcgaactccaagcactcattccagacctggcgaggaagagtgcacgcttgctgtgcctcagctcccccagtcaaactcgatctgtggccacgcccctgccacaccagccccctcgcgcctccctccagctcagcgtggagcccggcgacaccgtgcgggcggcaatcttcctgtctgacaacacggttgactgccagctggctcgggccctgcacagtgtccagtccgcgctgactgccgccaggatgcggcagggcatgtgggggagggccatcgcagccagcaggcggaaaccgcgcgctgtgcacgctgcgcacctggcgatgcaggtgaccgtgccctgcaggcccctgtcccgggccatttatgcaggcggcgctgctgccgctgacgctgacgcggcgaggcaggccaggcgtgcgaaacaggctgcgctggtccagggtgtggttgccatccatgagcagctacacaaagcgtggctggaggccaggatccgggctcagaaggagcgtctggctgcgctgcgatccaatgacatggccgcatatgtcgggctggtggctgtggcggggagctcgcagctggacaagctcctgtgccagacggatgcctgcctgagggcactcacggcccgcctgtccagcacgcgggcggtatcctctgtggggaaaggcctggagggaccaggcacggagtgcagtgagtgtggctgctggggcttcctgagaaatgtggagtga

SEQ ID NO: 3748 - DNA, 1245 bp, Chlorella protothecoides
  modified_base (900)..(909): a, c, t, g, unknown or other
atgccttgctcctccaaacaccgtgctctcttcctgtcagaactgccgcaaaatgttcactcatcacccgtgcctcaaccctgtggacccctcacagccggctgcacgtgccaggcagtgagtgcgagttgccggcttcaaacctcccggcagaactccgtctgtgcgggaaactggcggttctggaccgaattctgggcaggctcaaggccgcagggcaccggggttggggagtggcgtccggtgggctgtttggccaagaaactttggttgtgcacctgcaatttcccatatgctgtgacaatcactcactcttgcacaggtgctcatcttcagcacgatgactcgggccctggatgtgctggaggagtacctgaactggcgggggtacacgtggcagaggctggatggaaacacgggcgcacaggagcgtgatgccaagcgatgccttccgtcaatctgtggggagggggtggagtgatgatcgtaccgccaccaccagccctgcacatcaggatgccgcatgatctgtcatcagcatcactccctcaatctcattctccctttccaggctccagcacgtttgtcttcctgctcagcgtgcgggcaggaggcgtgggcctgaatctgcagagcgctgacaccgtcgtgatggtggggcaggggattggtgtggctgaaccatgcttggtcagtttgggtgggcacattggtagcccactgcattgcatgggcagaaatcgacctgcaggcccaggcccgagtgcatcggctcggccagacgaaaaaggtgtaaaatggagcggtgaaggcgacagtacttggcgcaccggtgcacagggtttttctggtcatctgcgttgtgactgtcagcatcctggccgcatgccaaactcaggnnnnnnnnnnattctggtcgtctgcgctgtgactatcagcatcctggccgcatgccaaactcaggctgctcccgcccttgatcatgcttcgagtccgcaggtgttggtcatccgcctccagactgcgggctctgtggaggagcgggtggttgacgtcgcacagagcaagaggacgtttgtggacagatccatcacctgcggattctttgacggcaagaccagcgccgcagagaggcagcgccacctcctggaattcattgctgcgtctgctgacagcagcggcatggctggcactagagacggtggcgctgagatgactgacgaagaggtgagatccatggtctga

SEQ ID NO: 3749 - DNA, 2613 bp, Chlorella protothecoides
  modified_base (100)..(109): a, c, t, g, unknown or other
  modified_base (942)..(951): a, c, t, g, unknown or other
  modified_base (1948)..(1957): a, c, t, g, unknown or other
  modified_base (2264)..(2273): a, c, t, g, unknown or other
atggctcgcaccccgagcgtgagacttttcgatctgaggggcagacacgccacacgattgcagcgatcaggggcctccccaggatgccgccctgcatacnnnnnnnnnnggcagggaagcaaggcagccatggctcgcaatccgagcgtgagacttttcgatttgagggcagacacgccacatgattgcagcgatcagggacctccccaggatgccgccctgcataccccctcccccaaacccttcctttcccacacaacacatccacccgacgcactcgtggtgcttctggatgcgggccaccaccctgtctgcggtgtccagacgcttgcgcaggtagtccttgtctgcctcattcaggctgcaccttgcctgtggtctgctgactcttatagaacacctgtctaccaaagacagaccctgtccctctgtcccgtccatgaccccccaactgcacacccacactcacccacccacccagtcaccacccctgcacaatcgatcacctaccctgaccacggtctcgttcaggttggggttggacaggatgttgtccagggccgactgcgcgtggcgccgcagcaggtccagcttggccccgatgtaggcggcgtcggtgtggcgcagccgctcctgctcgcccttgagctccagggtcttggccgcgccctcctgcaccagcgtcagcatgtcctccatctcgttcaggcgggagtagacggtgtgcatggcctcagtctggcgcagcgccgtcacgcgctcctccagcacgcggccctgcaggaagagctcggccaggccgcagtcgacgtgcacctctcgcaccacctggccgatgaagttgaaggacaggaggagggccaggagggtggccagcaggtgcagattgctcaggttggcggagcgggcacggccgcccacccaacccacgccgcccgcggnnnnnnnnnngagggccaggagggtggccagcaggtgcaggttgctcaggttggcggagcgggcgcggccgcccgcccaacccacgccgcccgcgcccagcatggccgcgcccagcatcaggcccgtggcctccgtgaactcgtagaagaagagccaggagaggagcatgatgaccaggcccagcccagcctggcccatggacaccagctggccggcggaggcccagagcgcctggcctggggaagggggtgcaggaagagggggagggatgaggggtttgagggcttgacacacaccaccgaggccctggagcgctcacttttccgaccaaagcttcctcccgacaggagcatgccgctgggattggagtgcacgcctgcgctgccgtacatggtgccggatggaggagcaagcccaggcactagagccggtgggacgctagcccagaactcggagggtatgcttcgctggcgtgtgacgaattccgcatgcgagcagaccatccatgtgacgcgcaacgagaggaaagcaggccgccatgtgaatgaacaacgaaagagaggccttggccattctgctgagcccgggccacttgctcggtttccccgttacagcatggtgcttggaggccacggccattctgctgagcccgggccacttgctcggtttccccgttacagcatggtgcttggaggcatgaaagtcctccaaaagcgaacgacccatatcttgcctgaatggaagaagctcagacttttgaactgtcatctttgtgctggatatcagaccctgcaggcttttcacaggtcgagctctgtaagtccggtgccccagttatttattcgcatgacctccttcaatcaccaagaaaccctgattccggtatatggagttccgaatttgaaaaaacttggcatattgcacttttcgatcagcagggtgcatgaattagcagtagaattattgcgaaagagtgatggagtggggcggacctgtttgagaaaannnnnnnnnnattgcacttttcgatcagcaggggcagtgctacggcatcgcgaccccctcatggcgtcgggaggtcccgaccgtgagagtggcgacgatgctagggtatggagggaggctcgaaggagcctgttagctggtgttgcgctactggcagtgctgctgctctccctcgtgcccctcacctggtgcctcccagccctctcgggacggcttcccatcataattttaagtgcccctctcaagccatgcttcctacaacgtttccccattcacgaacacacaggcagaagacttggctatactgaaaagcttcnnnnnnnnnnctggtgcctcccagccctctcggtgagattatgggggacgctcctgcccccttaccgccttgtggtgctgccagttcatgaggcagaggacttggctatactgaaaagctttcccccccgcacgttgggcacgctactggagcagcgtgaggttatcctgcgctacgcagccacctcccccaacatcgtggcggtgtgcttctgcatggcctatgtggtcatgcagagtctggccatcccagggaccctggtgctgagcgtcctggcgggggccatctatgggcactggaggggctgggctctggtctcgggtgaggagcgagatgggtgcgggatctag

SEQ ID NO: 3750 - DNA, 2343 bp, Chlorella protothecoides
  modified_base (56)..(65): a, c, t, g, unknown or other
  modified_base (1166)..(1203): a, c, t, g, unknown or other
  modified_base (2107)..(2116): a, c, t, g, unknown or other
atgctgccaatctccgctggcatgtcatgcctcgctcttaccaacctgtatagatnnnnnnnnnnacccgggcacggaaagactgatccgcgccccgaagtcacatcgggccatgctgccgatcggactccgctggcatgtcatgactcgcttttaccaacctttatagagcagatctattactgcaagacgacgctggcatcgcagtcagccctcatggcctccgcggaggctgggtccccctcctccagcggtgcccctacctgcagccctgcccgggaatcgcgcgtgcgctatgacaggggcatgcgcatttggggtgcggagggccaggacgccctggaaagggcttcggtgtgcctcctgcatgctggacctaccggggctgaagccctgaaaaacttggtgctgggaggcatccgatccttcaccgtggtggatggcgagagggtgggaccccaggacctgggcaataacttcatgattgaccaggatgccttggggcgccctagggcggaggtcgtgacaggatgccttgggccgccccagggcggaggtcgtgacaggcacgccgggccatgctggggtgccagcctcaaggagctgaacgaggccgtaggggggagttacgtggtagatgagcctgcgcagctcatctccagcaacccctccttcttccatgagtacgacctggtcatcggcgcccagaaatgtcatagtagactcacagccacgtgcccgcagtgtgccttgtttttgaatcccagatgccagcggcacccagcacaaacttacgaatccccacccaagctcctctcgcagctgcgatctagcgacgctgcagcgctggacgctgtgtgtcgcgagaggggcattcccctgatcctgggccgggcctatggcctcgtcggactcgtccaggtgaacagggtcaaatggcctcgggcccctgacccctcggatgcagtgttgggcctccttgtgccgatgggttgcctggagggacgcagtgtggccttggtcacccggaatcgtctcagcacgatgctgccagcttatcctgcttggatcctcatgcccatgcctggtcctgctgcccaccaggtgtgcgtcgctgagcactgcgtcgtcgagtccaagccagacaacacgatagaagacctgannnnnnnnnnnnnnnnnnnnnnnnnnnnnnnnnnnnnngggggggggggggggggggggggggttgaaggaccattttgccactcgttttgcggggagggacgggaagcgtgtgtctttcagcttcgcacactgccgtcgagcacaacaccacgtttctccgacaggttgaccgagccctggccagagctggcagaggctgcggcgcaagtcgatgccggcctgctggatgaccacgtcaggggtcacgtcccatatgccctcctgctcatcagggcggcggcagcctgggccgcgacgcatggtgcaccgttccctcgtacatcggcagagaaggcagacttcaaggagggcctccgatcgttgcagcgctgcatcgagggcgtccccattgagtactctcaggtgccaaaacctatacacttctcagatttcagggcacccctttatgaacctctgattggagtagttccccataatttgtgcatctccttctcgcgacgcacagaatctgacaccccctcacaggaagaaaacatcacagaggcgatcgccaatgcgcacagagtgtggtctgggagctccgctccaaagagacctccagtgtccttgaaatgcttgctggctgcagcgtctatgcatggattcaagttatcaagcagtgcgcctcgcgatcatgcctggtgggcgagactcataatcccttcaggccacccccgccgacattcaaccctcctccatgctgcctgcagccccggagctggtgcgcttgttccaggacgaagcctgccagcatctccgcgccggctcctcccccttctggatctgcgtggcggccctgagccgctttgtggcctccaatgcagcaggcgccctgcccctggaggtatattgtgtggtggggtatgccccaacaactctagagcacagtttggatggtatnnnnnnnnnnctgcccctggaggtatattgtgtggtggggcatgccccaacggctctagaacacagtttgaatggtacatatgtggcagacagcctggcctgcatggtcggtcatgcatggcttgtgagagacgcttagcgctatggaaaagctctccaacgctcgatatccaaggtcctatcccacgagcaccaattcttcctctctcctacctcgcaccagggaaacattcctga

SEQ ID NO: 3751 - DNA, 921 bp, Chlorella protothecoides
  modified_base (291)..(300): a, c, t, g, unknown or other
  modified_base (543)..(552): a, c, t, g, unknown or other
atgcctggtcctctcgtcaatcacaccatccctttccagaacctgggcctcgactgggatgagcgtgtgctgccgtccatcggcaatgaggtgctcaagtctgtggtggcgcagtaccaggccgagcagctgctgactcagcgtgacaaggtgcgactgggcatggcgatgcgggattgtgggtaccagttgtggaaccagaaatggagctgtctgtgggggcgggacagaactccagaaaggaggcagacagacccatgtgcgcctcgcgcaacccccagctcccacccnnnnnnnnnngtgcgactgggcatggcgatgcgggattgtaggtaccaggtgtggaaccagaaatgcatctgtctgtgcgggcgggacagaactccaggaatgaggcagacagacccatgtgcgcctagctcaacccccatctcccaccgtttccacctccccaggtatccaccgcggtgcgcagcgagctcacgcgccgcgccgcggagttcaacatcctcattgacgatgtggccatcacccacctgtccnnnnnnnnnngtgcggcgccctaccatgtcgtcagagacccaggcggctgcgcaaggcacatcacaatgtggagcaggggctgctgctgcccctccaggtaccagatgcctcagggaacttgtgctcaccccacccccctcaaacccaccgaatcccctccaggagcgcaaggcggcagtggtgagggcggagggagagtccgaggctgctcgcctcatttctgaggccacccgggctgcgggggctggcatgattgagctgcgccgcatcgaggccgcccgtgacgtggcggggaccctcgccaagtcccggaatgtcacgtacctgcccggcggggagggtggcgcctccaggatgttgttccagctgcctggatga

SEQ ID NO: 3752 - DNA, 453 bp, Chlorella protothecoides
  modified_base (188)..(197): a, c, t, g, unknown or other
atgttcgaccgcgtgtcgggagtgctggagactcccgtgagtgagggcacccatttccgcgtgccctacctccagacgcccaacgtcatggacatccgcacccgtccccgctccatcagctccgtgaccgggaccaagggtgaggagttttgtcggaggctaccgaggggtgcctttgccgaacctannnnnnnnnntcagctccgtgaccgggaccaaggatctccagatggtcaacatcaccctacgtgtgctttccaagccggatgtcgagagactggcactcacgttcagggtgggcgagacatgcgctggtttgggaatgggaaaggcacagccgtttccaccgtcttagggctgcagatctgcgtgtcagacgccgagtcctgcatgggaagacatgtctctgatggtccacaagccccacctttcatttctgttgttaacaactga

SEQ ID NO: 3753 - DNA, 1878 bp, Chlorella protothecoides
  modified_base (1549)..(1558): a, c, t, g, unknown or other
atgcatgcatgcagggggatgcagggcacccacactcgcttcactccgggagagaagcatcaacccgggcaggcgtcactcaccggtgtacagggaggcctgcagagcgctggcgccgattcccagtcccacggagtagcgtgcaaccttggagaggatgttggccaaggccttcgcggcctgctgctgagccatggtgacaaactcccgaggactcttctaggcgttgagccaacggcgtcacaattggggcctcccggtgcagcgtgtgggcgccgagatgacggtggctttccaccaggcgtgattcacccccacgacatcggctctaggctggggacgatcaagccttcagagcgtgccttaagctgcgggccccacactgagcttggcaatggccccatagagctgccctgcgacacggacctggcatggtacgtactctactggaactcatttggacgcctagattctgtagccccaagctgtgcatcgctcctccgcgcagggccagacccacggcaagggcccacgcacggtgtcggatggggacgggtaccccgtcccgggctccccttccccctccgccttctcccccggctcccccctgacctacagtccccagatgcccatggagcccttttcctctcgctccgaaacgcatcgctccgccatcccccaggcggagttcgagggttgggctgcccaccccagggtgccgcaattaaagggccttccctttggactccctggaccgcagggacgcatggcggtagccatgtggagctggaggggagctgggacaactggtcgcagcgccacgtcatgcaggcctccggcaaggactacaccctggtgaagctgctgacgccgggcatctaccaggtgcagcaccgagcaggctgcggggaggaaccgggggtgggcctgggtgtgggtgtgagggtgacccctgatcagccccccctcccatctcacggcccgaccggccccgtcccctgtcccttcatccccacagtacaagttcatcgagtacgtgcccgagaacctggactcgctgagcgggttcgagccgccgccctcgccgccctcgtcctacgcctcccccgcccccgcccccgaggatacggccaaggagccgccggccatgccgccccagctccagctcagcctgctcaacgtgcccccggccctggacgccatcgccgcgctgccccggccccagcacgtggtgctgaaccacctctacctccagcgcgcctccaccagcaccaacgcgctggtgctgggcgccacgcgccgctaccgcgccaagtatgtcaccgtcgtcgtgtacaagccgcggcgccggcggcggccggagggcttcggcgcggggacggggcaccccgccggcacggcggccgctgccaggcacgggcgcggaacctcggcgcccatggacgtctcctccccggccgcctcgggcgtgcaccagggggagccggcgttgcgccactcctcaggcggctactccctgcacgaccacgcctccagctaccaggtcccnnnnnnnnnnagctgcctcgggcgtgcaccagggggagccggcattgcgccacccctcaggcggctactccccgcacgaccacgcctccagctaccaggtccccggcttctgaggaggaggggcggcgaggtggcggggaggcggaccgggatgggaatcctccgactcaagggtgcagccgtgctcaggcggcggtggaggttcccctttgcagtccaggatgcgacctgacccaagccctgcctgctggcaggcaggctaggaccgcgttccaggctgcgcgctctagtgccatcgcactgagctcagtggtgaggattgtgcactga

SEQ ID NO: 3754 - DNA, 2037 bp, Chlorella protothecoides
  modified_base (743)..(752): a, c, t, g, unknown or other
  modified_base (1443)..(1452): a, c, t, g, unknown or other
atgtgcatggatccctgcgctgcctgcccgttgaacacctttcccatccgtctacccaggtgttttttttccacacagccagctgccacggcaggggctggcttgggcacggggcggcaaggagcagcctggagcgcccgacacgaagactaccagccaggagcctggggccgcccggccgacgatgcgccggcggcggcggccctccaccctggcccgggtgctactccagttccccctggagctgagctccatcctgtccaaggaggatgcgcactacctggagaagcgcgcgcggcggcggtggtggagccggcgctccttcccccgcgtccccaccgacacgctggaggtggcgcatcgcacccccccccccctggccgtctggcagaaggtgctgcccctcggcgccatcttcttcgccgcctccttcaacctcaccatcctggccaacctgaaggacgccatcatggtgaccacggcgggcgcggagacgctgccctggctggcatcctgcggcatcctccccgcctccgtcgccttcttcgtcgcctacggcaccatggtggagcgcttgccccagcgcgccgtcttctacgccgccgtggccccgctcctggccgcctatgcgctgttcgccggcgcgctctaccccgcgcacgctttcctccaccccgtgggcctgaccgccgcgctggccggggcgacgcctccgggcctgcacggcgcgctcaagatggtgnnnnnnnnnncggccttaccgccgcgctggccggggcaacgcccccgggcctgcacggcgcgctcaagatggtggagcactggaccttctcgcttttctactgtgccgcggagctctggggctccgtcgtcatctccatcctcttctggagcttggccaatgaggtctgcaccgtgaacgaggccaaggccgtgtaccccctcatgggcatcgccgccaatgtggcgctggtcatcgctgggtcctacctcaagtgggtcaacgccagcgtcgcccacggcaacacccaggtgggtggttggggaggggcgtcgtgtgatgggggagcaagcacaggaagtgggggtcccaagagcagggtccaagtggagtggagtgtgggatgggatcatgggaagggagaagcctcgacgcagtgcagcccgggccaggcaatgagctggggcagcgcgctcatgctgaatgtgctggtgggcactgtcattgccatgtctggcgtcatggccgttgccaagtttgttattgatacgtatgtggtgggtccctactgcagcctcgacgagcgctccagccccaagagcgatagccatctttcacggatgtcatgccggccagtgaaagggtcccattcgccttgggaggcctgcctcatgaaatgcactgcacaccctctgccatctccgacctcccccccgtccacnnnnnnnnnngtggtgttctggcaggatggcggccgatgtgcaagggtctgccatggtggatttgccatgctctcccggctcctattacaagctccgacctcccccccgtccacccttacccggcctttccctgcagtgctgaaggagtcgcccaaggtccggaacctggcgatgctggtggtcagctacagcgtctcccaccgcctgtttgagttcgcgtggaagggcgcgctgcgcacgctgcaccccactcccggcgcctaccagtcggtgctggccgatgtggccatcgccacaggctatgccaccatcgccctcatgctgctcagccgctacgtgtttcagtacgcgggctgggcggcggccgcagccgccacgcccaccgtcatgctcgtcaccggcggcgccttcttcggcctgtccatcgcggcgggggcggggctcacgcttggctccctggggcccctccagctggcggcgctgggggtgggcacgggggtggcaacccaggtatgtggtggggggaccctggcaagaacgggggcgggacttttggctgatcatgtgcagcatgagtgcttggaggggtgctga

SEQ ID NO: 3755 - DNA, 2802 bp, Chlorella protothecoides
  modified_base (674)..(683): a, c, t, g, unknown or other
  modified_base (1002)..(1011): a, c, t, g, unknown or other
  modified_base (1069)..(1127): a, c, t, g, unknown or other
  modified_base (1207)..(1216): a, c, t, g, unknown or other
  modified_base (1756)..(1765): a, c, t, g, unknown or other
  modified_base (2109)..(2118): a, c, t, g, unknown or other
  modified_base (2406)..(2415): a, c, t, g, unknown or other
  modified_base (2570)..(2579): a, c, t, g, unknown or other
atgtccagggcaagtgatggggggataacttctaggcatggacctgcatagtacaactttgacgtgccagaggcctttgacgaggagaccatcatcgactgcctgacagcgctcaaggctcagaggtccttcgaggtcccggagtacgacttcaacactcatactcgcagcgatcgcacgcggcgcgtgctgcctgctgacgtggtcatcatcgaaggcatcctggtgctgcacattgccagcatccgcggcatgctcaacatgaagatctacgtcgacaccgatgacgacgtccggctggctcgcaggatccagcgcgatgtcgcagacagggggcgtgacgtggcgggtgtgatcgagcagtacacaaagtttgtgaagcccgccttcgacacctacgtggccccctcccggaagcatgctgatgtcatcattccctgggcacggggggacaatgcagtggccatcgacctcatcacagagcacatccgcatgaagctgcagcagcatgatctcagacggatctacaccaacctagagatcatccccagcaactaccaggtggctgactggaggttggcaggtgcctggacttgcttggttcctgaatctgatgagtatctgcctgcaaacttgatgagccatgactggccaggactgatggggcggtgttnnnnnnnnnnggtggagagggagatgggatgctcagagaggtgggggggtgcttggcaggtgtctaagcagctgactggaggtaggcaggtgcctggacttgcttggtccctggtttttgatgagtatctgcctgcaaacttgacgagccaggactggccaggactgatggggcggtggcttgtgcggttcgcgctacctcctggctgcacgtcgcagttcctcttacagagtaccgaggcctcccccactgcagatccgtggcatgcacaccatcatcagggatgagcggcaggaagggtgctcagatcatgtgccgctgcctgctcnnnnnnnnnntgcggttcgcgctacctcctggctgcacgttgcagttcctcttacaaagcaccgaaannnnnnnnnnnnnnnnnnnnnnnnnnnnnnnnnnnnnnnnnnnnnnnnnnnnnnnnnnnccaggtcgtgtgtttgcctgaggcaggagcagcaggaagggacgtgcactctgctccaggcagctgcgcctctctctcannnnnnnnnntcagccgtccagccctctggctcaatgatttgaggacgtgcgctctgctccaggcagctgcgcctccctctctctccagccagcacagcctccactctagcccgcatatcataccctcatgctccccccggcccaacccaccctcacctccctcccaggtggtggaggcggggctgggccaccttcccttccaggagatgacggtgatcacccccaccggccacccctacgtcggcgtggactttgccaagaagctgtgcggcgtgtccatcatccggtcgggggagagcatggagcccgcgctgcgcgcctgctgcaagggcatcaagatcggcaagatcctggtgcaccgcgagaagacgtggtcggcggtgccgcgccgcgcctcggccggcgccggcttcgcccaccgctccagcgcctccagccccgacctgggggcggcgggggagggatcggcggccgtgcccgccggacccgccgggcgcagctcgcccgccgcgcccgtcgcgcctccctcctgcatcgcccccccctctnnnnnnnnnngggcgcagctcgcccgccgcgcccgtcgcgtctctctcctgcatcgaccccccctcccccgccggcccggcgccgccgcgccactctgccgacagcgagcttggggtgcgggcggcggtggagcgcgagatcgtgtacgagaagctgcccaccgacatcgccgagcgctatgtgctgctgatggaccccatcctagcgtccgggtactctgcccagcgcgccatccagggcgtgcatcgcatctgccgcgccttcccccgcctcaagctggtgaccagcgagatcgacgagggactggaggccttcgccgtgatcccgggcgcgggcaggcggcggcacagaannnnnnnnnncaagctggtgaccagcgagatcgacgaggggctggaggccttcgccgtgatcccaggtgttggcgagtttggcgaccgctacttctgcgactgaggctcgggcaggcgccggcacagaaccccctgaagcttgttctcctggtcgctgcaccaggtcatcgtgatacgaggatgcaccgcatacctccttcgaaaatgccatgtgatgatgatgcgtgtgaatctccagcccatgatgcgcccttgaaaggggaagtgcgcgaaccggacgtggcgcggaatcacatnnnnnnnnnngaatctccagcccatgatgcgcccttgaaaaaggacgtgcgcgaaccggacgtggcgcggaatcaaatcacaccctccggccacgacacatgcagaccacgacacccgggccaccccccgaaacaatgtgtttgggaccccataccattgcgcannnnnnnnnncatgcagaccacgacacccgggccaccccctgaagcaatacgtttgggaccctataccattgcgctaagcagtatgcattcatgtcagcacaatgacgagatcgggtcctgtctaggcgttggcgccgtgagatcaaggcgcagggtttcatgcagagagacgagcagtgagcggaagcacagcgtcttggcaaaggaaattacccccgtccaggccccatga

SEQ ID NO: 3756 - DNA, 663 bp, Chlorella protothecoides
  modified_base (521)..(530): a, c, t, g, unknown or other
atgaattacccactccagggagccatcgcaaagctgtttgaccctctggttgcgaggctcgcccccgcctaccaggcggctgttggcaacgagttgcggaaggtgggactgcggtacgaggacctgtacgaccctgagttcgacttggtgagtgatcagagggtctgggtcttaggctgtgaggaggacactcaacagtcccaacccctctatctcctgcatgcccgcactggtgttccagtgcctgcgctcgtcctcaccatcctctccggcataccctgcgaccttcaggacaccgccgaggctctgcgccgcctctcccccgatgaggtgcatgcccgcaaccagcggttgaagcgtggcatggacatgtcgatgaagcacagtgagctgccgcacgagatccaggagcagcagacgcccttcaacttctacctggatgagaccctggcccaggtcaaggccgaaaacgaggagaggaagcagctgggcagcggccggccattggtgattagagatcnnnnnnnnnnaggggtggtgcctggaagaatgcgctgggtcactcgtcatgtagatcaaagagctgatgcagattggcgatcagagatgggtagaaatgatggagatgagtgtacactggttttgttgttggaagctggctag

SEQ ID NO: 3757 - DNA, 207 bp, Chlorella protothecoides
atggagccggcgctgcgcgcctgctgcaagggcatcaagatcggcaagatcctcatccacagggtgggcgaccatgttctgcagcaggacaccatctacgagaagcttcccgcggacattgcggatcgctatgtgctgctcatggatcccatcgtgggaacgggagagactgcggtgaaggccgttcaggtggggttgggagcttga

SEQ ID NO: 3758 - DNA, 405 bp, Chlorella protothecoides
atgcagcagatggaccccctctttggtgccctggcggcactgccctgggtcgtggaggtggaccccgagaaagcgcggcatgtgcagaccaccgtcctggactccctggagggagatggactgctgcaggcgtgcatcatggcttctccccctgtgccctgtgtctggctgtgcggccacgaccacatgctccgtcctgtccaccaaatgaaaccccacatcatcccaacgaccgcaggctgggacgtccgcggcgcggtgcacaagatctgggcgggcgcgcgcgactacaaggcgctgcgcgtcggcgtggacccggggtcctgcgacgcgatcaaggccgtgctggagcacaccaggcggtacgacgagcagtacggccacaaggtgtaccacccgcaatga

SEQ ID NO: 3759 - DNA, 393 bp, Chlorella protothecoides
atggtgtacattgagatgacgccggaggagaagtccaagggcaaggcggccgtggacctgctgggcagccagatcggaaagagcggcggggcctggatcacgcagggcctgatcctggtatcggggtccatcacagccagcctccccctcatctccgccgtcttcctggcaacgctgacgacctggctgggcgcggtgcgcagcctggcccggcagatcgcagactacgaggccgagaagcaggcgcgggaggaggcgggggacccctcggcgggcaccgggggggagcatgcgcggaccaccccgccgcctggcccgcagcaaccgagtccgccgcccggcaacggcgcacatgcagacgcgccgaccgcccgcaggcccctggcggcgtga

SEQ ID NO: 3760 - DNA, 594 bp, Chlorella protothecoides
atggctgccttgcttccctgcctaccccgcacgccctatgcacccgctgcctctgcgcctgcagctttgcatccacctccaccactccccacgccccacggggcccccccctcaagcaaacccattctccccatcccaccggaggacggccaggacatcaccttcgaggagtacaacgagctgctgagcgcgctgacggacgccagcgtcttcgccgacaagcacggcgacggcgatctggtgcaggcccgggccgagctgcccaacatggcgggggcgctgaagcggcggcgcgatgatgagtaccacaacctgctccccggctcggcccacaaggacctggagcggataaacgcgcggcgcgcgcgctcgcgcgccgagtgggagcgccagctgacccagatcctggacgcgcaggcgcgggcgggggcgggtggcgccgacatgggcacccagctggcggagcattgcgtgcgagagtcgcgggggcatgcgatcaccatggcggcaggcctgctggcggtggccgtgcagctggcctccgcctacgtggcgctgtccctcagcatgcgcctgcccctcaagggcgactag

SEQ ID NO: 3761 - DNA, 612 bp, Chlorella protothecoides
atgcccagaatgtggttcctgggtggagagattgagggaagcggggaggaggggtctcgggccggggatgcgggagtggcccgaggccaggatggcggtctgggtgtcggcgtccagcaccgcatcggacgacagcatgaacaccaggtccaggggtgtcatggcctgatccgcggtcttggaggtcaggtccagcgcgcctttgatgatgcccacctcgtcggagctgagctggccgccaaaggtctggccctcgtggtggatgtccaccagcgccttgagctgcgcgcgcttgaacagcgcggtgcggtgcgcgcccagcaggcggtccagcacccagccgatgggccaggccaggggcgcgcagaggaacatgaagacgtggacgaagggcgcggcggcggccccggcctccagcccgtagctggagcacaccgcctgcgggatgatctcgccgaagatgagcaccaccgtgacggagacgatcacggcggtgacggggttggccagccggtccagaagcagtgtcaccagcaggcggtgcgggttgcgcagcagcggcataatggccgcggcggaggcctgctgggagggtgtccccgttctccgtag

SEQ ID NO: 3762 - DNA, 606 bp, Chlorella protothecoides
atgaaggtggtggacgtgccagagtacgacttcaccaggcatcgacgcaccgagacgccgcgacgagtcccccccgccgacgtgatcatcattgagggcatcctggtgctgcacatggagggggtgcggggcttgctcaacatgaagatctttgtggacaccgacgatgacgtggctgaggctgtgggggggggatgggaggccgggggcgggaagcttctcaggaaacagacttgctgctgctgggactccccccctgccctcctcatgtctgcgggtgggcaagctccccagaacaccctcgccgcctgcaggatccagcgcgacattagctgtcggggccgggacgtggcgggtgtgctgcaccagtacacccgcttcgtcaagccagccttccagcagtttgtggcgcccagccggaagcacgccgacatcatagtcccctggacagggtgcggaccagctgcctgggcactgctcagggtgggggcgtgttttctggctgcaggggcggccgccgcggcctcgggagaagggagagacagaaatcgcgcaccatcaaccctctgccgggctatgccggcctcatccatccccatcgcctga

SEQ ID NO: 3763 - DNA, 246 bp, Chlorella protothecoides
atgacacgcaactgcatgatgcatcggggccacagtgctcgaaaggccccggtactgctgaacaagggggtacaggaggaccacattctgttcctgtcgctcatcgccgcgccagaggctgtgcaccgcgtctgccgcgctttcccgaaactcaagctgatcaccagcgagattgacgagggcttggaggcgtaccgggttatccccggcgtcggcgagtttggcgaccggtatttctgtgactga

SEQ ID NO: 3764 - DNA, 561 bp, Chlorella protothecoides
atgtcccttgccagagtcattcggtgccccgccctgcacccagacggcctgccagtgaggacagaaccagaaaaaggagggacagacgcgttgcgtcaggcgctggccagtgaggacgccacagcgagcacggctgcgttctcggtgctggtacctgctgcggatagatactacaggacacatcagcgcttccctggatcgctgcagggcagcgaggtccctgagggcgaggtctcgcagctgcatgccatcgcacagggcctcctggccgagtcggggatctccggcgtccacctgcccgaggatgccaccacggaactcgtgcgatggggcggggtggagctgcactgcgtggcggccatcattggctccatcgccagccaggaggccattaagctgctgacggggcagtttgtgccgctggcgggcactctgttttatagtacgggcagacttccaggagttgtgggtcgtgcaggggaggtcagtcctggcagtggattgcagtgcacgcaggtaggactggacgcgcgcgccaaagccggtattgcctctgcatga

SEQ ID NO: 3765 - DNA, 1230 bp, Chlorella protothecoides
ccgcgccggggcccggccgcggcgctggagcacgaccgggaggcgctgcagggcgccctgagccggcacctcctggactcctacgccgagcacctgcaccagcgggccatgctggcggaggaggcggggcgggccgaggagggcgaggcgctgcgggcgcgggcggggcgcgtcgtcgcgccctgccacgacttcctcccgccctaccccgaggccgtgccggaggtgccgctggccgacctgccaccgcgccccgactcgctccccgccacgccttcggcgcggggccgggcggcggctccctgcgagaccccggagagcgccctgcagcagcgcctgctgggcagcagggccatgccctccacctctggtgagaaatggagcagggggagattggagggattgctgcggcgtcgaagctggccccgcagaccagccttgtccaaggtagctgcccaccacgtccgtctccagcctactgagcctgcacatacctcccctcatcccctcgcaggcaggccgccagtgtatcctgcctcggcccggcagccgcaggccgtccgccagcgcaggctgtccttcagcctggccgccgacgccggcgcttcggcgctggaccgcctgcatgccgaggtccagggcgcggcgagcgcggcgggtggggaggggtcccgcggcgcgatgcgcccggcacggcccgacgccggcgccctggagcccctgctccccggggactcggacttcgagcccctggccggcggcatcctggctgccgacgactttgacgcggccctggccgccgccgaggggcgcgtggtgagcctgagcacgctgcgccgcctgtcccggaacgaggacgcgcagcggcggctgagcggcgccgaggcggtggcggcgcgcgaggcctctgccgttctggccgcgctgcccaggaccttcagccgcctccagcgcgtgtttggcacggcggggccgcgcgcgctgacgcgcgaagcggtgctggccaagctgcgcggcggcgcgggcgccgggacggacgccgagctggaggccgggatccgggccttggcggagcacgcgcccgattacgtccagctgaagccctacggcgcgtgcggcacgcccgcggtctgggtggaccgcggcgccgatgcgcgcgcggtcatgggccgcctgatggcgctggcggaggggcggcatgccgcgagggagccgctcctgccccagccg

SEQ ID NO: 3766 - DNA, 897 bp, Chlorella protothecoides
atggcgcccaaggcccgcgaagtcgacgacgacgacccagcctccgccgcgctctcccccgggcgcctggccaagcgcgaggccgtgctgtcgcggctggagggcgccccgcccccgctggccgcccgcctgcaggcggtggaccagggggttgagagggtggcgcagggggccggggccgcgctgtcctccctgtggggctggggcgcgggcctcgcccggcacgtggagcaggcggtggatggcgaagcagcgggggccgacgcggggaaggccgagccgcgccagccctccgccgcgccctcggcggccggcctgctgggcgcgctgcgcgccactgccgcacagctggtggccgaggcggtgggccccgggggggactctgccgacgagggcgccggcgtgaggccgaggtccggaggcgcccgcgaggccctgaccctggaccagagcctgtacgtctacggcggcagccaggcgcgggaggagctgcaggagctgggcgccgagtgctcacggctcggacaccgagcctgcgccgcagagcaggaccccgtgcgccgcgctgcgctggaggacgcgctgcgcacgctggccgaggcgctggggagtctggatgagggagcaggagcgggtgttggaggtgccgaagcgggcggcgatgcgggggcgaggggaagcgaggagctcgcgagggacggcgcggcttcgacccagccaacggagtcgcagtgggccccgcccccacgcagcgcggcgctggagcgggggcacgcggtggtgcgcgatgtcgccgaggaggcggtggaaagcgcggagtcgctggggtccagggccgacgtcctgcctgcaggtgggtttttcccgtccctttgccaaaggggaaaaggggtgtag

SEQ ID NO: 3767 - DNA, 2874 bp, Chlorella protothecoides
  modified_base (71)..(80): a, c, t, g, unknown or other
atggtaccccgctccccgcctgcctcccacaccctttccgcgccgcgccgcagccccccgccggctcgccnnnnnnnnnnccgctcaagatggtaccccgctccccgcctccctcccacaccccctccgcgccgcgccgcagccccccgccggcaaggtggcggggcctcacttgggcacgcgcacgatggaggcgcgctcgagcatggcggggccgggcaccatggacccgcccacgccggggatgccgcccgaggtcttgccgcccatggacacgcgctgctgtgcggagccgcgtgccagcgagacgcgggacatggagttcttgttgatgccgacgccggcggaggtgcccatggcctccccgcgctggccgtagaaggtggagaagaagccgccgttgcggaagccctcctcgttcaggacgtagaacagggcccacttgagggggtccaggcccatgtaccaaatggcagaccagatccaggccacgatgacgtagcccaggcagccgatgacagaggcggtgaaggcggactcggtgccctccagcggcaccgcgcgcttgttccagaaggggttgtggttgccggaggacatggtgcagaagacgcagtcctccaggttggtgctcggctcctcgtacccgttgaacccaaaggcggcgatcagggtggacgcgacctgggccacgaagaaggccacgtacgtgagcagccccgcgcgcgacagcagcgagtactccacgcagcggacgacaaacaccagcgcctgcccggacacagacacctgtggggatacgagagagggaaactctcatggggccctcatcgtgcggggctggcaaggacgagcctcgcacacaaggcctgggggatcgtctcacaagatccccctgtcagaagacgcgagtggggcccccacccacacccattccccaccacgacaagggggcccccagaaaccaaaccccacccgccctcagcccacctggaggtagaggagggagcgcatcatggcgccgcgcacgtatctctgctcggcgatgcactggttcaggacgtcgtactggtcgcagctggcgcccagctgctcggcgtagctgggcacggtgcacagggtggcgcccggggtggcacccgcggcagggatggcgaagctggtgcagaagttggtcagcgactcctcggtgacgttcaggctgacgagcttggtcttgttctcgaagaagtcgaggtgggtggcgacgtagtagagcacccaggaggacagggtgaggtacaggccgtacacgatgcccgaggtgaagatggagggcaggttccagcggttgggcaggcgggacggggtcacgcggtccttggacagcgcgatcatggcgccgtcgttgaacacggccagcaggacgatgaggatggtggggaagtaccagtcgtagatgacggtgagcaggccaaaggtgaagcagatgcggaaggtcatggccacggtgtagcgcgagtaggtggtcatgcgctggaagatcttgcgcgcgccgatgatggcgcccacaatggtgtacagccccggctcggtgagcacgatgtcagccgcgccgcgcgccgcatcggtggcccccgccaccgcgatgcccacgtcggccttcttcagcgcgggcgcgtcgttcacgccgtcgcccgtcatgccgcacatgtgcttgcgctcctgcagcaccttgacaatcatgaacttgtgctcggggtagacctccgcgaagccgtcggcgttctcgatcaggtcctccaccgaggcgtggccctccaccaggccgatgccctgcttcgccttcagcagcgcctcggtggtgaacatgttggtgcccatgcccagctgcttggccgtctccttgccgatcagcagctggtcaccggtgatcatcttcacgtggatgcccatctccaggcaccgctcgatggtgtccttggtgtcgtggcggggggggtcgaacagcgggaccaggcccaccatcacccaggtggggtcgccctcgtgcccctccgcgcgcgcgatgcccagcgcgcggaagccgcggttggcgtactccacgatcttgtcgtggcagacagactcgatctccgcgcggttgtgcgcgaagcggaccaccacctggggcgcgcccttcatcacgcgcatcttctcccctgtcttcacgtccgtcacgctcgcgatggtgatcttgtcggtggggttgaagggcacaaacttggccagcttgtactcgctccacagcgtgtcgcgctcggggtaggactcgtgcaacaccatgtcgatgggctcctcggtcacgatgttggcagacagcgcgccgaacttgagcacatcctcgatgctgtgcccggacatgttgtaggtgttcacgtggtccacagtcagcttgttcagggtgagcgtgccagtcttgtcggagcacaggatgtccatgcccgccatctcctccaccgccgacatgcgcgacacgatggcaccctcgcgcgccagcttgaaggcgcccagggccagggtgaccgacagcacggtgggcatagcgatggggatgcctcccacgatgatcaccagcatgttggtcagggtggggcagttgcctgcggggtgggggtgccaggaagcagagtatgcaggcaggttggggctgaggcagggacccgcagcggagccggagatcaagtgacgagggacagcgtaggagatagcgacgcggggcatggcagaatgagaggaactcggaacatggaacgcagagtagcagggggctcggagagcacagggatcagggttgaagaaggttctacagggggggcgggcgactgtgcgcaccactcccttcaagcctgttga

SEQ ID NO: 3768 - DNA, 279 bp, Chlorella protothecoides
atgaccaacacggatgacatcaaggcggcagacatgtcggaggagcggggcagcgagccggtgaaggagggagaccatgttgcctggaagtggggtgcaggcatggtggagggccatgttgccgagacttccaccgagaagttggtgaaggagaccaagccaggcaccaacatcacccggaacggcaccgaggacaacccagcggtgtacatcgagcgggagggtaacaacgttgtgaagaagcagagcgagctgtacaaggtgcatgacgagaagtag

SEQ ID NO: 3769 - DNA, 1854 bp, Chlorella protothecoides
  modified_base (95)..(104): a, c, t, g, unknown or other
  modified_base (542)..(551): a, c, t, g, unknown or other
  modified_base (1007)..(1016): a, c, t, g, unknown or other
  modified_base (1573)..(1582): a, c, t, g, unknown or other
atggatgtcatggtaggagggcaccagtgcttgcgatttcttcgcaccgctccatcggtgggcacaaggtgcgagcatgaaacctcatgcgctcnnnnnnnnnnccatccgctccgcggcgacttgagccatggggggatgggccgccgtgcggctcgctcaatcctcacatcagggaccatcgggtcctctgccatcaccgagccatcgaccagccctcccagcctctcctatccaggtgtgaaagccaacggcctacagctggctgatttcgagggattgcggggcgtccaggccacccagcccatccaatccggcgacacgctcgtcaatgtgctgggcccagctgcaatccgcgtcctccccgaagacagctgtccctgcaccaactttgttcgaccagacttttggaagcaggcgccatggcaagtcgagacctggttatctggtacccggaatatatttgtgactgcagatgggctctgtaagatattcggcttgttctacgttgctcgactgacgcacggctgcagttctcccgnnnnnnnnnncgagacctggttatctggtacccggaatatgattgtgactgcagatgggctctgtaggatattcggcttgttctgcattgctcaactgacgcacggctgcagttctccgcgccctcgcccctcccctgccccaggtatgccaaggctggggtgctcctcctcgcggagaggtcaggacagctgccagccacccacacggcatacctccgcctcctcccggagtctctggacacccctgtcctgtggactgactctgagctggacttgctggcccacccacctgtgcaagaaaaggtgcttgctccatggtctgtgcggtgagagtggcatcacctgcttcccaggtcggtctacacttccatgtatgatcctgcagccccaacatcatcggtgcacctgcagcacacattggagtgccccgacgcttcccatcacgcgcccgctgccgctcaaacnnnnnnnnnnaggtgcttgctccatggtctgtgcgcacacattggagtttcccgacgcttcccatcacgcgcccactgccgctcaaatcacccccatgcagatcaagcagcagcggagggagtgggcagacctgtacacggccttctcggaggcctactgtggcccctcccccgcccctgacaagcagacattcctctgggcgctgcagtgcgtccgatccagggccttcagtggcccccaccccgggccgcccatccagcagcggctcgcgtcaggggccgcgctgtgcacgctgggagctgcctatgtcgtctgggcgcatgtcccgctcgagagcgcgctgaacgccgccatcgcagccgccctgttcaacctgctgtacgacgtgctcctgtcggggcgccggcgctggtacgcgctcctgcccggggtggactccatcaatcacagcagccacgtggaggtgcgggcgtttgatcctgggtgccttgtggggccatgtgctcctgccgggtgggctctggaccccaagctccaggcgccacctcatgtgttccagcataggnnnnnnnnnntggggccatgtgctcctgccgggtgggctccagaccccaagctccaggcaccagctcatgtgttccagcatagaaacgatcaccttgccccaccacagagtgatgttgcctaccgcgtgtttggggacagctttgagcttacgacgggctcctcattccagccaggggagcaggtcttcatctcctatgtacgtgggcggtttggggtggtagaggaagtgggggacatgcttgctggtcacacatggccccctgcggtccaacattcataa

SEQ ID NO: 3770 - DNA, 1617 bp, Chlorella protothecoides
atgctggtgatcatcgtgggaggcatccccatcgctatgcccaccgtgctgtcggtcaccctggccctgggcgccttcaagctggcgcgcgagggtgccatcgtgtcgcgcatgtcggcggtggaggagatggcgggcatggacatcctgtgctccgacaagactggcacgctcaccctgaacaagctgactgtggaccacgtgaacacctacaacatgtccgggcacagcatcgaggatgtgctcaagttcggcgcgctgtctgccaacatcgtgaccgaggagcccatcgacatggtgttgcacgagtcctaccccgagcgcgacacgctgtggagcgagtacaagctggccaagtttgtgcccttcaaccccaccgacaagatcaccatcgcgagcgtgacggacgtgaagacaggggagaagatgcgcgtgatgaagggcgcgccccaggtggtggtccgcttcgcgcacaaccgcgcggagatcgagtctgtctgccacgacaagatcgtggagtacgccaaccgcggcttccgcgcgctgggcatcgcgcgcgcggaggggcacgagggcgaccccacctgggtgatggtgggcctggtcccgctgttcgaccccccccgccacgacaccaaggacaccatcgagcggtgcctggagatgggcatccacgtgaagatgatcaccggtgaccagctgctgatcggcaaggagacggccaagcagctgggcatgggcaccaacatgttcaccaccgaggcgctgctgaaggcgaagcagggcatcggcctggtggagggccacgcctcggtggaggacctgatcgagaacgccgacggcttcgcggaggtctaccccgagcacaagttcatgattgtcaaggtgctgcaggagcgcaagcacatgtgcggcatgacgggcgacggcgtgaacgacgcgcccgcgctgaagaaggccgacgtgggcatcgcggtggcgggggccaccgatgcggcgcgcggcgcggctgacatcgtgctcaccgagccggggctgtacaccattgtgggcgccatcatcggcgcgcgcaagatcttccagcgcatgaccacctactcgcgctacaccgtggccatgaccttccgcatctgcttcacctttggcctgctcaccgtcatctacgactggtacttccccaccatcctcatcgtcctgctggccgtgttcaacgacggcgccatgatcgcgctgtccaaggaccgcgtgaccccgtcccgcctgcccaaccgctggaacctgccctccatcttcacctcgggcatcgtgtacggcctgtacctcaccctgtcctcctgggtgctctactacgtcgccacccacctcgacttcttcgagaacaagaccaagctcgtcagcctgaacgtcaccgaggagtcgctgaccaacttctgcaccagcttcgccatccctgccgcgggtgccaccccgggcgccaccctgtgcaccgtgcccagctacgccgagcagctgggcgccagctgcgaccagtacgacgtcctgaaccagtgcatcgccgagcagagatacgtgcgcggcgccatgatgcgctccctcctctacctccaggtgggctga

SEQ ID NO: 3771 - DNA, 609 bp, Chlorella protothecoides
atgagagcgctggtgtttgtcgtccgctgcgtggagtactcgctgctgtcgcgcgcggggctgctcacgtacgtggccttcttcgtggcccaggtcgcgtccaccctgatcgccgcctttgggttcaacgggtacgaggagccgagcaccaacctggaggactgcgtcttctgcaccatgtcctccggcaaccacaaccccttctggaacaagcgcgcggtgccgctggagggcaccgagtccgccttcaccgcctctgtcatcggctgcctgggctacgtcatcgtggcctggatctggtctgccatttggtacatgggcctggaccccctcaagtgggccctgttctacgtcctgaacgaggagggcttccgcaacggcggcttcttctccaccttctacggccagcgcggggaggccatgggcacctccgccggcgtcggcatcaacaagaactccatgtcccgcgtctcgctggcacgcggctccgcacagcagcgcgtgtccatgggcggcaagacctcgggcggcatccccggcgtgggcgggtccatggtgcccggccccgccatgctcgagcgcgcctccatcgtgcgcgtgcccaagtga

SEQ ID NO: 3772 - DNA, 657 bp, Chlorella protothecoides
ggaggtgaaccccaccctggggcccgcagccatctccatccagtaagggatggcgtgcagggaagggctggaaagatatacaagggcttcacgttgttgacggaccaatcagcttgtggtcgaggctgtctgtggagactgtgcagcaggcctgccgaccacccacccccaagcaacaactcagtgcaattcactgtccttcccttctcccacaggctgcagcaggccccacagtacacgaccacagtgaaaattgcatccaaggacaagaccttgatcagcgtctcgccctcatctgtgaccttcactgccagcaactggagcacgccgcagtatgtctacctgaccgcagtggatactattcctgaaacggaatcagccgagtcttttgagctgagcctcacatggcccacggtgtcttccagtggagtgcatggatcgcggaccaagacgatcacgggtattgtgcggagcgacgtgcaagggacgagcttcttcaatccagtggttgtggacagccttccgtttgcggttgaggaaagcatctcggtgaggggacctggagtggagaccaggacattgcatggatggggtgcacctgtgcgtttgggcgcgggccggtggcaatgcttgcaacgaggcacagtcccatgctga

SEQ ID NO: 3773 - DNA, 1644 bp, Chlorella protothecoides
atggccaagacaaaggcagcggtcaagcccgccgtcaaggccgccaaggccgaggcagagaacctgagcaagaagaagcagggatccaagaagaaggtgtgtgcgggggaaggcaatccaagcggggcctgccacctctcgcgagcggcatgcccctcgaccccgcacacctgccccggcggtgcatgcatatgctgcatcagtcgaaccccgccacaaccgccgccggccgtcatccccccgaaggtgcccgagcccgagtcttcctccgaggagagcagctcagacgaggaggtcgccgctgtcgttgagtccagcagctccgaggagtcgagcgatgaggagcccgccgtgcctgccaagaaggcggctgcctccaagaaggcgcccgcaaaggtcagcggcgtgctttacgagtggggaatttccatccatggaggcctttgcctggcccgcagagttgtcgcactgctcttaaaggccgagtcctcttccgaggaggaggagtcctcttccgaagaggaggaggaggaggtgaaggccgcgcctgccgccgccaaggccgagtccgagtccgaggaggagtctgatgaggacgagtccgaggaggagtccgaggaggagaagcccgcggccgccaaggccgaggagtcttccgaggaggagtctgacgatgaggaggagtcctctgaggaggaggcggaggcggcacccgccaagggcaccaagcgcgcctccaacggcaaggccaaggcagagtcctccgacgacgaggaggaggaggaggaggagtctgacgaggaggagtctgacgacgaggaggaggcccccgccgccgcgccgacgcccgcgcccaagaagcagaaggccgccgacggcagtgccgtggatgcgtccgcggccaacggctccaagaccatcttcatcaagaacctgccctgggccgcggacgaggacgcgctgcgcgagttcttcgccgaggccggccccatcgccgaggtgcgcatcgcctacgaccgcgagaccgggagggcgcgcggcttcgcgcacctgtcctttgagaccgtggagggcgcggccaaggccatcaccctgtccggccaggagctggcagggcgcgaggtctacatcgagtccaccaccgagcgcgagcaacgtgcgtggcgttttggaaggggtcgagggatgggggtcggtgcttgcccgacgagggggtgggaaggcgggtgtttcaccatgaacacgctcagttcgcctccctgctgtggtctgccttgcgctgcgtggcatctcccccccgcccttgtttggtcctccccccctgtctacctcacacctggtctctcgaggtctggtcaccgctcctcccatggcctgcgagtccccgccccttgctcccccccctccactctgctccatctcctggccagagcaccctccccgccgcccctcctcgggacgccctttcttcccttgcaccaccacccatgcgacggggtggggccgcgtgtgccacgcgccccgcccactgccatatccaaggggtgctgccttccccatcagcacacagcccttcaggaacgtcgcacactgatgggccccggtcgcaggctttccagcctcccgggcgcccccgcatgctga

SEQ ID NO: 3774 - DNA, 486 bp, Chlorella protothecoides
atggacaggctttcaaccatcttccagcccacccacccaccgcctcaacaccccacctgcccccccttccacctgttccttacaggcactcccggacaggaccgcttcgccgccagcgagggccagaccctcttcgtcaagggcttcgactccagcctgggcgaggacgacgtgcgcgccgcgctgaccgaggcctttggcgcctacggcgaggtcaccaacgtgcgcctgcccaccgaccgcgagaccggttccatgcgcggcatcggcttcgtggagttctccacctccgaggccaagaacgccgccatcgagctggatggcgctgaggtggctggcggctggctcaagctggacctcaacccctcctccggcggcggcggccgcggtgggcgtggcggcgaccgtggtgggcgcggcggtggccgtggcttcggtggcggccgtggatttggcggcgggcgcggcggccgtgacggcggccgc

SEQ ID NO: 3775 - DNA, 552 bp, Chlorella protothecoides
atgtgcacctgctcgggtgaaggcagcccctcgcagccatgcttgttaacggggggtggggagggtttcgcgcgggtgatggaccccactctttccctcgatctcgggcatggctccaagtgctggggtgaggcgcggtgtggccacagcttcatggtccattcctcgctttccaatgccacaaacccaatgcctttcactcccaagatcgcggcggtggacgtggagtcgggcgtgcagcaccgccgcggctgcaactgcaagaagtccggctgcatcaagaagtactgcgagtgcttccaggcgggcatcgcctgtggcgagcattgcaagtgcgaggggtgcaagaactgcgtggacaacccgctccgagccgccgcggggagccagaagcggggccgcacctcgggcccggcgcggcagggcgccgagagcgagcccggcctgtccggcgccacgctggacagcggcagtggcgtggacgaggggctgggccaggcggcgcgccccgggtcgacgggcgcagcgccggcggctgcggcgggcgggggc

SEQ ID NO: 3776 - DNA, 954 bp, Chlorella protothecoides
atgcccgagccttcgaggtacgaaaccctcagtattgagcaaaagggtgcatatgcatatccatccaaccatgagctggataccccggagctccctagcacacccactgcgcccctagcgcgacctcgagcggtgtcctgcagaactcgaaccggtgaggcgcaagatgtccagctgcatctggcgtgggtgcactccgtggctggtttggagttaggggaatggaagctgctagatccacaccgaacactcacttgtgcatctcagaatgcggctcgaggtgactctcccattcacactagattcctcgcggtgcgtggcaggctcagtgtaaatggtgtcgtttggcaagtggagtgcgatatagcgccagatccacttcccaaaacatcccccaccctcacacctttctcccaggttggggactggggccgggatggcaaacacaaccagtccctggtggcatcagccatggctctcaaggcagctactttacagccagacttcatcgtctccaccggcgacaagtgcgtgcagggcggcattctcgtccaaggcttttaccagagcggtttagtctggccagaggacccgcagttcaatacctccttcattgacatttactcccagcctagcctccagctaccctggtatgcggtgctggggaaccatgactatggagagctgaaggacgacgcccagccggacgaccagccgccagtgtgctccagcctggacagcgaatcatgctactactcgcccctgcatcaggacgtctgggggtctcagtggcatcccaggcgtctcttttgcaatgcatgctgcctggtctcggccgtcagccccatgcatttccagcactcggtgcgaaactcgttgagctcaagccatccactgcttcctctcacagctgagccagcggctggtcgccagggactggcgatggcggtgtga

SEQ ID NO: 3777 - DNA, 1047 bp, Chlorella protothecoides
atgccaagccatctaggaagcttgcacgcagcagtcgcagcatggcgctcaagtttccgaaaggtcgtcacttctccttacggtaacctccaacctctaacagggaatccaaggcttccattggaaaccatcctgttgctccctggtcttgccgtatactcagccaagaatggtgcgagatcgaagcagcagttgcgcacacatggtgtccctccgcctcctgacctcggccaccatggccccatgacgtccagtccagatggccaggaggcagcaaatcccttggagcgtggacgccaggtgtccaccttctacagcagcgtcgtcgccggggaacctcctgcctcgagcgcggccccggcaacccaaagccacgatcctctccctgtgcagccaaccggcgtactccatcctggagatgcgccaaagcctacagcaaagcggggcgtgtttcgcccaggcggcgtgctgacagatgtcttcacctccccgtccatcgactctggcgccttcactcctcacaacccgcagccccgcgcgctcgcagccggggctgccatccccagctcgaacatcgggcacaggctgctcaaggccgctggctggaaggaggggcaggggctgggtgccccccaaaccactggtcggcgacgtgtacggtggagcgggggagggcgggggaggcgggaggaaggcggggccccaggctgcccgacccctgcctggggacccccttgccggcgaggaccgggataccagggtcaaacgcgtcaagcaggtgcatgggtccaggggttgcgttgctcggcggtgctggaagctccgaggatggcgcctgcagagagccacgggcctccctccacaccagccccctctctcacttctcctggtcaggtgatgcgggccgaggctgatgcggcgcaccggcaggccatccagaggtacatccatcgggcgctctcagccaccgacggcggccccaccggcgacagcaaccccctcgttcgccgtaacgaaaggctgtcctccagcaaccccctcctatga

SEQ ID NO: 3778 - DNA, 318 bp, Chlorella protothecoides
atggcgtcaggtacgtctttggagagttctcagatccactctgtgcatgccggtgcagccttacccgcacacgatccctggagccttcactcaccgccccccctcccacacacaccccgtcttcactctacagagacggccctgaaggcgcccatccctggccagcgcaacatactcatcaccagcgccctaccctacgtcaacaatgtgccccatctgggtaacatcattggctcagtgctgaggtatgtgggagtctgcgggtaccgccacgaacggtcacttaggacaccctccctcgcatgcatcccaagctaa

SEQ ID NO: 3779 - DNA, 261 bp, Chlorella protothecoides
atgatccaggatgcccgcggcgaccagtgcgacaagtgcggcgcgctactgaaccccacagagcttctgaacccgcgctgcgccatcaccaaaactgtgccggtgcttcgggagaccaggcacatcttcctggacctacctcggctcagcgagcaggtgcaggcctacatcgacgccacaagcgaggtggggggctggtcctccaattgcgtccaggtgaggggaggttgtgcgagtggggttgagcttgagagaggctga

SEQ ID NO: 3780 - DNA, 330 bp, Chlorella protothecoides
atgctcacccaaaatttcacttcccatactaccctacccctcctcttccccacccccaccccgggtgctaacattctacagtcaacggccaggggagtctgggacggccctgcgccgcagggctcgtcggcgccgcccacccacgctgaggacatggcgccaaccccagccgactcgcaacagagcactgtgacgcttcccggaggctccgtcatgcccctgctcggcatcgggacatacaagctggacagtgtggaggcgctgcacaccgcgcttgatggtaggtctggcaatagcggtattctgcgtggtggcctcctgtgtgtgtga

SEQ ID NO: 3781 - DNA, 897 bp, Chlorella protothecoides
atgcaggggcgtcgcgccgagctcttcatcaccaccaagatatggaatgatgagcattcgcctgcagaagcaaggtaccacatgcagctgcgagcagggccagtccacccaaggcacagctggcggtctgtgctgcagtctatctcagagctgggcagtgagtatgctgacctggtcctggtccactggccccatgcctggaaagcgggaacgcaggaggacgacccctccgtgaccctccaagacacctggggtgcgctggaacggctggtggatgaaggcctggtcaagagcctgggggtgtccaacttcagcctgggccagatcgaggacctgctgagctgggctcgcatcaagcccgtggtcaaccaggtggagctccaccccttcctgccgcagcgtaaactcgtggaaggcagcctggccaagggagtgcacacggtggcctactccccacttggacacagcaaaacggatctcctggccaaccctgtggtgatcgaggtggccaaggatgttggagtgagcccagcccagtctgagggagggctcctggtcgaagccggcaccggtgggatcctggatatctcagcctgccctgatgaccatgacacccttgcaatgtcgcaggtcctactgcgctggaatgtggatcgtggtgtggccgtgatccccaaggccggcagcctcaatcatgtcaaggagaacctggacctcttctccttctctctttctccagcccagcaggtatgcaaacgatctctatgtgtagcatcgtacactccacttgcagtgttgcatgtgtgtcactattcacgcgctattccccttgcagaagaagctggacgccctggagaacggcaaacgcttcgtcagcacatcctggcactcatttga

SEQ ID NO: 3782 - DNA, 2874 bp, Chlorella protothecoides
atgctgccagcccacggcccaccaggtcctggttcttgtagatggatgctgcatcgatgtggcggtagccgactgcgagagaatagtgtgttgatctatcatagccaaggagccaacctgggtttcacatctcccaagcagaccctgcaccctcccctcccaccttccagagcggtcaccagggcctcctcgttcttcaggtcatacgttccgattccaacgagtggtaacaaggcaccgttggaaagctcgacagtgtctgatgcgctcccgcctgcaatgtgcgagcagtcgatgtcaggatcacctcgtgtgcacacctctcatgcaaacctgcttgggcaggcacacgggcgcatgcccatgctggcgtgcggccatgagcaggagcaatccgcaccggtagtcatgatgtcgaaagtgctccagagatcggatgcgttcgagtcgtttgtagacttaggtttgctttcggcttcgtccactgaggggcttgcagcgtatttgcccgcggcgggctcgatgccgaagacatgctggaacagtaattcgttaggtgatcatctccgtgatcgacgtccctccttgggaaatatggcgcttgcaccgatgtggcatgtgcaatacagctatgtcggtttcgcacaacattctcatgaaatccccaccaataacagagaattggacagtaacccaagtgctaatccgatgccgtcatgtgggacgtccatggcgggcttcagtttgtccgagggaacatgtactggaaatggacaaggaaggggaactcctattctgacgagaattacttggtcgagctcaagccactctgagccagtcgctgtaaggcccggccagacccattggctccaggtctgctcaagaagcccgggcaccgaacacaaagtgcagaaactgtaccgcggcatttgtattgcgcaatgccacgctccctcgaccgggacttccaagcattgggcgggaactctatttcagcccctgctgatcatgacacggcgaaggaacggtcatgggggtctggaagcggctcgtgggcaagatcaagaccaaggacaaggacccatcgcccttcaatggtgtcctcaagactcaagaggggccgggctccctcccccaaaatgggacgaagaaggacttccccaccgacatcccctccctcctcaaggccctggactcctccgatcccaagacgtccggtcgcgccgcggaggcgctgtacaatgcagccctggaggacagcgcggtgtgccgtgccgtgtgcgccaagcacctgccccgggcgagcgcgctgctgtcctcctccagcgccgccacgcagatgttctccgcctacctcatctcagcactggctggcacctcccccagcatcaaccgggagctctcacgcctgcaggtgtgggttgtgttgccgtgggggagttgggaccgcgggaaggccaggcctgcccgtctccagtgcattggcccgggtgccttgcagcccggcctactgttgcaacgatgacggtgggaagggctcccgtcagacttgctgggccacacatcccaaacatctcccagccgtgcacactcacccaattccaactcttcctcctcctccaaacccccgtggcaggtggcgtccacgctggcgtcgggcctggccgccacccactccacgggcgtgtcgcgcggcatgctgcgcgcgctgagcaagctggcgggccccagcgcctcgcccgaggacaccgtggaccagctggtcgcggcgcggggcctggccacgctggcgagccgcctgggctcgcaggacctcggcatcgtccggcgctgcctggacctgctcaccgtggccgcgcgcctgcgccccgaccccgcggtggacgccctgctgggccagaaggcggcggtgggcgccctgctgggcctgctgcgctccaccgtcatggatgtgcaggccggggcaatgacgaccatgcaggtcttggcagagtgagcctggagggggggatcccggtggaatcggggccgaccacccatttgtttgtttggctggggaatcaaggcctgcgtcgagagggtgggcgctgtgctgacgacgccaggggctgcgttgcacagagacaccatcaatccatgcctgtgtggatcaccaatcctgggtcacagcaggccctctcccccgtggggcctggcagttgccctgtcaagtgcactccttcaccgaccggctccagcctccttccaggagcaaagcctgctccagtcctgccccacccctacagcacccccatccccaccctcccacctccccttccttccaaagggtcgaggaggcgcggcacgcgctgctggacaaggggtgtcaggggctgccgatgcctcaagccccatggaaaacccaccaccactaccagcctcgcctcctttgtggcccacaaccccctcctccctgttgcacgagatgagacccctccccaacccaaacccccctggaccgcgcaggagctgcgcatgcaggccaacgccacgctgcaggccctccagccccaggccctggtcatgtcggcgggagggaccaccgcggcgcagagcgggctctacgacagcgccctgctgccaggcatgcaccgtgcggcagagatccggcaggcccccggggcggcagcggggagcgaggggcccagtgctgcgtccggcgcgggcgcgggggcggagtctgctgcaggcccggggtcgctggcgctgcctctctccccggggccgctgcagctgccggcgccgccctccccccggccctcctccgccccctcacaaagtacagacaccaccccggccccgcccgaccccgcgcgccgctgcgccagcgagctg

SEQ ID NO: 3783 - DNA, 756 bp, Chlorella protothecoides
atgcccagtgggagcgcagatggcaatgcaaacacgcacgctcctcaaacttgtaggggtgcgctggagcggttggtggatgagggccacgtcaggaacctgggggtgtccaactttagcctgggtcagatcgaggacctgctgagctgggctcgcatcaagcccgtggtcaaccaggtggagctgcaccccttcctgccgcagcgcaagctcgtcggcgggatgcttcgcaagccgtgccgccctccagatgtgcgagcacacaccggcacccacaccgccgtcacctcggcagggcttgcgggccattgcctactccccgctgggccacagcaagaccgacctgctgggtcaccccgtggtggaggagctggccaaggagctggatgtcgtgcccgcccaggtgagtggccagcggtgccagcatcgtgcgatgtgggtgctgtgcccgacgcatgcaatgccgctgaccgaagcgggccagctcatgcgactcctgcctcaacccctctctcctcccaggtgctgctgcgctggaatgtgcagcgtggcgtgggcgtcatccccaaggccggcagcgccgggcacgtgcgcgagaacgccgacatcttctccttctcgctcacctacgcccagaaggtacgcggcggggcggctggagagaggagggcgatcccgaagggacacgccaagctcgacgcgctggagaacggcaagcgctttgtcaacagcagctggcacaactgggaggattag

SEQ ID NO: 3784 - DNA, 1329 bp, Chlorella protothecoides
atggaggcgcagcgcatgaaggactccctgaagagtgccatgctcgtctccaaggccggcaacgcgttcttccaggagactgagatctgggtggcctacaagtccgaccgggatgcggcggcggcttacatctccgcctgtggcggcctggtcctgctgctggcctccctgctggagccattcatgccggccttcaccgccgccgcgctttcccagctgggggtcgacaaggtgggcgaggggagttgtgatgggaggagggatgctgacggcctgcatggccgtgaccatgaccagagagttcccagatgtcaagtgctgccgttggacaacgggatcgtggcgagcagccgcagcccagccaccatcctgccagccgggcacgccctgggctcggaggcggtgcccctgttccgcaagatcaccgaggaggaggcggcgggcctaagggcaggccgagctcgtcccgctgcctgcctgcctacccaccccaacccccatcgcccaccatcttcctcctacaggtttgccgggaaccaggcggagcgggaggcctctgacgccgccgaggccgcggcaaagctcacgctcggcgaggagaaggcccccgccgaggcccccggcaagaaggtcaaggccaaaaaggcggcgcccgccgaccccgccaccaatcggccggtggacgtgtctcgcgtggatctgcgggtggggctcatcaagaaagcgtggaagcaccccggggcagacagcctatatgttgaggaggtggatctgggcgaggagacgacgaggacggcaagttttccggggcgtgggcgtgggcgtggtgatgagtttgagcttcagcatctgcggccctgcagagggttcgagagagtcagcatcaggatcggagccgactcgccgccggcgtccctcgccccgccccacagcccgtgcccgcttgccgcgctggagcccctcttcctcctcctgtcaaacaccgcagagatgcaggagaggctggccgtgtttgtttgcaatctcaagcccgccaacatgcgcggccagcggagcgagggcatggtcctcgccgccaatgcgcccgacgacgccaaggtggagctggtgacccccccgccggggtccaagccgggggaccgggtgggcgtggatggcttcccgggcgagccggacgcgcggctgaaccccaagcacaacatcttcgaggcggtgtcagccgagctgggcatctccgaggacggggtggtgacctaccgggggaagcccctgggcacccagaacggcgcgtgcactgtgcccaccgtgcgctccggcatcatccgctga

SEQ ID NO: 3785 - DNA, 408 bp, Chlorella protothecoides
atggcccccgagatcctgctagcaaccagtgggaaaccctactccccccccccctggtaccgagcagcctcccgcaatgctgcggagtgggccacccagatccgagcagagggcgtcgagctccaagtgtacccagatgagatctccgatcttgctgcggttcgatatgctgtggtgctgaaccaacccgagggcttcctcgcgcaggcatggttggcgtgccctaacctggaggcggtcagtgggctgggtcacggcgtggagtacatcgcccaggaggccgacagcctccccgatcacgtgcagctcttcaggatcgtggacaccaagatggcagagcgcatggccaactggtgtctctgggccatcctcaactgccaggttttgtggaagtggggaggggggtga

SEQ ID NO: 3786 - DNA, 1353 bp, Chlorella protothecoides
atgtacccatcctacgcgcaggtcaccttccgcacccgcatctaccactgcaacatcaatagcaacgggcagatctgcctggatatcctgaaggaacagtggagccccgcgctgacggtgtccaaggtcctgctctccatctgctccctgctcacagatcccaaccccagtacgtgtatgccgggtggagaatgctttgaaggaggttcaggtggcaccgtgtgcccattcccccgtgtgcaccctttcctgagaggcactgggatataccagatggaggcatccccttcacaaattttgaacccacaaccctgcctcagcggagtggactcggcggtatgcgcagggctgacggcctcctggttagcggggttgcagtggacgccgccccggcacgctcatgcatggaagcatcctgcaagcgccaggccctgggcaggcttgctgcggggcccgctggctgtcagacgcgcattgctccgagcagacaacgtgggaggtgggggttgggcatcacgatacagcgctgggcagggcgagtggtggcagaggcgtgcggctgaaactggacacccagcagcgggggctccagctcccattgcgcagctcgacgccccgcggcagcaccgcgcccgcgtgccactgcacctcggtcggcgcgtcggggtgctggctccgctggcgctgcgacagctcgccgcgcatgttgacctccggcgcggccggcccctccgtgaacttgagccagcagtcgccgaaggagtgcttgtggatgtcgggctcccagcacccaccctccgccgcacaccacacaaacgcgttgcagggcagctcatccaggtgccctgggaatgcgaaaaagcgcaggaggtgtgtcacggcagtggcatcatcagtgcggagtatggtgcgcagcgctgcgcagtcgtcatggccgctcgtgcacgctttgcagagcccccgccccggacatttgaggagcctctcctcctcaatctttccccccgaacaaaatccacatcaccaccagcacacacccgactgcggcacgggctcgtgggtgaggcaggcgtgggcgcacgcctccacgctgggctgcgtgtggccgatgccccagcgcacggccatgccgtcgtagtcggcgcgccgctcgatgtgcacgcgcatggacgccgtcagcgccgccggccccagctcggcgcgcgcctcgcgccaccagcgcgcgacgggggaggcgagcaggcaggactcctgcacgttggcatactggtcggtggcgggggagccgcatacccgcgcctcatggaccagctgcagggctgcagcggcacctatggggacatgctgggctga

SEQ ID NO: 3787 - DNA, 522 bp, Chlorella protothecoides
gggggtagaggggagggaaggtgggaggggctggaggtggggagggcagctggagtgggctggagtgggatgaatggcagtcgggtggttcctgaatcatcccctcacgccaagcgctccccacccatcgcacaggcggcggccatcccgctgcccatggtcaagtcgctgctgggcccctacctggtcttcctctgctccaccgtgaatggggttgtgcacagcgccaggcatggtctcttgctgggtgacaacagcttgcagaaacctgccagcacactgcccgggacgggtgccatcccatgccgcggggcgtctcacccattgccccctcttcccaccccagggcgccaaggtggagggcaaggcgccctcggccgaggacggcagcgggggccgcaccttccgcgaggtcatcctgcgcgacccaatccgctacgcctcgggcgacgaggtggagaagtggctgaacggcctgctgtgcctggacgccgccgagcacatccccaagccgccaggtga

SEQ ID NO: 3788 - DNA, 1953 bp, Chlorella protothecoides
atggcggcagttaccaaagccatcgagcgatgggcgtgcggcagcgtctgcacgagctggtctcggacggacaccataatggcgcaggctcccacgcgacacagcgatttccgcgaccatcggcctctacccctgtctgaaatctacgagctgtacagcgaagttgtaaacgaggggcgatggaccaacggcctgctcgagatgtggtgcgtggggatcctgggttctggaagaataaaacagccaagtcttccgtccacataccttgctgggactccttcaagtggaatccgctggcctggcggggggcgtgcatgggaaggtgaggttaggggggtgcagtatttgaggccccgcaactctccatgccagcacccaagccctgcatgcatggcttcagccacacggttctgtcagacctcagagatccccaagagtcgggggccatgtgcagctcgactgcgcgcccacaccccagcgccgcgcctgcaagcccatgccctggccctgcgagagtccttgcccgacccatgccacaggacctgcgaggagtgctactggacaggcctgcgccagacgcggtgggcgcgggcggtgtatgccgccaacctgggccgtgagtacgtcttcccctaccagaacatcgggcacaagagctacaagtccgacatcaaagccctctgctggtcgcccgagactgaggcatccctgctccctgagcatcccgcaaatccctcctcaccgaccacaggatgtactgcctcatgtcgtgcgtgttcagctgcggcattggccagatcttctccttctgtgggaacgtgctgttcaactttggggcgttctacagctgccacgcgcgagagaaaatgcgacggtgcgatgtgtgcttgttggaacagaagtaggggtgcaagtgggtcagccaacagcctaggcccattccttgctgttgacggcgcggagctttccgagagctcatccctgctgctcatccctgtcgctcatgcggagcactatgttcagtttgcagaccctggactgcacagcctgatgccaactccactgcactgcagacgatacaagttgccttcgacctttggcctgcctccgggcatcgacgacttcctagcagctgccaggagcgcaagagaaggaacccacgagctcgtggcatgccgcacctatgaacaccctcccccaacccatacgcagtgcactttctgtgtttctactgcgccagccaccagtgcgttgggaggggtggcgtggtgtcaaagtgctgtgggaggcgtttgtccagctccagcttgtgcatggcctagtccatatgctgcctgcgggtctgcctgccctgtgctgggcgagcccctttcccacgacagttcagtgcctaaaatcccgccactccctttctccagggaactgcgagagctggcggtgcgaggcgtggacggacccggcatgcacatcctggacgtcctccctaattcctttgcaggcgcagagggtgagggctggggtggggagcattgcgcctcatcgcaattgagggcgggatcgaggggcgccaacgaggcgatcagggaacgggaggagcttgtgaacaagatgacggcgcacccgcccaagttcttcaagtccagggtcaaacgcaacccgctagtgctgtccaccgtggtggaggtggccaaggagacggcgctgagggctaagcagggcgtcaccgacgatgccggctccaccgccacctcggcgaccagcgccgcgccactgggctggatcagctacccggcgggcgcgcccagcacgcagaccatgagccgcgacgaggttgacgtcgagcaggcggacctcctgcatggccctgacggcaagccggactggcaggcgctggggacggagctgcacgctgcactgccgccgctgcagcgggcctggagtgtggcgtattga

SEQ ID NO: 3789 - DNA, 1029 bp, Chlorella protothecoides
atggtccttgtcaagactgcagagcctgctgcaggtgacacaccacgcccccacctgcatggcctgtatgacaaacttcaacacccgttgccatcccacacagtgctcattgacgaggcggggcaggcctcggagatcgcggccctgcagccgctgggatttggcgccgagaggtgcgaggggcctgggcgagtgcacttggtgggctgggagtgggtgggatgtctgatccatgatcaggatttccatgccctgcaatgtgtgctgaaggtggtgctggtgggcgacccgcagcagctccccgccaccatcctgtcagagctgggtcgcgagatggagatggagcggtccctgtttgagcgcctgcagcgctgcggcgcccctgtcagcatgctgagtgtgcagtaccgcatgcaccccgccatccgccagttcccatcggcctacttttacaataacaagctggaagatgcagcgtctgtgcttgagagacccgacgagccgtactatgcgcacccactcatgaagccctacgtggtatttgatgtggctcggggtcaagaacagcgcgcccgggcagccaccggatccgtcagcaacctggtgaggttgaatcaggaaggcccctgggccgctttcacggcagccaaacttcactcctgtgtctcccagatcgaggccgagctggctgcggccctgttccacgagctccgtgctttcctcatcaccacggccaaggagaaccccggcgagatcaggggaccgacgagtgtgggtgtcatcaccccttaccgagaacagcgggccctcctgcgcaaggtcttccaagatgtggtgggcaaggttgcagccgcagagagggtcctagtctgcaccaaggcagccagcaacctgcaccttcctccagccccaccaccccaccgcctgcaggtgatgatagagacagtcgactccttccagggcaagcagctagacgttgtcatcttctcctgcgtgcgcgccggcagcggcggaggcctcggtgcgtga

SEQ ID NO: 3790 - DNA, 1191 bp, Chlorella protothecoides
atgcttggattagtggccacccccctcgcaacggctggacaaggctgtgccagccccagatgcacaccggcagcgatacggacatggggaccccccgccctccgtgctcgccatgcccaccccttcacgccatgcaggctgacaaaaaggagcccccacccgcttgtgcaagcaaactcgacatctgagcagacctatgccaagccagctacagcaagtgaggagtatgtcctggactctgacttccgtatcgagcgggtgagacttgggatgggggaggcagattgctgctgggatggccactggatggatctgtgcctctcacttgcaagtctcattcggtaccatcctgagccccctgggcctgggtctcatggtgtacggcttctgcgcctacttctccctcctgcccggcggcgacgtctccagcctgctgctcatttatggctttcccctgacccttctcggcttcgcgctctcctacgcgcagctgccccccgtgccctgccgcagcgtgcccagcgcggtggctgccagggaatcacaagccacagacatccagaaacaggtgtggagtccgtgctgagtgcttttggggtgcagaggggtgtaaaggctgtagagtcttgggcttcagcacagggatttggggaggaggggacatgcttgcatcctgggttcagaacatctgatacccatctcgttcgggaggatgtgacgaggttcaggtatggggacgagcagcatctcgacgaggcgctggtcaggatcttcaagatcgggcagccgcgggggctggcccggcgcctgacccccaagctgaagggggtgcgggaggaggtccggggcccggagaatgcctacacgctggtcctggagtttgccgcaaagccccagatggagcggtcggcctgggaggagcgccaggagaagttccagtccttcttcgggccgggggttgtggccctgcttgagccgactgaggaggtgggtctggacaatgctcaccacatggtctccagtgaggtgcagggcgcagcagggcatgaggggcagcaccctcgtgaaaccatgtgtttgcacggtcactatgctgtggcaactacatacccggtgtcaacccaagcattgctgattgccacctggcgctgcaccgcagggcatggacgtcgtgctggtcgtggatggtag

SEQ ID NO: 3791 - DNA, 243 bp, Chlorella protothecoides
atgtggatcttgggagccgtggggaagctgcgagctgatgccgcctggggcgccctcatccgggacgccgaggcgagaggggtcgtcatccaggacgcggatgccaactccctttttcccgacatggagtactggcagcgcaaggcggcgggcacccccgcgccacaggaccaggcaccgacggcccaccccgcggggccttgcctgccgcgccagtttcccgccatccccagccgacgatag

SEQ ID NO: 3792 - DNA, 1188 bp, Chlorella protothecoides
atggagggggtggttgaagggcatggagggaggacagagcacggggttgtgtgggtgaaacacgagatccaggagcgccctgcacctccggccccgggcccatggcatccgtcccccaccttcctggggcccagctcttcaaacctccacacccagcgcaggcaccggctcccacccgcctcgcccccgcccacggcccccaacccctaccttgcgcggcccggcggccccgccgccggcacccccgccggcccccccctcgtcgtcgctggccagctcggccaggccgccctcgtagtactggcgcaggaggtccatggcgcgcgagccgtagcccgctcgcaccacctcggggtgcgtggcgatgcgcaccacgcgcgcgcccgacagcgcggggaagtcggcgtcctggaactgctggcccaccgtccaggggatgaggtcgccctgtggcagctgcccggcggccagcgaggcgcgcgcgctgcgcgccgagatggcgccctccagcgccacctgggccacggcgaggacgtcgggcagggcgtgcgcatcgggggccacggggcccagcaggacgaagaggtggtgggcaggggcgtcggccatgagcagcaggtcgttgggcgagttcttgtagtgggaggccacgtagagcgacatcatgcgctgcaggaaggtctccgaggcggcgtggaaggagaagagcgtgtcgcgctccacgtagtacagctggcagtcgtcggggcctgccggcccatcaccaggcactgccttcccgccatcacctggcggcttggggatgtgctcggcggcgtccaggcacagcaggccgttcagccacttctccacctcgtcgcccgaggcgtagcggattgggtcgcgcaggatgacctcgcggaaggtgcggcccccgctgccgtcctcggccgagggcgccttgccctccaccttggcgccctggggtgggaagagggggcaatgggtgagacgccccgcggcatgggatggcacccgtcccgggcactggtggatgagcttgagggacagagagcggcccgtgccttcatacccattcacggtggagcagaggaagaccaggtaggggcccagcagcgacttgaccatgggcagcgggatggccgccgcctgtgcgatgggtggggagcgcttggcgtgaggggatga

SEQ ID NO: 3793 - DNA, 591 bp, Chlorella protothecoides
atgcgttccctccctctcgttcttctatcagtcccacccacccagcccaccccctttcacaccggccaggccctgagcaccgacctcctgtcggggctgggcgcggctgtggtgaagacgcggccgcgcatcctggtttgcacgccctccaacgccgcatgcgacgagctgctggcccgcgtcatggcccagggcttttgcgacggcagcggcgggcgctactcgcccaacgtcgtgcgtgtgggcgctgatgtggacggcgtcatctcgccggcggtgcgcggccgctccatcggccgcctggtggaccagcaccggaccatgatccagagcgactggcagcgccgcttcgccgacgcctcacgccgacgccagcacgccggccgcgagatcgagctgctggaggccgccctgacgcgctgcgccgacgaggcggagcggatggagctggccaaggcacgcaccagagggggggcgggggggcggggtcagggggcatcaggggatgttttagtgtgtggaagaagaatgtacgggagatgggctggcgggctgggtcgggccaagggtagggtggtggtgggacggtag

SEQ ID NO: 3794 - DNA, 615 bp, Chlorella protothecoides
atgaacgagcgcaagatcatcgcgcaccgagccttcctggaaatagacaccctgcactgcctggtcaatctaggcgtcggcattcccgagggcgtggccgtgctgaaggccagccatgggcgcgacaaccctgccggtgccacggccacgctgaccaccgaggcgggcgtgtttggcgggatcccggcggggggcctgcgtttcgggtcggggtacaactgcgaggccctggtccccaccgcctccatgatcgacttctactcggggggtggcgtggacgtgtgtgtgctgggcatggcagaggtggatggggcggggaacgtcaacgtgcataactttgggacgcgggcgccgggctgcggcggcttcattgacatctcccagtccagcaagaagtgcgtgtttgtggggaccttcacctccggcgggctcaagggcggcaagctggtgatcctgcaggagggcaggaccaggaaattcatcaaggctgtcgtggaaaagacgtttgcggcggcgctctcccagggacgacccgtgctgtatgtcaccgagcgtgccgtctttaggcccctaggtgtgtatgtctcaggcttatgccgatattggggggggtaa

SEQ ID NO: 3795 - DNA, 558 bp, Chlorella protothecoides
atgtccacgcccgagaagatcgcggcggccatcgcccgcaaggagaaggggaatgcgtacttcaaggccgggagggtgggacgtgcggtgcgccaatggaaccaggccgaggagatcatcaagtatgacgacgccttcagcgccgaggagaaggaggagtcgcgcgccgtgaagaagtcggtgcagctgaatctggccgccgcgcacttgaaggaggggtcctggacggaggcgcgcaaggccgccacctcggtcctggaccacgacagcttcaacctgaaggccctgttccgcagggcgcaggcctacctcggcacctttgactttgtggaggcggagcaggacatcaagaagggcctgggagtggacccaaacaacgcagacttcaatgcgctgcaccgcaagtggaaggtggctcaggcggctgccggcaaagcggaggccaagctctacagcaagatgttcgccccgcggccctcagccgcccgcccgcaggccgcagaggcagcgccggctgctgaggtggcgccagctccagagcccattgccgctgtctga

SEQ ID NO: 3796 - DNA, 576 bp, Chlorella protothecoides
atgcagatatggcgcagtgtgtcgcgcacacgagcggccgggggcgcccccggcgaggcggaccgcggcgccgtgctggcggaggccgccgcccgcctggccgccgaggccggggacatgctggtgctggcggggcgacgataccgcgaggtactgcaggcagaccccggcgacgcgcgcgcatttctcaattgggggcgctgcatctgcctgcggggggagctggcgagggaggcgggggggagcctggaggaggcagcagccctgtttcagaatgccgccgacaagtttgacgccgcgctggacgccgagggccagaccgccgtcgtgctgcagcatgccggcgcggcgctgaccgacgcggccgacgccctgctgaccctggaccgggcgcaggcgcgcgctctggcccaggacgcgctgccgtacctgcggcaggccctcgcgctcgaccccagaaacgtcgacgcccagggcaggttgacccaggtatctggatggggagctgtgatgctgatgcgagatgaaggggcagcaggacgtgctgctcctggaatcctggaccttgactcgtga

SEQ ID NO: 3797 - DNA, 396 bp, Chlorella protothecoides
atgggagtatgctgggggctggaagaacgagctgcagcatggatcaggcgtactcacggcgccttcaagtacatgggcgagtgggaggcgggggagcagtgcggcgagggcaagtgcctctatgccgatggtggaaagtacgacggcgaatggcgcgccgggctccggcatgggaagggcagctacagccatggcgcctacaagtacaacgggcactgggtggaggataggcaggatggagctggcatgtgcaccaacgaggctggggataagtacatcggtgagccggaggagtggagtgtcgagggatatttgtgtctggcactatgtcaggcatgtcgttgggcttcactacggggccgtggggtgccctggggtggtatacttgtgacctag

SEQ ID NO: 3798 - DNA, 816 bp, Chlorella protothecoides
atgtctgacatcctgaacgatcacgacatggacggcgacctggcgttggaggacgagtttgctgaggccgtggacgaagtcggaaaggagattgatgtctcgaaggacggcggtgtgcgcaagatcatcaagaaggttggggccggctacgaggtcccagagaagggcgacaaagaagggcaacaatccagcacctgctgcctgttgcccaaagccgacgcccccatccttccccctccgtacaaacagtcggccaccgtgatcatccgcggggattatggctacggagcagccggcagcccccccaagatcccggcgaatgctaccctccactttgatatcgagctgctgagctggcggagtgacaaggacctcaccggtgacggcggggtgatcaagaccatcctggccgagggcaagggctgggccaaccccgggaaggatgacgtcatcacgctggagctcaaggccacgtctctggagggcaccgacacggtgtacacctcccccgagggcggctaccaagtgaccctggcgtccgggggcgcggacgctcccttcttctgccgcgccctggaagtggcactgcccaagatgaagaagggggagcgagccacactggtggtgaagccgcagtacggcccggtgcagggccctggggcgggcgaggcgctggagatcgaggtcaccctggtggactggcagaaggtggagcggctgccggggggcgtggtgaagcggaccctggtgtccaccgacgagtggcagacgcccaacgaaggtggggcgctgcggtgggcgttgcagggaggttga

SEQ ID NO: 3799 - DNA, 375 bp, Chlorella protothecoides
atgttcaaggcgggcaagcagcatggcaaggggcggtgcgtgtatgcagacgggtccaagtacgagggcgactgggaggacggccagcgctccggcaagggcgtctgcatctatgccaacggcgacaagttccagggggagtggctgcgggatgccaggcatggccggggcgtgtgcaagttcgcggatggcaccaggttcaagggggagtgggaggcggacgcctgggtccaatccgctgccgccccctcccggtgccgtgtggcgggggccggggtcacacacgccacagccggggtcgaggcgtcctttgtcatccaggtgcggtgcggggcaggagttgcaggagggttcaatgagggccagtggggttga

SEQ ID NO: 3800 - DNA, 2403 bp, Chlorella protothecoides
atgtcccttgccctgacgcacacgcggccactcgctcccaggcatacctcatgggctggcactgcagcacatgttacccggattccccgatacacacgaccttccctgtgcctggcggggcttcggggcggactgcggcccgggcccatgcacaggaccgggctgaggtgtgcgagggccctccctcctgatgcagggtcggacaccggccccaaccccggctggcagaccttctggaccaccctggacgtcacagcatggctgggcaccgtggggtccgccctggccttcatcatcacgggggagatgatgctgacagctgcgccggtcctgctccccatcctggccctttacgccagtcggcagcgggagaggctggcaatccaagccacacaggccagcacggcggcggcgctggtctccgtcctgcgggagcaggcggagaggacggcgcaggacaacgccgcgctcgccgccgagatgcggggtagcgggtctggggtgcaggcggccctcaaactggtggaggccaaattgagcaccatcgaagcctccgtcctgagcaccgggagcagcacgcagatcctccaccaggatgtgacagcggccacagggaagctgggcgcgcgtctgtcccgccagctggaagggctggcgggggaggtgggccgactgcggggcgccggctcctcggccgcagcggaggacgtggcggggctgcaatccgccctgcgctccctggaggcgcggctgcaggagacccagtcgtccggccaggagcagctttcttccgagatcgccgggctcctggccgccaagcagcaggagatgcagtggttcttcaccgacaagctgtggaaggaggccgaccagctcaaggcgctactggcgagccaggcggcgactggcgtgcgcggcgcctcggctgctcctggcgccgacaccgcgggcctgctggacgcgctgggcgcggaggtgcgggaagccctgcggcaggtgcggcaggagggtgagccagcctcgccacggcccctggacccggagcagtgggcggcgctggggcggcgcctgcgtgctctggaggacgcgctggcgcccgccgccgacgcgctgggcggcctggtaggccggctggacgcgctgcaggcggcggtggaggccgggcaggcggcgcaagggggagcggagggaacggcgcgagggggagcggagggaacggcgcggggctcgccggaacctgtcctggcagcgctttctttgctgcgtgccgacctgcgggccatgctggcggcggagcgcagcccaagcaaggcgggggccacgggcgaggcctccccgaccactgaggccctcccgtcgcggagtgaggacgccctggtcctggacgtcccggcacagcgcgtggctgtgccggagcgtgaggcggcgcccggcgagccggtagccgtcagggacggctcggagggtgtggagctgggatgggaggccgcacgcaacggcagagaaccagcgacccgggaggaggcgtacgcgcgcatgcagcgcctggtgcgggcggacacggccgaggaaccgggtgcgacgcgggaggaggcagaggagggaatggcgcaggctcggggtggacaggccgcggcgctgccatcgtggctgcagctcgagggtgcggttgcagcccgccgggaggatgatgatgaggctgccattctttcgggcggcagcagcgggagtgaggaggctggaacctcctccagggacccagcgatgattgaccaggcgggtggcgcaacgcaagcaggggttgagggcagcgattcctgggcggctgatggagcgcgagagggagctcagactacgaacaggatgacagaatctggggctcggtggcaggtagatcctgagaatcggctgcaggcagacgccgtcgagcgatggcaggcagattctaatgaccagtggcgggcagatgtcggcggctggtccggagcagcagcatctctcagggacagcggcgctcccacagatgccgcagtggaggacggggttttcaccatacccgtcactgccaacagcggggatgggcctcccgtgccaagcgaccaccattcgctcttcgcagaagcgcagcaggacgagacagctcacgatgccacgcagaccagcagcggcaagaggagcggcggtggggtggccgctgctcgggcgccggatcgcgatccagaagcctcccgtcttgaacccctggagactgatggcccaatggccgcttccactgggaagagccccagcctgatcaaggctacctacgacctcggcctgcagcgcctcaaggccggccgcatcctggcctccacgccaggtcagcggtgggatgttgctggccggttgttgttgtgcttgtga

SEQ ID NO: 3801 - DNA, 1023 bp, Chlorella protothecoides
atgcagtgctatgaggagaagcctgtcccaggccgtggcctcgggctggtggcgacccgcgacattgctgctggggaggcagtactaaccgactaccccctcgtcctgtacccacaattctccctgagatacgaggtctgcctccactgcctgaggcggttgccttccgacggggcatcctccagttcctgggccagcttctgctcctcggcctgcgcccaagcggcggctcgagatcccggcagccacaaccccgccgtcgctgcagcggaagcggagacccggttcgagggtctgggcgaggaggaggcgtcggcgctgctgctcctcctgcgcgtcgcgaccttgaaggccgccgcagccgccggggacacggggtccaccgcccggctgcaggccctgacctccctctcgccgggctgcccccagccagaggacgccgccgccgccctgcgggccaggctgcccggggacggcgcgggcttgaccctggaggaggtcagagcggtgctggagcgcgacggttccaacgcctacggcatcgcgctggaacccggggtcgcggacgggcccatcagggggtctgcgctctgcgcaactggctcccgcctcaaccacgagtgcctgcccaacctcgcccgccaggatgcctttgacgaggcccgggcagatggcgacccggggtcaaacacgggcatcacgttccgggccctgcatgccatcccagctggtgggtcaggtggtttgggaggtggggggtccttggcaagtggcgcctattgggcaataggtgggagagcgtccgagtccacagccctccatcccccctcaggcgaggagctgacgcagagctactttcccctgtggtgggagtacgacgagcggcaatcccgctgcagggaggtgtacggcttctcctgtgcatgcccgcgctgcaaggtgggcggcggcatgcggttcccctgtctggccgacagggcgtgcgcccactcgccccgacatgccgccctgcacatggtctaa

SEQ ID NO: 3802 - DNA, 204 bp, Chlorella protothecoides
atgagcctcctgcccttcctatgcccatcgagctcctcctccctctcctcctcctcccaccctcctgcagtgggcgagggtcgcctggagctggtggaggtcgcgcctggcgtggacatagcgcgtgatgtccttgcacacatggactttgagcctgtggtccgccatgtcaagctcatggaccccaggatcttccaggcctga

SEQ ID NO: 3803 - DNA, 1503 bp, Chlorella protothecoides
atggcgcgattcccgtgggttgttgcgttcgtgctcccccccagagggcaggaagaggggttgaccgtggaggtgcatgcccgcatgtccatgcaccaaccccgacggcagcctccgggatcgagtaccgtccacccctccccctccatgcaggcccgtgacgaggacggcaaccgacggctggagggcggcgacgacttctcggcggcactctactccccccacgccgtcgtgacgggcagcgtgcgggacctgggcgacggctcctacgcagtggcctacgtcgccaccgtggctggggtgtacgaactgcacgtcaccgccggccaggagcacgtggccgcctcgccctacccgctgcgcgtcgattcggggccgccctgcccgcgccgcagcgccgcgaccggcgagggccgggggcgcgcggtcacaggccgcccggcgcgcttcagcgtcctgctccacgacgcgcacggcaaccggtgcggagccggtgcccccgcgacgggcgtgccgctggagacggagctcaccggacccggcccggccccaccggcggttcgcgtggcgtgggacgaggcggcggggcggtacgactgcgagtactgcctgacctctccaggcctgtaccgcctgcacctggccagcgggggggtgcccctgcccggcgcgccgttctccgtacgctgcgtggtggccggggaagatgctgaggtggaggagtcccgagccggcccaggggcgcaggcccaggactgcgctggccagggtctggaaagcgcggcgcggccggtccaggacctgacgacccggtgggaggagatcgctcgggcagcatacctcctggacggcgacgccgcgggctgggacagcgatggggaggccgcggtgcagcgcacgccagaggacgagtacatcaagactttgggagtggatgggagggaggccatcccctctgcagcccactatggtgatgggggccggctcaaggcttgtacagggtgtgtggaagacaagcgcacccaagctctcctggcaacgaccagggcaacctgcactcagcgcccctcccacccccctgccccaccctgcacccaggcacacccggacgtgccggtggtggagaacctggaggacatctggcaggtgtccaagctgcaggccgagaggaaggagaaggaggagcgcgagaagcaggcccggctcaagaaccctcgagcagggacaccgccaacacatcccagcccacttgtcacaacaaacctgcaggagatccagagcaagctgggtgaaacgttcggggaggcgcagcgaccggcgccggaggaaatccgggcggcggtgcaggagatatttgccgccgaagctaggctggaggcggccagttccactgcggcccaggcggggggatgtgggcctctgccacccagacgccccatcaagctcagcaaggcccagctccacgccgcagcagccaccctggatgacctggatgatgtctga

SEQ ID NO: 3804 - DNA, 1059 bp, Chlorella protothecoides
  modified_base (332)..(341): a, c, t, g, unknown or other
  modified_base (609)..(618): a, c, t, g, unknown or other
  modified_base (707)..(716): a, c, t, g, unknown or other
  modified_base (970)..(979): a, c, t, g, unknown or other
atggcagcgcacgccagcaagacccagggccgcgtgggtctgggccaggcccagcgggccgtcaaggtcggcggtgtggcatggaccgggaccaaggtccagtttgacgaggcgggcgaggatggcgcccagaccagcggggctgggtgtcacgcggatgcggcgtgtcaaacacaggcggcgggtccaagcacggaggcgaggccctgggaggcgctggtgaggtggaaggcggtgacgcaggagttcctgctcggtgccaaacccagcggcgcttcgctgaagagagtcgggcgacacgtggtctcccacgtagccagggcactggcacnnnnnnnnnnggtggaaggcggtgacgcaggagttcctgcgcggtgccaaacccagcggcgcctcgctgaagagagtcgggcgccacgtggtctcccacgtggccgtgcgcttgcaggccaagggacacgcgcacgatgccatgcccggcgaggaagaaatcgcggcggtgctgctccggaagctgcagggcagccgccaatttggaatgctgcgtttcggtgcaggcagcagacactgtcaaccggggtacatgtcgttgagtccttgggtacacannnnnnnnnncaagcgagttcggctcgcggcgtaggggatttgcgaggatggagttttgccgccttttgggccggcatcgcgcagagggcactggcatnnnnnnnnnngaatgctgcgtttcggtgcaggcagcagacgctgtcaaccgggtacatgtcgttgagtcctggggtacacggcctccccttcagtcctggcaactctcaggaggaggtgtctgaaccaaccgcgcaggggcgtgcacacggctttggccgatctgcggcacgcctgcggccagcctcagggaggagagtccccctccagaaggcgcaggagcgggttcaagccttcagccccctgcagcgcccgctccacgacnnnnnnnnnngcctcagggaggagagtccccctccagaagccgcaggagcgggttcaagccttcggccccctgcagcgcccgctccatga

SEQ ID NO: 3805 - DNA, 1023 bp, Chlorella protothecoides
atggccggggggcagcttcatccttgcgtctacacagtagtgtcagagagtaggaagcgtactgactccaagaggaaggcacggccttgcggtacgccgtcggggcgcgagggcgcgacaagcggtcgcgcgccacaggttgaaggcgctctctcgtccaggggtgcagacctgcagggtgttctgcgcccaaacctccacagtgagtcatgggactggatgctagtggttgcagccgcgcctggctcaccctgtgcgcagcagccacctagatccagtgactcatcatgtcaacaaatcccatgtcatgtaggagctcctttaccagacgcctgtggactctctccaatttcagaggcaggccctgctggacccactggtgacatcctccccactgcggcgcgccgcgctgcggctcttcggctactacagccgcgaaagccgccacatgcgcgccggccaggctctcctggaggcgatacaggagcaggcggacgcgccaagcttctcacgggccttgcaggtgccagacagcttccagcaccaacacgcagtcttagtcttgcatgtctggctggtgctgcagcggctgcggtcagaaggaaaggacggcaagcacctggggcaggccatgtgcgctttagtaagtttctgaaggagtatgaggagcagttttacggatcaagccgatcctatgaccgtgcaatggagggacagaccgacctcgcagccgccttggcgaggaacgtgtacatgatggacccagagaagcatgaggctgccaatctgatggcaagatacgttcgacggacttcgtttgttggaagctccatatcctcccatgtccccccttcgtgcagagagattgcatgcctggctcttacccccaccgaggccgtgatggaggggaacatcaagttctccacgggtttctattcgcacatgcctgctgaggcagcttcaaggaggacagaagatcttgcaacagcaacaacagcaggagcagcagcagcagccttgtag

SEQ ID NO: 3806 - DNA, 1638 bp, Chlorella protothecoides
  modified_base (868)..(877): a, c, t, g, unknown or other
  modified_base (1154)..(1163): a, c, t, g, unknown or other
atgtttgggatgcacagaagggcccctgcactgcattattggtcggcaagggtaggccttgtaccttccgttcacactgcacttcaggggttgcctcagcaaccctctccatcgcttccctcgcttgcagaatctactcgatctgcacaagaaggggccgtgccaagcccacccaatcagaactcaagccaggccagcacggctgccagtgccagcggggccctgtcggaggagtacaccgagaccatgcaggcacgcatgggcagcgcctctcttgtgtattgccacgaggacggcatgaactacacccgcatcctcgacaacctgatcgtgggatcctgcccgcagacagccgaggacatcgagaggtgggctgccgcgagggggcgacaggggctggtttcaatcgagtttgaagtcagacggcgctgccttgggccagtatatgaagagaagcctgacgctccaggcactgcatttcatattggggcccgcatcgatgaggaggtgggcaccatcctgtccctgcaggaggactcggacatggcctacttcgggttggacctggcgcccatcctggccgcatgctccggccggatcgaccacgtgcgtcgcccgctgcgcgactttgacgcacacagcctgcgcatgggcctgccggccgcggtggccgcgctgcaggggtccatgcagcgccagggtggcaccgcctacatccactgcacggcaggcgcgatgatgtgtgggcacatcttgggggagggggggtcgcttgtcaggttgtggggatcggggagcgaggcccagtcggcccccaggtctgccctagggtggcaagctgtgcgtggacccactgctgccccgcccnnnnnnnnnngcccccaggcgctcggagcagatctcggatggactttctcaggcaaagcaaccgccctcccccccattcctcagtccaggcctgggccgtgctcccgcggtggccctggcttacatgtggtgggtgtgcggagtgacactcccccatgcacacgcacacctcacagccctgcgcccctgcagccccaagctgggcgccgtgcgagcggccgcgctggacgtgctgcagggcaggaaggcgcggcgcgcggtcctgcgcctggccgcccccgcaaccnnnnnnnnnncggtggccctggcttacatgtggtgggtgtccggggtgccgctcccccatgcccacgcgcacctcacagccctgcgcccctgcagccccaagctgggcgccgtgcgagcggccgcgctggacgtgctacagggcaggaaggcgcggcgcacggtcctgtgcctggccgcccccgccacttgccgccgtgtgcaggccgcggggctggacgtgggctggggcaaccgcgtggggctgactcggcgggggcggggctgggagctgcggcgcgagctgcccccgggcgcctacccctacaagtttgtcgtggaggggcagtggacgctgtcgcccgcccaccccacgatgctcgacggcgccagcaccaacaacgtcctgcacatcgagggctgggaggccacgccggaggtaggcttttgcgtatcttggtgcgctttagggggagggggaaggtggggcggcatgggggaacatga

SEQ ID NO: 3807 - DNA, 837 bp, Chlorella protothecoides
  modified_base (470)..(479): a, c, t, g, unknown or other
atgctgggcccctccatcctgcagccaggcgacacggcaattgacgccacatgcggcaacggccatgacaccctcaccctgtcacggtgtgtgggaggcgggggacgggtagtgggctttgacatctcggcagccgcgctacaggccacccggcggcggctggaggaggagctggcaccggaggcaatgccggaattgaagctcgtccacgcagggcatgagaccatgcccgagcacctgggacacgactctgcaaagctgatctgcttcaatctggggacgaaggggagcagccgggtgaacgaaggcaagattcaatgttggacatggggcacgatttctgccgtcctgattgagaacagacgcccgtgttcaggaaccttcacgcttccgctgcagaagggctgttctctcactcacacttgcctccttgtccccttcaccacacagctatctaccaggcagcgacnnnnnnnnnnagacgcccgtgttcaggaaccttcacgcttttgctgcataagggctgttctctcacacacacttgcctccttgtctccttcaccacacagctatctaccgggcagtgataagacagaggcaacacgagctggcagtagcctggcggctctcagccacgcctttgacatcctgcagccgggaggcttgctgtcggtcatgtgctacacaggtcacccagggggtgtggaggagactgatgccatcatttcttgcctttcagaactcgagcctgccagctgggtagtgactcagctgaagcttctaaatcgaccatcagctcctcttctgtgcaccgcatggaagagggtccgaaagtga

SEQ ID NO: 3808 - DNA, 885 bp, Chlorella protothecoides
atgtcagacttctcaacctgctaccacactgccaggcttggaccctctgctgaatgccttggaggacaccagctccgattgcctgtggcggtgggacctccgagaatcgcgctcgctgccgcatggcctcagggcacgaggggcggctgccaagaaggaggcaaagctgcactcgatgcacttaccgaggtgctgaagactcaggccgagggcgacccaccaaccgccaagctgcacaaagtctgggatgcctggaggaaggtggggagctgcgggcggccgctttcctatgattcgaggcggatcgtggaatctgccgccacttctgtactgcgaactcaggtccacacgccaacgtcacaggcggctgctgtagccgcatcgccggcacctgcagagaagcttcccgcacccagcgttgctgcggccgctgccgcccttgctccccccgtcgaggacaaggctcgactgcaggcagagaaagacgctgtgcgtgcagcggagaagaaggctcgggaggatgccaaggccgccgccctgcaagccaaggtggacctgaaggctgccagggaggcagaacgagccacggccgccgccgcggcagcggaggcccggacccaggcgcgcgccgagcgcgaggctgagcgcgagaggcagcgagcggagcaagaagcagagaaggagcggcagcgtgccgagcgcgaagccgaacgggagcgccagagggaggagcaggaggtgagggcgaagtgggagtggggagtggggacgtctggtgttcagattggtctggatgatcaagctgccagggccctaccctcctacaaatccctgcatccccttgttcttaatttcttcctggatgcatggtccccttgcgcttga

SEQ ID NO: 3809 - DNA, 891 bp, Chlorella protothecoides
atgaagctgccccccggccatgtagctggagtgggcgtggtcaaacccactggctacggagggtatggcgagcgcatgctgaagaccatgggctgggacaaaggccagggcttgggacgcacaggggagggcatcaaggaggccatccaagtgaaaaagaaggaggacagcgtgggagtgggcggccgagccagctggaagtgggacgacaactggtgggagagggcgtacagcgagtcctctgccgccattgatgccgtgaagaaggatgaagacagcagcagcagcagcagcagcagcgaaagcgaggatgacgccaccacttgcgtgtctcgccgcaatcgcgatgggactgccagctcggcgtccgctcacgaactggcgctgctggatgcactgacccagggtggttcccggctggccgccggccgctttggcggcagggagggcaagatgtcgaggatcagagcgcaggaggcgcgagaggcggcggcggcggcggcagccctcggcaccgccgtgccagatggcaggacctccaagagcaagaaagcacggagcgatgcggatgccaggccggcatcgcaggaacctgccgcgcctcgcattgtcgtggaggtgcattcggccgaggccagcgctgcggcggcggccgccgcagcgctctggaggcccacggagttggagggctggtggggtcggggcatgttctccccagcgggcgtgctggaggggatgaggaaagcgcaggaggacgccaagcgcggcttcaccgaggacgaccaggtggagggggggccttttcggggtatgggctggcacacctgcctgctccgtacaacattccctctttcatgccagcggcagcgtgcggcgcgggccggcctctga

SEQ ID NO: 3810 - DNA, 546 bp, Chlorella protothecoides
atggctggcacccccggcgctgccgggccccgagggctcacccccaatactggcggccagccggccgccagggagagggggtacgcggagctgttcctgaagccggagggcgagcctggggctgttccgccaccggcgcggggcgacagcatggacgccgagctggcaaggggcctgggcgaggccgagtcagagcgagcctttggcgagtggctggtgcgggcgcgcgcccagcgccgggcggcaaccttggagccccgcctgggcctgccgccctcctgggcgaggcggcgcggcgcggcggaggccgcgcgcgagcggtaccaccgcctgcgggacgacggcgttgacccggcgcaggttcgcacctggcgccgcaagctgctctggttccccgccgactcggcgaggcccgccttccacggctcctgctccggcgcgccgaggggcggcgtggggccccgcaggccctgggcccgtgaccctgtcttggactacgaggtcatgtccgacctggactgggaggaggagccggagggtgagtga

SEQ ID NO: 3811 - DNA, 603 bp, Chlorella protothecoides
atgggcctcgcccgctggctggcagccgcttcgcagaagccctatgtgagggtcggcgtccagtgccacactctgccttcccccgcacagatgggagtggggacactggtcatgatggctatcgtcagccccgtcagtgtctggagcgcgctgtccctggaccccgtggtggtcagccccacctcttccattctgctgctctactggaccagcgcgctggccctgcacattggcatgtcggtcctccaggtcgcggctgggatcatgctggcctcccccatgggggccctggtcgccgcgggtgtgtcctacctgatcgctgccatcaacggcggcagccagctggaatctgggaccaaggtgaggggtgcatgggcgcgggtggcgcgcctccctgggccagcagccactccgctggaagcctcatgccctgattcccatcccgacggctgcgcccatgcgctgcagtcaggactgaagtgcagcgtgcggggcatccctggtccgacctgccacacacaccaagaatgtgttgggtgggatgaggaacgctgtgatcagccccttccacatccgggccacctacgttgctcctgggatgag

SEQ ID NO: 3812 - DNA, 813 bp, Chlorella protothecoides
atgggcgctgcaggtgcattgggtacctttgcatggaatgcgacggcgtccaggggtggggtgttgtttggggggttggattggccccggagccgaagggtgggtcctgggccaccccctttcacccattcccccaaccgccactcaggcgccggggggcggctgtggctgaggcgcgccgggcctcggcggcgtggcggggcgctgccccatggcgttgtaaatgtagcgcgccttcttctctgccggcttcaggatctggaaggagcacatgagcgtctcgtccaccgacatcatggcccccgcgttgtcgaactcgccgcagtagttgggcgcagagaagatggtcaccagctggcgcttggcgaagaactcgtagccgtcctccaccacctggtgcgcgcggcagatgaggtccaggtcatgcttgttcaggaactcggtgatggtccccaggccaaaggtgtagctgacgccgcggtcgttctcgccccacccctgcacgtccttgtctgggtcggcccagagcaggtcgcagaggaggcccgtgtcggggacgtcggtggggcgggggatgcgcttgatcagctccagcgacttgagctcgggggagaggccgccgtgcatgcacaggatcttctcgtcgatcagcgccgccacgggcaggcagttgaagcagtcggtgaatgtcttccacagccggatgttgtaccgccgcttgcactcgtcgtagaagccatagatgcggttgatggacgcgcactcatggttgccccgcaacaagaagaagttctcggggtacttgatctgtga

SEQ ID NO: 3813 - DNA, 1029 bp, Chlorella protothecoides
  modified_base (140)..(149): a, c, t, g, unknown or other
atgctcatgaccaaggctgcaggtttcctcgaggcagctcctggccatgcatgccacacgccatgcttctcgccaacacctgcaattcctgccattgcctcgtgttcttgcgagggtcatgcgaaagcgattcatggtcnnnnnnnnnnccacacgccatgcttctcgccaacacctgccattcctgttattgcctcgtgttattgtgagggtcatgcaaaagcgattcatggttttgaagcatctgaagagcccccctttagaggaatcagatcatccctgggggttgaggttgcgtgctggtgttcccgccattcggtcaaagcgcatgggtcaaagctgtcccgtgagaggccccgccccccgcaactcataggagggacaggggcccatccccgcgatcgcagacggcgcgagaactccgatccgaaattggtcagggcattgcacgatggagaagaatccgtggtacaagaacgtgcaggggcccttcctgcagtggcaaggtcccaccggcatcaaggcagatggcggggggcattggggtctggctccgtggatccctcgtcattcgaatggggcgccgggaccactgaccaaccaggacccctccctccccctactccagccatcatccgcgcggtggacgccggcgcggatgtgaacgaggtggaggcggccggaaacccacccctccactccgcggcctatgagggctggacggagggctgcgagctcctgctcagcctgggcgccaagatcgatgccagcaacaacgcgggggaccggccctggcactgggcccgcaacatgggccaccaggaggtccaggacttcctggagcagaacggcgcctccacggagcagggccaggtgctggtgcaggaccatgtgcccaaggtcaaagactttttccagaaggagtgctgggcgcaccaccccaagccccacgccgagtacatggactggcggaagaaggaggacgaggcctacgaggcggagcgcgccaagctcatccccggcatgtag

SEQ ID NO: 3814 - DNA, 690 bp, Chlorella protothecoides
  modified_base (75)..(84): a, c, t, g, unknown or other
atgggcgttctccccgctgcaagtcgcttgcgtttgaccagtattgtgcaaagagtacaccgctgcacctccctnnnnnnnnnnggggtgggggccgatgggcgttctccccgccgcaggtcgcttgcatttgaccagtatggtgcaaagagtacaccgctgcacctccccccgtgtctacagccactgtactcccagcctgcaacccctggatccccttcccccatccaacccttttcccactacaccaccactaccgctccacgccaggcgccggccatcgggcggcagtggcacacctggagcccggaccaggacgagcatttccggtacgaggtggcgcccgcgcggcgctgcttcgactcgcccgaggaggtggaggcgctgacgcaggagggactgctgcgcggcggcgccgactttgtggctttggtcgctcagggccaggactggtacgacgactccctcctccgcttccccgtggacgacagcgaggcggcgcggcacgccatccagagcctgctcggtgtgctggccctggcggcgttgccagggtcaagggcactgcccctgggccacaccgtcatgtaccgcgccggcctcccactgcagctggagtttgccagggcgttgaggcgggagctgacgcgactggcggccgagacgggggcggaggtgggggggtggtga

SEQ ID NO: 3815 - DNA, 918 bp, Chlorella protothecoides
atgcctacatcttcgacacaccccctcctctcaggcgacattcacgggcagtactctgatctcctgcggctctttgagtacggaggcttcccgccagaggccaactacctcttcctgggcgactacgtggatcgagggaagcagagcctggagaccatctgcctcctcctctcctacaaggtagtttcatcacttcctggtcatgggccggccagcatccctttcccatccctcgcccaccccattaaatcacagatcaagtaccccgagaacttcttcttgttgcggggcaaccatgagtgcgcgtccatcaaccgcatctatggcttctacgacgagtgcaagcggcggtacaacatccggctgtggaagacattcaccgactgcttcaactgcctgcccgtggcggcgctgatcgacgagaagatcctgtgcatgcacggcggcctctcccccgagctcaagtcgctggagctgatcaagcgcatcccccgccccaccgacgtccccgacacgggcctcctctgcgacctgctctgggccgacccagacaaggacgtgcaggggtggggcgagaacgaccgcggcgtcagctacacctttggcctggggaccatcaccgagttcctgaacaagcatgacctggacctcatctgccgcgcgcaccaggtggtggaggacggctacgagttcttcgccaagcgccagctggtgaccatcttctctgcgcccaactactgcggcgagttcgacaacgcgggggccatgatgtcggtggacgagacgctcatgtgctccttccagatcctgaagccggcagagaagaaggcgcgctacatttacaacgccatggggcagcgccccgccacgccgccgaggcccggcgcgcctcagccacagccgccccccggcgcctga

SEQ ID NO: 3816 - DNA, 2139 bp, Chlorella protothecoides
  modified_base (124)..(133): a, c, t, g, unknown or other
  modified_base (837)..(846): a, c, t, g, unknown or other
  modified_base (1468)..(1477): a, c, t, g, unknown or other
  modified_base (2017)..(2026): a, c, t, g, unknown or other
atgcatcacgttactgtaaagagggagtctcgtctgcggtattcagagcatcagcgaggtgggtcacgacctggaatgcatggacacacggcgcctcgcaagtgtgcagctgctgacatgcagnnnnnnnnnnaggtgggtcacgacctggaatgcatggacatacggcgcctcgcatgttcatccggtcatacaccgtggcagcggggccgggactgcacccagcctctgtccaggtgcgtgggaagtctcgggcctccagcttcacgtacatctaaagagccgcctcttcagcaccgctcatccccttccttcgccccctgtgcggagcagacaccagccccccccggtcctgggctcccgaaacttgtggtctttggaggcagtggatttgtggggacctgggtcctgcaggctggcctggatcgcggtgcagatgtgacgagcgtgagcaggaaggggcggccaaagaaggtggggccaggaacgtggggcgacgccgtgcaatggacgctgggcgacgctctggaccctgcccagccctggcgcaaggcgctggagggtgctacaggcgtgatttccaccctgggcgcctttgggaccactgaacagatgtacaaggtacccagggtgttgggagtggggccggaatctgaggtgttggtggcagttttgccctctgctgagtcatccacatccagtgaaaggggggctggtttccatgacgtgtggggaggccaacatcctgctgatgaaggcggcggctgcggccggcgtgccgcgatttgcgttcatttcggtgcacgagttcaagctgccgagcgttggtggcagtgnnnnnnnnnngaggggtttccaggagcgctgtctcccggaggaatgttggtgccctgtgcatgtgacgagtgcgcacttgagcgctgtctcccggaagaaagttggtgccctgtgcgggtgacgagtgcgcacttgtcagtacatctatcgtccgatgcctcccctccccagctgtggattctctcctcatgggtggcttctgctcctaggttgccacatctcatctcacctcgtctggctgcagggggctggcatgcacaggacttccttctcaagggctacttccaggggaagagggatgcggaggcggagctggccgtctcctttcccacaggcggcgtggccttgcggccgggcttcatccatggcgagcgggatgtgggttcagtgtcgctgcccctcagcgtggtcggcacaccctgggccaaggtagacgcgatgaatgggcagagggcagcgaagattgcgtcaaagccacctgtcccagggtttgacttgagcgacattcatccacgtgccacgatgacccaccgtgtcaccatgcgccgcccaccctccgccaaccacgactccttttccccccacacaacccccaaactctctccctgcccaccctcctctccatccctcnnnnnnnnnntgagcgacattcatccacgtgccacgatgagtcgccgtgtcaccatgcgccgcccacccttcgccaaccacgactccttccccccacacaaaccccaaactctttccccgcccaccctcctctccatccctacagttgctgagtgccctgccttcacagtcactggcggacctccccatcgtcggcgcggcgttcgtgccccccgtcccggtcgaggtcgtgggcagggcagcggttgcggccgtgctggatgccagcgtgccgcccggcatcatggatgtggtgagtggtgctggggagagggatccattggcggcctgccctcaccgttgccggccctgttaccaggagggctctggctgttgaccctacagcccgtagtggcacgtagtggcagctcacgatcccccccccaccaagcctcgccctcccaacccccgtcgcgtgcagtggcagatccagaagtatggcgcagcccccggcgcctagcgcgcctccatcttgcaccccgagcctgtgcgaaatcgacacctccccgtnnnnnnnnnnagcccccggcgcctagcgcgcctccatcttacaccctgagcctgtgcgaaatcgacccctccctgcacacttccattctctgcatcagccccggccctcgtcgtacccagtga

SEQ ID NO: 3817 - DNA, 2271 bp, Chlorella protothecoides
  modified_base (68)..(77): a, c, t, g, unknown or other
  modified_base (1405)..(1414): a, c, t, g, unknown or other
atgagcttccacagcgcacaaagaccggaggttgattctccatccaaacctcaagcatggaaattacnnnnnnnnnncacagcgcacaaagaccggaggttgattcttcatccaaaccccaagcatggaaactattcccgattcgggatcgcaggggtcacgccctgcgactcgacagccgccttctggctccccgtggccctggccacagccgacaccccgactggcaaacccacttggaccgagttctccggctgccagtcggcggcgcccgtgctgcagaacgcggcgtcggccggcacctgggtcaaggccaacgccgggcagtacggcttcttccgggtgcagtacgacgaagccctgtgggcccggctggtggcggccgccccgaccctgcctcccactgacctggcggggttgctggaggacagctgggcgctggccgaggcaggggagctgggcatcgacacctttctgaatctcgtcgggtgcgcgccattccaggggagggcgcgcgagggtgggtgggtctgccgtgagggggatcgcggatggctgggttgtgttgggaaatctgacgagtcgcatcccagggctgcaaccgtccctctgcccaccggcgcactgggcacgtgcggaggcttccttggcgaggcgcacagcctttcctcggttcttcaggccctgggggtcccccctcttgacgacccgaccgccaccccgccccccttcaaccctcccacacgcccatccagctcgctggccgctcgctcgccggaggactacgagccctgggcggcggcgctgccttacctggagcgcgtggcgcagctggccccctgcagcacgctgtggcagaactacctggcccagaccctgttcaacaccttcctgcgccaggacgcggggggccaggcgaataccagcactgcccccccgcccctggccttctccttcgatgccccggcgccggagggggcgggggtcggtcagcgactgctgcgccccgccatccttgcggcggctgggcggtacggccacctggccatcacggcccaggcgctggagctggtgcccaacctgacggccagcagcgtcgacccggacgcgcgctccgcgctcctggccacggcggtccgcgccgggcaccgcgacgtgtgggagggcgtgcaccggctgtacctggccgccgacgccgcggatgagcgcgagcgcacgctgcgcgcgctggcggccgcgccgggggcggcggccgatcccctggactggagcctggggccggaggtccgcgcacaggtgagcgggagttttctttgggagcggggttggggagggacgtggaaaacgagcgaggtgggatgtggcgagtgggagggacggtccacccgaggctttgcattctggnnnnnnnnnngggaaaacgagcgaggtgggatgtggcgagcgggagggacggtccacccgaggcgttgcattctgtgtcacctcgctggagaaccaaggatggtgcacatgtgccatcggaggcgagccctggccctgcgaccatgcacgccagccctcgctgcctcgtggacttcaccccctccccttctgccgcgcttctcctcgcaggacatggccaccgtcatcgtcaccgccgcccggacccgccccgacacgccaggcctggtctgggcctggctgggccggaagtggaggccagtgtctgagaagcttggaggtggggcgggggggagggaacgagggggcacgccgcatggggtccctgctggaaagcgtggcgtccctcttctccaaccagaccgcgatcccggaggtggaggccgtcttcgctgccagcagggtgggagcactgtggggatcgagcttcatctgcaagggtgccggggttttgcactgctagactctgtcgtcaaggatgggtttcctccatataggccggaaaagactgccgaggggcagccacacagagccactagacccatgccctacatctcaaccaacgccaactctcaacccatttccacctcttcagggcgtcgtcacggaggggatctacctcgagcgggcgcgagagaccatcgagacgaatgcagcatgggtgaccgcccacggatccaagctcttcgttttgaccaaaaggcattggtggcctctggcggcattccgtcgtgggtgatcgaagatcctcgcgggccgacagtggcgcgccatggtggcactacattcgacaccgggtcagaaaccccaaaggctttgcaaccatga

SEQ ID NO: 3818 - DNA, 627 bp, Chlorella protothecoides
atggtggtggccgacttcctcaccccgctgacggtgggtgcaggtgacgccgcaagagagcagcagtacgctgctgtccttgagcgtgtagtgctcctgcttgatggtaagacactcactgccaccagtcaaatgcatgacgcaccaaccctgctgcatcccatcactcagccgtcctgccctcccaccctcgcatcaggtgaagacgactggatcgtggccatgtccactgtcgcgtccgagctgcatgcagcattcgattatttccactggacagggttttacaggacaactgcccctggcgtgctgaagctgggcccgtaccagggaggcaccgcctgcctcaccatccccttctcccgcggcgtgtgcggtgccgcagctcgagaagccaggacgcagctcgtccccgatgtccactccttccctggccacattgcctgcgcctccagcaccctctccgagattgtggtcccggtgtgtgatcgcagcaatggcactgccattgctgtgctggacattgactcaaatctccccgccgcattcactgcctcggatgtggctggtttggagcatctcactggctggcttgaggctcagagctggaatgccaagtattggccttga

SEQ ID NO: 3819 - DNA, 1263 bp, Chlorella protothecoides
atgcattctattacgttggtatctagaaatcatcgtgcgagcatcagcttgtctgcgtggtcaggtgtcagggcgaccctgttccggagggcgagcgtgacgccagcgcatgcaccgcaggctctcgtcgaaagctttgctgctccatcgtgcacgcaaagcttggctgtgcggacctactccgtggggccggggatggcacaaaccactctcgtgtccctttcaggcaaaggcaccaacccgaagaccacgttgtatgtcggcggtctcgaggagagcgtgacagatgccatcctacacgcagccttcatccccttcggtgacatcaaggacgtatctgtccccatcgaccatgccagcggcaagcatcgcggctttggatttgtagactttgagactgcagaggacgccgcggacgccattgacaacatgcacaatggaggctccaagccagatgtgtgcggtgtcgtgcccactgcacacgcccaccaatttctcacagagctcttcggccgtgtcctgcgtgtcaactatgcccaacccatgaagatcaagggcggggacaagggctgggcgtcgcagcctgtttgggcagatgctgatgactggttcgagagggccgaggcggagaaccagctcgaggaactagaggaaagggaggccaaggctgctgagcgggcagctctcactgcagccgctggcctggacgccatgcaggcagttgaagcagagggtgcacacccacatgcaggccagcaatacaatgccacatcagggagtgctaaaagcttgggcttggggagggccactggagggcaatgggctctcggcgcgggagcggtggggtctcagacatgggtgtttggcacagccgagatgttggcacagcgtgagcgcatccctcttgggtggagaactcccagggtttgctttgggaatgacgtcacaggaggaggtgtgacttcacaccatctcgaagggatcctctacgtcgctactggaggagagggaggcggaggtgaggggcgagacaggtgcccgactgtcaagcccaagaaccttagaccgctccaagatgaatttgtgctccttgtatcgctcccgggggtcctgagccctgatatagagccaccctaccacctagtcggtcacccaattgtgcaagcgttgagctccaccccacctctcggcagcacgtgcagtgaatgtcgcacacggtatgtcgccccgtcgtcagctccctctcctggaggggtatgttga

SEQ ID NO: 3820 - DNA, 540 bp, Chlorella protothecoides
atgtttctgaatatcctgcacgttgctctgcacagcggagcaagcaggcaggcagtcggcgcggagaaggccgccgagccagcaggtttctcaccacgtgccacggacgccatcattccacgacaggatgaggatgtgatccgatttttctccgacggcagcatcagcagcgagcttcggacaggcattgaagctgtgcgcgtcgtccgtgatcgcaagaccacgctcgggaagggcatcgccttcatcctgtacaagacgcgctcagccgcccgcagcgcagtactgctggacgggcacgaactgggcggtcgcaagatcagggtcacgcgcgtcaaggcctccgcggtgggggcgggcgcgtcagcgtggcagggcgccacggctggacccaagcgccgaggcgtggccgctgcgggggtggccgccaggtcagcaaagggcccagccaagaagctcaagcgggcctcggaggggaagcggccggcggtggcggcgaggaaggcgcgcaccctcgccaaggccgcccgcagggcctga

SEQ ID NO: 3821 - DNA, 309 bp, Chlorella protothecoides
atggagtggtggggagagctgtggctcaacgagggctttgcctcctacctggagttcctgggcgctcaggccggtgaggtcacagggagggctgctgcctgcctcgactgcgatttgcggacgtcgggctggtctgatgacccccttgaggcttcaagcctgggggccggaagtagcgtccaggcctccccggagctggacatcttcctcagcttctacactgatgtgctccccgacgcactggaggaggactcgctgaacagcagccacccgctgtccatcccacaaggcatgatgggggtgggctga

SEQ ID NO: 3822 - DNA, 423 bp, Chlorella protothecoides
atgcaggccgccaggtgcgttgtcctgcacgccgcctccggcctgggcatccagggcgtctggctgggcaatggcaccggcggcgcacagggcgagctgagggaccgcccggggcaccagcagctcgtcctgcaatttccctccacccttcagccgggggaggggaatagcctgcacttccgctttgcctacaacctgtccgagggcctcagcggggctgcgagcttgggatgcagatgtgggaaaccctctgaaaggcgctgcctctccctggtcttctggcggcaccgcatcaccgccaacgtcccagctgtgctgccgctgccctgctccaaggagcgcctggcagctgcctggtgggctctcaggacatgcacagtttgccagctctctaaccccttctcgttccccttccccctctag

SEQ ID NO: 3823 - DNA, 471 bp, Chlorella protothecoides
gcgcggtcggcgcggctgctggcggccgccgaagcgctgcacgtgctccgccccctgatctacgcggcgacgctgcggcgctggggtcggcgcgcctggcgcccctggctggccagcctgctggtggacctggccagccgccagctcagcttccgtgcggccgccacctcgcgccaggccgcctacgccgccgccgcctcgcccgcggtgcagggcaccagcatggcggtgctgtaccgcctccagggcatcaggttcacggcggcggagtctgaggagctgctgcgccgacgcacgagcctgctgttctacctccttcgcgatccggtgtttgcaagccacacccggcctgcgctgggcaggctggccggcaagctggagcgggtgccgctggttggctggggagggggccggctgctggagatcctggacggcatgcagcagctctactcctacaccagtgcgagctga

SEQ ID NO: 3824 - DNA, 312 bp, Chlorella protothecoides
atgacaggtaccccaagccaaccccctcacaccattgcaggcgtcaacacttcggagaggatagagtcgctgttcgactccatcgagtacaacaagggcgccgctgtgctgcgcatgctgcgcgcctgggtcaatcgcggggcgggcctgggcgccttggaggtcgccgctggcatcaaccccgcccaggcgtacctgaaccttggcgcctacaatgcgaccacagggtcagagctgtggagggccctggccggcccactcggactcccagacctccccaaggtggatgggttacctttcatggggaactag

SEQ ID NO: 3825 - DNA, 657 bp, Chlorella protothecoides
atgcaccctcaggcatccgcgcccccacaggccggggacaggccggaggaggccgctgcgcgctcttccgatggtccctccccagaccccgcgcttgatgccccacgggcatgggaggaggctcttgatggggagagagaacagctgtttgccgggttctccggccgcatggagccccaggtggtcgtggccgagctccaaaggcgtcagcaggaggcagaaacccttcgcaccgagctggggacctctcaggccgcgcaggcgcagctgcatgcctccctgagtgcgatggccctggagaacattcggctgagggatgcgctggcggcggcgcaacgggccgccgaaccgagcgtggtccagctgcggcaggtgctcctggaccccgccgtcaacgctgagctggcgaggctgaagcgagagttggagcgtaggtcgggccggggaccggacgaccctgcgactgggagggtgagccgccgtggcttggcgtttggttgtttgctgaggtggggtcgcatctgcagggaaaatctggacgagggcaggcaaagcgggcggggcacaactgtgcatggtgtttggggttgccagctgtgccagtcggtatgcgcacagattgcttgtgcttgctccctcttgcctgcaggctggtaa

SEQ ID NO: 3826 - DNA, 294 bp, Chlorella protothecoides
atgtccacctacctcctcgcgattgtgattggggagctggcggggacctctcgcctcgccccgggtgcgactgcaggggcagaccctcggaacgtgaccgtctggggaacgccagacaggcgtgccagcctggagtttgcggcagacatcgcctcaaaggtcctgccggcctacgaggccgcgtttggggtgccgtactccatgcccaagctggatctggtggccatccccgacttctctgcaggcgccatggagaactggggtgcgtcgctgtgcccgggctattgctgctga

SEQ ID NO: 3827 - DNA, 618 bp, Chlorella protothecoides
  modified_base (50)..(59): a, c, t, g, unknown or other
  modified_base (264)..(312): a, c, t, g, unknown or other
  modified_base (375)..(384): a, c, t, g, unknown or other
atggcccaatccgccgccacatctttcggcgcaattttgccggtcaccgnnnnnnnnnntataccaaatacggctcagggtcagcaccacgttgcgttcatcacccgcccaatccggcgggctgttccacagggtcagggtttcgttcagcgcttcaaacaggtcctgttccggcaccggatcaaacagttcttccgctgccggaccaaccagcgccacgctatgttcacgcgctttggtcagcagaatggccagatcgatatnnnnnnnnnnnnnnnnnnnnnnnnnnnnnnnnnnnnnnnnnnnnnnnnnacggtcacggtcaccagcagatcaatatcgctatgcggtttcaggccgccatccaccgcgctnnnnnnnnnnccattcgccaaactgcagctcacgtttcgccggataacgccacggaataatgtcatcatgcaccacgatggtcacttccaccgcacgcagaatttcgctttcacccgggctcgcgctggtttccagcagatcgttaatcagcgcacgacggggtcggttccagatgacgttcaatcacgcccaccacttcagacagctgggtgctcacttccgcaatcaccgcttcacgcataa

SEQ ID NO: 3828 - DNA, 957 bp, Chlorella protothecoides
atgattcagtggcgtagctccaccgacgatccgcgcatactactccctacacctgtgatcaagactaccttcaatccaatacttggagagtgtacgttgcctgtcgagcaggcaagccggcctttcggtcggatctccgttgcagccatgcacgcatccatatgcctgaagcctaccccactctcgcgcgcattcgtgccacggggcaccgcccctcgctctcgacactgccgccctttccgtgtcatggatgatggatctgccctactagctgttggcgggaccgcggcggtcgccgcggtgtctgcggcactgctggccgctgatcccgagaagaggcgtgcggtgcagacccaggaggccggtggcaatgagctggaggccgtggccaactacttcaacacccagggcttcgagaggtggaacaggatttacggtaccaccgacaacgtcaacaaggtcgctgtgaatagggctgcaggggtgcgtagatcttccaaggcagattttctgacactccaacatgtacgggatccctcaggtgcaactggacatcagggagggccatgccgtcactgtcagcaaggtcctgaactggcttggagaggcctctctgcatggcgtcactatcgccgacatcgggtgcggcacgggatcattggccatccccctggcgctcaaggcaagcagagctcatgggcaggagaacccagcaagttggttgacatttttacgacactctgccccacttgctgcctccagggagcgtcggtgacggcttccgacatctccgaggccatggcaaaggaggctgagcagcgctacaaggcagcgagcagtgagccaggtgccaagaagccccgcaaggcgcccacgttccaggcgcaagacctggaatcatgctcgggttgttttgacacggttgcatgcattgatgtcatgatccactatcctcag

SEQ ID NO: 3829 - DNA, 3603 bp, Chlorella protothecoides
  modified_base (1334)..(1343): a, c, t, g, unknown or other
atgttgtccttcggcgcgtgtcaagggagaatttccactttgcaggcttacagctccgccgcaaggacgccgtcggtcacgcggcatggagttcaagtgatcaccgtcagaccattcaagtcacagcatccactactgcatagacggatagctctgccatcgaggcactgcggcctttgtcgagccacctccccaggggaagccaccgagaaggaagctctggtaaaacgggataccgagcacgtcgaccagcttacttccactacagaaaacgagcacaactatgccaatggaaaagagaatggggtcgcggaggccacggccgatgctgccgcccagcctgccaatcagaatttgtatattgcggcgagcgtcgcagctgtgttcatcttgggcattgggaatcgtgtgctctacaagctcgccctcgtcccactctccgattactcattctttctagcacagctacaaacttttggctaccttgcagtctacttctccgtcctggcctacagattcaggtgggaaattggacgattcaaaccttgcgatccgtacatctgcaaaggggaggcgcagttcacccctccgacacccacccaattgcacctctgtcttcatatcaagcagagccgggaagatcacaagctccatgatcggggtggctggaagcaagaagaagctcctgtttctgattggcggcgtggaagccgtatcatccgtcctgggattctatggagcttcgcagctcccaggttgggttgggttgggatgtcatacggacagagatggtgcgagtctgttgaaggttgcctctcctggctgcgactgaattgggctcgcgttccatcaccatcctgtcaacattttggcagcctcattctcatcaatgtctcgcctctctgcaggagtggtattgccgcttctcggacagacggtgttattctggcaggtgttctttgctctcaccctcctgaagaagcgtctgagtacggtgcagcttttatcaataagctgttgattgataatttaacgcctcacctgtgcacggtggtccagatgcttggtgtggctctcgttgtgctgggcgtctcggcggcagcttggcccagcaatggttcgtctcctcttgcaaatgtgagatacatctgcctcagctttgcatgtcatcagtaccctcccgatgcacacctcatcaatctccttgcccaggtaaatctcatgtttgctgcaatctactgtgcgtccatgattttcccagccctcgactccatcttaaaggagcgtctcttcaggtcaggaatcggcgctgcctcttcaaaggagcactcttnnnnnnnnnnaaagagggtttgggcagcacctccccctgtctgcgggatgtgctcgtggaatggcgtggcctttgaggtggtggagctgcttgagcctcttcaaaggagcactcttcctttgaaagcgaagtctgtgtcgctcaatctgtggattcaagattcctccctacctcgtgcatccaccaacagggaagccaaagagactctgaagggcaaggatctggatttattcgttgtcaattcttttgggagcctggcgcagagcgcctgcatcctcctccttttgccgttgcttgcccctctgcgcggcatccccctctctggattgcccggataccttgctgaaggggggggtgaaagaggcagggaggtgtactgtgactctctgcctcaaaactcaatctggacgatctcaggacaggagtgcatggggttgaagctcatggctcagttgatcaccgccatccattgttcattcatttcattcctcgagcatgtcacaccatcaggctggtcggtgttttggggcctggctggaggtgccactggggcgcccatgctccccctcctgtacatcggcgcaaacctggctttcaacatcgcagcactgaacctcgtgcggtctgctgggaacgtcatcacctcactggtgagaatgacggcgtgctgggatgtgttactttctggtggaatctgggtgattgtgtgcgtgctttgtcatggccagcatcgttcctttcaccatctatgcattcactgtgagtggattggtggagagatggggtatccccatgttgtgcaagagcgcagcttgaggtgtagattctatcaagctctgctcccacaacatctcgcctcccacctaccctccccctcacagtttgaccttccgttcctcccgctgaacccgcccctcggcctcccattcctgcttggcaccgtggtaatggtggctggactggctctctacaacgggccgcagtggatcggccctgtgcgcggtatgattagcaactggctcaacacagaagaaggtgtgcgagtttctaggagctggagggaacatgccagtctgacgtcatctgggagttgcaagctgattgatcgtagattcacaatagttttgaatgtgcagcttagtgccatgcccaggagcaacactgttctcctgtcatccccttgcagcatgatcccaacagagactgctcacaggcggctccctgcttgtgacattgcaactttcttatattggtggcggcttatcagcacgctgaattgttacacgcaccaccccttcttcggtgattctgtatgcatggtgtgcaaaaggaggcacacagaggcgagtgcacgccttttagtactctttggcattgtgtggagggattgtgtgccggaatttcaacctctgagtgctttggggtgcctcagtacaggcgacagacacccgtctatctcatgggctgtaaatctgcttccctgtcccaaggatagcagcggattcttacttttcatgaagcaatgcaaacaaagtacgatgcatgagaatagtagctggaccaggaatttggagcttggaaaaggggtggcattctgcgaggtggagaaagacgagcgaggggagatggtgaagaggttggttgacacaaaagatcccgcgcttcctcctttcctcccatgctgcgtagcagcagtccgcgccgcggggcgctttaccccgcacacgtctgctttccgaaaccacaaatggactcctttgggtgttgggggccggtgctggatgcacccccgccccgcacgggcaacggaccgcccgaccgcagcatgttgcggagttaacgacagtattggtacgagccttgcggccggcgcgtgtccggcagccgagtcaaaggcgggaacgacgcagcgcatggagcctcagacccctgtcgccatggctgggttcagcaccaagagttgtgctggccagcacagtgccctgccaccggcacgcacatcggcaaaacctgtgctacagtctacgctgacggtgccattggaggccctagagagaggctacctcccggaaatggccgacagaatcgcgcaatttgcgaccgagcgagagaaagctgagcatgaggaaggagctcgagatagagatatgagtcctatacaccaacaacacctcatcaatgccattggagagagaggagccttggaccattgggagaggagaatcttcgccgcgtggcgaagcacggggcgtctgtccgaccaggcgtga

SEQ ID NO: 3830 - DNA, 624 bp, Chlorella protothecoides
  modified_base (251)..(260): a, c, t, g, unknown or other
  modified_base (496)..(505): a, c, t, g, unknown or other
atgtcggcggacatctggtccctgggcatctccgccatcgaggtgggcgcgtggtcgaattattttgtctggggcggagaaagggcaagggctgggcgcttgtactgcaacctggacaccaggtgggcgcgtggtcggattgttttgtctggggcggaggaaggggaagggctgggcgcttgtacatgcacctgcagcttggataccaggtacgccactacgccgccgcgaccaactcttcaaggccggcnnnnnnnnnnccctgcctctgagcttgctgcgccggcatgcgaacagcaaaagtatccctccaacgcgcagatggcccggggagagccgccgcggggcgaggtgtcatccttccgcctcctcttcatgatcgtgcgggatgagcccccctccctggagggtcccttctccacagagttcaaggactttgtatggcagtgcctccgcaaggcgcgtggtgctgggggtggagggttttactggcgcnnnnnnnnnntcccttctccacagagttcaaggactttgtctggcagtgcctccgaaaggcgcgtggtgctgggggtggcgggttttcgtggcgtcgcgctgcccttttctgatgtgccgagttggtga

SEQ ID NO: 3831 - DNA, 189 bp, Chlorella protothecoides
atgccctacgccctcgtcagcgtcaccctctgcaatgaggggccagacgcctaccgtgccgaggagctggggcccagaatcacgatagagcggcgcatcaacagcagcactggtggccacatcaagatccgagacgcgcagggccgggaggtgggagggaaagggcggggtggtccgagggaggtttaa

SEQ ID NO: 3832 - DNA, 441 bp, Chlorella protothecoides
atgccacacgggtgtaggctcccttccacctgcaatgcctgggtcctgcagcctccaagacccctcttcctcaccggctctcgacaggctgaggcccccctgcccagcgggcaggccagggcgggccaggtggccaccatcacgctggtcaacttcatgtgccacgagcacctgaccatggactttgggcccaacgtcaccttcatttcggggtcaaacgggagcggcaagagcgcggcgctcaccgccctgcagtgctgcctgggtgcccgggcccgggacaccggcaggtgcggtgggcgtggctgtgggcatcgtttgtcggtgcacgcgcgctgcgggcttgcatgctgtagtgtgggatgccccgcgctctggtggcgggggccaggcctgaagccgggcggcgttctgtgcctgcctcaacgctctgaggaatga

SEQ ID NO: 3833 - DNA, 873 bp, Chlorella protothecoides
ctggccgggtacgacggcggcgaggcgcacgccgcgcacgccgcgctggccgacccggggtcgtacgaggcgctggagtcggggctgaccttcctggggctggccgcgctgcgcgacccgccgcggccggaggtgcgcggcgccatcggggcctgccgcggcgcgggcatccgcgtgatcgtcatcacgggggacaacaaggccacggcggagaccatctgcgccgacatcggcgtgctgggcggcgcgggggacgaggaggatgggagcgacgacggcgcgtccctgccgcgcagcctgaccggcaccgagttctgcgcgctgagcgaggccgacaaggcgcgcgtgctggcccgccccggcggcctctgcatctcccgcgccgagccggggcacaagcaggacgtggtgcgccgcctgcgcgacgcgggcgaggtgacggccatgacgggggacggcgtgaacgacgcgccggccctgaagctggccgacatcggcatcgccatgggcgtgacggggacggagggggccaaggaggcagccgacatggtgctggccgacgacaactttgccaccgtggtggccgcggtggaggaggggcgcgccatcttcaacaacatgaaggccttcatccgctacatgatctcctccaacatcggggaggtggcctccatcttcctctccgccgcgctggggctgccggaggggctcatccccgtccagctgctctgggtcaacctggtgacagacggtccgccggccaccgcgctagggttcaaccccccggacccggacatcatgagcaagccgccgcgccgcggcagcgaccacttcctcaccccctggctcctgttccgatgggtggtgagctga

SEQ ID NO: 3834 - DNA, 975 bp, Chlorella protothecoides
cgcgcggcggccgcggcggccgcggcgctggcgggtctcgctcctccaccccccccacgcaatagccggcctgtgcctgccctcgagaacgaagagccccaatcctgtttgcctcgccttgcgctgcacctttccccgctacccactcgaacattttccgtgccacaagcaagcaatgtccctgctgctccccctgtctaccccccctccacagccgcgcctgacgatgttcatcaaaagtgcgcacagagcaaccgtcacgagagcgggcagggcgcgggatttgagcagggtaccaaggtcatcagaccccgaccccagaatccatcctgtcctggtggcagcctgcatccctcagtcccactattcgagcttggccttgccggcggccctgtcggctgcagcggtggacttgttgacccaggtcctgcccaccgccttgagcacctcgtcgatgaggactacggggagggagtaggccagcaccaggagccattcctggaaggagagcgggacgatggagaagacgtctgccagcaccgggacatagaggatgaggaagtggaggccgaaggagacggccatggccaggaggagccaggggttccaccacacgggcacagtgacgagcgagttgtcctccgacagcgcgttggcggcattgaacatctcgatggccaccagcacggacagggacaaggtggaggccttggccttgccggtggtgaagtaatcgcaggggtcggcgaactccaccgcgcgcgcgccggcagtgtagttggccgcggtgaagccgggccaggaggggcaggactcccagtcgcgcagctgggccagggtgacgggggtgtgcccgtcgcgcgacaggtcgatgaagcccaggaaggtggtggaggtgtaccacgtcgcaaaggcgcccaccgtggcaaagcccacatagcagcccaccacctgacaggggggcgggggtgttag

SEQ ID NO: 3835 - DNA, 2169 bp, Chlorella protothecoides
  modified_base (1049)..(1058): a, c, t, g, unknown or other
  modified_base (1411)..(1420): a, c, t, g, unknown or other
  modified_base (1501)..(1510): a, c, t, g, unknown or other
  modified_base (1593)..(1602): a, c, t, g, unknown or other
ctgttgccggtggggtacgttgccttgctccccctcacgctgactgtgcatcccacacggcagttgactcgacatgatgcagactgcatgcgctcgttaagcgagtttgtcgagactggtaatgctgatgttcgacctcagccccagatcagcgttcaaggcacgcgcaattgcgtcggcgttttgcaggggatctcgggcccatgctgggcatgcccggcgaggctgctgggcatggtgtctcgccacttcgtgagcatcacggccttgttggcctgcggtctagtccctgcgctcgcgctccagacctggtcactgggggacagcgcgacgtggagcctgaacaacagcgctggctccgcaaacataagtgatgtgcccgtgaccctcccttcatgcgcccttggctccctgctggaggacggacgactggccggcgacccgctgtacaggtacaatgagctggactaccggtgggtggcggatgacacatggacgtggacggccagcttcccctccccgcagccggccgagaacgccacgcactggctcctgaccatcggcgccgtggacggcgtgggtcaggtggccctgaacggcaaggtcctggcctttccccgcaactcccaccggccggttgaggcagacgtgagtggcctgctggcggaagatggcaacaacaccctcaccgtgacaatcgaatccgcggccgccgtcgctgcggccgctgcggccgtctacccctaccaggtgcccgccgtgcgtcaggtgggcggcctcccccactacaacttcatccggaaggcggcgtctgactttggctgggactggggccccgcctttgcccctgcctgcatcctgggcgacgtcacgttgacggcctacagcggcccctacctcaccggtgcgctgtggtcagcttccctgtggctttgggatggcaaggcagggaaaggatggggttctgaaggggaactcctcagccctgacatccagcatctcgagaacgggcgtcacatggagcctggcgctggcacaggaggagcagnnnnnnnnnnagggaactcctcctcagccctgacacccagcatgtcaagaacgggcgtcgcatggagttggggcagtaaatggcgggcaggcctggcgctggcacaggaggagcagagcaatggcagcttcctgatcacggccacggcattctttcaggccccgcccggcgagcatggcggcctactcatcctggacatgggcaaccagaccttgtctggggcctggagcacggagcaggaggtgctgctgtcctgtggtggggctaaggaaagcgcggcggtgggagcctcagcatcgtcgggccccgcctgcgcagctgcggccgccctcccggccagctgcagcgccgtcatctctctgnnnnnnnnnncggggcctggagcgcggagcaggaggtgctgctgtcctgtggcggggctgaggaaagcgcggcggtgggagcctcagcatnnnnnnnnnngccatcgacccgcccttccggcgctggtggccctgggagctgggggcacccgcgctgtacgacctggaggtgcgcttcgagcnnnnnnnnnnaccgtcgacccgcccttccagcgctggtggccctgggagctggggtcgcccacgctgtacgacctggaggtgcgcttcgagccggaaggggcgggcggcgcgctttcttccctcacccgcgccgtgggcctgcgctccgtggagctggtcaccgaggccctggtggagggcgggcgcgcggtgggggagaccttcttcctgcgcgtcaatggcgtgcccatgttcgcgcgcggcgccaacgtcatccccgacgacgtgctggagagcgcggtgacgcccgccaggctggcgcgccaggtggcggacgcgcgcgcggtgggcatgaacatgctgcgcgtgtggggcggggggaggtacgccggcgacgcattttacgccgcggcggacgaggcggggttgctggtctggcaggaggttatggccgcctgcgccgcctacccccgcgacgcacccttcctggaggaggtaagggtggtcggggtgggaagtgggtcgtgtgtattgggacacgcggcgtgctggtctgggctcggtgcccctgctcaccgcgtcccttgcggcctttaa

SEQ ID NO: 3836 - DNA, 471 bp, Chlorella protothecoides
atgggcgtggggggttccagggtgtgccactccatcccacctgacctggcatggacagcccacttccagtgtgatcccgaacagcttccctcagcaaatcaccccacaccacccccgtgccccctcccctccacccccagcgatcgcctggagcagctcaaggtggagatcgaggagcagcaggtgaaggcgcggggcaagctcttcccctccgccttcgtcaccttcaacgccaggctggcccaggtgggcgccgtgcgctcgctgatgaatgaggacctgtccacctggcgctgtcaggcggcaccccgcccctccgagatcgtgtggggcaacctggggtggcgcatctgggagcgcgcggggcggcacctgctcatgctggcggccttcatcgcgctcgccttcttcttcatgatccccgtggcggcggtgcagggcctgctcaccaccaactccctggtcgggtga

SEQ ID NO: 3837 - DNA, 507 bp, Chlorella protothecoides
atgctgcgccgggcgccgatgcctgccgcaatgcctgcatacttccatgagaggatgcatgtgcatggtcttcacatgcaaccccatgcaggtttgtcaagtacccaggacaccagaaacctcctcgtttgcggaataagtggggcgcatgggcagtgcaggcaagtgatctgtgctgctgtgtgtccccacccgcttgggtgtggtgggatggcgaacaggagacacgctttctgtaggtggagaaccgtatgtatgcgttggcaatctgcgccagaaatcattactctagcgcatacaaatctccttgctcggtcgcaggtgttcaagatgagcgaggctgaggtgatccgctgtggcgggatggatgctgccatgtatgtgaagatcctcgagatgggtgagcacaaggcagatgggtggcagcgctacattgtccagcaggcgtgtcttcagaacactagtttggcagccgcaataaatctagtgcccagggtggatacatga

SEQ ID NO: 3838 - DNA, 1032 bp, Chlorella protothecoides
atgtgccaggagcccgcctcacagttgctgtacatcgtcgtcaaggacatcgacctcgtgaacgtcaaggtgggggagggagtgggggcgatgtggttgctggtggtgccagctctggctagatgtccctgtgataagaggagttcctcgacgaaaggcatggcactggcgcctccaacgtggtcaagaactcgacgctgcttggtcgggctgcgctgcccatcaaggagttcacccaggtggggttttgggagtgcggcaggcgggacttccctctccacgattgtgtttctggcacgtcagtatgcttacaagcgcctgacctgcctctgttgtccccttgaccaccaacagaggcctggagagccccacgagatgtgggtccccctgggcacgggagactttgcggctgcggcgggctgtgtgagtacactttcgagaggggaacggggaggaaggggtgtgctggtgactgctatgaagtctgactttggctcccagcctctcccgctcagatcactctcacatcccatcctccaacctccgcagggctctgggaggggcgaggtgcacctcaacatcaccttctggccctttgatcagctgaaggggcacaaatcttctgctcgaggcgccgtgattgtcaccctattcaggtggctgccgtggcctggcctggccctgagagcagggtttgagggtgtgtcaagaccagtgcaccaagttggcggatggatgtcgactggttggaggctgggtcaggccagagacacccatctgcaccaaggtagccgctcatcccctggtgcttacattcgttgcacatccagcaactgtgacccacacacctccccgtgcaggtgcaacaaccttgtacccatggaccgccccgtgaaccagtcggaccccatggtggtgttcaagctgaacaaagaaagcaagaagagcagcgtggtgtggaagaacctcaatccccgttggattggggagcactttgactggttccatgtgaggctggcctgggggtcttag

SEQ ID NO: 3839 - DNA, 2073 bp, Chlorella protothecoides
  modified_base (1803)..(1812): a, c, t, g, unknown or other
  modified_base (2053)..(2062): a, c, t, g, unknown or other
atgaatctcgagtgcaccaacggagccctccaggctgtgcccctcagccaggccctgcactcgctggatgccgtctgggatggcctctttgagttcaaggtgtggaggcaaggaggcaaggaggctggtgtaatttttgcatctcagaaatgcggacccccctgtgtgatggaagtcttgcttggaatcacgacgcacaccaccctccgctacatgcctggcagatgtgcccgcaccgaatgctccatcagtcatgattcacaaagcttgcccgtttcccccagggtggcaaggtggagaatcaggctgcgggcttggtgggcttgtcagcgcgcctcatcggccagcagaccgggggagctagtgctgggcctggcgcagatgctgagcaggccactgaaaagcagggcgctgaggggtcgggtgagacccggcaccctgttgctgatcggcccggaagggcggcctcctccatcgcatcggcaggaagctgactggctgatgtgtgagggcactgtatccgccggcaaggccacgtttgtgctgcttgaggcgctgtttatcacctttcaaatggtcgagggccccaaattcaagtcggatctcgcgccttgcccacaatgtcacacccaaaccacctccatcacagcattgcgcaccttcagctcgatcctaccagcttacatctcacaccatggcccacctcgtgctgcgcctcgtcctggtgggcctcctcgtgaccaccgcctcgtgttggcgccaggatcgcaaaccgacgctacgaaggcatctgctcgctccattgacgattcttatggcaccgcgacgttgttgacaccccggggcaagccgccatcacggccctcacaccgcctcgtgacggcccctccccctcttcgggtctcgatgcctcaggagctgacctcggtgtcctgcccctgcaccaccgatggccagagcaacggcgtggacacgggccgggtggggtgcgggcagtggctgggctcccagggcagcgccgagttcgtgtgctacatcgcctcctccagcctctgcctgggcgcggacccccggcagtccacgctcttcgtcggcgccgcgctgcgcgcctgcgatgtcgccacggccagcctgccgtcactggccggcctgctggcggggacgccgcaggccctgctcttcgtccaggcgttgcgtgcggcggacatcgccagcttcccgggctcccagatcacggtgtttgcgcccaccaacgccgccatggccacctacgtcccagccgccgacctgaccgacggtccagccatgcgcgtgctggtcctgcagtccctggcctcgggggcgctcggccgtagcgagctgctggaggcggggcaggtgcgaatggccagcggggacaccttccccgtgacccaggttgcggggccagatggtgaggcgccgggaactggcttgggccagagtggctggatgtggaaggctggcatcggggtggctggatgtggaaggctggcattaggtgtcacgggaatgggcaagccttttatttgttcttatcgtaagcatgaatggggcacttcaggagggcaagattcccgggcgtctcccgattcaccccaaaacctcacctgcaggcaacagcacgctggaagttgggggtggggaggtggtgctggcagacttgtacgcatcagacggggtgctgcacctggtggcggcgccgctgagcacggcccccgtgctgccccccagtcccgcgattggggccggcgagggccccgccccggcccccctgccggagannnnnnnnnntcccccagccccgccactggggccggcaagggccccgccccggcccccctgccggagacgaccccgctctccgacctcgggcctcagcccgaggccgagacgtccagtctcggcccgctggccgagggtgtgaccgacagactgccaggccagcaggttgggtctggcgtcgtgccggccatacagtctggcaaccaggacaccgagccacccgagccggagcccgccgcgcccggggcannnnnnnnnntgagggtgtga

SEQ ID NO: 3840 - DNA, 849 bp, Chlorella protothecoides
atgtcgtccacgaaacttcgactcttcaacacggtgccggacggcaatagcgccgcgagggaaacccagtcctctaaatctaagttcatccctcatgcaaacggaagcagccgctggggcgccctgcacgccctcaccgcctcctggccgctggagttgtcgaacctggtcttgcaggccagcaacccagactgcacggacctcatcctcctccgcttccgggaccacctggtgccctcctggcggtacctctcctggacagtgccctactttgcgtggcactaccagaactttctggagtacggtctgcagggcggggtgccaggcatctgtgcctacaccgcggccaggtgccggtggctggacgaccagatccgggcgggcgtcgaggagggcgcggagcaagtagtcatcctgcgccccggctatgacacgaggccataccgcatgaggttcccccatgtcaaggtgactgagcttcgtgtgctccctaatcggaacctgcacccccgccccgcctttgtgagcgtggactggggcaacctggctaccttcatccccgccctcaccggcgccggcttcaaccctggcaagagggcggtgttcgtggctgagggcctcctctgccagctggactcagaggcggcggacaccctgctcagcgacgtctcggccctgtcggcgcccgggtcccgccttgccttcgacttcctgcatgaggatgtgctggaggggctggtgcagccggctgggtacgccagcctggcgcagagcctggccaacaaggggcgacccttcctcaacggaatgcgccccgtgtactctggtgagtgggaatgctgggtgtga

SEQ ID NO: 3841 - DNA, 1332 bp, Chlorella protothecoides
atggcgggggcagggcccgtggtgctgggccctcccgagcccgagcctgaggatgagggggcgccaggggaggggcaggccctcgtgtaccccaccctgctgccccagggcccgaggcctgcgccagaggcagaggccgactcggcggccgctggtgctgacctggcgatggatgcccctggcctgccgccgctaggggaacctgggctggagccatttgaacccatcctcaccgagcagccagccgccgcgctcatagcaccattgccccggagttcagagccacagagcgagccggctgtccccactccctcgctggagccagcggctgagggggcctcgagcgccacactggtggtcctcccgccagttgttacaagccggattgcaggacctgatgcagagccagtctccgagcctactcccgaacctgtctcagagcctgtctcagagcaagccccggagccagttcctgaaccctctccagagcctgtctcagagccacccttggagccagttcctgagccctctccagagcctgtctcggagccacccttggagccagttcctgagccctctccagagcctgtctcagagccacccttggagccagttcctgagccttctccagagcctcttcccacgcctgtcctggagccagtcccagagctggtccctgcatcaacacagcctctcctggcgcctgttttgaacccaacccctcagccagccttggaaccgggctctcagccaagctccgcacctgccccagagctggctccgctgcgccctcaggaagcagtttcacctgcagtcgcacctattgctgagatgaccccgagctcaccgagccaagaacctaatccgttcctgcctccctctgctgatgcctccagggagacacctgcgcccagtcccaaacgggtcacatcacccccaccgggccccattccgccagcggaagtcgagattccgaccccagaggaggtgcccgccccaccaagccctcctgttgtctttggcggatccagtgtcctcccgacggacgtgggctgccccgagtgccagccggacccagatacatacgccccgctccctgtcacccaagtgagcgccaacgcgctgctggccaccaactgggctggtgaggcggggcctgggtgctggcagcagggatggtttgggggtcgtgggtgcgctgccatgccaaaaggcgaggagtgtggattcttcctctttgctggatctggcgtccttccctgctttgtcgccgggagggagtacaccacacctgggtgtgtccgccaccagttcagccccctcagctcctag

SEQ ID NO: 3842 - DNA, 312 bp, Chlorella protothecoides
atggagcagatgccggcagacatcacccccacctcggccgcgtcggcggacgccgcagaggcctccctgaagcaggggcagctgcacccaaacaccatttcggtggaacgcaagacatttgccagggtgttcaaggaccccaagaccatctggcagggcctgttcaagaaggtgcggctgcaggaggcctgcttcaaggatgtggtggtgctctacaggaaggcccaccctgggccggcccccagcgagctggacatcatcaatgacgaggagaccgtgagcagagcatgcggattggatggtttggtgtga

SEQ ID NO: 3843 - DNA, 204 bp, Chlorella protothecoides
atgcaacagctcctgcacaagatccccacatggctggactttgccgacacagagaagctggaggtgaagcggtggctgaacgacatcatcctcaagtcctggccctactacgatctggccatatcgacgatggtcaaggtgtgcctctgggctgtgtgcggtggggctggtgcctggccactgtttaggcggcatgtggtgtaa

SEQ ID NO: 3844 - DNA, 1803 bp, Chlorella protothecoides
  modified_base (1026)..(1035): a, c, t, g, unknown or other
atgagcaggcgtaacgaccgttggacgattgccaggcacgggacccccctcctcgcactctgccatgcacacgccttgaggttctgtagtcgccggaatacgtcctccaatgcctcctccacggtcacccttcccatcactgaggtcccaacagaccctctcgggaccctgccgcaggcaccagatccttcgcatcgacagaaaaaattcgaacttggagtcaagtcgatgctccgcatgctgtccctggagagcgcgatctcggaacggtgccgagcagtcctcacccgccatgtgagtcatcaggccccaagggctgactgggtggttgctggaatggggtcccagcaactgatcacagcggtgtgcaccgtgattttcgatctggatcagggacagaagatcgagagtctgcacccccctgcgtctctgagtgagggcgatcagcagcgggtcgcctaccatgcattcccagtgagacctggggacgaggagggacatgcactgctgatgtcctgggcactttacaatggatgcacaggcctggactccaccgcccagaagcagctggcgcccgcctccatccgcgactcaagcttcttcttccgcctgccgcgccggggaagctcgctgtacggcttcgtcttctgccgccagcgccaggacgaagcgctgcgccgcggtgcggagcagcgcagctttgtggtgctgtctcccctccccctgcatgcgctgtggaccgcgctggcctgcgccgccggccccgtctgcctcgcctacggcccacacgccgtcgtggatgtgagcgcgctgggggtgcgctctcgccgagcagcagcagtggactgcgttccttgggggcagatgcgtgggtgtggggcaggctgcaaagtggccgccagcgcggatttccgcaggcagactcagtttgtgaggctcgttgtcggacctttgcgtcgtggctctgtcggaggcctggagtatccctccatcgtccctttcccgctcctccctccctccaggtgnnnnnnnnnngcgtgggtgtggggcaggctgcaaagtggctgccagcgcggatttcccctggcagactcagtttgtgaggctccttgtcagacccttgcgtcgtggctctgtcggaggcctggaatatccgtccatcttccctttcccgcccccccctccctccaggtatacgaggcggcgcttgtcttccccatcgcgctgcctctggcagaccgcgaggcgcaggtctggatccggggccagcagctgacgctggccctgcctgaccccgccaccatccccggcacagcggccacacagacgctggacccgggcaccggcctgccccaggccctgctggcggacagccacaagctcaccgccggcccctactcccacgtgcgcggcagggatgacggggagggaagggaggtcgtgctggggagggtgtacaccatgagccacagcccatggagcggttgtgcactgggcgaaccatgggataccatctcagctcaccatcatgaatcggtccattcaagccctgctctgcaggtggatgtgtactctgcgttgcagcctgtgctgcaacacctgtggacgctctgggagctgctggtgctggggaggaggctggccgtcatcggcgccagcccaggtgcgaaacctgctgggatttgtcggatgcaaatgggtctgggcacacggggtgtggctctgcaaagctggcttgatagagtgaatgctggcgctttcccgtttcactccttcctgggcatctgcatcacctcggagtag

SEQ ID NO: 3845 - DNA, 2268 bp, Chlorella protothecoides
atggtctgtcccaagcccaggactttgagtagcaagagctcagaaacctctcctcctcctgacatttcaaatttcatgctcaccagatgtcacgggcctcatggtcgggaggcagtccctggcgctcgtcgccgccaaagtaggtggcgtacaggcggtcagcaggcagactgtacacctgcaggacgaggggagctcccaggcccagccgatggcctccttcttgaagtagtcgccaaaggaccaattgcccagcatctcgaaaaaggtgtggtggtacacatccttgcccacatcgtccagatcgttgtgcttgccgccggcacggatgcactgcggaggggtacagggtggggtggtcttgcctctggtgagtctctgaacaaccaggcccttcagcaaaccccaaccagtcaagcacttaacccgtctcgcacgcctcccgccgtccatgatcctcagcatcacaagcacacaacgtaccttctgggcgtttgtggcgcgcttgagctttcccaggtccgaggcggggtccacggtgcccaagaaaatgggcttgtactggttcatgcccgcattggagaagagcagggtggggtcgttcacaggcacgacagggctggaggggttgaaagtgtggcccttggacttgaaaaagtcgatgaaggtggaccgcacgaccgatcccggccagtcggtgggggagggcatggtcgcgaggcaggtgagccgagagcgggggcggggtgcgcgctgtacgatgatcggcaggcaagagatctggcagcgactaggagccaggcccaatcgcagtgtcgccaacatgcgtgccttgatgggggaaggatggttggggccgacccaagcactctcggctcgggtgaggagggggaaggcctgcggtacccgagcaccctggcgcggtaccccccaccccccttcacgcatgagcagcagggctgcagggcgcaaagacgccgcgcaatgcccttgggactgcttctcccacacagctgtgtcgttgcgacggtgctcgcaaaccattctccccacttccctgcccctcccagcctaattgaggaggaagagctgggccccattgatctagaccctttttacgtcgaccctaccgagccggacccgtgggcctcggaagatggcatggaggggaccgagggcacagcctccactcctttttccatcccagaaagcttcgactcaaggttcgtggagtctccaaggacgcctgtggcctcacaggatcctcggataacaacgcagtacctcaccaagtatgagcgtgccagggtactgggcactcgggcgctgcaaatctccttgaacgcaccagtcatggtggatgtcggcacggaatcaggtggcgggtcgtacctgatggcccttcgatctgccatcatctgcgccgtctgccgaggcttgggggaccatcagcacccaacatgcagacatgactgagctgcgggaaaagaagattcccttcaccatcaggcgttacctgcccgacaacacctacgaagactggagtctgtcagagctcctcatacaggagcaatgactttcattgctgatcctctgcactgtagtgacctgagcactttcctgcacgcggcacgcatagcgggctacggtgaatcagcacaggggattggtaagggaacagtgcgttcgagacgatctatagtggaaagaccaaggtgcacagggttcctggtattgacaagaggctgtgtatgcaatcaagaatgcacggggcacacagagtggccctggacgaagatgggctggcgcaaaacgaccactcgtggtgccctcgtctgcggcaagccacgaccatgaatcagcaaacgcaatgcggtggtcaatgtgcgagtcttggagagcatgacaccctgtcccattggtgtcagggtgctcggtcagatggggggttgggtgagtcatctcggcgtgggtgcttcatggacccatcaggtgacgagtcgcgcctacggcggggagcaggctgctgtggtagtgaggggaatggcaagcctgcggcatggggggccagccttgggaaggcactggagtcggcgaacgcaggggagccatctgaagcatcagcagctgctgacccaggtggcggggcctgtcaaggacagtaatttgaatcagtgggatcaggggtgcagagagatgagcttaaagcgtggtgaggattcgacaggcaacagatacagagcacgcgtaagatgccctccaaactga

SEQ ID NO: 3846 - DNA, 1812 bp, Chlorella protothecoides
atgtccacctcccctctccaggtgtccaatgccggctccaaggccggcagcgagcggagcccaaccgcgtcctccgaacaggcgagccaccgcgacctgggcaccggcgacagcgggacgccgcgctcccgccccggcgcccccgccggcgagcgcgacaccgggcgctggtcgcggcggcgctacgaggccgcgctggccgcgctgacgggcgtgctgcagcgcctgggcgcgctgactcccgtggccgcggtgctgcgcccgcgcctgggcgcgctgacccccgtggccgcggtactgcgcccggtactgcgagacgcggcgcgccgtgtcatcggcgacacgggcctgctggaccacctgctcaagcaccaggcggaccgggtagtggggccaagggcgcagcgcctgcgccgccggcacaaccacgagggccacatggagtactggctgcagtcgcccgaggccgccacggccgaggacgcgctgctgcgcaaggaggtcaccgcgctgaccagcgaactgcgcgacgtcaaggaggtgcgccacgctctgcacgctgtgcgcgctgaggcggcccaggtgctgcacgaggtgtccagcggcagcgcgctggaggaaggcacgggacaggctgcgggtggaggtggcggcaacggcggcggaggaagaggggtgcagggcgagagcgtcggcaaccacagcgggaagggctcgtgggtggttggcgcagatataggggtgatgcaacgccagtttgccgagatcagcaagcgctttgccaacaccgacagcgtccttgagagggcaagcagagctagagaaccaggtggctcagctgagggaggagggtgctgggcgactggaggcactttccgccgcggcccaagacaatgctgggctcagaaaagcataaaaatctcagtcgacctcacatcactgccctccctttccatcgcagccctgcaaaacgtgctgcaagacctgccccgtctgacagcccaggctgctgccaaccaggcagcgagtggctccagggcacgggatgcttcaccccatcccgactacaacacatcgtcagtcaagcagcctcgcgtcctgcgcctgcagcctcaacagggtctgatgccagaggagcagaaggcggggccatctctgccggccctgggccaccccaacaaaatcaaagacctgtcccagctgacgcatgaggccctgaacgtctggaacaccctgaagttccagccagacaccacacccatcatcgtcgggcacgcctcgcgccagaccggtccaggggcgcctggcaataccgacggggcctccgaggaggagctggcgcagctgacgccggaggcccgtgcgatctgggaccagctgcgccgcgcccgaacccgggcacctgccccgcctgcaccggcagttgaccctccggcagcagtagccccgccgccgccgccgccgccgcccagcacccgtcctgagcagaacgtcggggtcaggggagttccttctcgccaggcccctgaaatcccgcctggagagcaagtccaggacctggccatgatgcatcgcttcctcacccaggccccgccacctgggtcagcagctgctgatgcttcagatggctcccctgcgttcgccgactccagtgccttcccaaggctggccccccatgccgcaggcttgccattcccctcactaccacagcagcctgctccccgccgtaggcgcgactcgtcacctgatgggtccatgaagcacccacgccgagatgactcacccaaccccccatctgaccgagcaccctga

SEQ ID NO: 3847 - DNA, 774 bp, Chlorella protothecoides
atgcgtgaaggggggtggggggtaccgcgccagggtgctcgggtaccgcaggccttccccctcctcacccgagccgagagtgcttgggtcggccccaaccatccttcccccatcaaggcacgcatgttggcgacactgcgattgggcctggctcctagtcgctgccagatctcttgcctgccgatcatcgtacagcgcgcaccccgcccccgctctcggctcacctgcctcgcgaccatgccctcccccaccgactggccgggatcggtcgtgcggtccaccttcatcgactttttcaagtccaagggccacactttcaacccctccagccctgtcgtgcctgtgaacgaccccaccctgctcttctccaatgcgggcatgaaccagtacaagcccattttcttgggcaccgtggaccccgcctcggacctgggaaagctcaagcgcgccacaaacgcccagaagggcctggttgttcagagactcaccagaggcaagaccaccccaccctgtacccctccgcagtgcatccgtgccggcggcaagcacaacgatctggacgatgtgggcaaggatgtgtaccaccacacctttttcgagatgctgggcaattggtcctttggcgactacttcaagaaggaggccatcggctgggcctgggagctcctaaccaaggtgtacagtctgcctgctgaccgcctgtacgccacctactttggcggcgacgagcgccagggactgcctcccgaccatgaggcccgtgacatctggtga

SEQ ID NO: 3848 - DNA, 1674 bp, Chlorella protothecoides
aggagggccggggggtgggcggggggtggactgcacggagcagcctcgccacgagatgaacgccgccgacgccgcaccccgacacccccaaaccacgccgggaagggggcgcggtgccgctcacgaccgaccccacacccaatcgcatccgggtccccacctcgtctccctctcggggacccccctcgaagacactctacagacctggactgccgcgccgtaggccacggcctcgtcggggttgacgcccttgttgggctccttgccgttgaagtagtccttgatcatggactggaccttggggatgcgggtggagccgcccaccagcacgatctcgtcgatgtcctccttcttcaggcctgcgtcctccagcgccttgcgcaccggtcccatggtcttcttgaacaggtcggcgttcagctcctcgaagcgtgcgcgcgtcaggggctctgcgaggttgtggtgtgggcaggggggccatgtgagagaggggaggagagggggtggagcagatggggcgagggggtggggcccccctggtcccttgctgcacgcgagccagatgcgggtcgcctcctgccgcacggtccccactccacagacgcccccacgcgccgctccatcaagacactcgtgtcatcccctggctgccaggctctcgatctccacgcggacctgatgctgggaggaaagcgcacgcttggcgcgctccgcctcgcgcctcagcttctgcagcgcgcggctgtcccccgacacgtccttcttgtacttgcgcttgatcagcttgatgaagtactccatgacgcgctggtcaaagtcctcgccgcccaggtgggtgtcgcccgatgtgctcagcacctcaaacacgccgccgtcgatggtcaggatggacaccccgtacgcgatggcagcggcggtgggttcgttaatgatgcgctccacggtcagacccgcgatcacgcccgcatccttggtcgcctggcgctgcgcatcgttgaagtaggcggggacggtgaccacggcgcgggagacggggcggcccaggtacccctcagccgtctccttcatcttggtcaggatcatggcgctgatctcctccgcggagaaggacttggggccgtcaggcaggtccacggagatgtggggcttggaggccttgtccaccacatcaaaggacaccagcttggcgtcgcgctgcacctcgcggtcgctaaacctgggggggtcaaaggggggcggggaaaggagggggggcctggagtggggttccaggcatggacagcgcagaaggggaagcattcaacagggaacggcctcacagggaccctcctcccccagaacatgaaatcaacaaactcacttgcggccgatcaggcgcttgacgtcgtagatggtgcgcttggggttgacggtggcctggttcttggccgcatctcccaccaggcgctcggtgtcggtgaaggcgacgtaggagggggtgatgcggttgccctggtcgttagcgatgatctccaccttgccgttcttgtacacacccacacacgagtaggtggtacccaggtcgataccgatcacggggccctccttcttcttctcctctttcttctcctcctttgccttgcccagggcggggctcaggcacagcgccaacactgcggggtggttgcggggtga

SEQ ID NO: 3849 - DNA, 1935 bp, Chlorella protothecoides
  modified_base (195)..(204): a, c, t, g, unknown or other
atggggtgcggggctttcaggctcggagagagaagctcaggatcaggcacacgcccaaccgtcccctctgctcggctgaaaagctgcgacgagggccggcatgcggtaccctcacagacgctccttgccgacccaggcacccagcgcccaggtaccttgcccgtggcccgacttcctcacacactgtgcgcaggnnnnnnnnnncgacccaggcacccagcgcccaggtaccttactcgtggcccgacttcctcacacaccatgctcagccccccacccagcccaccttcgtccacgacgtcggcgtccttgtcgtcggcgtccttgctgtcaggagcaggggagtcatcatccagcggcacctggcagcgtggggagcaaggcacgagggccccccagtccccttccacccccccccacactcctcacctccttggtaacggttttctccacctggaggctgatggggaaggagatgaactcggagtagcgctggaccagctcgcgcagcttgtccgggcgcgcgtactcctcgcaggcgggcttgaggtggatgttgatctgcgtgccgcggcccagctgcggcccgtcttcgtcggccgacagcgcgtagtcgcccgaggcgcggctctcccacacccactggctgtcgttgttgtgcttggtcaccacctccacgtagtcggcgacgaggtaaacggagtagaagccgacaccaaactggccgatgagggagaggtcgccgccgcgctgggcctgctccaggaaggccgaggtgccagagcgcgccacggtgcccaggttgttcaccaggtcctggcgcgtcatgcccacgccggagtcgcggatggacagcacgcgcctctcctcgtccacccagatgcggatgcccagggcctgggactcctcggtgtcacccagctgggacttgtcggtcagggccaggaagcggatcttgtccagcgcgtcggcagcgttggaaatgagctcgcgcaggaagatgtccttgttggagtacagggagttgatcaggatgtccatcagcctgttcacctcggcctgggagtgagtgtgatttttgggggggtgagcgggggggaagggtggggaggtgatgcatcttatgggcaggcaccaatgggaggaccctggaggaaggctgctggcatatttgtagaatgcatggcgcttgtttcgagagctgcgcagggtgtgaatggcgggtacccaaacgcagctcctgttccacccatccggctgtgcctgatctgtgcattcaccgcagcgccgacgacttgcccgtcgaagcaatttgcatggctagcattgaggaataacccccggctccctgttcttaccacccacctggaactgcatggtctcggcgcccttgcggaaggcgtgcaccggagcggcggcctcggtcgcgttgctgcaattgtgagagccagtgtaaatgggagcactcacctagctggagtggcgtcatcctcggcatggcaccctgcaatgaacaaaagcattgatgtgagcacgttgtacatagcatggcatactcatatcgcctcgcgaggaacatgcgcacccatcctcaccctgccagccggccgtgatcgcgcagaaaagcaagagaacggcggtccaccgcaccctccccatgttcgtcaggctcagatggatctcttgttattgcttcaattgcgtatccgatcgctgcagcacggtgtggcagctcatgtccggttcgaagcgggggacaggtgtttgggcgctctttccaccgtgactcactcaaacgccgcgaaggttcctcctcctgccctcttacccgtcccccgcgtgctcagactcccagtacgcaactccagaacggtgctgcattattcgcccaggctaacaccccggaggaaacccgtttgcgaatcggcttggtga

SEQ ID NO: 3850 - DNA, 675 bp, Chlorella protothecoides
atgccggccctcgtcgcagcttttcagccgagcagaggggacgacgaggaggaggccaaggagaagacgaagaccgtcactgaaaaggtcaaggagtgggaggtgctgaacgatgcgcaggcgctctggctccgcgccccgggcgacgtcaccgacgaggactacgacaagttcttccaggtcctcagcaaggtgggcgacgcgggggcccctggcgccttggcacgcaggagatctcacctcggcgacttgtcgctgcccgcctcgttccatgcccaattcgacccagccccagcccccgccaacacgtcgcccgcccgccccgacccgcagggccagtccaatccgctggcgcacacccacttccgcgccgagggcgacgtcgagttcaaggccatcctgtacgtgccccgcacgccgccacctggtgaggctccctgctgcggggctgggaggggtcgtttggggggtaccatgggggtgtgggggttgaggcagggaaagggaacgcagggcggccagaggatgcatggagagcatgcgtgctgctcgatgcccggccagccccagggtgccgtcctcgtcacgaccggcccctcgcacgaccacgtccccaccccgccccctccggcgcagacatgtaccaggactactacagccgcaagccgagcctga

SEQ ID NO: 3851 - DNA, 735 bp, Chlorella protothecoides
atggagtacttcatcaagctgatcaagcgcaagtacaagaaggacgtgtcgggggacagccgcgcgctgcagaagctgaggcgcgaggcggagcgcgccaagcgtgcgctttcctcccagcatcaggtccgcgtggagatcgagagcctagtggacggcgttgacctgtcgggaggcgacccgcatctggctcgcgtgcagcaagggaccaggggggctgttgcagcacagcgatactggcccctcaacctgttgtgcatccagccatcggtgcagaccagcgccgtatgggcttccactcccccaccgtcagtcgacgctcacccccaccccctcgccccatctgctccaccccctctcctcccctctctcacatggcccccctgcccacaccacaacctcgcagagcccctgacgcgcgcacgcttcgaggagctgaacgccgacctgttcaagaagaccatgggaccggtgcgcaaggcgctggaggacgcaggcctgaagaaggaggacatcgacgagatcgtgctggtgggcggctccacccgcatccccaaggtccagtccatgatcaaggactacttcaacggcaaggagcccaacaagggcgtcaaccccgacgaggccgtggcctacggcgcggcagtccaggtctgtagagtgtcttcgaggggggtccccgagagggagacgaggtggggacccggatgcgattgggtgtggggtcggtcgtga

SEQ ID NO: 3852 - DNA, 864 bp, Chlorella protothecoides
atggacatcctgatcaactccctgtactccaacaaggacatcttcctgcgcgagctcatttccaacgctgccgacgcgctggacaagatccgcttcctggccctgaccgacaagtcccagctgggtgacaccgaggagtcccaggccctgggcatccgcatctgggtggacgaggagaggcgcgtgctgtccatccgcgactccggcgtgggcatgacgcgccaggacctggtgaacaacctgggcaccgtggcgcgctctggcacctcggccttcctggagcaggcccagcgcggcggcgacctctccctcatcggccagtttggtgtcggcttctactccgtttacctcgtcgccgactacgtggaggtggtgaccaagcacaacaacgacagccagtgggtgtgggagagccgcgcctcgggcgactacgcgctgtcggccgacgaagacgggccgcagctgggccgcggcacgcagatcaacatccacctcaagcccgcctgcgaggagtacgcgcgcccggacaagctgcgcgagctggtccagcgctactccgagttcatctccttccccatcagcctccaggtggagaaaaccgttaccaaggaggtgaggagtgtgggggggggtggaaggggactgggggctggaagtggagggaagctgccatcgacaggacgggcccgtggcagcgacgcatgttgtggcaccctcgcaagctcaaaacggctcacgccctcgtgccttgctccccacgctgccaggtgccgctggatgatgactcccctgctcctgacagcaaggacgccgacgacaaggacgccgacgtcgtggacgaaggtgggctgggtggggggctga

SEQ ID NO: 3853 - DNA, 1113 bp, Chlorella protothecoides
  modified_base (501)..(510): a, c, t, g, unknown or other
atgcctcgccggcaccctttctgctgcgaccgcggccgagtgctttccccgattctgcagacaactctccggatgtcccatccccagcgttttctgctcgcacgccctccaccacatcctgtccccctcgcaggctccatctgggcctttggaccagacaactcgggccccaacatcctgatggatgacacgctaccctcggaagtggacaagaccctgctgaacgcagtgcgagagagcattgtccaggtacgatgcggtggggggtttgagggaaccggagctggggagggagctcggtcttgctgcaactggcccagggaaggtctgggtgtctgcaacatgcgaatgggcggccgaggaacaaccacagagccagcaatccgccctctgttgctacatgcacctcttggcagcctctccataacgtctgtgcattgccgcccctcggctcacccccactctccatccttgacgtccaaccccccaagatctcccttnnnnnnnnnngaacaaccacagagccagcaatccgccctcggttgctacctgcacctcttggcagcctctccatgtcgtctgtgcattgccgcccctaggctcaccccactctccatcctggacgtccaaccccccaagatctccctcccttccctccccccaacacacacagggcttccagtggggggcgcgggagggcccgctgtgcgacgagccgctgcgcaactgcaagttcaagatcatggacgcggtggtggcgcccgagccgctacaccgcggcggcggccaggtcatccccaccgcgcgccgcgcctgctactccgccttcctcatggccacgccgcgcctgatggagccagtgtacgcggtggagatccagacccccgcagactgcatcgctgccatctacaacgtgctggccaagcggcggggccacgtgaccgccgacgtgccgcgccccggcacgcccgtcttcctggtccgcgccttcctcccggtcatagagtcctttgggttcgagaccgacctgcgctaccacacccagggccaggccttctgcctctccgccttcgaccactggcagatcgttcccggcgaccccctggaccgtag

SEQ ID NO: 3854 - DNA, 1008 bp, Chlorella protothecoides
  modified_base (473)..(482): a, c, t, g, unknown or other
  modified_base (943)..(952): a, c, t, g, unknown or other
atgcgacccgcttgccgcgcctgtaaaagccctgcatgcacaaacactgggaaagcggactccgtgcggtcaccaatcggtcctcagggcttccggcaaagtatgcacaccgcaacctgcctgacacaacaacctgcaacaccaccgctctcacccctacaggacctgcgggagatgtacgcagaggtggaggtgaaggttgcggacccggtggtggccttctgcgagaccgtggtggagacctcctccctcaagtgcttcgcggagacgccaaacaagaagaacaagatcacaatgatcgctgagccattggagaagggtgcgaggggtagtgcactgagtgcataccctaggcgctgggtggttgcaatggcatggatttgggcatgtcatgggcatggcgacgaggcacagagggtcatgagcatgctctgcattgcagctgacctggcatggaattgtctgatgatggnnnnnnnnnnggtgggggtatctggggatggcggctgggggtggcggcaccagcgatggtgcaggaggagcagtgcaccgagtgcataccctaggcactgtgtgcttgcgacggcatggatttgggcatgtcatgggcatggctacgaggcacagagggttatgagcatgctctgcattacagctgacctggcatgggcttgtctgatgacgttggggccaccgatggagacgctgtctggcagctaccactattcttccctgcattcaagcgctctgtttcgctcaaggcccccaccctcctcgcacctgtggacaggtctggcggaggacatcgagcggggcgccgtctccatggactggacgcgcaaggagatcagcacctttttccagtcaaaatacgactgggacatcctggctgcacgtgagaacgggctgtgcgaggaggtttggatgaccccgattcagcggnnnnnnnnnncgactgggacatcctggctgcacgtgagaaggggctgtgccaggaggtttggatga

SEQ ID NO: 3855 - DNA, 2550 bp, Chlorella protothecoides
  modified_base (1638)..(1794): a, c, t, g, unknown or other
  modified_base (2071)..(2080): a, c, t, g, unknown or other
  modified_base (2527)..(2536): a, c, t, g, unknown or other
atgtctctttggaatgtgggtgagagtcacgtatgggtcgaccaggcgggctttggaggactggagtcgagggcgcgactctcagtgcgccacggcccgagcgccaggctggcacctgacacaggatctcttcctgggagtggtcttggggaagggggcacgcaggctcgaccatcacccaccccgcagcagagctggcggtggccccgaacgcctgcctcacgctccctccgcagaccacgcccgttgttgagttcgtggcactgtgctgagcgtggaagggtgcatcaccgcgggcgccatggacgagtcgctctacgacgagtttggcaactacgtgggccccgagctgtccggcagcgaggcgagcagggggaggaggaggaggaggagcaggtgcagcagcagcccggggcggaggacatggatgcccaggcagggtctgaggtggaggaggatggggaggaggaggacgacggcgccccctccggcgccctggtcctgcacgaggacaagaagtactaccccagcgccgaggagctgtacggcgcgggcaccgagaccctggtgcaggaggaggacgcacagccgctggaggtgcccatcgtggcgcccgtgcgccgcgcccggcacgaggccggcggcccggcgctggccccccgcttcacccccgagttcctgggcagcctgctggccacgccggagctgtgtcggaacgtgacgctggcggggcacatccacgctggcaagacgctgctgatggacatgctggtggagcagacgcacgtggtgcccgacgcggcggcgctggccgacgcgccgatgcggtacaccgacacgcgcgccgacgagcagcggcgcggcatctccatcaaggccgcgccggtgagcctggtggtgcagggcctgagcgggaagtcctacgtggccagcatcctggacgcgcccggccacctcgactttggcgacgagctgtcggtctcgctgcgcctgtcggacggcatgctgctggcggtggacgcggcggagggcgcggcggcggggacggagcgcgcggtgcgcgccgcggcggccgagggcctcgccatcgcgctggtggtcaccaaggtggaccgcctgatcacggagctgaagctgccccccgcagacgcctaccacaagctgcgccacgtcgtggaggaggtgaacgcgctggtccgcgcgcactaccccgccgagggcgccgcggaccgcgtcctggacccacgccgcggcaacgtcgcctttgccgcgccgctctacggctggtccttcaccctggagtcctttgccgtgctgcagtccgaggtccagcgcctggccttggacccgcgcgagctggcgcgccgtctctggggcgacctgtggtaccacgcggacgtgcgcgccttccgccgcgcgccgcccgccggcggcggcgaccgctcctttgtgcagttcgtgctggagccgctgtacaagatctacgccaccgtgctgggcgaggacgacgcggcggtgagggagctgatggcggagctgggcgtggccctgcgccccgccgcctacggcgccaacgtccgcccgctcttgaaagaggcctgcaccgcggtgttcggctccgcggcggggctggtcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcctctggccgtctacgtcaccaagctgttccccaccgccgatgccaccgcctttgacctcttcggtcgggtcctgagcggcaccgtcaagccgggggacaaggtggagagggggcggggatggggggaggagttggtcatggtggggcggtggaggcccgctcacctgaccaccagcccagccgcgatcctggaacctcctgcgcgtgcatgcatcccacccaaccgaatccttcaacacacacacaaacgctcacaccccaagccttctccgnnnnnnnnnngagttggtcatggtggggcggtggaggcccactcacctgaccaccagcccagccatgatcctggaacctcctccgcgtgcatgcatcccacccaactgaacccttcaacacatgcacaaacactcacaccccaacccttcaccacacacccaggtgcgggtgctgggcgaggcgtacacgcccgaggacgaggaggacgccgccacggccacggtgacgggagtgtgggcggcccagggtcgtgcccgccagcccctggcccgcgccgtggctgggaactgggtgctgctgggggggctggacgccacggtggccaagaccgccaccctggtcccggagtttggcgccgaggaggcgtacatcttcgcaccactgacttttggcgcccaggccgtggtgaaaattgccaccgagccgctgaacccctccgagctcccaaagatggtnnnnnnnnnngttcagcttcctga

SEQ ID NO: 3856 - DNA, 285 bp, Chlorella protothecoides
atgggtgacgacttctacgtccggtactatgttgggcacaagggcaagttcggacacgagttcctagaatttgagttccatcccgatggcaaggcaacccttcaccgcgccgatctccctcatcacccacagctgcggtatgcgaacaactccaactacaagaacgacaccatgatcaggaaggaggtgtacgtcacagatgcagtgcttgcagagctcaagcgcatcatctcggagagcgaggtgcgtgttgtagatgctgtgctggggaagggaggacagtga

SEQ ID NO: 3857 - DNA, 342 bp, Chlorella protothecoides
atggatggggaggacgccatcgacacgttcatggccctcaccaatgctcccaggcacgtggcccagcatgtacttgacgcccatgctggcgacctggaggctggcgtcagcttctacctggagggaggcggcgtgggccacggcgtgaccggcccgagcggcagcctggatcccgttctgtataccgccgcactgtctgcgcaggaacagccgaggagcagccctctcacagtgaggagctgggtggatgtactctcgagggagcagctgacggtggcgaggggttatccgagcagccctcgagcacatggtagacgtggtgatcacgtcacttttgtgtaa

SEQ ID NO: 3858 - DNA, 1269 bp, Chlorella protothecoides
  modified_base (88)..(97): a, c, t, g, unknown or other
atggggtcaatcacaagtcctggcgaaggctcacgcaaagcagggcaggcaggcaccgacgagccggcggcgcagcatgggcggcggnnnnnnnnnngctcacgcaaagcagggcaggcaggcaccggcgggccggcggcgcagcgtgtgcggcgtgggcgggcgcggggcctggcacacgcacggcgtgcgtcacgccccgaccccgcgcccaccgctcctctgcgttcacctgcggcccacggcccagacgcggatgacgccgtcggtgtagcccgagtagagggtggcgccatcggcggaccaggccagggacacgggcttgggctgcttggcggcctccacgccctccagcggcgcgtccaggtcgtccaccaccgacttgtactccaggtcccagatcttgatgccgcggtcggtggcggcgcagagccagtagcggttgggggagaagaccagggcgttgatgacgttgccggcgtccagggagtagaggtgcttgcccacggacaggtcccacagcatggccacgccgtccttgccgcccgaggcgcagagcgagccgtcgggcgagacggtgacggagttgatgtagccgcggtggccggacagggtgtcgcgaagcttgcagtcctgcaggttccacaccttgaccgtcttgtcccaggaggccgacacgatgagcggcggcttggacacaggggacagacgcacgcaggacacccactcggtgtgccccgcgggctcggccacggtgaacttgcactccgccagcgtgttccacagcttgatggacttgtcacgggagccggacaggatctggcggttgtcggccgagatggcgacggacagcacgtccttggtgtggcccaggaagcggcgggtggtggtgcccttgttcaggtcccacaggcgcatggtcccgtcccaggatccggacagggcgtactgggcatcggaggacagcacaacgtcctggacgtagtgggagtggccgcgcagggagcggcgggcgaagccgtagtcctccttctcgccgcgggtcagggtccacacgatcaccgacttgtcgctgcgatggagagggggtggggagtgaaggtgaggattttacgcaatctggatgttaatcaggcgcctgaggccgcctcacgcaaggcagggatcgggggcagtgccggcagccgcagggcgggccggaggggcgcctccccccctgatgctgtcaattcccctcttccccatcggcgaggacacttgggtgcataa

SEQ ID NO: 3859 - DNA, 3276 bp, Chlorella protothecoides
  modified_base (530)..(539): a, c, t, g, unknown or other
  modified_base (1316)..(1325): a, c, t, g, unknown or other
  modified_base (2734)..(2743): a, c, t, g, unknown or other
atgcaggggtcgcccgcgtccggcagcgtgctccgcgccctgcgggagatggcggcgcgcgagggcctctcctcgctctggcgcggcaacggcgtgaccatcgtgcaccgcctgccctactccgcggccaacttctgggtgtatgagcaggtgaatgagcagtggaagcacatcatccccgcccaggggaccctggccgcggcggacgtgacccggcgctttgtcgcgggcggcatcgccggcctcaccgcctgcaccctggtgaggcgaggggatgagggggggcctggggaaggctggacctcgcaagcgtctgggcccctgtgctcaggcccgggcagcgctttgacgcctggagcccggtcaccacccctctgccggcaccgctttccgacaaggagcaccattgtgctctccgacctgcccacaaatcccccctttccatcaccccccccccctcgccctcccactcaactcccaaaaggcgtacccgctggatctggtgcgcacgcggctggcggcgcaggtgnnnnnnnnnnttcccccctttccatcacccccccccctcaccctccctctcaactcccaaaaggcgtacccgctggacctggtgcgcacgcggctggcggcgcaggtgggcgcccccgtctactccggcatcggcgccacgctggcggccatcgtgcgcgagggcggtgcgcgcgggctgtaccgcgggctgggcgccacgctggcccaggtggcgcccagcctggccataaactacgcggcctacgagacgctgcgctccgcctggctgggcgggggcgcgccggggtcacggggggaggtgccctccgtccccgccacgctggcctgtgggtcgctggcggggctggtgtcctccaccgccaccttcccgctggacctggtccgacgccggctgcagctccagggcgcgcacggcgcggccgacgtctatgcctcctacgcaggcgtcttccgcagcatcgcggcgcgggagggtctgcgcggcttctacgccggcatcctgcccgaatactacaagcatattggcggctggaggtggcccccctccaaccgtgcttgtcctcggcccctgacccaccgaggctcgggctactcctcttcccccgagctcccccggcccttttgacactgacacactcctcagaagcactacaaccagatgcctgtggtttcctctgtcttctcaactggatgccaggtcgaggtcacgcagcttcagaggccccttgcctccagacctctttcccacttgtcactatcattcatcacaaccctctgacctccannnnnnnnnngtgcagcttcagaggccccttgcctcaagacctctttcccacttgtcgctatcattcatcacaaccctctgacctccaccctgctcttctgccagcggcccttgtttctccctatgctcgacccagcagggagggaagtctacgtcagctggcactatgtcattgctacttcgtggcgccatgcctgccgtctcgcggcctgctgggcgcgcatgcagtgccttcagcgcctgaatctgccgctgcatctgatttgccggcaaggatgggctcgctggtcctgcttgtgcgcggcctggcatccagggtcttgtggtacagggcacctgcagtggggccccaggtgcaggccgatgctcgctgtcaaccaggaatgcgctcagtcaaacagagtcaggataggaatccctccacattcaccccacccttccatcccttggcctcactttcccccccccaaatcagacacacacgcatacccaccaaacacaacgcaggcggcggcatactgctgggcgctgaagctgtggccgaacagcaggcccgacaggaggatggagagaaactggcgcgtggtcatggcggcggccacgagcagcgcaccgtgccgccggatggcgtgcgtgatgaagagctggcccgcggtggcggccagggccagcagcgccgcggcgcccagcgcgcgcgggtgcgctgcgaagaaagcgagcgcggggcgcagctcccccttggccaccaggccggccagggccaggagcgccgaggtagcggccacgtagaggacctggttgggcagggtgggggcgtgcagcgcaaagagccgggcctggaaggtggaggtgaagccgtcgactgtcaggtaggcggccatgagtgtcaggccccagggcgtgctggcatgattggtggcggcagaggagaggccagcggcggcgggggagacggcgcctgcgcgattcgcgcccacaaaggcggcgcagccgagtgtgacggcggcagcgcgcgcggcgtcccgcgctgcgtaccgcttgcccagcatgactcggccccagagcatgacgggcagcattttggcacacttgcccagcgtctgcgctgcaaagctgacgtggcgcaaggcctcgtactggcagaaggttgcggcgacgttggaaagggagaccgcggcgaagctgtcttgggaattctgtgtgatgaagcatgtgagcatgccgaacgcagccgtcacaacagggttgggcctggatctggacgggctctgcgcggcgtctgcgcccagcctgcagtacacggtgcaagcagccccaaacccttcccacagccgcccacaagacgcacgagggagagggagagggccactgcgcaggcgacgaggcggttggccaggaccagtgccaggctgtgggtgnnnnnnnnnnaggctctgcgcggcgtctgcgcccacactgcagtacacggtgcaagcagcgccaaacccttcccacagccgcccacgagacacacgagggagagggaaagggccactgcgcaggcgacgaggcgattggccaggaccagtgccaggctgtgggtgaacggctcgccatcaaacggggactgcatgatccgctcctgcgtgggagcaacagatgagggcagagtgcctcctggcagagcttggcaaggggttgggcatgggggcggcaggctgatctccatcgtgactgctgcgctgccgtgcagcagtcacctgtcaggagttggctaccctgaaggcagaccttgcaaattccatccccaatcccagccgcacctgcagcaccccgtacaacaccaggctgccaatgatgccaccgaagcaccagacgacatgcagagcgtcggtgctggcaaggcgcgaggaggtgtgcttgtttggggacgacatccccgcgtcgccccgtcggaggcctgcgcactacggtgtgactga

SEQ ID NO: 3860 - DNA, 429 bp, Chlorella protothecoides
atggccttccaccacggccccaagtggacgccccaggacctggatgccgccgccctgacggggaacgagggcgccgaggtggacatggagcgggtcctggtggaggacgatggggcccgcctgctggaacggggaccaggagggccaggaggcgccggcccctcccggcgcgaggaggccatcgaggtgatcaagctgctgacctccggcggcctggcgggggccatctccaagacggccactgcccccctcgcccgcctcaccatcctgtaccaggtgacgcgcgcaggggtcgagtggtgcctcgctggcgcggccccatggagcgtgaggggcatgcaccatcgtgtcctcacgatccgccgctgtgccgggctgcgttgttcttcgatgagctctgtctggcgcacctcgaccagccggcgatga

SEQ ID NO: 3861 - DNA, 810 bp, Chlorella protothecoides
atggacgccaaggttgtcgcacacgacagcggttcgacttccaccgccagcggaggcgctgggcccaaggaccccctccgcccagcggtgcaggcgtcctggatgctctcaggcgacaccgccacccagtacgggaagagtgcggacgcacccctgcccgggctggggtcccagccggaggcctccgtgggcttccaagccagggtccaccagggcatgggggagctcccggggccctcctccaccgcgaacattccggtcctccccgacattgcccggctgaaggacagtaggagggacatccctctcacctgccaggtgctggggtgtgggcagagcctggtgggccacgccgattactaccagcgctatcgggtgtgcaagccgcacctcaagggccccgccctgatcgtggagggcctcccgcagcgcttctgccagcagtgtggcaggtttcacccgctggatgcctttgatggggacaaaagcgttgacggcagtgctgcacgccttctgtgcctgacgagggctctggaacccattctggggccatgcgcccagggcagtcccaggccgacacacagcctgcccaccaccacacgacgacccccgcaggaactgccgggcgcggttggagcagcacaactcccggcgccgcaaggtgttcaccacgactcaggccagccggaggcctgctgggaagcgggaggagcccctgcactccgctggccccaccagcggcgactgggcgggggacgcccacctcgccagctcggccccctcccaaggtgcggctggtgtgtgggatga

SEQ ID NO: 3862 - DNA, 717 bp, Chlorella protothecoides
atgctgggcaagcggtacgcagcgcgggacgccgcgcgcgctgccgccgtcacactcggctgcgccgcctttgtgggcgcgaatcgcgcaggcgccgtctcccccgccgccgctggcctctcctctgccgccaccaatcatgccagcacgccctggggcctgacactcatggccgcctacctgacagtcgacggcttcacctccaccttccaggcccggctctttgcgctgcacgcccccaccctgcccaaccaggtcctctacgtggccgctacctcggcgctcctggccctggccggcctggtggccaagggggagctgcgccccgcgctcgctttcttcgcagcgcacccgcgcgcgctgggcgccgcggcgctgctggccctggccgccaccgcgggccagctcttcatcacgcacgccatccggcggcacggtgcgctgctcgtggccgccgccatgaccacgcgccagtttctctccatcctcctgtcgggcctgctgttcggccacagcttcagcgcccagcagtatgccgccgcctgcgttgtgtttggtgccctgtaccacaagaccctggatgccaggccgcgcacaagcaggaccagcgagcccatccttgccggcaaatcagatgcagcggcagattcaggcgctgaaggcactgcatgcgcgcccagcaggccgcgagacggcaggcatggcgccacgaagtag

SEQ ID NO: 3863 - DNA, 936 bp, Chlorella protothecoides
atggggaagaggggaattgacagcatcagggggggaggcgcccctccggcccgccctgcggctgccggcactgcccccgatccctgccttgccgacaagtcggtgatcgtgtggaccctgacccgcggcgagaaggaggactacggcttcgcccgccgctccctgcgcggccactcccactacgtccaggacgttgtgctgtcctccgatgcccagtacgccctgtccggatcctgggacgggaccatgcgcctgtgggacctgaacaagggcaccaccacccgccgcttcctgggccacaccaaggacgtgctgtccgtcgccatctcggccgacaaccgccagatcctgtccggctcccgtgacaagtccatcaagctgtggaacacgctggcggagtgcaagttcaccgtggccgagcccgcggggcacaccgagtgggtgtcctgcgtgcgtctgtcccctgtgtccaagccgccgctcatcgtgtcggcctcctgggacaagacggtcaaggtgtggaacctgcaggactgcaagcttcgcgacaccctgtccggccaccgcggctacatcaactccgtcaccgtctcgcccgacggctcgctctgcgcctcgggcggcaaggacggcgtggccatgctgtgggacctgtccgtgggcaagcacctctactccctggacgccggcaacgtcatcaacgccctggtcttctcccccaaccgctactggctctgcgccgccaccgaccgcggcatcaagatctgggacctggagtacaagtcggtggtggacgacctggacgcgccgctggagggcgtggaggccgccaagcagcccaagcccgtgtccctggcctggtccgccgatggcgccaccctctactcgggctacaccgacggcgtcatccgcgtctgggccgtgggccgcaggtga

SEQ ID NO: 3864 - DNA, 543 bp, Chlorella protothecoides
atggcgggggcgctgctccacacgcgtcatgtttggcgtgcagtcccccctcgtcagctcgcaacccacactggttcgcctcagcccagcactcgtgcgccccacaatctcgcaggcgcggcccggccgctgctgacgggcgtcagcctggacctgcccgccgacagcctgagcgtgctttccgggcccagcggggcggggaagaccacgctgctccacgtgctggcgggcctgtcggaggccacggccggcaccatcctgctgggcggggccgccgccccttggccggccagccccgcgcccgccgccgcccctgcccgcctgcgtgccagcggcgtggtcttccagttcccggagcgccacttcctgggcagcacactggtggaggagctgaccctgggctggccggagacggggccgggacgcacccggctggcccagcgcgcgcagcaggtgctcgccgctgtgggcctatcgagcaccccactccaggccaggctgtccagcctcagcgacgggtacaagaggtgggtgtggggatga

SEQ ID NO: 3865 - DNA, 2502 bp, Chlorella protothecoides
  modified_base (2397)..(2406): a, c, t, g, unknown or other
atgcttgattctcaaaggtcgctcacaaagctcaatcccctgatggcaaaattgatccccgtcccccacgtcaccttacagctcaccttttggtggagctggtttgagaacctgtcggcttctgttcggtcaggggacgcgttgtcagcctatatctacctcatctccagacgcacctccactgtggggatcattcagggcatcaatggcatctcacaggtttgcccaatgatggttggtggaacaacttgcttccccattgatgtggttggcccaatgatggttggtggaacaccttgcttccccattgatgtgctggccgccgctgtgcctgccggctatctgtgtgacatcctgcggcgggacatggtattacgctctggagccgtgctggggctgcttgcagcaggtaccctggctaccaccatgagcctggcccccacgatcgtcaatcttgcggtgtgtgctggcctgctgggcatctaccgcggcattcactctgtggctatggagtccatctttgcagacagcgtcgaggcgggccgcagtccatcttcgcagacagcgtcgaggcgggccgcaggtaaggggttgctcccactgtttgcgttggattgggaactcatcagtgtagcgacagagccacttgaattgaatgcgctcggattgaagcatgttattcccttctgggatcagcaatacacctgcagatggatctgggacagatttccgccaacctttccagtggcagcacccttctcactcgtcatccccctcccctccatccccaacgatgagcagttcactgtacaccaaaaagtatatcgtgaccgtgcttgccgccggaagcgggcaacttctttctttcttcgtcttcctgaggctgggaaaccgctggcgcacgggggactgccgggccgtggtcgaggcaggcctgctcctcatgctggcacccctggtgctgatgctcttcttcaacgacgaccttgccctgggccatgccagcgaggccgtgacgaagggtttcgtttgtacgcaatgaatgaggaggggagagtgagcatcatacgaccaggacaagacatctgcaaggtgccatgcggtgcgaattcctcacaatcaaaaggatcctcagcgctcctttctcctggcaggctccctgatgcgagcggtgcgccaacctccaatgcggaggggtgcaccgacggcccagacccggagcttgacatggagcgaaacaccgtgattgaccctggcagtgagctggacttccccctcctctccactcctgccgcccaacctacctcctgctgcccaccggccgtctttgtcacgctgctgctgaccctgtcggacctgctcagcgggctggcctcaggcatgacggtaaagttctttgcaatatttttcctggagcagtgcaggctgcggccggccaccgtggcggccgtggcagctgcggcgccctgcggcgtagcctttgccgccgcggccgcccagcgcattgctgccagggtcggcagggtggagggtggaggtgaggtagttcttgggttcataaaattcatgaagaaggcctgggggcttgaccgtggcagaggcttggcgggggagcggggctccaacagtcgcaaacctgcagactcttggagcaagccttgccctctagacccccacgcactgggactcttggtgcaagccctgccctctagacccccacgcactggggtgaagcacatgatcctgcacccaccgcccctccctcaccccaatcgcccacccatcatcagccagggcgcccgccatgctgaccgtgcacctcctacgaacggcactggccaacagcacccggcccctcatgcgcagcgtgctcatggaagtggtgcccaagcagtaccgtggcaaggtgaacgccttcgagagcataaccatgttctcctggagtggctctgcggccctcggagggtgaggcggggcgcccccacccctgtgcccccttcccaacagcgtgctgatagagcgtctggggttccaggccaccttcctggtgaccgcggcgatcaagctggctgcctgcgtccccgtggtcgtgctgctggtgacgtgggtcatcttgcaccagcgaaccaagctcacgcatgtgggctgcagcaattggtccctttcgacgctagggtgccgagcggcaccagggtgtgtacagccaccattgacttgcgtggtcaggagaaaatgctgatggcaggcgcgtctgtacaggagcaggccgtgtgcgtcatgtgtgccgatggctgggagcaggccgtgtgcgtcgtgtgtgccgatggctgggtacaagagggtgcgggctcagggtgcagaaacggcttgaaggggcgctggggacaggatggtacnnnnnnnnnntggggcaggcggagcggcggcgggatgtggagtagactgggcaaggaacggggtgagacccacgagctgcggcgtccctgggcgcagccacgctga

SEQ ID NO: 3866 - DNA, 309 bp, Chlorella protothecoides
atgcctgagacgacggagccaggctgccatggaaatgcacggctggcgattgccggggacgatgccgctgtgtccatcatctccatggctgaggcgcgcgtgacgacgctccttcaggggcatgtggcagctgtcacagacctggctgccaatccttcccaaccaggagcattggcggccctttcttcagacggttccgtggcactgtgggacctcggatcggagcgacagcgaggaccctgcagcacctcgcatgccgccagtctggtgaggacggggtcttggtgccaggtgctcagggatggttga

SEQ ID NO: 3867 - DNA, 279 bp, Chlorella protothecoides
atgaaccagggagagacgcagtcgaacagagcacgggagaccgaggtcaagctactgggcgggctcgatgcataccgaagacatgcgctggcaaatttgcgcctcaagaccgtcatcaaggtgcgagacggaaacctggtagccagcatcggctcgaaccatgctacggtgtatgatggcacccacctggccgatcacgtcagcgtcgccgtgcagtttgtcaactctgccaccgcccacacgcctggcggggtgagttgcctgtggctgcggacatga

SEQ ID NO: 3868 - DNA, 552 bp, Chlorella protothecoides
atgcacgcgcacctggccggtgcggcgccggaccccgggccagcgctggctgcgctgggcggcgcgcaggctcggggcatggcgccgtcggccgcctacctcctgctcgcgctgtgcgtgcggtctggcgagggccggcgccgcctggccgccgagatcgtggccgcactgacctccgagtctgaagcggtggcggagccgagtgtcgcttcgggagaggccggcgccgaccccagcccggcgtccgaggaccggcgcggcgccccggcgtctgaggaccggcgcggcgcgttcgtggacgtacccgggcgcacccccgcgcacgaggtgcgcgtgctctgcgacctggcggcctcgctcctggcggcgcctgcctcgcagtacgcggcccccggggccgccgcgtcaccagccgccgcgctggtgccgggcgagatcgcgcgcgcgatgcgcgatgcaggcatggtccccgccctcgccggcgtgctggaccgcgtggatctcgaccaccccaaggtaggggaggagcctgtgtttccgttgttgttttga

SEQ ID NO: 3869 - DNA, 363 bp, Chlorella protothecoides
atgacactcccttgcgggacggcaaccgcgacaggctcctgggattcctcacagagaggtgcgcgccgatgttactccgcctcatggccgggcccaggctccgagggggggtacagttccgaggggctcatcaccaggctctgcccttgtaaacatctctatagggcggctcgcaccctaagtttctacgcctacgagctgaatcctaccctcttcggttggttcaatgattacatgaagcgtcaccccatccccaaggtgaaaaagtgcggttggaatgaggtcagcgagagtggcacgtgtcacgctgcaccaccaggctgctgcattgaacggtcaccagtgcgatgcccggacacctga

SEQ ID NO: 3870 - DNA, 435 bp, Chlorella protothecoides
atgtcctgcgcgagggattggacccccccctccagtctgcacaatggcagcgccaggcctgcccccgaactgcacctgtacaactctctggtggacgccaaggtgcccttcgtgcccgccgctgggccaggctcccggcatgtgagctggtacacctgcgggcccacggtctacgactcggcgcacctgggccacgccaggaactacctcacctttgacatcctgcgccgggtgctggaggaccactttgggtacgatgtgcgctacgtgatgaacgtgaccgacatcgacgataagatcatcctcagggcccgccgcaaccacctgctggaggcctaccgcgccacagccaccgatcccagccaggcaaggagcgggggggtctgtaaagggggtgggctggggagtggtgctgtggccaggcctgaggggtga

SEQ ID NO: 3871 - DNA, 1452 bp, Chlorella protothecoides
ggtgcgcaccagctcgtggacgcggggcatgcgcgtcatgccgcccaccaacagcacctcgttcacgtccttggcggtgacgcccgcgtccttgagcgcgctgtggcagggctgcacagtgcggtccaggagcggcttgaccagggtctcgaacttggaccgcgtcagggtcagctgcaagtgcttggggcccgtggcgtcggcggtgatgaagggcaggttgatgtcggtggaggaggcggaggacagctcgcacttggccttctccgccgcctcgcgcaagcgctgcaccgccagcttgtccttggacaggtcgtacaccgccaccaggccctccttcttgtctgcgccgtagcacagcgccgcggcggtgggctcgttgatgatgcggaggacgtccaggccggcgatgcgccccgcgtccttggtcgcctggcgctggtggtcgttgaagtaggcgggcacggtgaccaccgcctgggagacggggcggcccaggtaccgctccgcggtctccttcatcttctgcagcgtgaaggcgccgacctgggagggggagtagcgctggccgccggcctccacccacgcgtcgccgttgtcggcgcgcacgatgttgtagggcaccatcttgcgctccttctgcacctcggcatcgtcgaaggcgcggccaatcaggcgcttggtcgcgtacacggtgttggtggggttggtgatggcctggcgcttggcgggcaggcccaccaggcgctcgccggactcggtgaaggccgccacggagggcgtggtgcgctgcccctccgcgatcagcgtccgcgatctgccgacaagtggctgcttgggccccagccacacgctgcagcaaggatcactgcttgcagcagcaaaagggccgtgcatgcatgcatgcatgcatgccttcagcgtgccgctgtgcagagcatcggtacaccctgggccctgtcagcacagccctgcacaaacccaaatccacactggttacgctgtggtgcaaggcattcccaaccagcgccagatcgcagcactgtgcaggccccacaccagatgattcatcccctcaccttgccctccatgacagccacgcaagagttggtggtgcccagatcgatgccgatgacctcattcccagcggcggatcggctcacggtggacctgcgtggaatgggggatggggtcggtgcatgccatgcggcgcaacacatctcagcacacacaccacccaaggtcggactgctcacccgaagcaccgcaggctgtccgtccatgatgtggcgttgcatttatatgcagaaatctgcgattatgatgatgaggcaaggtaaggatctcaaagccgctcacgagcaggaggacaccatcagcacaacagcatcgccgctcaccgatgactccgggctcaggcggagcaggctcttcccgagccgccgacccgcc

SEQ ID NO: 3872 - DNA, 1965 bp, Chlorella protothecoides
  modified_base (518)..(527): a, c, t, g, unknown or other
  modified_base (1798)..(1807): a, c, t, g, unknown or other
  modified_base (1868)..(1877): a, c, t, g, unknown or other
  modified_base (1953)..(1962): a, c, t, g, unknown or other
atgtgtcggagacgggaggggcgggggtgcccagcacgagcacgagccggacgcccagacctggggtgcagcggattgggagttaagcacgcacggtgtgcatgtggcgacgggaaggacgtgctcgagtggggtgggtgctcagcaaaagagtccggcacgacgcttgcagacttcttgctggggaacgaggaaaatttgaaaaggactcgaagctggcagaatgcctgccctgcccacaacgatcgcttggagtcaagaggacgctgctccaaagcccatgcagtcgccatcacacaagatcaacagttaagagacacgcgctggcctccctgtgcctcgacccaccatgcaggagcgcaatgtcctccagcagggcactcagttgactccgattggagaccacctacatcgagggtgggcagggtctcagaagaaggtccgccacctcctcatgctgcattccagaagaaacacatccggctcgcccttccagcaccaacaccaggagcagtggnnnnnnnnnncatgtctggtgcgggggtctcagaagaaggtccgccacctcctaatgctggattccagaagaaacacaaccggctcacccttccagcaccaacaccaggagcagtggagcgatggctccacacactcacgcacctctccaggaatgctgatcacgaagggaccacggcatgctgtgggcttggagcctccgcagaggtcgaggcggtgccattggtggtgctggacgggggcccagttgggcctagccggtgggtgcaagccatggggttagagtgtgctgaagctgggactttgaagagggaaaacctcagatcaccaccccttacatgggggcgcgaagatgaaaccctagggggacccccgcagcgcgcccgcgggccaagattgcaggggtggaccagatgcaacgactgggtcgtgcggtcgggatcgagggctgcacccggctcgggttcagcctgcaggtgcggacatgccttgatgagggtggtgcaaggggatgggagttgctccactgctcacatgggtgatgcaggagtggatgacagccctggcgtcccaccacccctgcaccaacaggtgggcttcatcctgggccggccacagcctggtggcaaggacctgctgctggccctcatccccaccccagactgcgaggcgggccctgcagcgaggctggatggcaagacgcacatcaccctcgacgccgactgggtggtggagcacgccctgcagctgtcgcgcatcctgatcggaggtgagaagcgcggtgaggtgccgcggcgcaccgccctgcttgccagtctgatcccggcagcccccaccgcccctggccccgcaatacacgtgcaggcatccacgtgctgggtattcggagctcagaggtgggcgggacttggtgaggggggaggaggaggtgcacggagagcagtggaggggctgggtgctcccgcagatcccccacaccagggtatcgccagacgttggtcgcccgcccgacgctgcccgggccctctccatgttgcacgggactcgcccaagcgctcccctgtccctgccccccttcctcacaggctcccatgcctcgctcgtgctgcacgccgacgcgaccagcggagcgctcacggccagggatgcgagcgggcccggcgccctgaagccctgcgaccaccgcgtctccgcgctggcagagcagatggtgacgctgcagacccggtgggccggcgtcgggtggtgtgcggatgtgggtggtgcgcctgccaagctgggnnnnnnnnnnaggactcgcctaagcgctcccctgtccctacccccttcctcacaggctcccatgcctcgcnnnnnnnnnncagtcccgtgaccctgtgctgggggtgcagcagcttgcatgcttgccttgcgcgccatgtgcctgtcgccctccgnnnnnnnnnntag

SEQ ID NO: 3873 - DNA, 321 bp, Chlorella protothecoides
atgctttgcggcgtccccgtgcccaacactcgcacctgcacgcatgccccttcccctcaaacaccctaccatccacccccccctcttgcccgtccgccgcctccccaggcccccacggtggccctggcccggcgccacacgcgcggcaagcggggcgagccccccaccgtgcacacgcccagcctcagcgtcgtctctggcaactacctggcggccaagcgccggggcgtggtgggcggggtggaccacggcgccacgggcatggtgcgccacgtggccgccgcctcggtggccgcgcagctggcggccggcagcatcgtg

SEQ ID NO: 3874 - DNA, 1014 bp, Chlorella protothecoides
  modified_base (946)..(955): a, c, t, g, unknown or other
atggggtgggattttcctgctacgaacgctttcacacggtgcttggatcgctgtgaacagtgccagatctgggtgcgctcggctgccattgtgattcttacaccggaacacgcaaggcgcgagatagtacagatgcatgaagcaacgctcgagaggggcttcagcctcgcgacaggattcgtgtccccagagaaagcgcctaatcctgcatctgcacgcctaaaccggtcatttgtcgctcactggctcaaaaggatgtggagcaccgccgcatgcatgtccccgacggtgccaacgttcgagcatggacgccagctgcgcctcctcagcgggttggcaggggagcgtgtgttcaagcatagcgttgtcgggcccaggtacgagggaccccgtggtatgatctttggaagctacctgctcacatgtgacgccgggttgcctgcatcgactccttctggcctgaagggtgggacgcctcagctacctcgcactcacccttgccgccctcatcaaagcaggcgatgcaacctcaagcgcacaatccacgcctctgccaccacctctgggtctactctggtggaggaggaggtgtacatggaacgtttcaatgggtacaggcggcaaggagctccctccaaacacccaataatcaatgcagactacactccatttgagctgatcgagtacacagacaaggcaatgcagcacgagattgtcatgccggtggctgcagggatagaaaagtgctacagcatctggagtgaccgcctgaactggttgcagtggtttgacatgattgaagagcgcaggcaagcaatcagattgttcacggcggcaccacattctaaggcatatttctccatgcaggtggggttccatgaggatgaccccagcctcgtgtctgccttctacatgtaccgatggggtgagcgcaaggatcctgtgnnnnnnnnnncccttgcagtttacgagatgtttaatgagattgacaacactccgagcatagctgcataa

SEQ ID NO: 3875 - DNA, 2073 bp, Chlorella protothecoides
  modified_base (266)..(275): a, c, t, g, unknown or other
  modified_base (1525)..(1534): a, c, t, g, unknown or other
  modified_base (2002)..(2011): a, c, t, g, unknown or other
atgacgcccctttgcttcccgaggtctgaaatgctgccggtcttgaggggacttcgcgcgctgtactctgggcgcgaaggcacccttcgagacaaagctcgtggaatcgtcccagcggggccgatggagggggtcgcggcaggggagcacagcggggacacagacacagctgcagacacagaaagaccctccccagctcttccggcggttctcaataagaagaagctgcagaagctgcaggaacagtacgagcggcgcggcattgnnnnnnnnnncacacagctgcagacacagaaagaccctcctcagctcttccggcggttcttaataagaagaagctgcagaagatgcaggaacagtacgagcggcgcggcattgtatacatcagtcgcattcctccccacatggtgggtgctgtcgcaaagctatgatccctgggacgcttgtaccttgccctggaaggtatgtgcactccccaggtccagtgcaggccgtatgcacgattcttgctcctgcggtggcctggtccgcagcaacatgcccccgatctcgtcctcagatcctcgcctccggcgcaagcgtaaggagaagggcgccaacaccggcaagaacttcacagagggctgggtcgagtttgaggacaagcagaatgccaaggatgtgagttggctgaaggcacacggtgcgcggccatggactggagggtaccctgtctcagtattcgctgggcacacggcacgtctgccacactgcctcacaacctgctgtcgactcacccctcctctgagccaggccgtccagctgttgaatggccagcccatgggtggcaagcgtcggtccgcctacttctacgacctctggtgcctgcggtatctgcccaagtttaagtgggaccatctcaccgaggagatcaactaccagaaggcgatcaaggagcagcggatggcggtcgaggtgtctgcggccaagcgtgagcgcgatttctacctggcgcaggtggacgccagcaaggcccaggcggccatgctggagagacgccgcgaggtaagagacccgggtgctgatgctgggggaaaggtggtggtggagcggtgcctcgccgccgtgtccttgcatgtggacacaagtggtgcacagctgtcccatgtgaagagttgcaagcagttccagatgcctcttgatgcacgtgcacatccctttgcgcctctgcctttgcagcgctcgggggcggaggccacacctccagcagacccctcgggcggcatgcctgcagagcagccgcaggcggccgacaagccggccaagcctgtcgtggtgaggcgctatgggcagaggaagcccaaggccgaccccatcctggacgacggcgtccccagtctctctgggggcctgctgaagcagctggcaggtcgaaagaggccgcgcagcttggggacattgcctcctgagctggcggccggagggggcactcgaggggacgcagctttccagaagcccacacgagcatcagcagttgccggggttnnnnnnnnnncgcctcctgagctggcggccggagggggcaatcgaggggttatggctcggccttgtgagaaccacagcgacctctgcatgcaccaatcggcggagtgtatttcaaggacgcagctttccagaaacccacacgagcatcagcagttgccggggttgagaagagaggcggggtctggcagcacgtttgggtcgccttgcttcaatggggagcttgcctggatcgcctctccctctgtcgaggcctcggggatgggtgtgggtgcagcgctgcgttcacccggtgcacccagcagtgccgtgtcctggggggtttgccaccagtggggatcaggcgatgatgcggccatgaaacccgtcaccaccaggccatcgcctgcagcaagacacgtgccacagcctctgcacgtggcagaggcagggtgctcctgcccttgggcagacagcataccatacccacagtcaggcccannnnnnnnnngctggtgcacccggcagtgccgtgtcctggggggtttgcaatcagtggggatcaggcgatga

SEQ ID NO: 3876 - DNA, 519 bp, Chlorella protothecoides
atgtgtgcgcagcttccctatcgttggaggcctccatctctttggcggaaaagttcagggatgcgagctgctgccggaagtgctcgatgtctgagcgaacgtcgcgtggaatgtgatgactcttcacagcctccagtcctgagtagagggggacaaagagagtgtaggcagacaggcggtgagcagcgaggggcgaggaaggctcagatcttcaaaacgctgggcgacaccctccccgcatgtcctgccatgcaagaccccggagtgcataccctgcatcccggcgtgcagcgaccatgccacggcttgaaagtcggcagagtcctcgaggggccagacgctgccggcctctccctcctggcaccggctgatcagcgcatctgcctggcggatggcgtcgcccagctcgtccagagcagccagcagcgactgttcccctgtggtggcggtacacttgtgtttggggtccacgcaagggacagggacgcaaatacagaggtcccaaacacagagctttga

SEQ ID NO: 3877 - DNA, 681 bp, Chlorella protothecoides
atgccatcgcatcttaaagctccctctttcaccatgaccctgcccctggcaaggtgtcgggtcacagctccggctggacctgtgcttctacaccctgcacccggtcggctggtggcacggggagtcgggcctcctcggcccttcacacactccctgcaggccgtgagacgagtgtgtcgagcaggatcagggcccttggacatcagcgagcccttccatgcaatccagaccaccgagtcggttgcgaccaacccagtagactacgacgccgaagccccgtccccgcgcttgctgggcttcacctttcaagatgtgcgctgtttctatggcagggtccggggccgcggctcactcccagacgcggaagtacggctccctagacaccctcacttcccaccagtactgttcttggatcggagggtatactactacttgaacatagcgtactggagcctgctcctcctgtcggtgctcactggcaacgacttcctgtcccgcatcgcccagttcgagacctacaccaccgccatgtttgtggcctccaccgcgttttcgaccttcttcgggctgaagtggtggcatgacgcgcggcgggagctgcgcagggagcagaccagcgactggcgggcactgctccgttactcctggaacgccctcttctggctaggtgggcgagactga

SEQ ID NO: 3878 - DNA, 1251 bp, Chlorella protothecoides
atgctgaggaaggtgtctgggttgctgcgccgtggtcacggccaggacgcagcggcccctcgctctagactgcacacggaggacaccgatcacgatgcatcggggaaggggctgccacaggcccgcttgccctcccgcatctttcccgacggcccccgccaggtgtccgaggaggagactttcggtgagaagcccggaagaggagaggggggcgacctaccaatcaaatatcagtgccaggcctccctggggtcattacagggtgcattagaccgaggcctgctgaagctgaccctgcactgcgcgcagctcctgcaagtccgccgggaccgcccctactttgccgtgctctccatcggcagccagaccctgacctctgcgcgcatacgggcccctgcccacgaggatgtgtgcctgacatgggaggccagcagccactttgtgctgcaacgctccggcccgacgctggcgcgggtcgcgatctaccgtggcggcaagtacaagggcgcgctcaacaacttcctggaggtaggagatatgggtggaagggttgaggacgagtctatgcgctgctgttcccggcagctgaccctgccagtccctccggaaagaggggaagatccctgcctgaaacctcatcacaccctctcgctcctgcagtgctggtgtcagattgacctcgccacctactttgacaacgagccgggggcgaggtccctgcccgagggcggctggcacgacctgctgtcggcaaacggcagcgacggctcggcctcccagcacgccggccggctgaaggtgtcggcggcggcctcctcgccgcgcgccctggagtcgcagctgtggacgcgcctgctccccctggccgactttgacggcaacggcagcctgaatgatcaggagtttgtcatgctcatgcaggcctttggcgccgacctggaggagcacgacctggagggcctgtggcggcgggtggctgaccctgagggcgccgccacacccatcgctcagctggcggaccgcatgacgcgcgtgcacagcgggggcgacctggcctcgctcatgaagcgctgccctgttgacggcgcggccctagtccccggtcaggacctggccaacctcatctacatgaccctggtgctggacgaggggctggccccgaccacgccctccgccacgctcaaggtcggcggggaaggaggtggaggtggagttcaaaaggggtggtgggggtgggatggaggctggtag

SEQ ID NO: 3879 - DNA, 771 bp, Chlorella protothecoides
atggcccctttgtcaccctcctccgtgctgccaaaccccactcctgcccttcttacgtcctccaccccagcccgcacgccttacctggagttctacacgaccttcaagaggacagaggccgagccaaaccggtgcattctggaggaaccagtggagggcacccctttggttattgcagtcctgttccagacggtggaggaggccagggcccaagcgtctgcatctggcacagtttccaatgtcctggagggcaaggaaggcggcacagtcgtgacgctgcgcatctcctaccagctcgcagtggtcctggatgagtttgccgggcagctggcggtgtatgctgacgtggaggagaagctgaaggcgtgcatggtgcgcatggcagcattcatcgaaaacgtggatgaggcggcgctggcagagtgccggggccaggaccagaccctgatcactgatggtgaggggaatcaaaagggcgtcggcggcttcccggagcagcgagcgcggaggggggaggtggaagcagagcgccaggccgccatcgcggcccatgaggcgcgggtggaaagcgcgctggagtacgtcacgcaggagggtcaggtgatgcaggacgaggcgacggccgccagcgaggtggccgccgaaaaggcggtggttgcccagcaggccgcgcaggccgaggcggcggccgcggccgccgcggcgccggtcgaggtgaagaaggcgcccacgaagcgagggcgcaaacccaagaagaaggacgggaactga

SEQ ID NO: 3880 - DNA, 498 bp, Chlorella protothecoides
atgaagccgtccacatccaccaaggccatcaccagcaccgcgcccagggagttcaaatctcaatctggcagccccgcttcgcctccagacgacagcatccgcttccacggggtgcaccatgtcggcctcctctgctcctccctctcccgctccctggacttctattgtggggtgctgggcctggccatcaaccccgaccgccccgacgccaagctgccctacgccggggcctggctctggatcggcccggagatgatccacctgatggagctccagaatcccaaccccaaccccacccccgacggcgtgggggatggcatgacgcgcgaccggcacacgtgcgtgggggtgcacaccgtcaagcccctggaggagaggctcgaggcgcacggcatccccttccagcgctccgccaaccgtcccgccatcttcttcaaagacccggacaacaactgccttgaggtagtggagatccggccgtggcggcagggtcagtga

SEQ ID NO: 3881 - DNA, 339 bp, Chlorella protothecoides
atgctgcgtatgaccgagtggctgacgcaccccctggccggcgcgccttccggcatcctgcgcggcaacaagtacgcggtgggtggcctgcgcctgggcgcccaggcggcgcacatcttggtggtggaccgccgctcgcggctggtcgtcgaggagaagctgggcgtggtgctgtcgctggccatgcgcaacatgtatcagtcacgcatggggcgggtgctgatgcgggagggcttctttgcccgcctgaaatccatgtccgagaccaaggggcggtacatggacagcccggagagtgtcaaggtgggcggatgggagagggagggaaaggggggctga

SEQ ID NO: 3882 - DNA, 579 bp, Chlorella protothecoides
atgcgccctgcccagaacggcgtggttcctgtccacgcctgcagctcccaaggtcccgatgtggggggtccgcatggcccttaccgccagtcggagaggcgggagatctacaaagagtatgttgacaagctggtcgagcagggccttgcctacccctgcttctgcagtgacgaggagctggagcggcagcgagaggaggctgaagctgccaaacagccgcccatttacaggggaaagtgggcacaggccagcaaggaggaggtggaggagcagatgcgggccgggacgccctactgctaccgcttccgcgtgcccaaggatgaggtcattaccatccaggacctgatccgtggggaggtgtcgtggaacaccgacacgctgggcgactttgtggtcctgcgttccaacggcctgccggtgtacaacttttgcgtggcggtggacgacgcgctgatgaagatcagccacgtcatccgcgccgaggagcacctcccaaacaccctgcgccaggtgtgccgtggcggtgtgcgtgattgtcgactcggagcatcaccacccagtgcaccacaccccccttaa

SEQ ID NO: 3883 - DNA, 363 bp, Chlorella protothecoides
atgatgcaggtgctggtatacaaggccctgggcttccccctgcctcagtttgggcatgtgtccttgatcctggcggcagacaagtccaagctgtccaagcgccacggcgccacctcggtgggcgagtttgcggggcagggctacctcccaaccgccatgatgaacttcctggccctcctgggttggaacgatggcacggagcgcgaaatgtttgacgcccgggagctgtcggaggccttttccctggaccgcatcaccaagtccggggcggtgtttgacacaacaaagctggcctggatgaatggtggggcgggaaggagtgggttgaggatcctgggcgtggagacctgtgcttgctcttga

SEQ ID NO: 3884 - DNA, 501 bp, Chlorella protothecoides
atggcccagatggtggcggaggtgggggcggccaaaggcctgctggcacgacccgcggtcacgccctttgtacaggcggccacagagctgacgcaccagtcgttggagctggtgaacgatgccgtgacccagatccagtggctgctgcagtacccgctggaggagactctggctagccccgacgccgcccctttcatcgaggacgggtttgccgacgtggctcgcgccgtcgtcgccgcccacgccgatggcagcctgcaggccgccatcaccgggggacccgacgcctacaagggcctgggcaagtccatgaagcgcaagggcaagcgcctgttcatgccggtgcgcatcgcgctgacgggcagccaggcaggcccggacgtgggccaggccctgcggcttttgaccctggaggatggggacctggcggccggggtcaccgtcgtgcacctcgacgaccggatcaaggcgctgcaggcttggctggacgcccgctcctga

SEQ ID NO: 3885 - DNA, 1608 bp, Chlorella protothecoides
  modified_base (48)..(57): a, c, t, g, unknown or other
  modified_base (654)..(663): a, c, t, g, unknown or other
  modified_base (766)..(775): a, c, t, g, unknown or other
  modified_base (843)..(852): a, c, t, g, unknown or other
  modified_base (1172)..(1181): a, c, t, g, unknown or other
atgccgcctgtgcaggatgtctggcgcctggctctcccagtccaaccnnnnnnnnnnaatgctcaatcggtacacgattggatttcgttaggcagggcaacgtcagagactccggatatttcccccaaaacacccgacatcaccctcctgcaggtccccggccaggggaggggcctctttgccacgcaggccatttcccagaacacactggttcacagggaggcgcccatgctgtgcacgcccccaccttcccttcaccagcatgccgcctgtgcagggtgtctggcgcctggctctcccagtccaaccccctggatctgtcaggcctgccaggaggccgggctgcagggggagccctggtggcgcctgcacactcgctgtgactgggggccactccaggccctgtgctctgggtcgggcgacaagttccccctcctgatggcacggctggcatgcatgcgcctgcgcccctgcggcccagaacgtggggaggagctcggcgtgggggcgctgcgcagtcccccgcctgcccgcggggacccactcagcgacctgcagcacctctgccacgcccgggtgccgccgcccccgcccgagccttggcgggagcagcatgcagcactgctccgcggcctggccgccggcttggccggnnnnnnnnnncgcggcccagaacgtggggaggagcccggcgcggggccgctgcgcagtcccccgcccgcccgcggggacccgctcagcgacctgcagcacctctgccacgccnnnnnnnnnngaaagcgacggcagtggcgtgccgggcgctcgaccttgcgtggtacagcgacggcatgtcgcgcctcnnnnnnnnnnccaagcggcggcagtggcgtgccgggcgctcgacctcgcgtggtacagcgacggcatgtcgcgcctccacctcaacgtgttcaggtgcgggggatgggcggggtttgtgtggtgaagcggcagccacacagcatgactgtcccggggggcgacttgggcagggcaaagtgctgcaccgagtctcccgcccagccgccgctccctgcagccggcacgccgagcgcagacccaccgcctcgaatccgcacccccgactcgcagggtggacacgatctcgatgcacggcgcatcactcctccaggccgcggctgccagcctgnnnnnnnnnntctcgaatccgcaccccaactcgcagggtggacacgatatcgatgcacggcgcgtcactcctccaggccgcggctgccagcctgggcggggggccggtggcggccctgggcgccggcagcgcgttgtacgcgctggcctccctgttcaaccactcctgcgacccctgcctggacgcgtgacgcagcgccagcggagcctgcaccacgcctacggattccggtgccgctgcgcacgctgtgtggaggagggggccggatctgcgggggactgaggatgcagtctggcgcgcgtggagtgcatgcatggagagatgtgggctggaacctccctgctgaggtgggaggagggccggtgcgtgctgcacgtgatggcatgtcggagggattgcggtccgagacagacgcagtgaggggaggcgtgacatga

SEQ ID NO: 3886 - DNA, 1062 bp, Chlorella protothecoides
  modified_base (296)..(305): a, c, t, g, unknown or other
  modified_base (369)..(398): a, c, t, g, unknown or other
  modified_base (839)..(848): a, c, t, g, unknown or other
atggcgctgagcagtgcccgacccggcacgaaggcccaaaccctgctcctcgccctgagctgcaccgctctgggcgcgttgatgatgtgtgcacacgatcgatggacatctgtgggattcccacttgggctgtgtccacccatggaccttttggaagagaagcctagacccgagggctggtggaccgacctgcaccagcagtatgtcgacgccatggcagaggcagacaagggcgaggggagtaacgactgcagcgttgcccagtactggtctatggtggacgtctattcctcctnnnnnnnnnnggtccgcccatggaccttttggaagaaaagcccagacccgagggctggtggaccgacctgcacnnnnnnnnnnnnnnnnnnnnnnnnnnnnnnctatggcgaagggattacagaggggtggcagggcaccttccaagggagcgccactcaaccgaccaccctcaggaagccggtcgatcgtgcaaaggatgtcacagtcacgttcaacgccacgtttgcgaccccatatggcgcggcggcgtttggcatcgccggggacggcgtggactccttggcctggcgcctcttccatggggagctacccacgcgcaacccccccaaagtcatagtgctcaacatcgggagcaacgacctggagcgcgcccgccgcagctccccctccccacaccaggtggaggagtccatctggaaggctgtgccgcacgtcacaatgaggtcggggctggagggggggggggaggagcagcaagggcacgagagtgggggagagaggcgccttgaaatagcattccgtgctgtttgtatctccaaggnnnnnnnnnngcagcggcaagggcatgagagtgggggagagaggcgccttgaagtagcattccgtgctgtttgtatctccaaggctcaggatggtggattgacgttccatgcacatccgctatggaggaggattggtgcccggcatctacccctctgggaggctctgttggctggcccatgtcacacgaagcatatttttgaggtcatccatcggtcaggatga

SEQ ID NO: 3887 - DNA, 960 bp, Chlorella protothecoides
atgcctgccatcgctggcccactgatcagacctgcccacgggggtcccggagtcagacgtgctccgacagtggcgggaggcaaagtgctcatgatccttcacatgagagaggcgacgaagatgtgcagtctgcgaagcactcggacgacaaatttagatcctgccaggactccagggtccctggggagggttggccgggagaacgaagtgatcactcacctggacatgatgtataggtcacatcccatggccaccggcctactcgtcatgcttgcgacctcgttcctgatccctgtcgctgctgaccaggagtgtgattggactgggcctcgcgtggattgtggctatgtgggcatcactgagggggaatgcaggaacaagggctgctgctggaatcctgccgacttccaggatttcccttatgtggatgtgccctggtgcttcacccaaaacgcccacccagcggaatatgaggctgccaagatccaggaggacaatggtaagaatgaatgcctggtactgtaccactccagaacccataggggcatgttgcatgggcagtggcatcatggattttcccatgtagccatcctgcccgtccaacacagacaggttcccggtcgtcatgtcctcacgattgcgcacatgtgcggcatgagcctgcacctggcccggtcgcctcgtgcccagcgccaaccctgccctgccgtcccacgcatgccaggcggcggctcctacgctgagctggcgctcgtcaagtcggtgcagccagagctgggcccagacgttaccaaactctccgccagcgtccggcgcgtcggctgcgacacactacgcctgaccctccgcgacgctgacgaggcgcgctgggaggtccccacccacctcttcaagtctgacatcctcgcaggtgtgatgatggccggagatgggactggcggtgtgcagatgggtgtctga

SEQ ID NO: 3888 - DNA, 897 bp, Chlorella protothecoides
atggggatagcatggcccgcacagtatgctctccatgcgcgcagcatcagacgcccatgcagcccgcccgtgcccgaacgagcacggccagcagggcgcctcgtccccgcagcgggggtggcgtggacgcccagtgcccccgtcttcctcgccaccccccgccccacccaccgccgcccctccctcctcgcacaggagctgtatctgtggcccgaggtggcggaggcggggcgccaggcgctgagtcagcggtaccgcctgctgccgtacctgtacagcacgatgcgcgccgcgcacgacaccggcgcgccggcgatgcgcccactgtggatgaccttccccgaggacgtggccggccaccgcaacgaccgccagttcatgtttggggacgcgctgctcgtgaccccggtgctgacccagggcgcgcgcagcgtggagggccacttcccacccggcacctggtacagcctgtggaacgccagcgacgtcgtgcatgcgaggtgcgcggcccttgggatccagcgggggtcgcacgcgtcgggcgccgaggcgctcgtgtggcgcgccgagctgcggcacgacgacttggggatgcgctggcgtgcccctcctcctcagctccttgccatcgaccctgccgccagggcgaacggcaccgacgtgaccctggacgccccgctggagcgcattccctaccacgtgcgcggggggcgcatcatcggcacggcggagccccgccgcaccacccgcgacaccaaggccggggccctcaccctcctcgtcgcgctccctggggagggctctggcgctgagcggagcgctcacggcgtggtgtacaacgacgacggagagagcgtggtccaggcgagtcgtgagtgcatgggagggggccggtga

SEQ ID NO: 3889 - DNA, 399 bp, Chlorella protothecoides
atggatttcacctttgacccggtggacttccccgtggaggagatgcaggtatgtggcagactccgatggcaaagtggccaccagggagtcggcatgggtctgagcagggcatgggtgttgggtgctttcaccttgtgcaggcactttgagggtttgcacaacagagatcagggctttagtgctgtgccacttgccaccacctccaaatacacatggcaggccctggtggaggatctgcacgccaatggtcagaagtttgtgccaattctggatcctggcatcaaggtcgagccagggtaccatgcctacgatgaggccctgaagcgagacctgtttgtgagaaatgtagagggcgacccctacctgggctgggtaagggcatcctggggggggctctaa

SEQ ID NO: 3890 - DNA, 1047 bp, Chlorella protothecoides
  modified_base (910)..(919): a, c, t, g, unknown or other
ccgcccccgcccccgcccccgccgccactgccgtcaggggtgctggcatcgaatgcagactccgactctggcggtgattctgatggcggcgcgcttccgagcgcagatgccatcaggagagcaaaggagacccgggagaggctgaggtcggcccaccttgcaccggactatgtgcctttggcggcgggtatgggaggaggcactgatctcagttcaaagtctgaagcgctggtgctccgagcccgcctgaccgactgcgcctcactgccgacgccaccccgcagggcgcgtgacaggaagctgaccgaagagggcgctgcccccagtgggtcggacgccgaggcggacgacgaggaccggggacgaatggtgtttggcctgggcacgcggagcgatgccccaggacaactcggtccacaggagtgggcatgtcgaaagggtctggtgctgcggcaggccctggtcggccctgccgcagcaccagcagcccaggacctggacgaggaggaggccgcctgggcggaggagcagatcaccaagggcatgggcgggctgacccaccgggcggcgctggtccccggccccgcaggggcagcgccgccggcagcggcacgctccgcgccccgcgcgatgcgcccccccggccaccccggaggcgcggaggatgtgggagcggcgctggccgccgcgggcgccacggcgctggcctcgctcagggcggcggtggatgatggccgcgcgcgcgcgctggcggcagctaagcagcgcgaccggaccgccgccgcgctgcgcaccgccgtcgccagcgtggagaccctgcgcgccgacctggaccgcgcctcggagaagtatgtggacgcgcagcgcatgcgcgcctatgccgccgacctgtgcgccatgctgcaggcgnnnnnnnnnnaaagtacgtggacgtgcagcgcatgcgcgcctacgccgccgacctgtgcgccatgctgcaggcgaggagggtttgtgtcggggtggggtgggggggtggtcctgacgcagatcgaggggccgggatga

SEQ ID NO: 3891 - DNA, 810 bp, Chlorella protothecoides
atggcgccccgccggccgccgagctggacgaattcgggaggaatgcgggggcctgggcgcggcaggaggcgcagcgcaaggccgaggccggcgacgccgcgctggagcgactcgttgccgcgctgccgggctccggtggaagcagggtcgacaggcagccccgaccccgagctggagttccacggggcgacctccagcgagtccgagggggacgtggacgagtatcggaacacgcgcgacaagatcctgcaggcaggcttcggccttgactttcatgtttttgatgaggacatcggggagctcgtggccgcagacacgctcttcctggatgctgcagagccgtacggcacgctgcgcgcggtccgcgccgagctggacggctggcggcggcgccagccggccgcctaccgcgatgcctacgtcgccgctgccgcgcccgcgctcttcgcgccctgggtccgactggagctgctggcctgggaacccctggacgcgcgcacgcccttcaccgacctggcctgggggatgaacaggagggggcggctggggaggggggatgaacaggacggggcggcgggggagggtgggcccgcggcgacgacgacgagcaacgaggacgacctcacagtcccccgccttgtgtccagcctcgtgctgccggctgcgcgacgtgcgctggcgcccggcgcctggtcgccgctgagcgtgcgccagtcacgtggcgcggctgcgctgctggccgcgctggaggaccacctgccgggggaggaggcggcggtggccgaactgaacgccggcgtgcgggcggcg

SEQ ID NO: 3892 - DNA, 897 bp, Chlorella protothecoides
  modified_base (61)..(70): a, c, t, g, unknown or other
atggaaccttttaacaatctgtccccgcaacccccgcccctcccgcgccagcgcattgggnnnnnnnnnngatgcaagacctttgctgctgggaactgtgcatggaacctgttaacaatctgtcctcgcaccccccgcccctcccgcgccagcgcattgggagattccactccgaaacgttttaggggcatacctttgcatgctcagggaccgatcaagctcgctggacaatccatccgatcgatggcggggtgtccctatcacacgaggatgggcgagatgacgtcgcagctggagcgactggtgcactcccccgccggggctgccctggtggtggtctccgtcgcgctcacactgctggccatggtggcctcttccctgcgcacacttgggggcctgtatcggcattttatccgaggaggacggaatttgaggcagtatggcgagtgggccgtggtcactggggccaccgacggcatcggcaaggcatacgcagaggccctggcgaagcagcgtgagccccggggtgtgaggactgtactgtgtctaagacttgtatctgtgtcaaacgtactcactcacaccctcttgaaaccgcctgcccccaggtctacgcctggtactgatctcgaggaccgcctcccggctggaggaggaggccaaggcgatcacggacaagtttggcgtggaggtgcgggtcgtcgccgcagacctcacctccaccgatcccgccgtcttctcccgcatccaggaggccctcaagcccctggacgtcggcatccttgtgaacaacgcgggcatgtcctacccccaccccgagtacatgcacgttgtgggcgacgaggacatcaagaacattgtgaatttgaatgttctgtccctctccaaggtaactga

SEQ ID NO: 3893 - DNA, 1071 bp, Chlorella protothecoides
  modified_base (381)..(390): a, c, t, g, unknown or other
  modified_base (626)..(635): a, c, t, g, unknown or other
atgcgcaccgcctcgtcatggcacagccctgctcaaggaggttcccccctccccctcgtcccacacccatgcccacagctctgccgcatcgtcctggggggcatgaaggagcgcggccgcggcctcatcgtcaacgtgggaagcggcgcagccaccgccatcccctcggggcccctcctcgcagtgtacaccgcttccaaggtggaggaacgaggctgccctttggtggccgtcggccgatccctggctcagcgcgtcgagctggccgcctggccatgccctgcgactgcctttcctttccgcacgaggatctccaacccaaacctccccacacaaaccacgccacccccccccaggcgtacgtggatgctctcagtcggnnnnnnnnnnccacccccacacaaaccacgccaacccccacccccccaccccaggcgtacgtggatgctctcagtcggtcgctggaccacgaataccgcgagttcggcgtgcgcgtgcagaaccaggcgcccctctttgtcgccaccaagatgtccaagatcaggcgagcagaggggtgtgctgggtgggggattcgtggtggtgtgtggcttcatcggctgggtgccgatggtctgtacacgcannnnnnnnnnagatgggggattcgtggtggcgtgtggcttcttcggctgggtgccgatggtctgtacacgcagaggctcccccctcgccatcaccacagcctgcaaaggactcgcatgcagaggccggcacggtcacccactcccacgcaggcgagcccgcattgacgcgcccacgccagaggtctgggcggcggccgcggtgcgcgccatgggctacgagacggtcttcttcccctactggttccacgcgctgcaggcggccgccgtgaagctgctgcccgccagcctggtgcagtaccaggtgatgcagatccaccgcagcctgcgccgcgcggcgtaccgcaagaagtccaaggcggcggcggagctgctccgcgcccggagcgggaacgaggcgggcgaggcccccgcgcccgctgccaacggggtcaagaaggacgactga

SEQ ID NO: 3894 - DNA, 1617 bp, Chlorella protothecoides
  modified_base (423)..(432): a, c, t, g, unknown or other
atggctctgcgccagcgatgcccggccctggcgcggggcatattcctccacctagcgcgtagggaggctgcaggcggctgggcatggaccgccgcggctgcccccggccccactctgccatctacgtgcgtcccggcatgcgtgggggcatggcgcaccttcgcttccgggtccctccccgagcacaccgagcttgccatgcccgcgctcagccccacaatgaaccaggggaacatcctggagtggcagaagaaggtcggggacaccatcgcccccggcgacatctactgcgaggtggagaccgacaagaaaggtcgcactgtcttgttgtccgctcgtacttcatcatggagagggggcacaaccttcactcccaacatcgcgcatgccaacaatgccccggacccccatcctcatgccgannnnnnnnnnatcacggtgtggactgcgcaagcttggaaaatatgtcacagaaaggtcgcactgtcttgttgtccgctcgcatttcatcatggagaggggacaccaccctcactcccaacatcgcgcatgccagcaatgccccggacccccatcctcatgccgacctctttccaggcaagcatggagtgggaggcccaggaggagggcttccttgcccgcatcgtggcgggtaacaataccaaggatgtgcccgtgggccaggtggtcgccatcattgtggagaacgaggaggacatccccgccttcaaggactgggcgcccggtgcgtcgtccgagcccgcgccggcgccggccaaggaggcgcccggccacaaggaggcagccgcccccgccaagcccgcgcccaagcccaagaagggcggcaagaaggccgcgaagccggcgggccggtcctggcctccgcacgagatcctgaccatgcccgcgctgagccccaccatgtcccagggcaacatcctggagtggaagaagaaggcgggcgaaaccgtggcccccggcgacgtctgggccgaggtggagactgacaaggccagcatggagtgggaggcgcaggaggagggcgtcgtggccaagctgctctgcgccgacggcgcctcgggtgtggccgtgggccacccgctggtggtgctggtggaggagggcgccgacatcaccgcctttgccgacttcaccgacgccgacgcgcagggcggggcggggggagcggctggcgaaggggaggccgaggaggccgagggtgcgaaggaagtcaagccggccaaggaggccaaggaggccaagcccgcggcgtcagccaaggcggccaagtcggcggcgcccggcgcccgcgtcgtggccagcccctatgccaagaagctggccgaggaggcgggggtgtccctgcagggcgtggctggcagcggggagggcggccgcatcacggcggcggacgtccgcgagctggtggagtcgggcgggggcaagcctgtcggcggtgcgggcgacgccggcgcgcaggcggccgccgccagctgggagggcgagggcgacgacgtcgcgcactcccagatccggcgcatcaccgcgcagcgcctgctggagtccaaacagaccgtgccgcactactacctctccgtcaggtgtggagggagccaa

SEQ ID NO: 3895 - DNA, 999 bp, Chlorella protothecoides
atgctgtcgcctcacagccccctccatgtgtcattccctgtgcatagagaggtgctggaccgagcatgcacaggccgcctccccccctacaccctctaccgcttcctgcactcccgagtggaggtcggcaagaccattgctcccgggtttgaccccgcccctgtcaaccggctcgcagtgcatggcgctggagatgcgatggccctgcactgcaaggatggcaacgtcctcctgtccagcctgggctccctgcgcagctcctcgctggtcctcagctggggcgccccagccgtgccctgcacacgcctcgaccccggcgccggcccattcttcatgccagtctgggcggcagacgacctggccatcccctcgcttgcctccaaccgcgtcctcctgtacgccggcgccgagggaaggcactccctcccacacaccgccctggccctggtcagccagggtcggaacgccgcggtcagttgcctgcacgtgccgccgcccggcaccgcccccttccgcctggcagcgggcacattggatggccacgtgggcctgtgggactcacgcgaccccggtcgcggccaggggggggctctggccccggacctggtgctggagatggtcagcgggcggtacgcgcccggcaggcactccgtggctgggctgagcgtgcgggacggcggcaacgcggtggtggcggcctactccacgggcacagtgcgcacctgggacctacgtggcgggcggactgcggccgcctgcttcggcgcccgcatccactcccaccccgagctgagccaggtgtcgctgccgggcatgctggccgacattcctggcctggaagattgggtggggggaaggaaatgcttggagcggcactcaaactgcaggcttgcacaggtgcgcggaggtgggagggcggggaaagaaggaagaagcccagctctgggggtgggaagggtgcactcctgggcgaggtggggcaccagctccgcaacctag

SEQ ID NO: 3896 - DNA, 330 bp, Chlorella protothecoides
atgacccccctgctaccctcacaggcgctcgtcggcattcctggactgattgcgactgaggcggatgctcatcataccggcgacttcttttgtgccaggctgaatgacaggccctccctgcacggcgccttgttggggtgcctcatgttccttgagaatccagcctgccctccaagcctcagccaggcacagctgctgagcgttgccaagaacctgaccagcaatgtgttcgtgcagcacctcccccagacagagcgcctgctggcatacagagctctccaggctcttgtccaggtggggtgggggacggccaagacaggtccagtctaa

SEQ ID NO: 3897 - DNA, 582 bp, Chlorella protothecoides
atgcgccggcccggcaacgccaacctcacgggcactcagtaccagtacctcttctcccaggcttccaccccctcctccctggtggcccagcccaactcggtgagcagtcggcgggctggactggcagggctggtgttccttggagtgatactgctttccatcggacatctttactcccgccttcaaacccacgcccttgccacccctgaacccctgcccatacttccaaatccccaaccacctccccctcagatcggcatctacctgcctgattcggagcatcccgcctcgggattggtgcgggtgatggtggtggatggcaccggcgaccccaccggcaactccgccaactacctggattcggacgggcacgtcaatgacaatgaggcgcgcaacacctccagtccagcccagagtgcgtcgtgggggccggggagccgtgccactcttcttatgcagccctctccctccaattcctccatttcccttgtagacgttaacgacggcaactggcacatgatcacggtttccacccaccccaacaactccctggggtacagtctgtacctggacggcaggtag

SEQ ID NO: 3898 - DNA, 546 bp, Chlorella protothecoides
atgcagctcctgccccagctaacaaccggcatagatgtaaatgtccgatttacaagcataggcggctttgaggcgattattaccctccagcccctgccctcccacctgcagtttacgagggagactggcatctttgatctgctcaatgttcgcctggtgcatggttggctcgtggacccccaggacacggtcaccgctcaggctgtcggccaggcatcctacaacgagctcatcctgcgggtcgtgtgcgcactggacgggtcctacgccgccggggtcacctcagaggcgcccggccaggccccggcggccagccagcctctgcccatcccagggcatggcatcgatgccgcatcactcacagcagcgctggccagcgcggcgtctggcgcgccggccgcctcccccagccccgccgaccacaaggacagcctcgcatccgccatcaactccatgctgggggacctggtgaaggtgagtgcccccttgcgcagccgagatgacaagggggggacaggctccatatatgagcattgtccgccttga

SEQ ID NO: 3899 - DNA, 1212 bp, Chlorella protothecoides
atgacatgtgctggtacagacgccggaatcccggtgatgggccctctcaagtgccacccaattggccccaacctcctcacctttcctccctccatccacccccccgctctgcagggagacctgttggacgactgcgtgcagcgcaacggcacctggtcgtgcctgaccaacagcggcgcctggaaggcgtgtgcgctttccggcgatgaccagcccatggaggagcagggcctgctgcacgtcgccagccgcaacaccgtgggcggcgatgcctgcctcctccccgccgtcctcaacggctacgtcttcttcgactgcgtgcagtacgccacggagagctccaatgtggagatctgccccatcgccaactccagctgggccacctgcgatccgctgtcccgtgccgcgcccaccgtctttgacgcctctgtgaccctggcgcgcacggcgaggggcagggtgaaccagctgtgccatgtggaccccgccgacaacgccaatgagaatcagggctgcctggaggacctggtgtgcgtgcctctgccccagctggtgaggcttgaatgggccggggcgcaggggattggggcccctgtgctgccctgggagggtttgagtcttgtggagcccgggagaggtcttgcccggcccagccaggcattggccccagtgctcctcggcatcattgcctgcttttcttgttgcagcttcgttcccccgccctgcacgtccacgtcggcactgttgtcttgtcccaaccagtctccccacgactctccccatcctccaaaggaaatcccctctttcgcaccacagaacacgacggcgctggacggcctgggctactgccacgactcgccgcaggggggcaccttcgacctgcctgccatcctgcggggggaagacatggcgcccctcgctttctacccgctcaccggcggcggcctggagacgctgaccctgccgctgtacaacggcagcagcgccgggccggtgcagctgcgctgggccaacgacaccaattttgggtctgtcccagactgcatgagggtgagctctactcttgtttgtgcgcttgtgcctgaggggtttggtgggatggggaaggggggaaagctggatcttccactccacgctgccatgtgctttggccggcacgaccccgcctgctgtgatggcgccaccgttcttgccggtgagcacgcttcatga

SEQ ID NO: 3900 - DNA, 393 bp, Chlorella protothecoides
atgaggagccggcacggcagtcgacgccgccatgggcagatgcaggcggcgacgatgggcccagacctgaccgtcgccacgggagtgccaggccggcaggctgcacagggcaccgtggccggcatcgacacgagacaggaggccgccgtggccgcagaaaacaacgcaaggcagggatctgagggtgcgggtgggaccccagcgccggcctctgttgcggcggcctctgggtcacagcgtgaggcgcggcaggtggacgaggaggtgcggcaggcgctcgtcatccaggatttcctggagagctgccccagccagctgacgtatcatgggctggccagcctgatccaggacttgcaggagggggaggtggcggtgttcttcaggtgcgggtga

SEQ ID NO: 3901 - DNA, 504 bp, Chlorella protothecoides
atgccgctcacaaacctggttcaggccgtccggcctgtacccatcacgatatgcacggtggccaaggcatctagcccagcggctagggccatggcctcggaatggcgtgacaagctgcagcggtacgtgtctgtggaggaggtgtgcgtgaagcccaaccccaagaatgtcaaggacccgctgctggcagtgcagcatgagggcgagcgaactctggctgcccttcccaacgacgcctatgtggtacttcttgacgagcggggcaaggccctgaccagcccagggctggccgccttactcaccagggcctcctccgatgggtcgccacgcctcgctttcctagtggggggcccgcatgggcaccatgcctcggtgagagcccgcgctgacatcagcataaggctgtctgacatggtcctgaaccaccaggtggcccacgtggtcctgctggagcagctctaccgcgcgtggaccatcctgaaggggtcgccctatcaccactga

SEQ ID NO: 3902 - DNA, 600 bp, Chlorella protothecoides
atgatacagcagtccgaagcatgcccgatcaagccgctccattctcatcatgcaccgcaggcggccagtccagcaggcgatgccttccctgctgcaaacgccttcttcacactgcaagatggcgacctgacctcctccgtgccgctgaatgcgtaccgtggctcgggcaccaacgtgagctgggtgacggacccttcgttcggcacgcgcgtgctgcagtgcgacgccagcctgggcagccacgtgtccatccccggcctgtcctacggccaggcagggccctgggcgctgggcgtctgggcgcggtggaacgtcaccaacggcaccgcctccgcgtacgtgctgagccagaacaagaccaccaacgtggaggcctctctggaccccaacaccgtgggcctgtacctgccagagctgggcaaccccagctatgggctggtgcgcgccgtcgtccaggactccactgccacgcacggcaacaccagcgtgccccttttcctcgactccaacggctgcatcgccgacatcctctgcactaaccagaagaacttcaccctggtgagttactcttgggggagagggggggggttgagagtgtga

SEQ ID NO: 3903 - DNA, 510 bp, Chlorella protothecoides
atgtcattattattacgtagacctcctggccgtgaagcattccctggagatgttttctatttacattcaagattacttgaaagagcagctaaaatgtctagttctgtaggtggtggctcattaacagcacttccagttattgaaacacaagctggagacgtttctgcttatattcctactaacgttatttctattactgatggtcaaatcttcttagaaactgagttattttataaaggtatacgtcctgctatcaacgtaggtttatctgttagtcgtgtaggttctgcagctcaagtaaaagctatgaaacaagtagctggtactatgaaattagaacttgctcaatatcgtgaagttgctgctttcgcacaatttggtagtgatttagatgcttctactcaatatttattaaaccgtggagcacgattaactgaagttttaaaacaaggtcaatattcaccaatgcctattgaaaaacaagttgttgttttatacgctgcaactaaa

SEQ ID NO: 3904 - DNA, 1305 bp, Chlorella protothecoides
  modified_base (698)..(707): a, c, t, g, unknown or other
atgcgccactcggccctgcccgagcgtgcaaagtggggactgggtggtagcatgggatcaggagggcagagggctgcaaaggccagcgccccgtcaggcctcatgtgctgcgtcccacctgttttcatccaggatcaagtacccatgggagacgtccgggatggtggatcgcacgattctcgcgccaggcgcgggttccgaccaggccggaacgagtctgccttccactgccccggaacccatctggctccgagcagcagcagcctccataccgcgatcaagacatcatcgcaatacgctggctgggccaaccttaggagcgttctgtgcgcatggcccattgctaccaatgataaaaaacaagacgaggttgggaaaggccagtccagtctcaatatcctccagataataatcttctcaggaggcagtgctaatatatcatctggagaagtctcccctgatagtcgtggaacatcgcgcacctgcctgctcgccgagtcgctgcagcacctcggtgcgatggcgcaggccgtatcgctggaggccaaggagttgtccagtatcagcttcctcaaacagcgtcctaggcggagccaacagggccaacctgcgtggccaaccaggaacaaccatggacctccagatgtcatcgctgctcacgaatccacggatcaaacttgtgcgacctcccaaagtgnnnnnnnnnntttgctcatgctgggtgcgagtgttctaaattgtgtttgggagcggccgggagagggtcaccaaggcggagccgacagggccaacctgcgtggccaaccagaaacaaccatgcacctccagatgaacgaccggctggacctctggccctttgtttgtgcctacgtcgcgtggagtggatatgtgctctggcgcctggtcaccatcgggaccgaagggttttacctcattcagcttgctacatatgccctcctggccatacacgtgcgccgggccagggaggggacccccgaggctggcggcagggctgggactgagcgactgagcagggcgagcggcatgcgggagggcacgaacggcgcagagtcacgacctcaaatcactcctcccaaaaccctgatccccacaggccgtgaccttcctgtccggggtctggagcgtcggcagccaggctcgcctgcgcttccggccggcggggtccatctcgcaggccacgcatgtgctggtcgtgccgcatgcatttgtggggacacgggacattgtccccctggagcaaaaggccgatgcggtgagagtcagggcgcaaagaggcggtgggac

SEQ ID NO: 3905 - DNA, 729 bp, Chlorella protothecoides
atgtcgagcgatctggacgcccgcttcaagaaggccgtgtggctgatccggaatgggcctcccaggcccggcaccaccaacgacaccaagttggcgtactacgcccacttcaagcaggccacggagggggatgtgaggggcgaccaaccctgggccgtccagttcgaggccagggccaagtacgacgcctgggccaaactgaagggcatgagcggcgacgaggccaaagccaagtacattgcgctgctggaggaaggtgagctggatggtgccagggcgggtcggtgtgcgagggttggagagggctgctgggtctcccatttcagggcgttggtgttgtgcgggccggccgcttccagccgtcccctgtcgctccttccccacaacaatctgcataaacgctgccccaactcccatgaccaggggatgctgcatgggagaaccatctcgcactcaaggactacccagatccgtgaccgagcccaccaccacgctcaacttcccatcactgcctggcacccaatgtgcccacctgtgggtcgagggggtgccggcagcggtgttcggcatggccgaggtcagagcggcgggacagggcaggaaaccctccggggtcctgcagggtgtggctcctctgccggctggttgctcctggtctccgaccaactcccagaccgccgctcttccctgtgtgtgaggcattcatgtgaccgttctctgtgggtttga

SEQ ID NO: 3906 - DNA, 411 bp, Chlorella protothecoides
atggccaagcgcatcatcaagctcgtctccgccgtggccgagaaggtgagcatggggctccgacaccgtcaggcaccccccccgattcgctccagcccgcaggacgcccattggcgcacaaccgaccaccccgttcctcccccacatgcccctgtttcgcaggtcaacaacgacccagaggtcggcgacctgctcaaggttgcctttgtgcccgactacaatgtgtcggtggcggaggccatcatccccggcacggagctcagcgagcacatctccacggcgggcaccgaggcctcgggcacggggaacatgaagtttgccatgaacggcgcgctcatcatcggcaccatggacggcgccaacatcgagatcgcagagggggtgatcgtgctcgaggcgcggtctctttga

SEQ ID NO: 3907 - DNA, 1722 bp, Chlorella protothecoides
atggacacgtacacgagcgacaacgtgctggccatccagcaggccatcgtgcaccatgtggaatacaccctggcccagacgcggtacaagtttgacgacctggaggcgtacatggccacggcctactccatccgcgaccgcctgatcgagtcgtggaacgacacccagagctacttcaaggaggtggaccccaagcgcgtgtactacctgtccatggagttcctgatggggcgcagcctgctcaacgcgctgaacaacctggaggtgcggggccagtacacggaggcgctggccgagcttggctactcgctggagacgctggtgacgcaggagcgcgatgcggcgctgggcaacggcgggctgggccgcctggcggcctgcttcctggactccatggccaccaccaacctgcccgcctggggctacggcatccgctaccagtacggcatgttccggcaggtgctgcgcgacggcttccagcacgagcagcccgactactggctcaactttggcaacccctgggagctggagcgctccgcctccatcgcctaccaggtctccttctacggccacgtgtcggtgcaggacgacggcgggcgccaggcctttcgctggaacccgggggagcaggtgaccgcggtggcctacgacacccccatccccggtttccagaccaacaacaccaacaacctgcggctgtgggcggccaagccggaccgcgagttcgacctgcaggccttcaacacgggggattacgtgcaggccatcctggccaagcagcgcgccgagacgctgtcctcagtgctgtaccccgacgaccgcacctatgagggcaaggagctgcggctgaagcagcagcacttcttcgtctccgccaccgtgcaggacgtggtgcggcgctaccgcgagcaacacgcctcctgggacgccttccccgacaaggtggccttccagatgaacgacacccaccccacgctgctcgtccccgagctcatgcgcgtactgatggatcacgagggccttggctggacgcgggcctgggagctggtgaccgagacctgcaacttcaccaaccacaccatcctgcccgaggcgctggagcgctggccggtggccatgatggagaagctgctgccgcgccacatgcagatcatctacgacatcaactggcgcttcctgcagcagatgcgcggccgctacggcgacgactgggaccgcatctcccgcatgtccatcatcgaggagaccccggacgccgacaagtacgtgcgcatggcctacctcgccgtcatcgccgcgcgcaccgtcaacggcgtggccgccatccacagcaacatcctgcgcgacgacacctttgcccccttccacgagctgttcccgggcaagttccagaacaagaccaatggcgtgacgccgcgccgctggcttgccttctgcaacgagccgctgagggagctgctcaccgacaccctgggctccgacgcctggatcaaggacctggaccgactcaaggtgctgcgcgagcacgcgagggacccggcgctgcagaagcgctggcaggaggtcaaggccctggccaaggacaaggcgctgagcaccatcgaaaggctatcgggcgtggcactgcccaaccgcgaggccatgctggacgtgcaggtgcatacgagcagggctgggtgggacggggaggagaagagtatcaaggggaggcaggtgtcgtga

SEQ ID NO: 3908 - DNA, 987 bp, Chlorella protothecoides
atggaggccaaggggggtagggtttccccatgcaggcctacagggagaacccccaacaaggatgcctgcaacaggcccgccactcccccttgcaggcactctccattcaacgaatccagccacttcagcggccgcttcgtgtctgacgaggatcgcgtgatgctgaacgccatctacttctcctcctcctcccccagcgccgaccgcgtgcggtgctcggcgcccgtggcgggcctgggggagaaggcggggctggtggtgccccccacctcctccgggggcgaggcggaggcggaggacgtctgcatccccctgcccacctggggcatgcgtgcggggccgagggagaccatctactttgagccgtcgttgactcgggccgcgagtgagggcgcgggggagtggggagtgggaggaggcggtgcgacggcgagcttggcctggacagcatgcatcagtcttgggattgaggttcacaccaaccaacaccccggaccccttggcaggtacgggttccaggggttctactccaagaagcaccgcccggtggtgctgacggggcgcagcgtggaagacatccacctggagggcggctccatccttggcacatctagcatcgcgcccgactatcggtggggggtgcttgtgtggctgggtcggagcctggaggttgtggtgtgctccactgtgtgcattccctgcctcgagccgtctgtagccctcttgtgtgtgagctccccctccgttacctctcccaaacccctcagcaagatcgtgaggatgattgacctgatgggcctggacatgctgtttgtcatcggcggcgccggtggccacatgggcgccacccagctcgaggccctgctgactcagcacggtgtgcgctgcgtggtggtgggggtgcccaagagcatcgacaacagcatcctgctggtgggacgggaggatatgtggggcgaggtcctgtggcagcttcggggtcgatag

SEQ ID NO: 3909 - DNA, 858 bp, Chlorella protothecoides
  modified_base (842)..(851): a, c, t, g, unknown or other
gccgcccgcgcgcgaccccggcgcggaggagcgcgtgtacggcgagaagtgggcggcgcggcgcgcgcgcgtgcgcgcgcagtcgccccacggcgcgcgccccggctgggacctggcctgcgtgatcgtgaaggccggggacgactgccggcaggaactgctggccatgcagctgatcgacgccttccacgacatcttccgcgaggcgcgtctgcccctgaccctgcacccctacgaggtgctggtcaccagcaaccgcaccgcgctcatcgagctcgtgcccaacgcgcccagcgtgcacgccgtgaagggcgcctgcccgccgggcaccagcctgagggaccacttcctggagcggtacggagcaggcacgccggagctcctggccgcgcagcgcaacttcgtggagtccatggccgcctactccctcgtctcctacttcttgcagatcaaagacagggggataccgggggaggtggcgatcaatgccccacccggagcgcagcattgcactccggcggggcccagggaaatcaggcatcatcttcactcctccctttccacctaccccgatgcaggcacaatggcaacatcctgctggacgacgccgggcacatcgtgcacatcgactttggcttcatgctcaccaactcccccggtggagtcaactttgagtcgggtgagcgtgtgcatggtggaaatggctgtgagggaaatgatgggtgggctgatgggcggtgctgtgccccgatgagaagcgtggaaggcgtcgcatgcacccctgactgggcgagatgccacctgacgttgggcttgggtgtcactcctcatcgccccccttnnnnnnnnnnaaaatga

SEQ ID NO: 3910 - DNA, 1254 bp, Chlorella protothecoides
  modified_base (1209)..(1218): a, c, t, g, unknown or other
atgcttgtgatcgtctctgcaggggtgcagatgtcagaagatggttgcgctacggatgacaagaagggagatagggagtatttgagacagtttcggtcctcactgctccagaatggggacgctgcgagtcgcatccccggtgacccacggcgaaggcttcaatggcccgggtcaaatgacgcgtgcccttccaccagcatacacttgacaaatgccaaatcagggcatccagtcgccccaaaacaggggtgtagaatgcagagaaaactcttgtcagtacgtaaaatgtgcaaatcaatccagtgggctcagggtctgctccgtctaacggagtggcgactgcccgcaatgttaccaacaacagtccaacctaaccctttcggtcattctgtcctttggcaagggctcagaatgaagtcccatcttccaccggggaaggaccgtcgaaatgcctctgcagacggccaccgtctgatcgctgcctgtcccgaggtgacggcgatgtcgtccttatcccaaacaatcgttcgaagacctttcttttgttcgctcaacccaccgaggagaccgtctggattccatgctgctgtgacgcctagccccctgagaccctccaagtgggcggtcccctccctagcccccagcctctctgacgtggcagatgcctccgcggaagcaaatcaggatcgcagggagggctcctacgagcagcccctggtccaacgccaggtgcctagggggaaaggagggcagggggccttgaggcgagcctggcccaggcagggcttccatggtcagtcgtggcagtgccatgacagccgaagcccaacgcgacaccgtgggtgcagcatgcgtggacggaaacattggcaatgccttgccccattggccccccaggcccggaaacgggacgatcagcaggaccccttgtccagcctcctccccacgcccgacgcccgcgtctcgcccgacgtcctggtcgtcggcgccggccccgccggcctcgcccttgctgcggagctgggcgctcaggggctgaggaccacgctcgtgggcgacgcggccagcatctttaccaataattatggggtttgggcggatgagttccaagccctgggactggagcacaccctggagcacggtgaggggcctgcgtggaactgggtgtgcgcctgtgtgagcgtctctgtgtttggggggcggaggagnnnnnnnnnnagccctgggactggagcacaccctggagcatggtga

SEQ ID NO: 3911 - DNA, 1500 bp, Chlorella protothecoides
  modified_base (85)..(168): a, c, t, g, unknown or other
  modified_base (754)..(763): a, c, t, g, unknown or other
atgctgtactcttctgaatccttacacagagcacgagctctgcatacctttactttgtcacctccaccctggtcgacgagtggannnnnnnnnnnnnnnnnnnnnnnnnnnnnnnnnnnnnnnnnnnnnnnnnnnnnnnnnnnnnnnnnnnnnnnnnnnnnnnnnnnngcttgcacccacctcctccaccctccttgccacctgcttgggaagtgtgctctcgccctgtcctctacctcaaccccgcttctgcacacctcctacctcccaatcatagggctccaagcttaccggcggcaacatcaacaccgtcaatggctggaagtggtctgtcttcgctgtcgcggccgcgctgatcgcctactatgggcaccaatcttacctctcggtgcaggggtacgtgcgcgtcgggcgcagctctttctgattcaggttgggcacccattgcctgtccatctcccccattgcagtcatggggatgacccattcaccctttcctttccccctgcgcgccagacgcaagcaagacgaagcggcgtcagcgtgccctggaggagctgcaggccatggactccaagtcaaagtgagcaccccctgttgctcctttctggttcaaggggtagtgtggcccctccagcatccctggcattgcaagacagagacaccccgttgagcacagcggccctcggacccgaaggttctcgtttgcagtcagtgggagcacatgattgtccagcaggcaggagtgtccctnnnnnnnnnncagacgcatgcgccgtgacatcgccagagaagtgtcagcagtacggccgtcgggcaggggcgtccccgggtgccacgggatggccgacagtctcgttctggccttctggaggatccgcacagcgctcgccgaatcaggacgctctgcgggttttcccctcaggccagctggccgcagtcggtgatgcggatgacctgcttggtggcgccggagccagagccgtaggactcaatcttcttaaccacgtcgaggcccttggtcacggagccaaacacgacgtgcttgccgtccagccaggcggtggcggcggtgcagaggaagaactgggagccgttggtgttggggccggcgttggccatggacaggatgccggggccggtgtgcgtcagcttgaagttctcgtcgttgaacttggcgccgtagatggactcgccgccggtgccgtttcctgggacgatgggaccggggacggtgaggatgcatcattgggatggcagcttggtacacacggggatgggggagacccttgggagatgtttgcaaggccccaccgtgccctcatgcagagacactcatggcaacgcacccgcggtgaagtcgccaccctggcacatgaatccggggatgacgcggtggaaggtggagcccttgaagtgcaggggcttgccagagcggcccgtgcccttctcgcctgcagggtgggaggcaggcagcattctggtcatatagtggcataa

SEQ ID NO: 3912 - DNA, 822 bp, Chlorella protothecoides
  modified_base (406)..(428): a, c, t, g, unknown or other
atgccatcgagatcgaatggtgcgggagccgtctgccagaagtgcctgcagcccgggcactggacatacgaatgcaagaatcctgcggcgtactcccatcgaccatcccgaacggagcagctgaagaatcccaaggcccgccctcgcttcatggatgcatcagagctgccagaggagctgcaggacaagcctggaaagccccagaagcaggaggggaaggcaagcaaacgcaagaggcgcaggagtccatcctcctcttcgtcatcatcttcttcgtcctctggcagtgattcggacagtagtggaaccagctccagcagcggaaccagctccagcagcggaagcagctccagcagcggaagcagctcaagcagcggaaccagctccagcagcggaaccagctccnnnnnnnnnnnnnnnnnnnnnnnctctagcagcggaaccagctcaagcagcagcggcggcacgagctcgagcagtgggactgatggcagcagcagcagtgactctgagtcgggcagcagcggttcatcctcttccacctccactggacgcacctcggcttccgacactgccagtccaccccccacaacagtgaagaagcgggcccatagatctggagcaacaccacccgcagaggagcctattgcggctcggaagcgatcgacgtccccatcggctgcagcggcagcagatacaagcgctactgcatactatcgacgccccagtcgctctccgaggaggagacgacgcagccctgacgcagagacagccgaacggaggagaattcccaagcaggatgatcgctggcaactccattga

SEQ ID NO: 3913 - DNA, 408 bp, Chlorella protothecoides
atggtgctggcgccccccttcctcctccaccacctccccgtcctggccgctggtgccgcgctcgtcgtcctcgtcaagggcctcgtcgttggcggcgtggtgctcgtgtttgggtacgggctcgaggtggcggccggcgtgggcctggccctggcccaggtcggcgagttcgtctttgtcctgctttccttggcgcacggccaggagctgctggccacgcaggtctatctcctcctcatgggtgagccggggggatggtgtaagggggggaaggtgggtgtggttatgggggtaagaagatgcatgcaagggagaggtgggcattcaggaccctaccactggtctcgcgctgtgcgtgggatgcagaggggcctgggttgcatgggagttgctggtgggataccgtag

SEQ ID NO: 3914 - DNA, 1011 bp, Chlorella protothecoides
atggggggtggacttgcatccgacatccccccacatccactcccttgcctcgcgacattgccctggctgcagatcaaggaggtgcacgaggaggagtggtcctatatccccgtgggcggcccgctgcccctggcagaccagcccatcactgcatttggggcggcagcctccctggtgcaccccgccacggggtacagcctggcccgcagcctgcgggaggccaagggcgtcgcggccgccacggccgccgcgctgggctccgcggattcgcagcgcagcgtggcatctcgggtgtgggatgccctctggtcccaggagcggcgcaagcaggttgggtttgtgggtcgggggctgaggttgtttttggaggtacatgaggatgttcgaggggtgaggggcggcttcggctgtcgtgggcatgctccactggcctgtggcccctccccgactgccatccatcaatgcacttgccccttgatccaaatacaaacacctacaggccgcgttccacatctttgggatggagctgctgtgcaagatgggggtggagccaacggcccagttcttcaccaccttcttcagcctgcccacgcgccagtggcgtggcttcctgggctccagcctcacctccctccagctcctcgtctttgccgggaccacctttgtgttggcccccttgcccatcaaggtggtgtgcatggctgtttgggcggggacctcttggaagcatacggttggggccggacatcaagccagtttcctggaggttccctcgtcccccgatggatctgcacttgtctcgtacagcccttccagcacctcctcttcctcagcccccgaatcgcggcccaaccaaacttgcagacgcggctggtgcgtcacctggtccaggacccggcggggaagtacctgctgcgggcctacaccaggagctcccaggaggggtctgcgacggaggaggccccaggcgcggcgacagcggcacccagggacagcctgcccgcagcatga

SEQ ID NO: 3915 - DNA, 483 bp, Chlorella protothecoides
atgcgcagggctaccgaggatgtggacgaggtggacgatgaagactcctctgacttcgccgaccgcgccttcctgatcgtgcgccgggtggttgccgacaagcggccgatccagggcaagaccactaccgtcacggtggagctatacaatgccggatccacgtcggcactggaggtaaaggcggtcgagtccaagtggcccgagcccttcttctccgtgtctggggacctctctgccagctacgagtccatccccgctggcgccaccgtccgcttcacctaccaggtgaccgcccaggaggctggtccctaccagcatccacccacccaggtctcttaccaggccgtcgaggacgatgaggactccgtcaaggtggggagcggacgtattatggggatgagatgcattctgcgttgctgctgggaagggcaccttattccaggcgagcatgctggtattgtgatgagagccaggaggaagtag

SEQ ID NO: 3916 - DNA, 420 bp, Chlorella protothecoides
atgctgcctgcctcccaccctgcaggcgagaagggcacgggccgctctggcaagcccctgcacttcaagggctccaccttccaccgcgtcatccccggattcatgtgccagggtggcgacttcaccgcgggaaacggcaccggcggcgagtccatctacggcgccaagttcaacgacgagaacttcaagctgacgcacaccggccccggcatcctgtccatggccaacgccggccccaacaccaacggctcccagttcttcctctgcaccgccgccaccgcctggctggacggcaagcacgtcgtgtttggctccgtgaccaagggcctcgacgtggttaagaagattgagtcctacggctctggctccggcgccaccaagcaggtcatccgcatcaccgactgcggccagctggcctga

SEQ ID NO: 3917 - DNA, 252 bp, Chlorella protothecoides
atgcaggcactggagggtgtcaagaccaagctggcggagacagtgacccctgcggagagcctgaagggggtgctgcaggcccgcgacaagaaggcggcgctgctggagctggctgggaagaacggcatcaacgccgccttcatccagttgctggacgagaacatcgcaacggcgggggcggcccagcagcagaaggctgtggaagtcatgaccaagctgcgcgccgaagcgtcgcggtacctcacggcctga

SEQ ID NO: 3918 - DNA, 441 bp, Chlorella protothecoides
atgcatgccccctcgcacatcccgcacaggctggtgaccctggcctccggcgcggcggcggggcgcttcctcaagtacgagagctctgcccccgctgtggccgtgcagacggcgtacggcatcgaagtggaggtggcgggctacgacgaggcctttgaccccagcgtcatgctcttcatggacttccggcggcaccacgtgggcctgggcgcgggcggcgcgcggcgcctgcgccccggccgccacccggccggcggggacggtgtgtgggatgccacggacgaggtgccctccttcctctacgccatgcccctgggcggccagcgcgtgttcctggaggagacgtgcctggtggccaagcctgcgctgcccttccagacactcaagcggcgcttggagcggcgctgcgctgctctgggcctggaggtgggctggggttag

SEQ ID NO: 3919 - DNA, 1242 bp, Chlorella protothecoides
  modified_base (1200)..(1209): a, c, t, g, unknown or other
atgcactccatcgccatcaaccccacccctacccttttcacatcgcgccagcaccgacttcacctgacacccagtacgcgaagccgccatgtgggtccccgaaaagctgtagaagggtccccagagccaactgaagagagcgccactgagggtacctccaaccgatgcgagacgtgcggtgctcctactgacgcaattccttctggctgtgaccgcatgggccgcatagtgggtggcttgggctcagtgcctggcttctcctggtttccactcaaggcatacaggccctgcccagcagccgcacaggcgggggtccaatacacaagcagtgatcctcacttgctctctgcaggaagggtcagatcacagacgatattttcaggccttcaaagtgagaagagtgcaagaccaacgagcaccatgtccagcatccatgcccagtcgtccgctcccatgtgccgttattgtcccccgaccgatgcgctgaatgttacgaagagttactccaggaaggagagactgccaggaagtgctgcccgctgggtaggatccgtcgcgatcatggttgatacgtttaaaattcattcatcaccaagatcgaccatggccaatcttgtccatggagcatctggtgcaccccttggtgcacaagttctgcataaaatggagtatggtgcttggcagctccatgccatgataggatcgtgcagtctgtgcaagggcccgaccatgcatatcccatgtcgaacctcgtcatgcgcgagtggacagagcacccctcggctgcaccgatccctggcattgtcaccggaattcagcagccaaggctcagcaaagaaattgtgtaccagcacgggcccttatctaggaggcagggacccgagcaggaggcaggccatcaagcatgccatggcagcccctgcagcctttctactggcccagttggccgctcccagctcctcccacgccttccccggcttcaagaaggatctcacctccaagcggcgggtcaagatccccgagtccgaattcaaggccggccctgaaggcctcaagtactacgacgtctcgcccggcaaggggcctgaggcgcatgaaggccagcgagtcgtcgtccactttgatgccaagtgtgtttctgggggatggaactggggttggtggtgtggctctggctttttggatgttgcaagccgcatnnnnnnnnnngcaccgatccctggcattgtcaccggaatttag

SEQ ID NO: 3920 - DNA, 3537 bp, Chlorella protothecoides
  modified_base (532)..(541): a, c, t, g, unknown or other
  modified_base (1019)..(1028): a, c, t, g, unknown or other
  modified_base (1455)..(1464): a, c, t, g, unknown or other
  modified_base (2088)..(2097): a, c, t, g, unknown or other
  modified_base (2694)..(2703): a, c, t, g, unknown or other
  modified_base (2790)..(2799): a, c, t, g, unknown or other
  modified_base (2989)..(2998): a, c, t, g, unknown or other
  modified_base (3427)..(3436): a, c, t, g, unknown or other
atgagccacgagttgcgcacgccgctcaacggcatcatcggcctgtcctccacactgctcctggacctggcgggggagccgctgcgcggccgcggccccgcggtcacccacgacgtggcagccatccgctcctccggcgtgcgcctgctcaacctggtgaacgacatcctggatgcctccgcgcttcgcgagggcaagctggcggtgaagctggagcgcgtggacgtgcgccgtgtggccgaggacgtgctggcgctggtgcggcagctggcggcgccgggggtggtcatcctgaacgacatcccgtccgacctccccgccgccaaggccgacacggggcgcctcatccaggtcatgtataacctcatcggcaacgcctgcaagttcaccgacaaggcgagctggtggtggtggtggtggggtggggggtccaagggggatggggcgtggtgcttggtggggagggtgccctgggagaagggggcacaggaggccacaaatctcgtggcctccagcggcacgtgcgctgcgnnnnnnnnnngcttggtggggagggtgccctgggagaaggtggcacaggagggcacaaatctcgtggcctccagcggcacgcgcactgcagacagctgccgccaccccctacccgcacgcgtttggcaaggagggcagccagcgttagatgctgaggaagaggggtgctgggcccctgaaatcaacatccagggcatggcactcaaccactggaccgactccagtgcgccttgtgtctgcacagacttctcccccactcctatcccgagcaccgccagggctgcatcatgctcaccgctggcccggagagagaaaacatggtgtccatctcggtgtcggacacgggcatcggcatcccgccaagcaagctggacctcatcttcggcccttttgcccaggcaggaggcttggtttgggagtggggtggtgagcgcgggagctcccgggcggctggcaggaaagtgtgaaagggggggttggcacgcttnnnnnnnnnngagcgcgggagctcccgggcggctggcagggaagggtgaaatgggggtttggcacgctacatgttcagtctgcaatcgcccctgtgaccctgcaaagcatgcatgttttgcaccaatgatgtccatcccccacagtaacaaaccaccacccctgctgcaggcggacatgagctacacgaggcggtacagcggtacggggctgggcctgcacctggcccgccagctgctggccgctcaggggggaaccatccacgctacctcacaccagaacaagggctccaccttcaccttcaccctgccagtgggccggactctgggggggtgctggaggcggcttgcctgcattgtatcaaaggcctgggttgtgtcgtcgtctggatggatcatcccggcgagcatagggttgttcatggcacgcatgcgctcnnnnnnnnnnctgggggggtgctggaggcggcttgcctgccttgtatcaaaggcctgggttgtgacgtcgtctggatggatcatcccggcgagcccagggttgttcatggcacgcatgccctgtgtacaccgacgccgactccaaggccgccgccgtggcgggcgtgatcagccaggggcgcacgctgcgcaacccgccgcgcatcgacgacatgctggaggaggaggccggcgcgctgggcctgggcgcccagcccgacggcggggccgcgggcgaggacctgctccagctgctgctggggcaggcgggcctggaccccggcccggtccacctacttcctggccacggagcgcgagacgcagcgcaaggcgccgcagcagctcagcccggaggccgccgccagcgccttcaccagcgccgccggaccgagccccggctggcccggggcgcagggcgactgggcggcggccgacgccggcgcctgcggcgcgggcggcgcctcgggcgaccaggccatgtcgcccttcctcctgcccagcgccagcacggcggagtctggcggcccccccagcggctccgaccgcggcccgctggtgctgccgctgcgcgggggcgggggcgccgagtcccgcnnnnnnnnnnggctccgaccgcggcccgctggtgctgccgacgcgtggggccgggggcgccgagtcccgtcccgactggcagcgcgcgtggcagagcgtggaggacatgcgccagcgcggggccatccgtgtgctgtcggtggacgacgacccgctgacgcagacggtggtgcagggcatgctgtcgcgcagcgggttccaggtcagcaaggccgccgacggcgagcgcgcgttggacgtgctggagggcggcattctggccggccggccaccgcacatcgtcctcatcaacctcatgatgcccaagaccagcgggtggggggtgggggggagggagctcgaagcggagggcaggtggccatgcagagaactctctggggccgcaggtacctgcacatacctccaccctgcaacactcggcatccccttgacccctcgtctccgcaggttcgacgtcatccgcaccatccgatcccgctggccaggcctcatgctccccgtcatcatcctgtcggcctcctgctgggagaaggccgtggtcgagggtctccaggcgagtggtggtgcttgggctctggatcgccgtgcaggatgcagggttggtacnnnnnnnnnngcgcacccacgagttcatggccgaggcctgtcgccaggcccggccttcggaggcccggtcctccgagggagggagtgggggcagcgnnnnnnnnnnggccgtggtcgagggtctccaggcgagtggcggtgcttgggctctggatggccgtgcaggatgcagggttggcatatgttggatgcattacaccctgttttgctcatcacagaggcccaccgcgccacccagcatgcctctgcggcaagccggcgcgatccctgggggtgcactgggcgcccacagaatnnnnnnnnnncacccagcatgcctctgcggcaagccggcgtgatccctgggggtgcgctgggctcccacagaagtacgctccatcaaacaggcgcccctacccttccaggccggcgccaacgactacctgcccaagccgtttggctgcttcgagctcatggccaggatcgaggcccagctgcgcacccacgagttcatggccgaggcctgccgccaggcccggccctcggaggctcggtcctccgagggagggagtgggggcagcaggtcagccagcgccaacggcgtctgctcccccgactcctccagcgacgcgagctacaactgagcggggtggagctggcaggggccaacatgtcagcatctgactgtggtaccctcgggcggggtgcccgagggtactacagcccttttccttgtgcatccgtacattctgcannnnnnnnnnggtaccctcgggcggggtgcccgagggtaccacagcccccttccttgtgcatccgtacattctgctgtacccccaaacctaccaagtaccctcctccatga

SEQ ID NO: 3921 - DNA, 2331 bp, Chlorella protothecoides
  modified_base (59)..(68): a, c, t, g, unknown or other
  modified_base (1931)..(2061): a, c, t, g, unknown or other
atgctctggagcaggtggcctaccgtttacgctcaggaatggtccagcaagtcgacaannnnnnnnnncaggatgatcagcgagactgaaaattgtgtcttttcctcgccttgtcgatgctctggagcagttggcctaccgttcacgctcaggaatggtccagcaagtcgacagcatttggtgtggaccccatgcagggcgtttggtcgaccacaggggccgatccgatgtgctgagcgtgcggcccggtgcgtggcacatcgtcgttgggggccgcgcccaaacctagcggattcatatgcgcgcggggatctgaagctccgctcgcgtgctccgtcttcccccttcccccgccagtctggctgtcgagggatggatgcgtggagcgctgccaatgcgccacaccgaattctggtgtatcgcaccgttggctggacctatgtcgtgggcgggagcaaggatcagcaggcatggaggatcctcaagctcagtcgacgagaggtcgagctcactgtcgtggaggaccccaccacgtacacgcgggaggagctcacctccctcctgcgatgcctgcgtgacggtgagcggaatggatgcagctatctgggatccgagcctgccttcgtgcctcccgatatgcccaggttggggctctgctccccccggccccagtccccacccgccccatcacctcctgattgcttacctgcaggcaaccaggccgcgggcgggctccagttcgtgtgcagggcgcatggtatggctgggtgcttcaggttcctgcagggctactacctcctgctcatcctgaagaagtcgatgcagggcctcattgcaggtgggcctgcgtgggtggatggtcgtgcacctcgaccccccctccgtcccgtgctttgcgccctggacatccccagcacagcgcccccaggaggccacgcaccccccacattccccctttctccaccagggcacaaggtgtacggtgtggcgagcacggcgctcctccccctgctgcaccccgaggcgcatgccgcggccttccgtgagggcggcaccgcgttgcccgaggcacgctaccgccgcatcttcggcggcgtgcccctggactccagcttcctcttctcccgcacctggcccctgtggcgcagcgtgcagagcgtgctggcccccggcgcacccgccgccgccccgccccccaaccccgacccctttgccagccagtgggtgtggaacgcgcacatctcccgcccgctgcgcgcgctgggcctggcgcgctggctcacgccgctggtgcatgggttctggacgcagcgccgcctctccgtcttcggccgccccttcacgctgacgctgctggcgcggcggtcgcggcgcttcgccggcacgcgctaccgcaagcgcgggctcaacgccgacggcttcgtggccaacgaggtggagctggagcaggtggtggaggcggggctagaccgccgcacccgcctccccgccatctcctcctggctccagctccgcggctccctgcccctgttctggtaccaggccgccagcagcgcggtgctgaagcccgagatcgtggtgcagcagtacgacccgctgtaccgcgccaccgccgcgcactttgacgcgctgcgcgcgcgctacggcgacccggtcgtcgcgctggacctggtgcgccgcagcgggcgcgaggcggcgctgggccgcgcctacgaggccgcgctggcccagctgaaccgggggcccccgccctggacgccacgggcttcttcgtcctgggcggcgcgaccggggggtgggggtcctgcgccagggccgcacccgacggcggcgagggcggcgcaggggggcgggactccggcgccggggccgcggccgcccccccctcgtcttccagcctgcggctgcagtccggcgtgctgcgcaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctggcggcgctgggcctgtccggctccgcgcgcggcctggcccccgactcctccgccgcgcgcgcgctgatggacgcatacgaggcggcggggcacgcggccgcgcagcagtacggcggcagcgaggcgcacgcctccttcttccagcgcgcgcgcggcgacggcgcggcagccaccacttcgcgcgacctgctcacctccctgcgccgcttttacagcaacgcatacaccgacgctgacaagcaggacagcatcaacctgctgctg

SEQ ID NO: 3922 - DNA, 993 bp, Chlorella protothecoides
  modified_base (672)..(681): a, c, t, g, unknown or other
atgtccttcgtgcgaaccccatcttcatgcttcccaagatcctcgccacattctcccgcaggacgtcagcaaaggccagttgcgcggcaggccgaaacaaaagggcctcaggtggtccgaaaattgcctgtctcaggcggtgcacagctgctcttgcagttgctccaggcaaaggacccagcggcatacgcacgtgccaacgtggatttgtaccaggaggagttcttccagtcctcctgggccttcatcgccatggcggagcgggaaggcagcaaggaggttgtacaggagctacacaaggccatgcgcatcgccatggatgccaagcaggcctccctgcggccggagctgcagctgatgaacctgctcatggctgctccagatggaccagccagggcaaagatctgggcccaatttactgaaggagacaaggcccccctagatggggccttcttcacacgggtcctcgctcggttctcaaaggacgttgccagtggtgcatcagggacgcagaaggacaagaacctgcaggacaggttgagaagaatcctgattcccagcccatgtgtacttgatggagggtgcggaggcgagctcaaccacccaaggtatggcgtcgtgggaggggcgcagtggctggacgagggccagactctcgcagacccgaacatnnnnnnnnnntcagcccatgtgtatttgatggagggtgcggaggcgagctcaatcacccaaggtccagcgggttccttggaggagggggtcactcgtgtgttcgagcgccagcaaaacattggggtggaactggctgacatccgtcgtcagatcgccgcgttcaacgctacaaccagcaagctagccacggcggcaaacaaggtggagtctacggccttgactttcggagatgtccaggggtttctgaccgcgatagaggcggaggtggccaccattcaggccgccctgcagaagatacaaggtcgcaacaatggtggctga

SEQ ID NO: 3923 - DNA, 375 bp, Chlorella protothecoides
atgcccggagaactggggattgcccgcacgcactggagtggccttcatcaacaaacgggggccattctcctcaccaagcgcccgtccacatcccctccccccgtacccagaggtgcgaccccgcgcccttctacctcttcgatgagatcgacgcggcgctcgacccgcagtacagcacggcttcgtgcgaaatcctgtcatcctttgcctcgctttccacatcgccacaggaccgtggtggcggacctcctgcgcgcccagtcccgggatgtgcaccagcgcgcccagttcatcgtcaccaccttccacccgcagctggtggcggtggccgaccgcgtgtatgccgtctcccactccaaccgggtgtcgaggtga

SEQ ID NO: 3924 - DNA, 369 bp, Chlorella protothecoides
atgaagcgcaacccgcgcaaggtgaagtggaccaaggcataccgcaagctggcgggcaaggacctggcggaggacgccaccttcgagatggagcgaaagcgcaaccggcccgagaagtacgatcgcgagctggtgcacaaggcggtgggcgcgctgaagaaggtcaccgccatccgcgcgacgcgcgaggcgcgcctgcacacgctgcgcaagtccgccgcgcgcgacgcggagaaggctgccgaccttcgcgagctggagcagtccatccacctgatcaaggcgccgggcgtgctagcgcgcgaggaggaggagcgcctgcgcgagagcgtggaggagctgcagcagacggaggccatgcaggagtga

SEQ ID NO: 3925 - DNA, 672 bp, Chlorella protothecoides
atgttggactatgcgctgctgacacccaaaatagccctggagctggcaaggcaggcgtcgctgctgggagattgtctgctgactgtcgcccagctggccgactgcaccttcttcctccggccggacaggtatctgcctgatgctgcccctcccctcttcatcgattttacctctggaaccgcaacctgggtggagcccggctccgaaaggggcacaagcctggccggagtcgcagcagaggtgagggcgagtgtagcccgccgggctgtggcctctggggcgccatgcctgttgaccctggactgcgaccggtgggcggcccggggggccgctctccccaccctggcaggcatcctgctgggataccctgcagtctacgcgatcggaagccaggaggaaggcgcccaggccgcgcggtgcctgtccagcggcggcctggtcctgcacagcctcaccgccgggctgcaggccgggcgggatccctcgccgccagccatactggcctactcggtgcccgcctccctgctcccagacaccgagatggacgagcgcgcctcggcctgggaggccgaggtgcgcgtggccgccgctgtggcgcagggcgggggttgggcctggggcgacgtcgggcgcagcagggcggcggcgggtccccgtcctgtggtcctgtag

SEQ ID NO: 3926 - DNA, 357 bp, Chlorella protothecoides
atgcaggacaacgacgagggcgagcgcaagatcaggcagctcatctccacgctggacatgcgcaaggacgaggcgctggagcgcaccttcaagggcgtggccaagaacttccgtgacatcttcgccacggtgggtggtttgaggaggtgtgcggggggccaccctgtttcagatgagcaagcctggatgcctccgtgcagatggaaggccgaacggaaccttgaaagacacggtggctgggcggctgtgggtcgtggcctgcatgggtgttgcaccctgcacaaccgcacccccccgtccactgccccttccattccccccaacagctggtgccaggcgggaggggggaggttgtga

SEQ ID NO: 3927 - DNA, 303 bp, Chlorella protothecoides
aactccaatgtgggcactgccaactggggaaacaacaacaagggcacgggcaatcgctgcttcaacaagactggtacccgcaagatagtaaacgactgtagccttcttgagttccgcaagtatgcatgggtccttagcttcccaccacccccggccaagaagtctccacccccctcacccactaagaagtctccaccgcccccatccaagaagtctccaccgcccccatccaagaagtctccaccgcccccgtccaagaagtctccaccgccgccatccaagaagactccaccgcccccatcc

SEQ ID NO: 3928 - DNA, 810 bp, Chlorella protothecoides
atgctggcagcgcgagcatgccatcgctgggcaggagggcagcacttgaaattttggcgatctagcctccgatccgccaggcacctgagccatggtcgcaagtggcagcaccaggggagaggggctgtgctaaattctgctgcatcgcagtctcgcaaatccgtagtcttcttcggcacaccccaggtggcagtccctgtgctggatgggctcatccaggcggcctcacagccagacagcacgttcgatgtcaccggcgtggtgagccagcccgccaggccctctgggcgcgggtcccggcgcaatccacctcccagccccgtggcccaggctgcggcgagggccggcatcccgcaggatcgcatcctcacccccgagcgggcgggggacgcggggttcctggacgccctccgatccttgcacccggacctcctcgtcactgcggcctatggaaactatctccccaccaggctgctcggcataccccggcaaggcaccctgaacatccacccctccctcttgccagcctaccgaggggcggcgccggtccagcgtgcattgatggtgagcagggcggtcaagctgggagcccttgctttgcgttacggggcggcacactttgtcctgccacgtttgcctctttggcaggactgcctcgagccgctgcccttagctcatcctgacatccttgcgtgcactccgccaaacccacaggatgggctcacccagacgggcgtgagcgttctctactcggtcagggaaatggatgccgggcctgtccttgcacaagctgcctatgaggtgcgctga

SEQ ID NO: 3929 - DNA, 528 bp, Chlorella protothecoides
atgttccccgtcatcttccccgaggagtgcgtggaggggagctggagacgggtgctccccgcctgccgccctgtgtacatcaacgacaccctggcggggctgtctccggcggcggagcctggggcagaagcggcgcggccacgctccggcatctgcctgcagggcaagctggaccagagccggcgcgactacaccggcatctttgcgcagctccaggagcaggcggaggagctggcggccagcaacttcaccctcgtcatccaggtgctgggagtgggggttgggctgcgggtgggcacaggcatcacagtggactggtgggggacgcgagggtctggcgaggggatcggggtgtgtgtcgcaaggcaacccatgagggaaaccaagcttgcgacaccctggcccccggccgctgtcgatgtgcatgccacaggccgccggcgcctgcagcgagagcaaccttggcctgcccatcctcactcaactcgtgcactcccccataccctcagggcaagggcgcagatgtga

SEQ ID NO: 3930 - DNA, 1332 bp, Chlorella protothecoides
ggaccctgggaccggcggggcccggaatccaaggggccggcgcgccgccggtgccgacgcagggcgttgcattggggccacccgcctggagcgaggagcgggcccggctcaggccgcgcccggggctgaagggaccctgggcgcggcggggcccgggatccaaggggccggcacgccgccggtgccgacgcagggcgtggcagtggggctgcccgcctggagcgagtgggaggcgggcctgctggccgagggcgtgagggtgtggggctgcggcaatccctgcgcgctggcctccatgatcggcacccgctcctgcgcagaggtggcggccgaggtggcgcggcgcttccccggcgccacgcacgggtcgcccaccaagcccccggcctaccaccgccgcaagccggcctggggcaagcgcatccgacctacggtcacccaggaccgcctcaggcggacagaccccgtgagtggccagagcttgcgtattttggggggggaggaagaggtcctgatgtgcacgaggggtggcttccagtcgggaagaggagggagcgcacagaggtcctgttgtgcacgaggggtggcttccagtcgggaggaggagggagcgcacaggtggctgtgtccagatgagcgcccgccctcatcgagtcgagtggctagctggctctcaccctgccccctccaccacccaactcttcccccttcccccaaagaagtacatgccgtcctccccccccgccctctgcagctctgggcgccgtggcggccatgcagctgcgtgggtccctgcgtacgcggcacctgcccctgcgtggactcccagaacttctgcgagaagttctgcgcctgcgactgccgcgcctgcggcaaccgcttccccggctgcaagtgcagcgcgcgcgcgcgcggcggcgggcgctgccgcgtgcgcacctgctcctgcctggccgcgggtcgggagtgcgaccccgacctctgcgccggctgccaaccctccctggccgccggcagcgagggcggcgacggcgactgcgccaacttccggctgcgccgcgggaccaagaagcgggtgctcatggggctgagcgacgtgcagggctggggcgccttcctgcagggctccgcgcgtgcgggcgacttcctcggcgagtatgtgggggagctggtggacaccgcggaggcggaccgccgcggcatcagctacgaccgcgacgacaactcctacctgttcagcctgaacaaggcgtcggtcgtggatgcaaagaccaagggcaccaaactgcggttcgcaaaccattcctccgacgccaactgcgaggcctcgtg

SEQ ID NO: 3931 - DNA, 420 bp, Chlorella protothecoides
atggtgccactactgaggcccttccagtgggcatctgccaaccctttctctgcccttagcccttgcctggccataatctcctcccccctgctggcatggcaggcagctgcccggcacaccccacacccccttccccctcaaatcacacacacacacacacagctgccccagacctatgtcgtgatggtgcacaatgctttggccctggagcaggaggcggcggtccgcgccatccgcgccagcggcgccaagatccttaccatagcgccgcatgtccaggcggcggcgcagcggcgggcagcagcccagggagtccaggtggggggctcccggtgcactgacgtgcatccgccatgcgctccacggccctgtgctcccgtcgagcgctcggggaaaccttctcccctcggagatttctga

SEQ ID NO: 3932 - DNA, 378 bp, Chlorella protothecoides
  modified_base (316)..(325): a, c, t, g, unknown or other
atgcacagagtgcactgggtgccttccatccccctccccgcctcatctctgtgcccctttatttcgattttctgccagggcaaggccgagatcgtgcaacgcgtgctggaggtgcagagcctgccgggggcgctgcccgcacaactcgtcaggcccaagcatggtgaggactgtgtgatgagggccggtactcgagatgagggtcctaggggaaggcatgtcctttgcatgggaggtattatgcagagccgctttgctgcagtatactctgagattgcacttgtgcgtgtcagcccatgggcccaaggtcctttcnnnnnnnnnnttccttcgcatgggaggtattatgtagagccgctttgctgcagcatattctaa

SEQ ID NO: 3933 - DNA, 225 bp, Chlorella protothecoides
atggcgatagacagggtgggggcggtggtcatagcgacgaggcagggaggcaacgttgtgtacgagcgcttctatggaccgttcagtgagccggagaagggggagctgcgagaggccatgcaccaagccaccgcccaccagccgcccgacagtgctgacgaggcccttggccagtacaggtggggagcaaaagggggagggattgccggtcaatctcaatgttga

SEQ ID NO: 3934 - DNA, 1026 bp, Chlorella protothecoides
atgcgcggagcctggaccgtggtcaccgcaaccctcgtctcacaatgcatcggagcggcagctttgggtcaatcgcatgtgataaaggaagccttggagtactactgtggcccttccgggaattgcccgctgcgtctgcagtccggtcccgtggttattcggagggtgttggagggcagcggtgcacacaggagtctcgtggtatccgtaccagtcaccgccgtgcacgacacaaagcgactcctgctgctccagcctcttcctgccgagatcttcgctgatgtctaccagctgcagtctgcggccgcggtgggggaggtcccccccaccctcctgcatggacgggtcgacgtcgagaacatcaccctctgggccgaccccactgtgctggcagtggagctgcagctcgctgcacaggtaggagaagccgctttggcgaatgaggggctgggcgaggggttggctgtactggctgtttggcaaggactgttgaaaagggatgccacaaggtgccctggggtgccacccaacagccttgctttgcaagtgtctggccacacctttgtccccaatccagcatcagcaaccgactgcacgccaaccccttgccacctccctcaaggagactgccagggaggagctcctcgccagggtcccgctgcatgcacggtaccctctcctgctcagggagctgccctggtggcgcagcatgcacgccgcggtcgagctcccgcctccccagctcctgctggtaccccgagctgcagcgcagtcgcggcgggcttcggcagaggaggtcccggccgtcttgacagacagcgctccgctgatctggcgcatgccggccggcaatcaggcggcaagggaacccatcacctgggcttcggctgcagccgtcgtcttggccaccagcttcctgctgtggacggccgccaccagttgatacccacgtacatcttgacgcctgtcgtgacccgctctggacctggggctctcttacccagccccctctttctgtccctctga

SEQ ID NO: 3935 - DNA, 1029 bp, Chlorella protothecoides
atgctctccccgtcgtacctgcagaaggtgcaggcgatcgctcgacggtacctggatgccatgcggtcaagggtaccacagtctaggaagaacgtgacccacatcgtggacaagatgctgttcaactcatggtgtacgaggagctcatgtcttgaacaacaaaatgggacctcattgccttgtaatgttcaaactgctctcctctctaatatctccttctccaacttgattcgattccttgcacccccaggaacctgggcttcatctccatgctcttccccaacgcctgcatcgtgcacgtggagcgccaccccgccgacaccgtcctctcctgcttcgcccagtcctttgaacggcgcggcatcctctgggctaataacctcaccctctatggctcctgcttggagagactctgtgcaaccagcctccatcggcgctgcactgccagctctggtgcccagagaggctggtcccttggcttggcgccttcccggtcccaagctctgttcctctctttcaacctccctccctccttcccccctccctccactgcgcaacgcaggcatcgtggaccagcacatccagacccagagggtgatggccctatgggagcgggtgctcccccccggccgcgtgtaccgcctgcggtacgaggacgtggtgcgggacggcgaggtggcgtcgcgcggcctcctgcgcgcctgcggcctggcctgggacccggccgtgctgggcttccacgccagccagggacgcagcgtggccacggccagcgcgctgcaggtgcgacagccgctgcacgcccgcgccgtgggcgcttggcgccgcttcgcaccctggctggcgcccgcgctgcgcccgctgcgtcacgacatcgcggcgtacgaggccgcggcagggctgccatccggcgcgccgctccttgacgacgaggtttggggtggcggggcggtccagaacgagcaagcagacgccagcgccgcccgcgacgagcaagcagacgccagcgccgcccgcgacgagctgtga

SEQ ID NO: 3936 - DNA, 1206 bp, Chlorella protothecoides
  modified_base (433)..(442): a, c, t, g, unknown or other
  modified_base (977)..(986): a, c, t, g, unknown or other
atgcctccactcattcgagtacttgaacccctgaacagacccccgtccacccccccaccaccccctattccatgctgcagtcagagcgacggtaaggcgctagtgtggggggcgccgccccaggccatacgcgcccagtaccgcaccggcgacgggcgtaccaagacctcgctgctgctggtttcaggctggtggggcctggcccgccacttccactacctgccggagctggttgcggccgccatctggagcatgcccgccttccatgtcgccatcatgccatttgtatacctcgcattcctcaccatcctcctgctggatcgggcatacaggtggggcggggctcacgggagcgcgtggcgctgctccttacccctttcagggtgggaagacgtcctgccgcagcatagtctctcctcggcgtccatgttcnnnnnnnnnncttcgccatcatgccatttgtatacctcgcgttcctcaccatcctcctgctggaccgggcatacaggtggggcggggctcaagggagcgcgtggcgctgctcctcacccctttcagggtgggaagacgtcctgccacagcatagtctctcctcggcgtccatgttctggccacgtgggcaatgcagccatcgtgcccctgccagtaccagctgctgcattgaccccaccgcattggcgcatcacttccacagcgtcaagccagccgatttctactcaatcaacactccctgaccctcacagggatgacgcgagatgctctgccaagtacggcaaatactgggaccaatactgccagcgtgtgagtgggtgggaggaacaggcatggttggtgtcctgcgtgggacaggaggttggtagactgctgacagggcgcctgccgacaggtgctgctcaatgtccaagagcctctcgccaattccattgctcccatcttcctgtacctcgccaggttccataccgagtagtgccataccnnnnnnnnnngtactgccagcgtgtgctgctcgatgtccaagagcctctcgcccatcccattgctccatctccctgtaccttgccaggttccataccgagtagtgccatacctcttctagaaatactgtacctcttccctgcaagaagaaggggagggggccaggctgcactccatgtcccctcccccacaacaaccctgctccaagcagctcactcaagaatctactag

SEQ ID NO: 3937 - DNA, 1956 bp, Chlorella protothecoides
  modified_base (1788)..(1797): a, c, t, g, unknown or other
  modified_base (1897)..(1906): a, c, t, g, unknown or other
atgcaaggaagccctgtggcttgcccacgctgcaatagaccaatcccgcgcccagcgcctggcgggcctcttcacgatctagactttcgacgcataattccatgcattccgaaggtcagatgtaatataacgtgcacttgcaggttattctggagcacacttggcgtcagacttctgtgtaaaggtcttctcacaccacccgacaacaaccggacgtacacaatggacacaccgatctgcgagggctcgacgccggcacctccgccaatcactgtacactgctggtcggggccgcgttgtgtcagtactgccctcatcaacgatcgatccgccacacaggtggttgacgagccgctttatgcgtcttacctcgccagaactggcgcagaacgcccctacagggacctggtaatgccgggagtgctgctgtgggtggtgctgaacgctcaatcgacttcagcggctgaggtaatccagagcctcaacgagccccatgcagggaagttctcatttgcaaagcacatggctaagcataggctggatattccgctcactgcctttgggcctgcctctaagcacatgctgcttgtgaggcacggtttggggatgatgcgggcagaatctcgaccctgtcgaccagacatcctctgcttctaccctgtagccgtgctgtgccaagcgcccacttgccatagccggtggccccctcaccctctccatgacagacatccgctcgccgtcatacgctcgttctccaaggttctgccggccaccctggaggagacgtgctaccccgcattgctgagcctggccagcgagctccgaaccagtagcagcaggcttgcctgcgcgagagaccatgcgtgggcgactcagggtgagggccagaatccgtggaccctcctgccgtcccggaatgcatccccgactccacacgcactcgcgccgtcccctcccgctccatcccagcacacatcagactcgcgtccccgccatcctcccctctctgcatccccacaccgcagcaggcacggggtgcccatcatcctgtcagaggacctggtgcgggatgcggagggcaccctgagcctgctgtgctgcgcgctgggtatggccccggacccggccatgcttgattgggagcgcggtcaaggggcgtacgccgctggacccgacgctgcggcccctgctggaggagtgccaggcgctgtatgccgtgctgagccggcgcgccctgcggcctcacagcgcgaggcccgggggcggcctgctgtcgctggactctggtgcctgcccggtacaccgaggcggaacgcacgagtatgcgccggacagccggaacgacgacaccctcgtgggcatgcgcgatggggtcacaggtgtgatgtggagttccgggtggggggaaggggggaaggcaagctcgaatgtaaccaggcggttgcaggtggagggagcaggtgggttgatgagtgcatacctctcgcagcgtcacacctctgttcccctgacccagccccgacagcaccctgcaggcagcttcgacctggtgtggcgcccggccgcaacggtctccgtgctggagtctggcttcctcctgggcgacggggtgtgggagggcctgcgcctgctcaacggggtggtgctgtttgcggacaggcatctggcacggctgttcgagggagcggcagggatcggcatgtccatcgagcgataccctcccagctactggtgacgctccttccattcattgaacacgcattcaaatctcacaccggccacgggatnnnnnnnnnntcggttgccggacttgaacagagcgatacccttccagctactggtgacgctccttccattcatggaacacgcattcaaacctcacaccggccacggggcnnnnnnnnnngcctgaagcccacggtgtgcacttggagccgtgcggatcccgcggggtga

SEQ ID NO: 3938 - DNA, 972 bp, Chlorella protothecoides
  modified_base (384)..(393): a, c, t, g, unknown or other
  modified_base (755)..(764): a, c, t, g, unknown or other
atggctggatcatctcttagtcggtatacgagcccgccaatgctcctgtctcacccacggcaccacacgtctcgccactcgcacaaaggtgtgccggaggagttcaacgacttcctgcccaaggactgcgacgagtacaagaagctgaaggcagcacagcagagtgcagccgagagcgggctggaggagctgacgcttcagtccctgccagcgggtccccctgctgccaagcagttaccagggaacaaggggaagaagaagaaggggaaaccagaggcgcatcaattactcgagtggccagcgtggcccctcaagcgacctgcggcagcatggccgagtaccaacatgcaagtcaaaccctcccggagaatatttgtggccacnnnnnnnnnngtgactgggaagggaggcgcatcaatcaactcgagtgggccagtgtggcccctcaagcgacctgctgcagcatggctgagtaccaacatgcaagccaaaccctcccggagaatatttgtggccacctgttgctcagccagtgccggccatgccaacaatccaccccaggttgtgttggagcgcaacacccgcaacaagaagaagtgtgtgacgacgatctccggtctggatctctttggcgtgaagctggccgaggcctccaagatctttggcaagaaatttgccagcggggcttccatcgtaaaaaacgccgagggcaaggagcagattgacattcagggagatttcgtggaccctgcggnnnnnnnnnngtttgccagcggggcttccatcgtgaaaaacgccgagggcaaggagcagatcgacattcagggagatttcgtggaccctgcggtggacctcatcctcaagcagttcaagtccatcaagaagtctgacctggccctggtggagaacaagaagaaggcgccatactttgacgaggaagacagcgaggatgaggacgagctcttcgactag

SEQ ID NO: 3939 - DNA, 765 bp, Chlorella protothecoides
  modified_base (375)..(384): a, c, t, g, unknown or other
atgtccatgatgaatgccatcgcagggctgggcactcaggtcatcatgggcagcggcaccaacctgcacacgtcagggcacgcctacaggtgcgctgaagtgctgtgcacatggcttggatgcctgtataggagtgcgtgttcaagggagccaacctatgcccttgtgcatggcagtggcctcaatcaacccccatttcccatcacccgccccgccaccgccagggatgagctggaggaggttttgcgactgatcaagccccagcactttttgcccgtccacggcgagggaaaacgcgatgccatccttggatggccagggccccgcgctgatgtctggcttgttcctgccgctaattcctaccgccccaccatnnnnnnnnnnccagggccccgcgctgatgtctggcttgtttctgccgccaattcctaccgccgcaccacactatcctcaccccaatctccaagccttccgaaccctcacgtgcgttcgcagctggcgcgggacaacggcatccagcacactctggtggtcagaaatgggcagatggtgggcgtgggggaccggcgcaaccgcgccgagtacggtacgcccaccagcctctccgtcgtgggtcaggccgcgctgacgaccttttacaacgacggcgacaaggtaggcgggtggggtcttgggcggggtgggaggcgtggatttctcgcccagcataccctgagtggtggtctcgtttggatactaatcttctccaggtatttggcgccctga

SEQ ID NO: 3940 - DNA, 729 bp, Chlorella protothecoides
atgcacgcggtgaccaccagcgggatggcagcctccgaaggcctcgcgcgggccactgtggtggtggaggctgcatccgtggctgctgcctgcaccaagtgggccacatcgcatggcacgggagaccgctccaccttctgtgccgtcagcgggcgggcgggggtgctcgtgcaccgtgccggcacctggggcatcctcaccctcttccccctgtttgccgtttacgcggtcgggccagctgggcccgccctggaggctagccaacagtactgcccagcccagtgcggtgcccccccttctcacaggtggtacatcaacgagcactgcgacggctccctcctcggtttcctgggccgtctggaagcggggggctgggccttcctggtggaggcctaccccagccccagctgggcggcggtgcgctacatcctcggctttggcctgctccagggtgtgctccaggtctggctgccaggtccggtgcaccgcggccccaccacaccgcgcggcaatgtgcccacctacaccgccaatggcgtgcccacgctggcgaccaccctgctcatcttccttgccacgtggcgggcaggcctgtttgacccgggcgcggtctacgactgcatgggctccatcgtctccacctccaacatcatgtccctcatcctctgcaccctgctctacctcaaggcaaacgatttttcttttgtggggggcggatggcaggggtga

SEQ ID NO: 3941 - DNA, 684 bp, Chlorella protothecoides
atgttggatgccgactggtttggaacgtgtgatcacctggcctctttggcaagcctgctccctgctgatacgcccactccaggccagctgaacctggtggacctggcggggagcgagcgcttgtcacgctccggcgtcgagggcaagggcgtcaaggagacgcaggccatcaacaagtcgctcagcgccctaggtgaggcgggaggatggagttggcaggaggaggaggagtggggatccggtgtaccagatgcttcatggcttgggggctccagggagcagggaggcacccctgacccaacgcacaccctccagcctgcctggtgcatgcggctgtccagcatgcagaagggcgcgaggacaccacaccgggcgcccccgtctgccttgttcaacaccacacacccccaaaaaaacctcacaacactccatgccgccggcacaggcgacgtcatcgcggcgctggtgaacaaggacacccacgtgccgtaccgcaactcccgcctgacccacctgctccagggctgcctgggcggcgcctccggcaaggcactcatgctcgtgcacgtcgcccctgagcccggcagcgcccaggagacactgtgctcgctgcgctttgccgccaaggtcggggcggtggaggtgggcaccgcgcggcgccaggtggcggccgcccccacgtga

SEQ ID NO: 3942 - DNA, 483 bp, Chlorella protothecoides
atgcggccacgcccctggatgctctgtgcatgtatcctggctgccctgctgtggcaagcagggtgccagttggacagcgcggcgccagacggccgcagccgcgtgccgcgcgccgccgagctgtaccgcgccgtggctcgcgccaccgacgacgacgccgggcgcgcggtggtgctgggcaacctgggcgcgctgctgctgggcgcggaggacgccgagggggcgcgggcggcgctcaccgagtcccaggccctgtgccgcggcctgctcgatgggggggcgtcccggcccgtgaccctggaggagcagtgcacggggaacgagttcaacctggccaagctgctgcagacactgggcgacgctgaaggggcagaggccgtcctccgctcgcgcctgctcacccgcgccgccctcgagcgcacgccggccctgtatgccaaggtgaggggcgggcggtgggcgtgtcacctgcttgttgtgtaa

SEQ ID NO: 3943 - DNA, 648 bp, Chlorella protothecoides
atgaaccccttcccccctctttccccgcgccagggccggctggcgccctccagcaccgactccggcaccacaggctccctgctctacgacttttactggggcatggagctgtacccgcgcatcggcgcctttgacatcaaggtctggaccaactgccgcatgggcatgatgggctggagcgtgatcacgctgtgctacgcggtgaagcaggcccagctctacggcgcgcccgctacctccatgctcctgtcggtggccctggtccaggtctacatcttcaagttcttcctgtgggagacagggtactggtccagcatggacatcgcacacgaccgcgccggcttctacctttgctggggctgcctggtctggatccccgccgtctacacctccccggccatgtatcttgtgcgccggcccgtgaacctgccgctgtctttgaccctggtcctggggttcctagggctggccgccatctacatcaactacgactcggaccgccagcgccaggagttccgggtcctggagccacatttggaagaggggcaggagcacaatgtatatgcacgcccgccgcagcgggggacaggggaaagagacgcggtgcaaggtttgtgccgatgtgttggcctgaaccaggagctatga

SEQ ID NO: 3944 - DNA, 504 bp, Chlorella protothecoides
atgcatccccttctcaccctgggcccccccccaattaaatcatcacccccaggttcggagctccaggtgacgcacgccgccgcctcaggggccgtccccgccacccacaccttctcctacgaccgtgtgtttggcccggcggcccggcaggaggccgtcttccaggagatcagccagctggtgcagagcgcgctggacggctacaacatctgcatcttcgcctacggccagacggggtcgggcaagacgcacaccatgctggggcgggcgggggaggagggcattgttccccgcgccatgcgccagctgtttggcgacggcgaggcgctggcgcgccggggctggcgctttgccatggccgtgtcggtggtggagatctacaacgaggagctgcgggacctgctgggggccaggctgcccccgggcaagaagcacacgggtagggacgaggggcatggggatgagggaggggtgaaagggggaggggtgaaccctggggattga

SEQ ID NO: 3945 - DNA, 1101 bp, Chlorella protothecoides
  modified_base (769)..(778): a, c, t, g, unknown or other
atggcacgctgtcggaagggtgcatcatcacttgccatggccgtgaaggccccccggggaggtgctgggcatcaggccaacagggccacccaagtgaccagttccgcacgcccagcacgacacgtacccaccgcggaattccgctgtatgagagcgcgaggtgaatgccggcacacgctccaacacgcaattgctcttcaagaattcatgtccaggccctcattcaaggtgccacgccctcactgtctgcaaagtggctgtggccatcgcctctcaacttccgtgagacattctggtagagaggcctggctcgcagattcgcttaggaccatacctagacggtgtcgggggtgctcatcacgacactggcctgagcagggccgtggaagctcggcgcgggtgggtgcaactccttcgggccgggagtcatgcagggcggagagtccctccccggcacttccagggccggggggctgcccccgctcgcagtcctccgctcaccccccctcctcgcgccagacactgcctgcggcaagtgtggccctggcctacccggatgccctccctgccaagagggtgggagggcatgcctggaaggtctggctcgtgtgtggcgactgtttcctcataggtacgtttgggactctgcggagaccaggatgtcctagggactgtgtcctggcaggctgtgcctgcagattcatgagcagagatttccctgagacgcagctgtgctgtgttgatcgtcatccttgggcccccccccccnnnnnnnnnnagagcagagatttccctgagaggcagctgtgctgtgttgatcgtcatccttgcccccccccccccattttaggcctcgctccagtactggtccacctgtccaaggacgccgacggctcctacggattcaaccccattgccgtgaacctgctggtggaggtggtgaagaccctctttgcgctgggcaccctcatcgcatacgtgagctcctccgcgtgcctgggtggtgggggcagtgtgcgtgtgtttgatcttgtcatgccccagcaagggtgcatgctgcgcagtgtagggctcttgaagtggagcggccatgggaaatga

SEQ ID NO: 3946 - DNA, 1497 bp, Chlorella protothecoides
  modified_base (302)..(311): a, c, t, g, unknown or other
  modified_base (1235)..(1244): a, c, t, g, unknown or other
atgcctcttcgcattctttccgcgctcgacgcgtcaggcgtcgtgcgcccgaggcacgcagggcggcgctctgggtcgacccagctgtggggccggtgccactggtccagtattttccagcacagcctccttgagtacttgcacattcagatcaggctgaacgatttttcctgccaccatggggaggccaagggatcccaccatcgtgaaggaggaggaagtcaagcacgcaacagcataaggctgtgtgctattgcctgtaccgactggagtccgacaggcggtggggggtgtcctgaggnnnnnnnnnnaggagatgcggtggggggtgtcctgaggaaggatgaaggacaggtggggccagctgccgtgcttcatgctgattctccactcccaacctcatatccctgcagtttcaacccgcctgcccggcaaggtcacccacgcgcccaggaacccgcgccactgcttaagggatacccaaattgcatagtgtgtttggtaaaactaatggttatgttgggattaaacgttcatccgcgcgctcaggcagcttcgcgaggtggcaacccctcgcaggagctgtccggcaacagccgcccccttgtcctccagcatcgcagtagcgggagccagacgcgcggggcgagggagcaccaacgtggaactcccaccatgcaaaaaccctccaggagacaccagcgcgtgagcgcccaggtttcccagcccctcgccccctcgacctcccacgatccgtatgagcggctcatgcaggatgctgaggcctttctgtggaaggatcttgaacacctctttgacgaccaagggatcgacagctcccgttatgaagaggctgtgaacttttcagacccgatctccaaattctcctccctgcgagggccaaggcacccccctctccccgcgcctcgccaccagaccatgctcaccgctacccccaccccaggctacctggcgaacatttccttcctgcggatcgcgctgagtcccaagttccacttgcacgacatcaggaggactggaccccttgagcttaccacccgatggacgatggacatggagttgtctttcaatcggtggcctgcgtactattatgttgcctgggtcgtcaccctactccctcatgcatgcatcgcacgaggtgcctctgacgctcctctgtattcactacctccccaggttcaaccccctcaagccctggtacgacccaaagccgnnnnnnnnnnttccttccatctccccagcctgcgtaccatcctgttgcctaggtcgtcaccctactccctcatgcatgcattgcacgaggtgcctctgacgctcctctgtactccctacctccacaggttcaatcccctcaagccctggtacgacccaaagccggtctttacgggcacctctatcatgacagtgaaccctgacaccggtgagggggccaagatggggttgaatgtgtcgcagatgggccgcagctcagcctga

SEQ ID NO: 3947 - DNA, 1248 bp, Chlorella protothecoides
  modified_base (324)..(333): a, c, t, g, unknown or other
  modified_base (973)..(982): a, c, t, g, unknown or other
  modified_base (1144)..(1153): a, c, t, g, unknown or other
gaggcggcgggggcgggcgaggcggcgggagtgagcgaggcggcgggcgacgccgcccccccggacgacgtggtcctcttcgtgggcgtcctatccaagggcgcggagcaagcgcggcgcgacgcgatccgagccacctggggctcccaccccgcgctgcacgccgtccgcttctttctcgccgcgccggccgatccggccacgctgcagcaggtgtgtgtggcacgtggggcctgcggggcacggcagggcccgggatggggaggcccaaggcgagtgtggtctttgctgcttttctgtgaagaagcacaaaaccaaaataannnnnnnnnncgctgcagcaggtgtgtgtggcacgtgggggctgcggggcacggcagggcccgggatggtgaggcccaaggcgaatgtggtctttgctgctgttctgtgaagaaacacaaagccagaatattcctccgccccgcctgctttccccacactctggcactcccctccccccctcctccctctcttcaggtggaggccgaggccgcgcgccacggcgatgtgaccctcctccgcgacgtcgccgagtcctacttcaacatcacgcaccaaacgctggcggccttgcgcgccgcggcccacgaccgggcggccacgcacgtgctcaaggccgacgacgactcctacgtgcgcgtggcgccgctgctggaccgcatccgtgccgcgcccgccgaacgcctcttcctgggcttcgtggagaggccaggcggcggcccgcaccgtgatccccactcccgctggcacgtcacgcctgaggagtggcccggcgatcgctacccaccctgggcgcacggcgcgggctacgtgctcagcgccgacctggcgcgcggcgtcgagcgcctcgtgcgcccgcccctgttcaagctggaggacgtggcggtgggggagtgggtggagcgcgtggcagcggacgagggcggggtgnnnnnnnnnnttggatggtgggagggcgggggatggggtgtaatgcagaagaatagatggggggcggtggctgtatgtgcacggcctggctgcacccggcggggcttgcaggatctcccatgtatgacggaagcgtggccacatcctgtgcctcgtcacagtgaatacacannnnnnnnnnggacgtggcggtgggggagtgggtggagcgtgtcgcagcggacgagggcggagttatcaactacgagcgagacgagaggtgaggggccgcggtga

SEQ ID NO: 3948 - DNA, 543 bp, Chlorella protothecoides
atgggcgcaggcctcatggcaacgtgcatgacgcgctcctctgggccgcatatcctctgcatgccatccctgacccgcatcccacgccagggcgaggatgggagggacctgccgcaggcatcggacgagtccattcgcgtgacgggcagccctccccagatccagggggtggccaccttttccggcgcagccaaccagactctggcggcggccaaggctgccgagctgaggaatatcctgcgagaagacggccataccccggctgacgcgacctcgtggcagctcgcgcagtacaactcccctctcgtgccggggttcctgcgcaggaatgaggtccagggtgtggccaccttttccggcgtggccaaccagactctggcggcggctaaggctgccgagctgaggaacaacctgcgaggggacggccataccccggctgacgcaacttcgtggcagctcgcacagtacaactcccctctcgtgcccgggttcctgcgcaggaatgaggtgctgatacccctgagcgactacaaactctggtag

SEQ ID NO: 3949 - DNA, 495 bp, Chlorella protothecoides
atgagctcttgccagccacctacgtgcccatccccatcccatgcagggaaattcgtttcccacatagatacctgggacgcggtgagcaaccagtcctacctctcgctcgaggccgtgcggcacctcgccagccaggtgggcggattccccagccagcctgctgcaccctcgtccctccctgctccccaacctccccaggtgctgacgctgcgccagaccccccaggatctgaccacgcccagctacctggtcctgaagaagactccgcggtacgaggttcgacagtacgagggctttacggggcttgagacacgggcaggcgaggcccagggccaggccttccagaggctggcggggtacctgggcgggaagaacagccagggcaggaagctggccatgaccacacccgtgctcacggatgacaagggcggcatgcgattcgtcgtgggcgcagacgaggctgtgagtgggggcaaggaggtggggacgccttga

SEQ ID NO: 3950 - DNA, 546 bp, Chlorella protothecoides
cccgaggccgcggagccgagcgccgccgacagcggcgaggaggccgcagcggatgcgccggcgccggacgacacccctccagcgccggccgtttcggaggcccgggacgggtctgaggccggcgcgcccggcgccgcggaggcccaggccttccagggccgcctgcacaggcactggcagcaccggctggaccacggcgaggccgcgcaggccgccatgcgggaggagtacgtggaggccggcgtgacccagttcatcgaggatgccatcgtcaagcatgaggacaataagtggggcaacaaggtgggctgtgacacggcgctctccgccaagctgtttgtggcgcgggagtttgtggagaagcacatccgtaacaagcacgcgcacgtgctgcaggcggagcgagagcgcctccaggacatcgtttactgggagaacttccagtgcgtgtgggaggagggacaggggagttgcccgggatgcccaggggggtggcctgccgtggcgtccgtggggcccacatggcacggaggggagtacagctga

SEQ ID NO: 3951 - DNA, 960 bp, Chlorella protothecoides
atgtgggaccatgccagtgggcgctcccgtgggtatggattcgtgtcttttgcaaccaaggctcaggccgaggccgccatccagtgccactgggcgccctgctggcttgcctccctggaagaccgccttcgtcccaggcggcccttctcacttgaacaccacgcaccaaggaaagcatggccatctccgcagggccagcacgggcagaccatcggctcgcggcgcgtgcgctgcggctgggcgcagcacaaggtgggggagagcgcggcgccggtggacgcggctgtgctggaccgctccgaccccaccaacaccaatgtgtatgtgggcaacctggacgtggcgctgaccgactccgagatccggcgccacttcagcagctttggcgcgctggcagagatgaagctgcatcgcaagggcgcatacggcttcgtgcggttccgctcccacgccgacgccgtacgcgccatcgtcggctccaacgcccagccgctgggcagcaaggtgctcaagtgctcctggggacggcaccccagcctgcccccctccggcctgcactcccacctgctgctggccacgggcgcggggctgaacccaatgctgcccctggccctgtcggcccccgccccaggcatggtgtccggtgggctgggctccggcctggtcaaccccatgctgccggcgctgccgccggccatgaaccactccctgctcccgccctaccagccccccgtggtacactacggggggctgggcgggctggacggtgagggctccacccagcgcatgctgggcctgcagggggagggcgccggcgccccgggcggcggcatgcccctgggacccgaccccagccgcgagggcggcgggggggcaggacagccctacgccggcggcggccagcccggcccctccctcggcgctcccggcgcctacaacccaatgtttttctatagttga

SEQ ID NO: 3952 - DNA, 357 bp, Chlorella protothecoides
atgacgaccattcaggcagctcgccccgccggcaagctggctgatggtcacgaacagcctgcacctgtgtttcagccgatccatttcctgtacacataccttcacgaggcgatccgacacgagctcgcgctgctctcccagagcctgcagctcctgctggcggggacatccacgggctggccggaacttcgacgccgctacatcttcctccgggatgtgtacaagtaccacagcgccgctgaggacgaggtatgtgcgctctgcctggacggggaacgggcagcagcgcctgtgcgacacgggaagaggacgtgcgtgcgcacgacgacaacccgctcccacgacgcactcaggtga

SEQ ID NO: 3953 - DNA, 768 bp, Chlorella protothecoides
  modified_base (751)..(760): a, c, t, g, unknown or other
atggacacgcacaaacgtcgagttgggcagtcgtccttgttgtcggctgtgctggctgccggccctgagctgcagagggtgaagctcgcccgagcaaatgggatatccctgcccgacccggcgtcaaggcgtgacgctgcgcatggtgatgctgcactttgtatgcaagatgatccatctaaagcattgcagcaaggggcccctggcagcacgctgtgtctgcccgccacatcattctatgccaagagcaagctggatgctgtggaggaacgaatcctgcgctttctgacgagggtccatgtcagacacaagcaacccgaggccgtggaagccgaaatctggcacgtgtttccgacgcagcaagccgcctttgattgcgcggatggtctcaacgaacagcggggctcgccgcttgagaggaccagtctcctctcctcttgtcactgcaacagggtgtggtccatggagaccagcggagatgggaaacgtcgcttcctggtcagcactgtcacgaacttctacaggcgatactctgatatgctgccccaccaccgccactactatgaaataatcagggagggccagccctgccacatatactttggtgagctgggaagtggagaagaggagtttgagtcttccagaaacgccattgatggtccgttgtccctgccatcagcgcctccgtggcaagaacaatccagaagtcaacaaatacccaacatccctgaaccctttatgctgcttccannnnnnnnnngccattga

SEQ ID NO: 3954 - DNA, 936 bp, Chlorella protothecoides
atggcaggtgaggcatcttcgtgcgggcttgtcatcccagctgaaggacgcaccaccggatcgcttgcccttgtcttcaaaacccaccctttcgaacgcatcccagagctggtgaagaccaaagggtacccactggaggagcatttcgtcacgacctccgatggctacgtcctgggcacctaccgcatcccacacggccgcgagggcgcctcgccaggtcccaccccttgccgaccggtgctcctgcagcacggcctgctggactccagcgccacctgggtgctgaacgacccggaccagagcctggccctcatcctggcggacgcggggtgggacgtttggctggggaacagccgggggaatgcgtacagccgcaaccacaccggcctggcccccgacaccgccgccttctgggacttttccttcgacgacatggccgccgccgacctccccgccctgacggcccacgtacagggagtgacaggctgcgccacgctggcctacgtggggcactcccaggggaccacggtggctttggccgcgctgagcacgcagggtgcgctgcgtgccgcgctgcgccccgtcgtcctcctagcgcccgccatctcgctgcgccacatccagagcatccccatgctcacccttgcccgcctccaggctgaccaggtgattgtgcgggggggcggtaccttgtgtgatgggaaagaccatctctctgccaactgtcacttctcagcatgtgatccaggggccctgcctgcacaggcgagcttccccctttgcacagactcgcaccgtcagtgcccactccccaccccccttcatagttctttgccatgctgggcgtgtttgagttcatgcccagccgggaggccaccgccgcgctgttcgaggagctgtgccaggcaacccccacggcctgcgtgtcggtgctga

SEQ ID NO: 3955 - DNA, 399 bp, Chlorella protothecoides
atgtacgactggggcggctcctgcgtttcgcccctgggccggccgcagacctgcaaccggagggtttacggcagggagcagccgcccacctacgatctggcccggctggagggggtgccgctggcggtggtctggggtggtgaggacaagctggcggaccctctggacgtgaggcgtctgctgtacgtcctgccccaggcctccctgaagctggcagtggtgagatggggcggagtgggtaacctgcaaatgttcacgctggcttcactactgccattgaagccaagcgcgcctgccagggagcctgaacccactccctacattcccctcgcaggcgacaccgccaaggacagggtgtacccccttgtcctgcgcatgctgctcgaatgggccgagtga

SEQ ID NO: 3956 - DNA, 750 bp, Chlorella protothecoides
  modified_base (131)..(140): a, c, t, g, unknown or other
atgcgcggctcgaaggcgcgctcatcggaccgctggcggtgtcgtagcgcaggtttggtccagagttgcccaccaaccgcgtgctcaagaagatgttgtatcgagatggtccaccacgcaggcgatgcctnnnnnnnnnncgactccagtaacccatcgagggaatacccacagcattctgatgcggatcagatgatcacatctattctaagggctcaggcttcccacctgcatctcccaatttcaacccgactgatcctccctgcgcaggccaagaaacaggcatctgatgccgatttgatggcgcttgtcaaacagctgcgggctgagaacagtgctctgcgtgtgcagctggcacgggctgggctcctgccttcaggtggcaagcgcgcgcaggatgcctctgcgcccgccccaccgagcccccaggcacgagccctggcgtctccaagacggaaaagggaggacccggacccccaccagtccaaaggcaaatccctgcccagcctcgcagagctcgaggccggcatcgtctggccacaggggcgggaggacaggttctgggagcgcccgccacgcaaggccccgctgtccctgccaggcccgccggggaaggagggcccccctgcgacggccgccgagcccctcaccatcatccacatcgccgccgagatggcgcccattgccaaggtgggtgggggtgcggcgactgccattgctgaatctgtgacgcagggtatcatccaatga

SEQ ID NO: 3957 - DNA, 861 bp, Chlorella protothecoides
  modified_base (567)..(576): a, c, t, g, unknown or other
  modified_base (666)..(675): a, c, t, g, unknown or other
  modified_base (732)..(783): a, c, t, g, unknown or other
atgatcatcccctgtgtcaaacatgccgggcaccctgaccccggttcgccccgccacccatccacttgcactggggtgcaggtgggaggcctggcggatgtggtcaccgggctgtccaaggccaccgcagctcgtgggcactctgtggaagtggtgctgccctattacgcgttcctggagggctccccagacgtgagggatgcccgctcggtcggggtgtttaatgtgcccaaggaacatgctggtgaaagctctgtctgcttagcatgggggggcaacggcctggcgaggtgcgaggccttcactgccacggtggaggggtgcagggtgctgctgctgcgccccgtcgaccaggggagcctgttccagggccagagcgtgtacggcggcgcctacaacgagacagaggcctacctgcactttagcaggtctgacaagacactcgggtgtctcgcatggcagtgtgcaggcaaaggaggagcagggtgccaggcgtgcggcatggcaatgcttatgatgccaccctgtgtcgtgaagaggcccacgacatcaaccccttcccccccnnnnnnnnnnaaggcgggcggcatggcaatgcttatggtgccacgctatgtcggaaagaggcccacgacatcaaccccttccccaccccccccccctgannnnnnnnnnagggggggggaagtgcctcaatactccaggtctgacaagacactcgggtgtctcgcnnnnnnnnnnnnnnnnnnnnnnnnnnnnnnnnnnnnnnnnnnnnnnnnnnnnagtgcccatgctgttctgggaggcctactccgcgaccctgccccgcacgcgcctggtgctcaccatccacaactttga

SEQ ID NO: 3958 - DNA, 1164 bp, Chlorella protothecoides
  modified_base (735)..(744): a, c, t, g, unknown or other
atggcacctgccatctcattgaatagtcccatcgccatccttacttacagcggcgctctgccccgccgtgtcacggctggtggacgagaacgtccaagtcctcctgcgcgagaatgcccatcctcgcgttcccacaccaggtatggagagaaggtcaggctgatgaacagtggtcagccagacgcttacgaggagctctttgcctacgcctgccccaagtttgtttcccggcgcttcgtcgacccagccaatcctcagtgccttgcttgtcctcttgcaactggagtttcttctcatggcagtgctggccttttgctttggaagttggtgaccagggctaacacaagaatgtcagcagctcaactgcccttcaacctgatccccttcttttccctccatgcgccctcttcttcctgcttcccacagggcaatgccaacatggaggcgtacaagccgcagctcaaccagttcctgctggggttgggggaaagggatgaagcaaggagaagcttgcgacatgggcgagtggcacccaggaagggagcattgacgtgtgcaaggaaagatttgcttgcatctgtccttgccaatttggaaggggaaaaggaggcccttgggcccggcccatcctggagctgcagccatggatgcactggaggactgcgacgaggcctggctgcgttctcatcttccctctgccaatctcacccacccccacccaaactgcacctaaannnnnnnnnnttctcatcttccctctgccaatctcacccaacccccaccccaactgcaccttacagcacctccctctcacacacacagagcatcacgctgtccaagctggcgagcctggctgaactggacgaggccagcctgcgcgcgcagctggcgctgatgcatgccagcacccaggtggtgacatggaacggcggcgacgcgctggcggggacgccccagcccgcgggcgacctggactttgcgctggagcggggggaggacgggcaggagatggtggtggtgcaggagtcgcgggcggcgggggcttcgggctccgccttccttgtctcccacatccagaagctgcaggatatcgtgacggagctggagggcatcgtgctggcgccagcgcccggcgcttcggcccccgccgtggccgccaactga

SEQ ID NO: 3959 - DNA, 231 bp, Chlorella protothecoides
atgtccccatcccttcctttcctcagggtaatggcgcaccatcagagaggcccagggtacgaccagatcctgaagaagaacgagcagctgtatgccttgctggccatctcctgtgagtcatggctggtgcacactgggggatcagcgcttgtctcattgaagggccctgtgcgggcattgcaccctctaaagtggtggtctgggtttgtagccacgaagaacgcccgctga

SEQ ID NO: 3960 - DNA, 2025 bp, Chlorella protothecoides
  modified_base (230)..(239): a, c, t, g, unknown or other
  modified_base (303)..(312): a, c, t, g, unknown or other
  modified_base (801)..(810): a, c, t, g, unknown or other
  modified_base (1941)..(1950): a, c, t, g, unknown or other
atggatggatgggacgcagcgatcttacactgccacaccccctcgctccacggctggatcggtaccgggagtttggtaccacgacctgccgcccctgctgtggatcttgagcgcgaggaggcctcagcgggcaatgctgcaggctcgaagcgtaggccaggaagccacaccatggcggacggattcgatgtgagatacagggtgggggtgcctgttgatggtaattgccnnnnnnnnnntgagtggccaatgcgcattggacggctgaactggcccttagaacaagagtggaagggagcagannnnnnnnnngcggacggattcgatgtgagatacagggtgcgggtgcctgtcgatggctctgtcgcgcacggcacccgtgcccaagatggtgcaagactttgtcgtctacttctaccgtcacatcaggtctgtagccaacgcctggtgccagatgtgatccatatacacaccagcgaatcccttgaacagcgttgcatgatatgtgatccgagctgctccatttggactaccttgcatgacacctacgtccaccactgtagtagtctgatcagccagacccctcacccgacctccctcaacagggagcgcaacatccgcgagatcttcgtcatgtactcccacaccttcccccacctgtcggagcgctttttcaagggcgtggcctggcccccggtggaggctgtgagccacctcgtggacaatgaccacgtcttctgcatgcttgcgcccctcgatgcggattcactctcatgctattcggcgccccctcaaacggannnnnnnnnncgattgccagttgacatagtgcgcccctcggtgcggattcactctcatgctattcggtgcaccctcaaacggccacccctcacgcatcgcaccctggcccaggaaatgtgcttccgccacctgcacgccgcggccaagcccacgctggcgcaccgcatcgcctcctgggagaactaccgcgagttcttctcggtcatcctgtccagccacctcaacgtccagcttcccaaccagtggctctgggacatggtggacgagttcgtgtatcagtaccaggcttttgcgcagtatcgcggcaacctgtctggcaagtccattgaggagcttgatgtgctggccgccagccccaaggtctgggactcccagacggtgcttcagatcctcaacgacctggtctcccagtccgacatccgcggaatcctgtcaaagcctggagaccgaggagcctgcatgtatgcactgaagccccttgtgtttcccactagagtctctctcaaccaccgcatgttccaggtggcgctgaggcgctgtggcgccgaggcgctgtatgtgggcgaggggtatgacctgcagtccaacgtgcagaccatgctgggttatttcagtctggtcggcctgctgagggtgcacagcgtgcttggcgactatgtagccggcctgcaggtaggtggcagggtgaacactgcggtttgggccctgtatcatacaaggcgctcgtgccatggcagccctcctagtattgccttgtttggtagcagagaacctccatcaatgccgcccaacccctcggcaggcactggcgcccctcaaccccttcaaccgccggcacctgttcacgacaaagattgccatgtccaacatcacccttttctactactctgattgacaagtccaaagccatcaatcaaagcacacttcgccccccccttccccctcccgacacttcacagcctttgcgtatttgatgctgcaaaggtatctggacgccgccaagtgcctcaacttcatcttgggctacatttccaagtatgtgacaggcttggcggttgcttgtggaagtccactgcccctggctcgttcctcatgtccttgccttcggccgtcgttgccgcatggcttgggaaggtaaannnnnnnnnngcccctggctcgttcctcatgtccttgcctgcggccgtcgttgccgcatggcttgggaaatgtattgagagttag

SEQ ID NO: 3961 - DNA, 1941 bp, Chlorella protothecoides
  modified_base (34)..(43): a, c, t, g, unknown or other
atggtttgctttcaaatcctttcaggccaaggtnnnnnnnnnnagttcctccctcccaccccattcatcctgccgagcatttccttggatggtttgctttcaaatcttttcaggccaaggagttcctcacctgttttctcacacctcacccccgacggtccccaccataccccaccaccaaatcccccgatcccacctgccccccctcctccgcgcaggcagcgtgcggtacctggtgctggacgaggccgaccgcatgctgggcatgggctttgcgccgcagctggaccgcctgcgcggctgcctgcccgccgccgccccgccccaggtctcgctcttcacggccacgctgccagagggcgtggccggcgtggccgcctcttggctgcgcgacccgctgtgcgtctccgccggcccctccgccgcctccatctcgcacagcgtgacccaggtggtgcaggtgtgcgcggaggcgcgcaagcccgccaagctggcgcgccacctggcggccatcgatgccgccgcggggcccgggccgcgcaatcgcccgcgcgtcctgatcttcgccaaccgcctgcgcaccgtgcgcttcctgcacgacctgctggcggggcaggggcggcgcgtcgccatgctgcacggcgaccgcagccaggcggagcgcgacgcggcgctggccgacttccgcgcgggcaaggcccagatcctggtggcctcagatgtcgcggcgcgggggctgcacatccgcaacctgccctacgtcgtcaactacgacttcccggggaacctggagcagtacatccacaggtggcaagacggggggaaggatggtgttttgattggttggagggggagctggcaattatggcgtcacgatgtgatgctcgacgggggaaagcaggaagcactctctctttgtcaacatctatgggggtggatcgtggcaccaagaacaatacaatccagagtgctggcctcccccaccccctaactctcctgtttgagccgccacacaaccaccaggctgcccgttacatataccctgggcttttcctggcaaggtgtttgcggatagtgcaccctcaggaccggctgtcccggctcagtgcgtcacaggaacccgcaagggcgactggtgggacgccggggcctgccgggggacgccaaccgcccccaccaggccccaggggcagccggtccacatactatctctcttcccacccttttgcaatcttagctgcgcgcgcgcagatttctggagccctcgcactttctgcgccaagactccaactgtgcccctctccttgctcatcgtccagggtgggaagaacagggcggctggcgaccgacggccacgccttctccttcttcacgcgggagctggcgccgctggcggccccgctcatcgagctgctggaggcgcacgacgccgacctggaccccaacctgctgctggtggccaaggcgtacgcggtggtcaaggagaagctgggcgaggcagagcggccgcgcagcgaggacgtgctgggggagctggggctgaaggcccgcaagaagaaagggcggcgtgaggctgacgaggttgcgggcggccaggctgggcaggaggcgcacggcggcgaggccgttgccgggcaggggccagtcgagcccgccgcccctgctcctgcttacatcccggccaaggccttcaagggcgccaggcaggggtatgtgtttggcaaccgggcttcgggactgggataccacctggacacagcggcggccccggtgcaaggcaagaggtcttctggcccgcccgccacctcccgacggccggtgggaggcgcggcgccgggcgacgccgaggtcccagtcgaggctgccgtcatgaagcggaagaaagcgctgccggggcgtctgcgcaagaagctggcggcctctgctgcgccagcattatag

SEQ ID NO: 3962 - DNA, 1896 bp, Chlorella protothecoides
atgcggaactccgtcggaattgggtgctcgatatattgcttgcccggtcgacgacgttgctctgggcgccggatgagcaatgggagccatgcaacctgtgcaatatatccagggcctgttgggcagtggctccgttgctctgaccatgtgggacatgagcccttcccgccttttctacagagccggctttgggggttgcatgtgttgacatatgcatgccgcctgagccagatggttgagcctttacctctccgcattggggttgagcccgagcacactcatcggtctgaggcaggcatgggtgtcgactacctcgcgcggaaatccgcgaagaaggatcgcaagagggcagggaaggagggcaaggtgccccgctcccgctcgaggacgggccccaggcgattatgtcgaggagtctgcttccaggagccggtcctccaggccgccgacctggaagaagaggaaaccgggccactggctccctccgcttccgccccccctcccaagcatgagtcgctggagagccggatagccacccagctgacgtccgagccggttcctgccgcgccccgggtcgagacaccgcgccaggcggcccccaagcgccggaagatgtccaccagtgtggccctgcccatgcgtgtggagcacagcgaggcggagcggccgctgccgcaagccgcccagggcgcccccacgccgcccagcgcagcgctggcgcagctgccccccctcttccagcgctatatggcctcgaaagggttcgcggagcccaccccggtgcaggaccagacatgggcgccgctgctggcaggccgcgatgtgcaggccgtggccgagcccggcgctgggaagacgctgacgtttctgctgcctgccgcggcgctgctggagaagggggctgccaaggtccctgctgcgacggcgacggtgctggtcctggagccgacgcgtgagctggcccagcaggtgggcctggtctggaaggacctggcgcgtctgacaggggctcaagccgccgtcatccatggcggcgtacctaagcaagagcatgtgcgtggggagggccttggaggggtggtctttgtgctgggtgcactttcggagacggaggaagatgaggtcaggtgtgggttggtgcggggggggttgggggggcagtggtggaggccctttgcctccgccggcccagagtcccctcccatcaccgcactccccacgccggccagcaccccaccccttctcaaagaactcctggtgatgcacactcccgtggcaagggatgagtctgatgtttatccgcgcttctcagggacagccaccccaccggggggttgcccatgccgatactcctcgcttgcccgcccacacaccttccctgctcctggattctgcgcaggtagccgccatcaaggccaagccccaggtggtcatcgccacgccaggacgcttgttagacctcgtggacagcggggcactgagcctgagagggccaaacaggctttggtggggggggatatctgtgttgacttagatgacagagcctcctgccatgacttttccatgtactttgagattccagcagtccctcattgcccggactctttgcctcccacaattactttgaagcctgctcaggcatcctcaacctggtcgtcatgctctggaccgctgtgtctgaggtcctcgcctttcacttgctcctccatgacaaagctcgcctcacacactttctttcctttgggtccctatccccacctttgcgcccctgcatcgtcggccggtgaagagaaccctgtttactcaagttacggatgtttagggggaggctccacggagccctccccactgcaagcaaacacttttcccgaagctgaggccaccgatgtcctttga

SEQ ID NO: 3963 - DNA, 354 bp, Chlorella protothecoides
atgtacaatgctgagaagaaggggaagaagcaggtgctgatccgcccttcctccaaggtggtcatcaagtttctgcaggtcatgcagaagcacggctacattggcgagttcgagtttgtggacaaccaccgctccggcaagatcgtggtggagctgaacgggcgcctgaacaagtgcggcgtgatctccccccggtatgactttgcagccggcgacatcgagcactgggtggggcgcctgctcccctcccgccagttcgggttctttgtggtgaccacctcccagggcatcttcgaccacgaggaggccaggcgaaagaaggtgggcggcaagctgctcggattcttctactga

SEQ ID NO: 3964 - DNA, 1083 bp, Chlorella protothecoides
  modified_base (46)..(55): a, c, t, g, unknown or other
atgaggcagccgagcccagctccccagcctcattggatgaggaggnnnnnnnnnnactctgtcatcgatgacgggccagagggcagagcgaagggagatgaggcagtcgagcccagctccccagactcattggatgaggagcaggacgcagcaggcagcggtgattctgcctcagatgatgccagcgaggacgaggcaggagcggctgaggcgaatggcggaggggctgtcgatgccgaggaagatgacgaggcggattccgagtctgccggagactcagaggacctcgggagcgagggggaggagtcggagggcagcgaggaccgggcgctagatatttttactccggagcaggcggcgcccctgcgggccctgcgcgtggccgctacgccaaccgccttcctgcaggcctccggcgagctggccgagctggcgcgcctggcggctcgcgcgttgtacgcggtcgcggtatccacctcggtgcaggcgcccgccggcgcgctgccggagctgtacgtcgatggctttgaccctgagcagatctggctccagctggacatgctgggcgccccggccctgaagcgggtgcggcggctgctgaagaagaccagggaggactttgacctgctcaccccggacagcgcagaggccttggacgttgcgggcaatgagtgctgtcgctcttgcgtgcaaagcctttcgcatcagcctttccgttccacctccaccggccttgcagagctgctggggctgactgccggcccatcggatggagaggatgaggccagtgatgaggatggcagtgagggcgctgggcctcacccgagtgaccagctggacctggctgagctggactacggcgccatgctggcgggtgaccagcctggccagacaaggaaagccggcgagggggaggacgcccggcccaagggagggaagtcgacgagccatgcgctggctgccgtggaggacgagtacctgaaactcgacgagatggaggccttcctccaggatgcagagcgcgcagcagccgaggaagatggtgagcgtggaggcatgcgtgcgtgtgcgtgtgtgtgttga

SEQ ID NO: 3965 - DNA, 348 bp, Chlorella protothecoides
atgaccgtgctgccggagctgctgccttactcgctggagatggctaggcgtgggctgactggcgtgatgaactacaccaacccgggcgcgatcagccacaatgagatcctggagctgtacaagcagtacatcgaccccgacttcacctggtccaacttcaccgtggaggagcaggccaaggtcattgtggccccccgctctaacaacctcttggacaccgcccgcatcgagagcgagttccctgagatcctgcccatcaaggagtcgctcatcaagtatgtgtttgagcccaacgccgctcgcaaggccgagtgcttggccgaggtcaaggccatgcgcggccgctga

SEQ ID NO: 3966 - DNA, 1041 bp, Chlorella protothecoides
atggtggacttccccgatgcggccccgcccgcggcgctgaggagcaaggagcagttggacgagctgctggcgcggctgaaccggcgcgggccgcgcgagcgcgtgctgcacggcgcgctgcgcaagcgctacgccgccatcgtggcctgcatggcgcaggcggagggcacggcctacagcctggaggggtatgcacgacccgtcccgcgcgacaagcgcatggcagtcaggacgctgcccgaactggaggaggtccgcaatgccctggccgaggccaaggagcggctggacaactttttgactgaggcggtggaggtgggggtggagctggagtttgacgccaaggccatgcggaagacgctgcgtgcctgcgacacccccgaggacctgcgccgtgccatgctggagctggagaaggtctactgcaccgcgggcgagggccttccgccaggcgccacagaccgggagatccagatcttgatgggcgaggcggcggcagacgagccagaggcaaagcctggggcgacggcaagcgcagggcctacatgcgccgagcccggcgtgggcgtggagcccatgcagggcatggaggggcccgggtctgccggagctgagccggtgccggcagaggcccaggttgccaaggggaccgatgccgcggcgcccgattcggctgggcatgcagccgcggctctccccggcgcaggagtggaggcggccgctccggtcgcggcgcccggcccgtccacgacccccagcccggccacgacgccgcccacgcccgcgcagccgacgccgcaggcgtccggcacgggggccgcgggcgaggcgacgggcacgacgtgcgagggggaggagggggaggagggcgagacggcgggcacgccggcgcccttccgccccgtcacgcgcgacgacgacctggacgactccgacgcggagcacgccttcctgcgcgagaagcgcatgcgccgcccggcgcggctgtggcgctccgcgcgggcgagggcgaggcgccggcgccctccctgcgccccatga

SEQ ID NO: 3967 - DNA, 366 bp, Chlorella protothecoides
atggcggccatcaccgccgtcatctacaccctggccagcgtggctcgcctggactcctatgcctcctacttcctgcccctgcccaccattctggtggcactgcgccacggccacaccgccgcgctgagggccgtcctggtcagcgtcctgctgctgctgggtgcgcgcgtgcggggttcggtggggccctgccagtcggtgtcctggagcgagagcaccacccagcatgcccgggatggggcatcgtgctgcctgtcgctcgtgtcacgctgcacgccgcggaccacccactacaatcgtctccacctttcctcacctcaccaacccatccccccccaccacgcaccccttccctctcagtgctga

SEQ ID NO: 3968 - DNA, 540 bp, Chlorella protothecoides
atgtgccagctcaatgaagctggactcgcgtattctgagggtacctctctgttattggcggctcccaggtcggcaccctctggctgctcattcccgccttcttcgtggcaacccccctcccatccccacacacagtttgtgtctgtggcgagccaacgggcccccgaggaggtccatgcgcctctggaaaagggcggggttgcccccgccgagacggagctggagcgggaggaccgaaagcggcggcgcgcccagaagaagcgtggcgccaagaagcacagggccgccaaggacgcggagcgcgcggccagggagcagagtctgggcgggctgggccccatcgccggccggaagtccgagcaggctgccgccgctgccgccgctgccgccgcgaaaaaggtgaggggagcccaatgtgggcaggaggtgttctggccttggcttggtttcaccatggggagcgattccaggcatagttggtggcaggggttttgttccacattcaacaccccccgcctcatgtccatcgtcgagcgctga

SEQ ID NO: 3969 - DNA, 375 bp, Chlorella protothecoides
atgaatctcggcatgcaactccgccccgcatgtgcctcacaggatgagccgatccgtgccaacgcccgagcgctgttcgcatcgctgtgtgccaagctggacacgctgtcgcacctgcacttcaggttggtccaggtgctggtgaaaggggttacattcaaggtgtccagcagcatgtgttgcctgccctgcatcaggggcctgccctggctatgccctgcatgcatggcatggcccgcgctcgctccagacgctccacccctcctcactcaggccggcccccgtggtcgaggaggccgggccccggccggatgctcccgccatcctcatggaggaggtcgcgccacaggtgcgtccggcagggggggagtttga

SEQ ID NO: 3970 - DNA, 687 bp, Chlorella protothecoides
  modified_base (637)..(646): a, c, t, g, unknown or other
atgagtctttgggggcgattgttattgtcgtggctgcatgagcttgcgctgccgagttcaaaaccgtggatggaatcgtgcggagacccgggaccggcgcaaccaagcatctgggctgagttacgcatctggcattttgccatgttgcattgcgacgaactacaatctgttgactttgtggtgcgaatcgacgtgaaatcggcgatctatagggcacagggtgtggatctcacgcgttgccctcgtggtcaggtgcgaggcagggcgatgccgtacctctccaagcaggccctctcgggtctcaagcactaccactacaagcccggtggctacacgatcctcgacaactggcatcagcccctctggaactgtgagtgcatgagaggatggggttgtttacaggatcggaatgcattcctgccacacctctgcagggccaccgctaatggaagggagccggcagctgttgctgcctgccagctccagcaagtactgcatcgtttctcacacctgagcaccccccccacactctcgagaatgcacagatgcggtgtcctgccttcccacctggctggcacccaatgtgatcaccctcatcggcttgagctcggtgatggtggccaacctgatctccgcnnnnnnnnnnatgcctgctccagcgagtactgcatcggttctcacacctga

SEQ ID NO: 3971 - DNA, 1128 bp, Chlorella protothecoides
  modified_base (184)..(193): a, c, t, g, unknown or other
  modified_base (813)..(822): a, c, t, g, unknown or other
atggtgaccacatctcgggccgtgccaggagtcgcacactgctgtccagcggagggcgagcgctcacctgtgtctctcaagctcgtctaccagagaactgctgatcctgtccttgcaagaacctgcacaagattccgagtgcgtgttgccacccttcaatttaccccgcctcatgcgccacctnnnnnnnnnngctgtccagcggagggcgagcgctcacctgcgtctctcaagctcgtctaccagaggactgctggtcctgtccttgcaagggcctgcacgagattccgagtgcgtgttgccccccctcaatcacccccgcctcgtgcgccaccccaggacctggagctgtacctgaccggcaagatcgacaagtcggcggccatcgaggagggtccccaggacctggagccggtggagggccccgaggccgtggaccccggcctcccgcccctcggcgcccccagcgaggaggctgcgggggcgggcggcgtgggtggaaaggagggcgacgctgaggaggccaccctgcgccgcgtcctggccaacgagctccagctgcgggaccgcaactccatgctgcttgtccccggccgctccttcgacaaggtgctggccctcctccgcgccgtgcaggccgacggtgcgcatgcccccccgactcagcccaagaagaaggtggggggtggggggtgggggttggatatgaggagagggagggcctgtcaatctagaagcaggcggggcgatctaatgtcagcctcggcacttgcattggtgccgctttggccgacccacaccccaggcctcgcnnnnnnnnnncctgtcaatctagaagcaggcggggcgatccaatgccagcctcggcacttgcatcggtgccgcttcggccgacccataccccaggcctcgcgtgtcctgcatgcaaagtccccgccccccaacaactcccgcagccggcagcgctgcccgtggcgccctccggccgctacgagcgcgagaccgcgcaggacgccacgctgcgcacgctgggcgcgcagcaactgggcatcagcagcgtggccttcacgaccgctggcgcgggggcgccggggtcccgcgacgcaggccccgccgacggcgcgccgc

SEQ ID NO: 3972 - DNA, 1263 bp, Chlorella protothecoides
atgaccaaggacggtctgcgcaagcccaactactacgggtcgctgacgcacgcggcgacgtgccgcgtgggcaactaccagggcgaggaggtgcacgttcccttctcctccctgctgcccatggtgcaccccaacgacatcgtggtcgggggctgggacatctccagcctgaacctggcggacgccatggagcgcgcgcgtgtgctggactttgagctgcagaagcagctggtgccctacatgcgcggcaccgtgcccctgcccggcatctacgaccccgacttcatcgcggccaaccaggtcggccgcgccgacaacctgatcaaggggagccgcgcggagcaggtggcggccgtgcgcgggcacatccgcgacttccgcgcagcacactcgctggactcggtggtggtgctctggaccgccaacaccgagcgctacgcggaggtgctggagggcctgaacgacacggcggccaacctgctggccgcggtggagcgggacgaggccgagatcgcgccctccaccctctacgcgctggcctgcgtgcaggagggcgtgcccttcgtcaacggctcgcctcagaacacctttgtccccgggctgatcgagctggccacagaggcggggtccctcatcggcggcgacgacttcaagtcggggcagaccaagatgaagagcgtgctggtggactacctggtgggcgcggggatcaagccggtcagcatcgtgtcgtacaaccacctgggcaacaacgacggcatgaacctgtctgcccccgccaccttccgctccaaggagatctccaagtccaacgttgtggacgacatggtgctgtccaacgagctactctacgccccgggggagcacccggaccatgtggtggtcatcaagtacgtgccctacgtcgccgactccaagcgcgcactggacgagtacgtgtcggagatcttcatgggcgggcgcaacaccatcgccatgcacaacacgtgcgaggacagcctcctggccgcgcccatcatcctggacctggtcatcctggccgagctgctgacgcgcatccggctggcgcgcgatggcgaggagctggcgggcctgcaccccgtggccgtgctgctgtcctacctgacaaaggcgccgctggtgccgcagggcacgcccgtggtcaacgcgctggccaagcagcgtgccatgctggagaacgtcttccgcgcctgtgtcggcctggccccggagaacaacatgatgctggagttcaaggcctga

SEQ ID NO: 3973 - DNA, 405 bp, Chlorella protothecoides
atggatccgctccggctcctgcgggagtacgtgagcggtgggcgtctcgaggaggtcaccacggtgggggaccgggtgcactttggcacccgtttcgccctcccccgctctgcccggacggcctacaagtctcaggccaaggacggcgccttctacgatctgggagccctgctcttctatgccaggaacttgggccccaccttcaagtatgccgactacttcaagaaggccagggaggccggggtcgggcaggtcaccttcatcgaccgcaaggttagcccctgggctggtgcatgccggtgtggtgggccgtgtggttttgattgcatcttcctcgcgctttggggtagtgaggcagcaggcctggatgcatctgggagcacaagtggcaccgccccgtggtga

SEQ ID NO: 3974 - DNA, 969 bp, Chlorella protothecoides
  modified_base (145)..(154): a, c, t, g, unknown or other
  modified_base (498)..(507): a, c, t, g, unknown or other
  modified_base (883)..(892): a, c, t, g, unknown or other
gggggggatggtggggcatctggggggatgcatgcatgggagcaggtcctgagcgcaaggtgggtggagagggacggcacgaatgccctcccccaccgcggcagcgctgatatctggcacatgcacttggtggcggcgtgccacnnnnnnnnnnagatgcatgcatgggagcaggtcctgagcacaagggggtttgggagggacggcgctaatgccctcccccaccgcgacagcgcttgtatgtggcacatgcacttggtggcggcgtgccacatctggtcattctccccagaggtggagatcgtgaagcggcccgacggctcgccctggcagctgggcagcggcgggtttggcaccgtctacaaggccctgcgcaacggggtgcagcctgtggcggtgaagatgctctcggtgagcttcggagggcatttgcgttcaatcctgggtgctcagggtctcctgccagacatggggtcggtctgtgcggttctgggtaannnnnnnnnngtgcgttcaatcctgggtgctcagggtctcttgccgggcatggggtcggtctgtgcggttctggcagaatgtcgtggtgcacaagcgcctacaagcggcgcatctgtccctttcccgatttttttcctgaaagctgtgtccggggatgtccgccaggcagccctggaggatttccgcaaggaaatctccatccttaaggcttgccgtgacctcaacatcgtccagtttgtggtgagttggcggacggagggtgaaggggaggggcatgtggtgacagcacagtacctccagtcatgggctcgctgccgcctgcatgaacctcgcaccgagctgagggagtttgtacccctggctgcaagaccattgagcttgaccnnnnnnnnnngaccacccaccgagctgagggagtttgtgcccctggctgcaagaccattgagcttgaccaagtggccagaaccgtga

SEQ ID NO: 3975 - DNA, 1164 bp, Chlorella protothecoides
  modified_base (315)..(324): a, c, t, g, unknown or other
  modified_base (556)..(565): a, c, t, g, unknown or other
  modified_base (978)..(987): a, c, t, g, unknown or other
atgtacctcgaccccctggctgtcgtctgctcctttgtgcagggcgcctcgttagggccggacaataccatgctggtgacagagtactgcgagggtggcaacctgtgcaacaacattgcagcgggccgcgtgacatggttccggaggggtcgaaaggtgggtggagtggtcgttggggggggccctgggagggcgaggcggtgtgacactcacacaggccctactctgccaaccaacgactccccatgtttgtcacacctgcctcgggtgcatgggtggggccgccagctcagcaatgatgcgcaagagagaagnnnnnnnnnngcacacctgcctcggttgcatgtgtggggtcaccagctcagcaatgatgcgcaagagagaaggacctttccaggtgtcccatgcagtttcagttgcacactgccaatcttaaccaggcatgcataccaggcacatcctggagggttccatcacccctgccctgtgccggtgagtgttcgggtcttggggggaggggggggggtgcgttggagcaccgagtgtttggcattcnnnnnnnnnngctggccaggtgagtgttctggtcttgggggagggggggggttgtgcgttggagcaccgagtgtttggcattcaactcacagttccggcgcatcacccgccccacctaacgacctctcttctccccacgacagggatggcacggcaaagatcagcgatgttgggatggccaagattttgaatagagactacatcactggcgctgttggtaccttagcctgggctgcccccgagatgttgtggggggagcgctgctcggagaaggctgacatttattcttatggtgcggcggcggggatgcggggcacagcctgggttctattcatctacggtctgactcggtgcttgcaagcgcaacctaaccccacgccacttctccacccgctcgcaggcattgttctgtgggagatgtgnnnnnnnnnnatgagagagagggggcggaaggaggggcgcgagactcacctggtctggctttgcctggttgttgtggtgcattgttctgtgggagatgtgcaccggggagaagcctgtacgcggccagctgcgagatgtcgtgtgcgttggggtggctgcgcggcagctgctcggggccgcttgtag

SEQ ID NO: 3976 - DNA, 1980 bp, Chlorella protothecoides
atgcatcaagcctcacccatgcccaagcagcatgccgtgtctggctctgagagtggaacagtcacgatgaatggcttgacaaaatggaagggcaggcaccgtagcagtgagggggaatcggggcggagcagttgcaagggtacgtgccgaggctcacgccgcgacgtcggatgggcgctgcagcttctcgggcgccagggcggcggcgatgcggtccagccccttctccagctgctccatggaggtggcgtaggagatgcggaagcaggccggctcgccaaaggcctctccggggacaaccaccacgtgcgccacctccaggatgtatctttttgcggggcgggtgcatcagctggtggtgctctccctgccgagcaccattcgcgcgcccatcacccctccctcacacctcgccccacacagaggcatgcctcaccccttccctcacctgcacagctcggccacggagggcaccggcccgaatcccggggcttcagcgcccggccccaccagggccgaggcgtcgggaaacacgtaaaaggcgccgtcgggcgcatccaggacgacgcccgggatggcgcgcaggcgcgccaccacgtagtccctcctctccctgaaggccgccaccatgcgcgccacggggtcgccgccgtgcggccccaggcccagcgcggccagtgcggcgtgctgcgcgatgctgctggcgccggaggtgcactggctctgcaccacgcccgcggcggtggcaaaggttggaggcgccgccaggtagcccaggcgccagccggtcatggcgtaggccttggagaagccattgacggtgagggtgcggtgcgccatgcccggcagggatgcgaaggagacgtggcgcgcgggggggaagaccacgtactcgtagatctcgtcggagaggacgagcaggcgcgggtgggcggccaccacttccgccagcgcgcgcagcgtggcctcggggtacaccgcccccgtggggttggagggggagcacaggatgaggaggcgggaggcgggggtgagcgcgctcgccaggcgccggggcgtgagcaggaagccctcggcggcggggcagggcagcacgaccggcgtggcgcccgccaggcgcgccatctccgggtaggacacccagtagggcgcggggatcaggacttggtcccccgggccgcaggtggccagcagggcctgccacacggcctgcttggcgccgttggagaccaccacctgggctgggtccacgatcacgtcgttctcggccgccagcttcttcgcgatggcggcgcggagcggggcggtgccgttgttgggcgtgtagcgcgtgaggccggaggcgatggcctcgatccccgccgcgcagacggcggcgggggtgggcgcgtcgggctcgcccgccgccagcgccaccacgtccacgcccgcctcccgcagccggaccgccgtgtcggtcagctgcaccgtggcggagggccgcagggaggccaccagcgggttcagggactggtccacggggctggccatggcacggagcaggggggctgcacatgggtttgggtgggtgtgcgtgtgtgtggagtggagggacagattctagggaagggaatgatggtaggtgtaacaatcacgagccccctcgcctcgcatcggataacgcaatgcatggctggaaccccaaaccaaatgtacctctggcagccctcgggtgcctggctgggtgggcaaagggcacgcaacgcagggagcaggaggtgttcagggcacgctccatccctcggcactcgagcctgccgctggttggagatgtggggagcacgtggaacctgggatccttacaggctcgaagaccccactcaagcgagcacgcgacatgatgccggccagcgatgctgtgggggtcggaaacgtgcgttttcgcgccctgggcgatcgacctccggggctcaggcttgcaatctcaataaatctaggtag

SEQ ID NO: 3977 - DNA, 471 bp, Chlorella protothecoides
  modified_base (436)..(445): a, c, t, g, unknown or other
atgccgtccgacatcaagcgggtgcagtatgcccagctcgcgcgatctctgcggggccgacctctagccgaactgatctcgcgcgccaccacggaaccagacctggcgaccttcggggacttgctccacctcacagctgtacaggaggtgagattgggtgactggagaccctgggggtgctacctccatggcggcaccacgcggttggacaccgacgacgcaattgacacctcccttcactctgccccaccgcagctctccaacactgaggatgctgccgctctgagtctgctgaacctgttctcctacggtacttggcaagattattcaggtaacatgaccgctccagggcgctgtggctgcatacagcgacgtctgggagaaaggtgcccctttctgggtctgaaccctgacatcacaaacttccccctggggnnnnnnnnnnagaaaggtgcccctttctgggtctga

SEQ ID NO: 3978 - DNA, 1263 bp, Chlorella protothecoides
atgggttgctgggctgcggaggcggttgcaggcggaagggcccctggtttgcagaaatcctcgcaccagatcttcgaatactcgaccacaatattatctcgtgtacttgagcactgcatcgtgacaccgaggctggcggtttactggtgggtcgctgtctgtcactgccttgagcaggccccaaccataatctcgtatgtagacaagctggcgtattccggtggctccgagcggggctcggcacccacgctggagcaggtcataggggagttcttttggaaaggagcacagacggttctcagcgcccgcctgccccacgcgaccccgtccgacaccaaggggagcggcaagaagcgagcatgggtgagcaggtggtgcgggaccatcgcgatgaccctcgcgccttgccacccctctcgtttgccagaaccagctgaacgccttccgcgccgtgcagttcaacttggagctggacgaggtcgagtcggccaacaaggaactagagaaatggcgacgcgatgcaggcttgccactcgtggtggaggtgagggtgctcgcatgggggatggggcttctgggggcatggtggaaggcgggggagggttggatccggggtgctgcgaggtcctccagctctcagcgacaccgctccgcccccaccttttccacttgaaggtcttcttgagaccatggggtgcacaggaagagaaggtggcactgatgtcgggtgacactggcttaggtaagccttgcctgagagcgtcgtggtcgtcacgaaccaggtcttgttgtcttgtctggatgcacagtcgtctgcctgtgcctgtcgtatccgcctgtgatccagaactggagaagaaagagcttgagggcccacgtcctcctccacacaccacagtggagacgctgctggagcgctgggtcttccaccaccagcagctcctccccgactccccttcctccctgtccaaatcagcgctggtgcgcctgagcccctcctctatctacaagcgcctggtcatcctgctgcgctccgtcttcgccctcctgcgcaccctgcccgcccacaagctgtgccgcgccggcggcgccggccgtcgctccgccttctcgctgggctaccgcctgcacagcagcctgcccggcggcgcgggggagggcgggccggaacgctccggaagtggcggtggcggctcagcgggcgggtcgtccagcggcccggcgggccccggcgcggcgcaggctcgtgcgccccgcggcctc

SEQ ID NO: 3979 - DNA, 1377 bp, Chlorella protothecoides
atggccagccccgtggaccagtccctgaacccgctggtggcctccctgcggccctccgccacggtgcagctgaccgacacggcggtccggctgcgggaggcgggcgtggacgtggtggcgctggcggcgggcgagcccgacgcgcccacccccgccgccgtctgcgcggcggggatcgaggccatcgcctccggcctcacgcgctacacgcccaacaacggcaccgccccgctccgcgccgccatcgcgaagaagctggcggccgagaacgacgtgatcgtggacccagcccaggtggtggtctccaacggcgccaagcaggccgtgtggcaggccctgctggccacctgcggcccgggggaccaagtcctgatccccgcgccctactgggtgtcctacccggagatggcgcgcctggcgggcgccacgccggtcgtgctgccctgccccgccgccgagggcttcctgctcacgccccggcgcctggcgagcgcgctcacccccgcctcccgcctcctcatcctgtgctccccctccaaccccacgggggcggtgtaccccgaggccacgctgcgcgcgctggcggaagtggtggccgcccacccgcgcctgctcgtcctctccgacgagatctacgagtacgtggtcttcccccccgcgcgccacgtctccttcgcatccctgccgggcatggcgcaccgcaccctcaccgtcaatggcttctccaaggcctacgccatgaccggctggcgcctgggctacctggcggcgcctccaacctttgccaccgccgcgggcgtggtgcagagccagtgcacctccggcgccagcagcatcgcgcagcacgccgcactggccgcgctgggcctggggccgcacggcggcgaccccgtggcgcgcatggtggcggccttcagggagaggagggactacgtggtggcgcgcctgcgcgccatcccgggcgtcgtcctggatgcgcccgacggcgccttttacgtgtttcccgacgcctcggccctggtggggccgggcgctgaagccccgggattcgggccggtgccctccgtggccgagctgtgcagaaggagtgtgccccattgctcgagactccttcgtgcacctgagcaggtgcatgtgcaccttcatgcacacacatgcacccacacatatctgccccgctctcaaccccgccccgcaaaaagatacatcctggaggtggcgcacgtggtggttgtccccggagaggcctttggcgagccggcctgcttccgcatctcctacgccacctccatggagcagctggagaaggggctggaccgcatcgccgccgccctggcgcccgagaagctgcagcgcccatccgacgtcgcggcgtga

SEQ ID NO: 3980 - DNA, 1035 bp, Chlorella protothecoides
atgcaccacgcgatcttacgtgtgttctgcatttgcgcgatcgccggcctgctcctgggcctgtgcatcctccaggtagaccctgccccaccccagcctcatgcggatggacagacccagctccctcctccgccgtgcaccccgctggagggcagtggtgcatcggacgccgtccaatggatgcatgcccagctgggcagacattgccagcccagcaacctgaccatcaccatccctcccatcctccaccacatctacttcccggaccgtgccagcttcctccgcggcgcacaggggaaaggaagtgccaccaaccccgcctggagcgagtcctgcctgaggctccatccccactgggagcatgtcttctggggggaggctgaggccaaggcctttgtcgccaagttctggcccggcttcttggccaccttcttgtcctacgaccaccccgtcagtcgctccgacgccctccgacccctcctcctgcacaccctcggaggggtgtatctggacctggacatcgagtgctttgcacccctggagcccatgctggcaggggccgacgtggtgttgcagggcaccggccccatggagggcgtgaccaacggcgcgatggccagtgtccccggccaccagctctggctggacgtggcgggggagctggagcggcgcgcgccccgcgccgacctgcccatcgaccgccagacggggccgggcgtgctggcggccgccgcgcgccgggcactgggtctgcccgacggcgccggagggttcgccggcctgcatgcgcccagccatgccggcggcgccctccgcgtctggcccctgggctccttcctcacgccctgcgcctgggacgaccggcggtgccaccgggccgtcgccatcgcgcgcggcgcgggcgccgccccgccgggcgtcgtgggctaccaccgttacagcgccagctggcacgggcgggggcgcaaccggcacggcgtcctcaccccgcaggacgtcgtgtgggcagtgggcggcgcgcagctaggcatgtag

SEQ ID NO: 3981 - DNA, 198 bp, Chlorella protothecoides
atggagtacatccaggcagcggagccaatcaaggttcacggcctgaccgtggcatcgtacgggagcgacgaccctgccctgggctgccctgtggagtacatcaccctgaagggcacctcccgtgagcacccggcggtgtgcaagtacaccggcaacaagtactacagcgatgactgggtggggggcggcgcccactga

SEQ ID NO: 3982 - DNA, 627 bp, Chlorella protothecoides
atgcccaccatccttgttgagctcagggcaagtctgggtaccaatggggctggtgaaccgtgggcggttccacccatctccctatgggccctccctttgagagccccctcattcctccctctcgccatccctgtgccccaccgcagggccctggcggcgtacctccgccgccccggccagtgcatgtggctcctcggcatgttgctcttcgtcgccggcaacgtcctcaacttcctatcctttgcctttgcggcacagtccctactggccgccctggctgtggtccagttcgtggccaacgtggtgttcgcccgcctgatcaacggcgaggtggccacgcgccgcgtcctctgcgccacgggcgtggtcgtcgtcggctgtgtcctcctcgtggcatttggcaaccatgaaagccccgtcatggacgccgacgacctgcgccacctctacaccgcgtatgttgcgggcgctggggctggtgtcacgagcactttgtcacgccccgtgggggaattcgcagggttctgcatgctccattttgccgcaaccctccgcattcaaacacatcaccccactgcgcacccgcccacagacccgcatacattggctacttggtggggctactga

SEQ ID NO: 3983 - DNA, 1428 bp, Chlorella protothecoides
atgctgctgcgcaagtcgctgcagggccccacgcagctcacgcactggtacacctacgtggccctgctcctcttcctggcctttgccgccttctgggtggtcaagtactctgagggtgagcggcgaaatgaagcgcgccggtggagggccacgcgcaatgagccccgagctccctcagccgcatcaccttacccctgcccttcccgcacgacagccatgcgtcgcttcccggtgctcaccatgatgcccatgttgatgatcatgtgggtcctcatctccatgctgtcgggcatggtttacttccaggagtaccgcaccttcaccgtcctgtcgaccgccatgtttgtgctgggctccgccacactgctgggcggcatctacctgctggcgacgtgcaaggaggtggggccgggcagtgggcgggaggggctcaggggtgcggcaaaagcgctgaaaccccacatgcagcaagccggatgccgggcgtgctcgttcgatcgccgccgccccgctcaacactccctccccgcgccctcgctccacatagcccctggtggtgggcccgccggggtccgcccggcccagcccccagtccagcacgggggcctcgacccggcggaggacctggcggaggccctgtggggcgacgtggagcgcagcgattccgcacacccaagcgcccccgctgcctgcggcccgcgctttgggcccacggcggcggcggggcggctggtgaggaggaccagcacgggcgccggccctccgcccgcccaactggagcacgagccctcctcgccccccgcggtgccgctggcggtccccgtcggggcgctgcagctggcccagaaccccatgttcgacatgccgtgctcccctgggccgccctcctgccgcctgggcgcctggagggagctccccgccctgggccgggcgtcgcgcgtgccgggggcggtcctgcgcccgtccctggcgctgcaggtggactgtggcggaggcggggagcccgcgccgcggctggccaggtcgaccagcggcgggtcggaggcctcgagccgggtggcgggcgccgccccgggcgtgctcagccccatcctgtccatcttctccatgccaggaggggcttgggaccttggggcgcccacgccgcagccgtgcgcgccggccgcggcggcggagccggaaccgcccgcggcggtggacaaggacgccgggccagccgccgcctccaaggccgtgctgccggggactggggcccagagcgacggccagaagcaggcggccgtggatgccgcggagagcgccgaggcgccacgcgacaccatccccgccggccggccgggccgggaggccggcggcggccgcacggccgacgaggaggctgaggacggccaggatgcggagcccggcgagccggagactcgctcctga

SEQ ID NO: 3984 - DNA, 924 bp, Chlorella protothecoides
  modified_base (125)..(134): a, c, t, g, unknown or other
atgagcggcacatcggggccagtcatctggagggcagggggggacgcacattccgacaggtttcttcggggtggcgctggacacgcggggcacgcttccctggtgtcggcacccggcgcgcatgnnnnnnnnnnaagggagtctacgcagggcagtgcatgccagatcgtgccggccggctctgctgacgggcaaggatgcgcgacggggcgcaggacacgcggggcacgctttcctggtgtcggcacccggcgcgcatcccagagcggcgagcgcgccgctcgaggctcgcgccgcctacttgttgaaccagacctgcgtcttcttggtccgaccgatcttcttctgcagctggagcaggccgtacatgagggcctcggcggtgggggggcagccgggaacatagatgtccacggggacgatgcggtcgcagcccctcaccacggcgtaggagtagtggtagtagccgccgccattggcgcagctgtgggaggggagggagtagtggtagtagccgccgccgttggcgcagctgtgggaggggagggtgatgggacggtgacgagggagcggcaccgaggggactcgagcccgcaaagcaccttggcaggtgttgccctcagcgcatttcttcaaaccccccttgcccactcaaggatcctccctggtcaagtggtcgtcagccatccacacagccccagccgcggcccacctgcccatggacagcacccagcgcggctccggcatctggtcgtacaccttgcgcagggcaggcgccatcttgttcgtcagggtccccgccacgatcatgcagtcggactggcggggggagggccggaagatgatgccgaacctgtccaggtcgtatcgggcagcgcctgggccagggagaggttggaggatgggcagcttgcacgagcgtga

SEQ ID NO: 3985 - DNA, 639 bp, Chlorella protothecoides
cccgcgcccgtgctggcgtccctgctctcgtccctctactccgcccccgactccgccgagacggtgcgcgggctgacggtcggcgtgtcggcgcaccagaagctggagcgcctgtcggccctgctgcgcacgctggggtacgagggcctggccgtctttggcgactgcttcgacgaggtggtgctgctggacccggtgcagtaccccggcgccatcaaggtcttcgcgcgcgaggtctgccgcaacgacctcctcaactttggccgcatgcacttcttcttcccggactcgcgcctcgcgctggacctgaacaccgataagacgctcaaggaggcgcgcttcgaccgtcacttcgtccgcgacctcacctggtcccggcaccagctggaggagctggcggagcgccgcttcctggccgcgcagctggaggcgcagcgccgcgccgccgcgggcgcggggcacgctgaggcgcgcaaggacggcggcgcgggcctggccaacgccgacgtgtccagcgtggcgggggggaagacctacacctttgcagacctgttccaagcggtgagtggttttgggtgggcggggggagcaggaggggaagttgggaagggggagtcgaggtgtcgagggtgctgctag

SEQ ID NO: 3986 - DNA, 210 bp, Chlorella protothecoides
atgatcatgatggtgaggggtcgtggcccagaggccatgggttgtaggctgcagctggcgcgcaggaccctcagccggcacctgcactgtcccccccgggaccccctgcagaccgagatgatgggccgcatggaggcgcacccggagggcggtctcaccgcccaggacatggagatctcggtgaccaaggcgctggagcaagcggtgtga

SEQ ID NO: 3987 - DNA, 642 bp, Chlorella protothecoides
  modified_base (370)..(379): a, c, t, g, unknown or other
atgaggcattgcatggccgcctgccatgtgcctggcaagaagagactcaaccgcggctcagcaatgctctcgccctcccacccacaggacgaccaggtgtgccgcttcacgtcggccaaccacgagtggtttgccgcggccgcgggcgtctgtgtgaccacctacaccatggtggcctactcggggaggcgcagcgaggagtctgagaatgtgatgaacgagatcatgaaccgagagtgggggctcatcatcctggacgaggtgcacgttgtccccgcccagatgttccgcaaggtggggaaagggggaggggggggagaaagggggaaggagcaggtgtgggggattgcgggcctcctgttaatggggnnnnnnnnnnccagatgttccgcaaggtggggaaaggggggggggtggaagaaagggggaaggagcaggtgtgggagattgcgggcctcctgttcatgcgggggaggactgcatcttgctgtcttgccggacctgagcggtggtgtctgggtcatggggacagggtgctgtgatgctgggcccaggccccccctccgccctttcctctctccacacgtcgcgctccctgcacacctcccggccccccctgtccccaccctgtccccaccctgt

SEQ ID NO: 3988 - DNA, 1215 bp, Chlorella protothecoides
  modified_base (380)..(389): a, c, t, g, unknown or other
atgcgccgccgggcatccccagccccaggaacccgggcgccactcccctggacgcgcccaggtcaagctggtgctccagcgcaacgccttcttcgtggagtcgccctaccccgccgtcctgcgccgcctactgcacgaccccgtcatccgcgcggcgcgcgtcctgcgcgccgccgacgattgcttcgaggtcagtgcggccgtgcgcgacgccgcggccgccaccctggccaagacggacgtggaggcggggggggaggaggctgcagaggggcgaggtggcggggaggcggctggccccgatggggccggtgcttcggctcgaggaccttcccaaggcgaggctcctgccgcgccggccggccccgcctacctgattnnnnnnnnnnggccgccaccctggccaagacggacgtggacgcggggggggaggaggctgaagaggggggaggtggcggggaggcggctggcctcgatgggggcggtggttcggctcgagaaccttcccaaggcgaggctcctgccccgccggccggccccgcctacctgatagacccggtggagatcgaccccgaccgcgagttgcacgcctttgagatcgaggcagcccaggtgggaaggggggcgtgggcgggtgggcggccctgtccggccttcagtgtggcaatggggccgccccccacctggccgggtatgggggggtgcgacgcgcagctcttgctgctccatgccgcacccaggcatcctggatggagcccatcttgcatgcattgccacacgcctgcgccacctcccctccccgcccaccctgcatcctccctccttccctgcacgcgccaggtggagcacgtgaagcagcggtgcctgcccggcgggctgaactaccccatgctggaggagtacgacttccgcggcgacgtggccaaccccacgctgagcatggagctgcggccccacgtatctcaccgcccctaccaggagaagtcgctggcaaagatgtttggcaacggccgcgcccgctccggcatcatcgtgctgccctgcggcgcggggaagagcctggtgggcgtcagtgccgcggcgcgcatgaagaagtcctgcctcgtgctctgcaccaacgccgtgtcggtggaccagtggaagtaccagttccagatgtggacctcgctgcgagtgagggggatggggtatgtcttccggggattgagggagtga

SEQ ID NO: 3989 - DNA, 1404 bp, Chlorella protothecoides
  modified_base (874)..(883): a, c, t, g, unknown or other
atgacacagacactgaccagcatgatagctcggccggtcgcgcccgggtcgagcatcacacatcacagcggggcatggagctcacgactcgctcccatgagcacgcgacaaccctttactacaagaaccagggccgctgtcaagacggtggaggccagcgcctcttcctccacggacagtgaggaggaagagctcaagccccagcccgtagaccaggctaaggacaagctgtacatagggttcccaaagggcgactacaagccccggcgggggcgaacgggtcgcatcgtggtggatgacccgagcctctaccccgaccgtgacgcgctgggcatcgggggctgggcgggcggcgaagtgggcctccgcgctttcctggagcgctccggcgacgtcgcgcggtatgaggacgcaccgctggagacgccgctggccgacaccccgccccgccccgcccaggacccctttgccgggaacgaccgcatctacgtcggccgcgggcgctggatcaccgcagacgcgcgcaagtttccctaccgtgacgcgttctccggcggctttgccggcggcgagctgggcgtccgcaccttcctggagcgcggcgacgtgcccatcggcccgcctgggccgcgccggccctcggccttgaccatcgccagcaccgtggccgccgcgggcacagtcagcgcgctgctgatcaccgacgctgaggaggtgctgccgggcgcgctgcgcaccgtggccgtccccctgcgggcgggggtgaggggcctgaccacgctggacgacggcaccaagcacgccctccaggtggggagggggagtttttcgggaagaaggattgagaagggcatggaggggtgccaaatcctcnnnnnnnnnntccagcacacgtccacccttgtgcatgccaccctcgtgcatgccacaacaagcgctgccctccacaccccagatcgcgggagtgggcgtgggcgccgtcctgggcgccgtagccctgtccagactggtgtccacgctgactgggaagctggcagcgggactgcagcgcgtggcggtcacgctgctcttcagcgccgccttcctcgccgcagccgggtatgtcctggagctgtactgaccacctctcttcctgtaacatcgaccgtagcgagaaagggggcaagaggagcaagcatacgaatcagatgcgaagcgagggggggggtagaagcaaggtcgacaggaagcattgcagcacctggaaggcaggcaaaggactcaggcctactgtctgttcttcgcccccaggcgcctactcgtcgccctcaaagtcagagtcatcctcatcatcctcgtcctctgcttgtgggcatgatggaggggtggggtgggaggcgtggcaggggatcaagcgacaaatag

SEQ ID NO: 3990 - DNA, 522 bp, Chlorella protothecoides
atgctgtgtggaggaactgcatggggaagagctgcatctctgcgcgcatggatgtccagcatggagactataaccagcagaagagttcccaatcttccccccatcacccaccacacgtacagatatccgccccttcgttatccaggtggaatcgaccactctgtccatcccattagaggaagcggaagcacggcaactggccgtagtactgggcctgtaggcatgggttggacggtcatgcaagacgcagcagttgcagctcgtgtcctcggctgccatccaagcttcgaaaacaccgaacagcacctctgcaccatctttgcaggtgggagctctgattccaggcagtcgcttcaggcgatgtgcaatcccaatgcccatgccaccgcctttgaggctcgagtgtggctatctgtcaagacagggggcatgtcggtggcgactgaggccaagctgagtgccttcagggccgcgctggaggcttattttgagcagttgcgcacctccaagactgttgcttga

SEQ ID NO: 3991 - DNA, 1977 bp, Chlorella protothecoides
  modified_base (484)..(493): a, c, t, g, unknown or other
  modified_base (1127)..(1136): a, c, t, g, unknown or other
  modified_base (1321)..(1330): a, c, t, g, unknown or other
  modified_base (1407)..(1416): a, c, t, g, unknown or other
atgctagctgcaaggtttggtctagatggcagcataatgcacctatcctcctcaccagtgtgcattatgactcggcaccgtggctgcagcgtgtgcgagcagcggagggcaggtcgccccgggcggcatgggccgatcactcccggaaatctatctacgtccgagatgcatagcgttttgcaaagcgcagcaccatgcccgggcgctgcgacgagattgctcatagccaatgtgacgcgactttgtcacgaaaaagacaatccggatccactggcgagccctgggggtgtacctaggctggctttcgtttcaggtgttactgcacctcctactgcctggcaagcacgtccaaggagtgcccctggccaatggcgagcgcctcctctacaagttcaccggtgtgccactggggtgatgacgtggtgtgctgttgttgatttgggtcaagtgggaccccagccggcccgcctcgccggctcaaccnnnnnnnnnncgacgtgttgtgctgttgttgatttggatcaagtggggccccagccggcccgcctcgccggctcaaccccttttctctgccacatcacgtacgcaggtatgcagaacctggtggtaactctcgccctcgtctttggcctgggcttcgccaccgacgtgctgaacctgggctgggtgtacgacaactacctccccctgttcactgccagcctgatcgtgagcgtgctgggctcggtggccctatttgcggcctcccacagcccgtggcgggagcggccgcccctgctggccgcggggggggacactgggtaccacatatacgacttcttcattggccgcgagctgaacccccggatcgggagcctcgacctcaaggagttctgcgagctcatcccgggtgcgtgtgtgtctgggagcacccctgttgtttgggctgatcgggtggctggtcatcgatctggcctgcgcacacaagcagctgcaggagcaggggtctgtgtccgtgcccatggccctcgtctgcgcgttccagcattactgtgtgcttcatgcaggaccccaggccctgacctccctgcaccctcccatagcccccgtccacaatatctcattccaactttctgccactctgcagnnnnnnnnnncaggctgagcttgcacagagttcttcagggcagtatgcaaatacatggagtgtacctgtgtgaaaaacaagcttcaatgcagcattactgcgtgcttcatgcaggaccccaggccctgacctcccagcaccctcccacagcccccgtgcacaacatctcattccaactttctgccactctgcagnnnnnnnnnntgtcgtcactgacacccaagtctcctccacccatgtccgtgcttgcccacagggctgatcgggtggctggtcatcgnnnnnnnnnnggcctgtatgtctgggacgccctgtaccacgaacccgccatccttaccaccatggacattgtgtcggacggctttggcttcatgttggcctttggcgacacctcgctggtccccttcacctacagcctccaggcgcgcctcctggtcagccgcgggcccacgctgggcgcgctgagcatcgcaggcctgatcgcgctgaaggggctgggggacaccaccttccgcggctccaacagccagaaggaccagttccggcgcgacccagggcacgccagcgtggcgcacctctccagcctgcccacggagcggggcacgcgcctcttgacctcggggtggtggggcctgtcgcggcatcccaactacctcggggactggctcatggcgtgggcctggtgcctgcccactgggagtgcggcagggctggtgccctactactacgtaatctactttgcggcgctgctgggtgaggggagagagctatggaggggtgatgggtggggatcagagagcagtgtcaggggcaagcgagtgcaaggggagtgcacgctgtcgctatggtga

SEQ ID NO: 3992 - DNA, 378 bp, Chlorella protothecoides
atgaccccctcaagcatccccattgcagtgcaccgagcgatgcgggacgaccacgcatgtaggctcaagtatggcaaggactgggacaagtactgcaagctgaggtcgacaaggtcgcaggaaagacaacggaactggaggagatcatcggtgattcggtgcaagatcgtagagggtgagcctggatacattggtccagggcatggtggtgctgggtacggacggacaagctggggtttcggtgtctcaaattgcataactgatcggcgaagtaatcatcgaatgtacgaagagaacatcaaagcactggtgtgtccatgtgccgctgctggttgttgggaatgtgtgaagcaagtcgttagccgggcggctggttaa

SEQ ID NO: 3993 - DNA, 3096 bp, Chlorella protothecoides
  modified_base (294)..(303): a, c, t, g, unknown or other
  modified_base (2384)..(2393): a, c, t, g, unknown or other
atgggtggcgccgaaagttgctcaccttttctcatcgcaccctctccaccacaaaaccaggctcggggagagggctctgggatttgtgtccaaggttcaacccaaggtcagaatagtgcagtggggagtctgaaacgggtctatctggatatgaactgtaggctttatcatagtttatcttgttgtcagacttccctcctaaacttgtgctcatacacagcatgcagtcacccccctccactcaatccccttgtgcagcttctgatcggcggcaagttcgtggatgctgctggnnnnnnnnnnaagaacagtgtgcatgcagtcacccctccgttcaatgcccttgtgcagcttctgatcgacggcaagttcgtggatgctgctggtggagagaccttcacgtctgtggacccccgcaatggcaacgccctgctggagatcgccatggcaaagcccaaggacgtcgacagggcggtcgatgcagcacgcaaggcctttgatgagggtccctggccccgtatgagtgggcgggagcgcgccggcatccttttcaagctggcagacctgctggaggtgcccagggatccgctttgctcatggctgctgccagatgaaatggcgtgtagatctgcaccgatcttggagaatgcggaggagctggccctgctcgagacgctagacaacggcaagacctacagccagagtgcctgccacccgacgtctagccgccaaggctacccccccacacacacccaacagagttccacagtggacatccccgagaccatctaccactttcgctactttgcggggttcgcggataagatcgagggcgccaccatccccgtgggctccgccggggtcacaggcaagggcttcaccgcctacaccctgcgcgagcccatcggcgtggtgggccagatcctgccctggaacttcccggccctgatggctgcctggaagctggcccccgccctggctgtcggctgcaccgtggtgctcaaggtcagccagcacacgcccatgacgggcctgcgcatcgctgagctggcgctggaggcgggtctgccccccggcgtgctcaacgtgctgacggggaagggttctgacatcggggacgccatctgcaaccacccgggcattgacaaggtggccttcacggggagcaccaagatcggcaagatcatcggcggcacggccacgggcaacctcaagcctgtgaccctggagctgggcggcaactcccccgtcatcgtcaccgacaccgccgatctggaggccgccgcgctgggcgcacacgaggccctgttcttcaatgcgggtcaggcctgcgagtgcggggcgcgtgtgtttgtggacgagcgcgtctacgacgaattctgcgcgcgcagcatcgagctggccaagggccgcaagaccggggacccctttgaccccgacgtcaagcacgggcccatgatctcggagcagcagatggaaaaggtgctggagctgatcgagagcgggaaaaagcagggcgccaagctggtggcgggtggggagcggctgggcgaggaggggtacttcctgcagcccaccgtgtttgtggatgtccaggacgacatggacattgcgcgggatgagatctttggccccgtccaggtgtgtgtgtgtgtagggtggggggagttctgcagagtccaagctgggtactgggaatgcctgcattgtgtgtctttactgccttgcactgcatggcactcatattctccagactctcaccaaccaacatctttatctcccccacatcagatcatcttcaagtacaagacactggaggagggtcttcggcgcgcgaatgacaccaactatggcctggcgtcggcggtgtggaccaaggatatcgagaccatgcagcttgccagccgcactctgaaggccggcaccgtgtgggtgaacacacaccatgttctggatgcggcggtgccctttggtggctacaaggagtctggcttggggcgtgaacacggcaaggaggtgctggagcattacacccaggtgagggttcaagaggtttgccaaggggggtgtgaagtcgttgagatgaccagcaaagcagagacagcacacctcgttcttgacgccccctgcaccatcctcgctgatcccacagacaaaggcagtgtacattcccctgcccaagaacaacccctggcagatcatgtagagcagctgttgtgggtgtgctgcacaatgtacgagcagagagttcatcagcccggaagtgtaaacccacgtgtccctttgccaaaagcaaccacatgacagacgtgcaacagtactgctcagcaggggggtgggcaagagggggggagcaaaagggggagcaggaaggacagggcgcnnnnnnnnnnaaaacgtcatcacaggacagacgtgcaacaataccgctcagcagaggggagatggcatcacccgtctccctcactgtgcggacgcgggcggtcccccattcccccacctcccctcccgcttctcgatgtctgccagcaggatcttgatgaagaagtcggtctcctccgggttggccacccagatgatggagcagcagtcgcgcgtggccacgtcgttccccgagtcggtgaaccggtccccggcgtgcagggcctggtcgggccccacgccgacgtagcgcatcagcgcctccagcccgatgctcttgttgcccacgtccacgaagacgtcgttgcccccattgaaggcgcagaaggggaggttgggggtcggtcccgccagcaggccggcgtgcacggtcagcgccagctcctccagcacctcgtagatggtgggcgcggaggggaccacgcccaccgcgcgctccttacgcaccacgctgacggggaggcgcaggcgctccgcgccctccagcagcagccgctccgcggtctccagcagctcgtggatgtcgtcttcgcgccagctggccatgaactcgctcttccactcggagtcggggacgaaggccaggcgcccccggtccacgcgcagcaggtagttgcactccccacccatcacgtggaacctgggggttttgggaagggggcggggggcatgtag

SEQ ID NO: 3994 - DNA, 429 bp, Chlorella protothecoides
atggagtatgatgagttctttgccctctcccgccgccacttcatcccccccaactttgcggagctgcgccacattctaaacatcgcccagatccatgcctccgccaccagcctgcgcctggtcacctttgacgcggacggcacgctgtacgccgacggcgcgcacatgcagcacgacaacgagatgattgggcatgtgattgacctcatgcgcgcgggcgtgcacgtcgccatcgtcaccgccgcgggctaccccaacgagccggagcggttcgaggagcgcttcgacggcctactggccgccctgcgctaccagcccaaggcggtggtcaacaggtgggtggtgaggggtgggcccctgtgctccttgcaagtggggtggcctggcgggtgctctggcaggatcaggatcgctgacaagtgggagtag

SEQ ID NO: 3995 - DNA, 828 bp, Chlorella protothecoides
atggctgggctcgaacgcagcttgggcctgcgatgtcctgccgcggtccttcacagcaattacagccgtacatgctctcagagatggtttcggaaaggcccccagggccctcctcgctcccgcttcccgtcccggcttgcggtgcagagcctggagcgcgagcaggccgagctccagggcgatgcccagccatccaccagccaggagggcgtggacagcagcacctccgaatactggcaggagctcatcagcactcccgacagcgagctgttcggctccagggcccgctccgcatcggatgcagcggtgctgcgccggaaggggcacctgaaggagcaggacaagttcatcaattttctgcaggagatgcaccgaacgcacacgtgccttgaggtgtgcagggattggaattggcgtctgggggtgctatgcagactgcttgcgcccttgcatggtcgccacaaggtgttgtcgcgccaagcacacaatcctggacggctgcccattcaaatcgattctccccaccaccacaggtcatgcagaaggtggagcagtgggctctggagcaccaccgcagcccccggtccagccgcctcaaacgcatggtccccagcctgggcagcttcttcacccccctcaggtgggagcagcatggtgatgagcaggtgggagcagcatggtgttgagcaggtgctgagacgaaagagcaggtggctaggccctgtacaggcctcgaccagcaatgcagagactcgtgcacaaccacccacaagcgcccaacttgtgtcctcagaacacctcctgcgggatgccaccgccacctgctag

SEQ ID NO: 3996 - DNA, 1473 bp, Chlorella protothecoides
  modified_base (62)..(71): a, c, t, g, unknown or other
  modified_base (1069)..(1078): a, c, t, g, unknown or other
  modified_base (1189)..(1198): a, c, t, g, unknown or other
atgtgcaaattgcccatgttctacagcaagtggccatgggagcccatgtatgcacacattgnnnnnnnnnnagtggcgaagtgcgaattgcccatgttctacagcaaggggccatgggagcccattggcactgcttcccgtcatgaccgctgcacacggagctgtgtccctggggaccagacggcccatgcgcgtctcctgccaggccaccaaccccggaggccgtcaaagactcatactcccaggggatgcgcagttcaatcagggccccggtcagcagtcctcccgcctgatcattcccgggcagggcaacagcagacagggcgggtcctcctccctgtccatgaaccaaacacgcgatttccgcccgccccccggcttcatggacctagactccccggacgcagccacccagccagacccctccgacggtccctccctgcccgcggaggtgatgctggagcgcctgtccagggagagcgacgcatggaccaccctggcacggttcctggggcagctggtccccctgggctacgactccgccaccgtggaggaggtggccggggtggagcgccgccgccagcacctgtggctcattgctttgcaggaggcatcaactggctgaggggtggaggtgggggcaggcttctgcgactgcattgtggggttggagttccaaagggacccaggccccagcaatgcagcgggactacaggcctgtgtccactcccttcccgacaatttctctctttacaggtgtacacctcgctcgccaaggacatgaagaagtcggatctggaggagttcgaggtccctgggggcgacgagatcctggcagagctcaagttcctgacccatgagcagcggctgcccgccgtccgatacatacaggctcgacagatggatgcacaggtagggatggcggcgaagctggtgctggggctggcagtgagtgggggtccatgctgtcaccaggcaggaattggttgctgttgcaggagaaggtcatgtgctgtagttttctctgagcctctgtgtcgctgcttgtttgggtttcctgcttgccacnnnnnnnnnnaggtccatgctgtcaccaggcaggaattggtggttgttgcaggagaagtgtgcggaggggcagcaattacacaacatgctatgcaagcccacccacacccatcctgccccnnnnnnnnnnatacgcttgtcgaacctttctacccgccccagtgtgcgggggggcagcaatcacacaacatgcaatgcaagcccacccacacccatcctgccccggccctacagagcgcccgtgtcctcgctcgagccattaaggagtgggtgcgaagggagggggacaagcagggcttcagcaacgcgccagccgactgcctggccttcaagtactaccgcgatgtgagtgccttggggcaggattactgtggcctttcgagagtttgggctgaggggatgtag

SEQ ID NO: 3997 - DNA, 1353 bp, Chlorella protothecoides
atggctgcacaagagcttaagacagagcaggagatagtaaataagtttcagcagctcttggaagagcgcaatgccctctccacggctgccatcgagcggcggtcagaggtggccgagcacgagctcgtcgtcaagaccctcgagcccctggatgccagccgcaagtgcttcaagctgctaggggacatcctcgtcgagcggacggtgggcgaggtgctccccaccgtgaatgagaacaagaacaacctcctatcggtgagttgggtggcgtgttctgtggatgctggggtgaagagattgttgaagcacggacgaccagcgtcattccaccattcacccaatgcacgcagctggcaaggcctgttggattggatgagcgattgcgctgcgaggtcttctgcacctccgtgcaccagggtcaatcccttcgagcaccttgcccccttgtgcagggggagggcgagaatcaggcagctcccaaagcccaagcaccaggcagcgggaagcagggagtcctcgtcagcaactcatgaggctctggggtgcccgagctgtgtgcccgaatgtacagtcggcgtcccacagcagagagcagggagggtgccagtgcgatggtggttgcgccaaggtggggctgctcacagctctgaatacacgtcccctgctcaaagggacaggagttcagacgtcttggcagctgcccccgtggcaatggccggtggccggcagagaaacaggattgcggcgacgtgggaggcgccggcggcatcctcccccggcctcagcacggagaggccgccgggctgcgtggcgctctccaccaaccgccagccgtcgccggcggccgaggcgggccccacatccaccaccaggagccccggtcccgcctttgcgctgcccatgccggcctgcagcacactgcagttggccacccggaggccggcgggagtgccggcctgggcgagcgccggccagagcgggagcgcgacccagtcgtgcgcgctggaccccgcgggcagggccacggtggagaaaaagtcgccgcggccctgggcgcgggggcaggcccgcagcgtggcgggggccgtggactcgaaggcgccggcaatgggcagcaggcgggtgcccaggtccgtgggcatcaggtggagtgtgctcagcctgggcagcttggcggcggcggcctcctcgggggtcggctccttcttgggctccagcaggccgcccagggcctggcgtgccgagggggtgactgccaggtccaggcctgatttcgccagggcggcagactccaccgggtcccgggtctcgatggactgggaggatatcggggaaggggaagggggagagtga

SEQ ID NO: 3998 - DNA, 1230 bp, Chlorella protothecoides
  modified_base (784)..(793): a, c, t, g, unknown or other
atgcaggaccgctctccgaacgcacactcgttcagtatttccccagtacaatacaggatagataatatcaattgtgggcgtgcttcattttcatcttcaaaggctgatgggggcgtgatcgtcagagacgcaatccagcacctgggcaatgtccgtggttttctcattggtgcatcttccattccccacagattgggacctcagcatgccttcagagctcctcgcacacggctggtgtcggtcctccgagccccagcgcggtctctgagcgcggcatcggcccagcccgcctcccctgccaaggattccaagcgcagtgggcctgcctcggagcagagcgtgacacctctgagtgaagacttctccaggtggtacctggatgtcatacgggaggctcagctggccgactatggcccggtcaggggtaccatggtcattcgcccctacggctatgccctctgggagcgcctccagtcctggctcgatgcggccctgaaggagcatggcgtccagaatgcctacttcccccagcttattcccatgagcttctttgagcgcgaggccgagcacgtggagggttttgcgcctgagctggccatcgtcacccgagaacagggtgcacactgttccagtcagagtcgtgccagcatccgccagcgccgcctccttgtctgcccgcagcccatccagccagcctaccagtgtgcagccgtgcaccttgattccccttttccgccccccccccctgcctcaaaatccaggcggcggcaaggagttggaggannnnnnnnnntttgtctgcccgcagcccatccagccagccgtccagtgtgcagccgtgcacctttgattccctttttccgccccacccccctgcctcgaaatccaggcggcggcaaggagttggaggagccgctggcactgcgccccacctctgagaccatcatcaacagcatgtttgccaagtgggtgcagtcccaccgcgacctgcccatgcgcctcaaccagtgggccaatgtgcaccgctgggagatgcgcacccgcccctttgtccgcacgctggagttcctgtggcaggaggggcacaccgcacacgcgaccccggaggaggcccgcgccgaggccatggccatgctggaggttgggaggcggtggggggagtggaggttggtgcgggggcaggcaggaactggagggctgcgaggtcccagggccactctgatcagctga

SEQ ID NO: 3999 - DNA, 696 bp, Chlorella protothecoides
atgcccctccacgcgccctcccactgccttgttttgcatcccttcccggccaaccccgaccccgaaacacccaccaaccaccctcaggtttaccgcgagttcgcggtgacccaggccgccatgcccgtgatcgccgggcgcaagtcgcgcatcgagcagtttgcgggcgcgaacgcgaccttcaccatcgaggccatgatgcgcgacgggcgcgcgctgcaggccggcaccacccacgacctgggcgacaacttctcgcgcgcttttggcacccagttctccgacgcagaggggcgcctgcgccatgcgcaccaggccagctttggcatgagcacgcgcatggtgggcggcgtggtgatgagccacggcgacgataccgggctgcgcctgccgccgcgcatggcccccctccaggtcgtgctcgtgcccgtggcggcgcgcggcgcggccgccgccgccgtgctggcggccgtggatgccgcactggttgcgctgagggcgaagggcgtgcgcgcgcaggcggacgtggggacggagaagtcaccgggctggaagttcagccactgggagatgaaaggcgtgcccctgcgcatcgaggtggggcggtgttttggtgttcttagtgaggagcgaagggtgagggaggggaggactggtaggttgtggagagggtccaggacagcgtccagaggatga

SEQ ID NO: 4000 - DNA, 2004 bp, Chlorella protothecoides
  modified_base (508)..(517): a, c, t, g, unknown or other
  modified_base (1348)..(1357): a, c, t, g, unknown or other
atgggggtggaatcgtacttgaatcccctcaccacccagctctcttggacccgcctcacgcaggcccacgccgacagcctggcttgcgcggagagcacggaggccttcctcgccgctttcgctgccttgctggaagccgagggcatcgtgctgccaccgtcctcctcatcccagtcccacgccggcgtgtacatagcccacgacacgcggcccagcagccctggcctggccgaggcggccagggtcggcgcggctgcgctgggcgtgcctacgcacgacctgggtctgctcaccaccccgcagctgcactgggctgtggcgcgcacggcgccgggcgagcacttcaacgaggacgactactacgccgagcttgccggcgcctatgcagctctggtctcccgtgctgccaccggaagtggcgctgaacccgccgacggtggcgctgaatccgccgacgtgtcgatgaccggccgtgccgcccccccctcgacccccagcgtcctgcatnnnnnnnnnncgggcgagcacttcaacgaggacgactacttcgccgagctggccggcgcctatgcagctctggtctctcgcgctgccaccggaggtggcgctgaacccgccgacggtggcgctgaacccgccgacgtgtcggtgaccggccgtgcccccctcccgtcgacccccaccgtcctgcacgtggactgcgccaacggggtgggcgcgcccaagctgctggccctggcggaccgctgcaccgccgcggggctgcacctgaccctacacaacacgggtgagggcgcgctgaacgggcgctgcggcgccgacttcgtgcagaaggcgcggctgctgccggacgggctggagggcgcagggccctcctacccctgctgctccctggacggcgacgccgaccgcatcgtcttcttcgtccccggcacgggggcgggcctgacgctgctggacggcgaccgcatcgccgcgctggccgcgctgctctgcgccgacctggctgccgcgctgccgcggggactgagcccggcgatcggcgtggtgcagaccgcctatgccaacggcgccgccacgcgctacctgaccgaggcgctgcgcctgccggtgacggtgacccccaccggggtcaagcacctgcacgccgccgcccacgcgcacgacgtgggcatctacttcgaggccaacggccatggcaccgtgctcttcgcgcccgcctacctcctgcgcctcaaggagtttgtgcaggcgggtgtgggaggagggttgggggaggggggttgcaattgccaccacaaggaaggaacggatctgtgctggtcaatggaagaccatatcgcccccnnnnnnnnnngcgcctcaaggagtttgtgcaggcgggtgtcggaggagggttgggggagggggggttggggggttgcaattgccacgacaaggaaggaacggatctgtgctaacggtgggcgacgcgctttccatcttgctgctggtggtggtggccctgcggcggcgcggctggacgctggaggactgggcgggcatctaccgcgacctgccctcgcgccagagcgtgcgcagcgtggcggaccgaagcgtcatcgtcaccgccgacgcggagcggagggtcgcccgccccgcagctctgcagcccgccatcgacgcggccgtggcagcggcgccgcagggtgcgatgggttgggtttcaagagtgtggggcgagttgccaattgtctgtgtgccacatgcagaagtaggaggtgcgggccagcgatccaggcatgctcgttcgcctgtacgccagggggatgcgaggtaaacagcattcaccctcgcacccacaggccgggcgtttgtgaggccgtcgggaaccgaggatgtggtcaggatctatgcggaagctgccacccaggaggatgcggatgccctggccgcagaggtgtcggaccttgtggccctgcatgccggcggcctgtgatccccgcacctgacgagccctcctga

SEQ ID NO: 4001 - DNA, 360 bp, Chlorella protothecoides
atggcacggcaggctaccgtgcgcttgcccccctgctgccctccaccgtattcaggtgaagcgatcgggatgtcaagccggtgttctggcctctgccctgcatggggtccgcactctgtcctgctgagtacccagcacccggccccctcaccgccatgcaggtgtggcgtgctcatggctgtcaggtccctgctgctcgatgcccccactggcatctgcatcacagcctcacacaaccccgcacccgacaacggtgtcaagctggtggagtccaccggggagatgctgacccggtcctgggaggtgggtggctgggggccatggaggcgagaacctgggatgggggagggatcgtactag

SEQ ID NO: 4002 - DNA, 558 bp, Chlorella protothecoides
atgcctgcgccatgctccaaggacagacccaggttgcctgcacaactagaagcatgttctcaccttggtcagaatccacccacgttcactcttcctccgcggcagatcgccaccgccgcgggcgccaagaccacggccgctcggtccatcggccgcacggtcgccaagatcgccaacgacgaaacctcgggcctgccctggtggcgtgtggtgagctctgtcggggccctgcagtccaaccctgcgcgccaggaggcgcagctggagaggctgagggcagagggcgcgcgacccaacgaaggaagacaatgcttgggcgcattgccagcgcctgccagtgcaccaagcccctccatcgacttgtcttctgcaggggagggcatcaccgagtgggcggcccgcgtcggcgccaaggtggtcggcacctacgcgctgggctccttgcgcaccgtgtttgccgactacgacaacgatgatgtgacggtatgcgactggtggtgtggagctaggcccatgggggagttgggtgcatggaaagcctggcatctgcgacggtga

SEQ ID NO: 4003 - DNA, 1734 bp, Chlorella protothecoides
atgagatcccgatgctgcaatgcggttggcctgtcagcaaatggccaacaaaccatctcaaggcacgctctctccaaggacccctccccctcaccgaaacctgttcaactgcatggtctcccaccaaaaccacccccgccacccgcgcagctgctggtgatggacgcggtggaggagctgcagcggggcgaggacacgcgctggcgctgggtggcctactcggccaccgacgcgcgcgcgacctgggacctctacgccgcgctgcgcgagcggctggaggccatgaccgacgtggcattggaccccggcgtggcggccgagtacgcggcggcggggcgccccatcgcctccatgtgggacgtgtacctccgcttctggcgccccttcggcgagctgctgacggagatggaggcgctgggagtgggtgtggaccgtgcgcacctggccgccgccgagcgccgggcggtggccgaccaggagcgcgcgcgcgccgccttccgcgactgggcggtcgcgcgcgtgcccggcgccgcacacatgaacgttgggtccgggacgcaggtcgcccagctcctcttcgccggcgtgcccaacggccgcgacccggccaaggcgggggtgcctctgtcccgcgaattcaaggtgcccaacacgctgggcgtggccgagggggggaagaaggcgaagaaaaacatcgccgtcaccctgcacgggctgtggggcgagggcgtggcctcacccctggtccccaccgtgcacacgccctcgggagcgcccgcctgcaacaccgccgtgctgaaggccctagcagggccgcccggccgcgccgccaaggccctggctgcgctggaacaccgccccggtgcgggtctgggcctgggggattccctggacccggtgggcgcctgggacgacgcgagtggtgtggaggctggggcgatgggagacagtgagtccacagcagacctcgacgctgacgggggtgctggtgcggccgctgacgccagcgccaaccctgccggcgccgtcgcagcagagcccctggacgcggcggatctggaggcaaagcgcgccgccggcggccacggcgcgcttttccccctgtttggctcggagttggagggcctgcgcgcctgcgcggcggtggacgcgctggtggacgtgggcgccatcgacacgctgctcagcaacttcatcgtgccgcttcagcaggacgccatcgccaagcccgcggccgtggactgggccgcgcggcgccggggcgaggcgggggtgctgggcgcgcggaacctgtcgctggcgggtcgggaaggaccgaccatggggcagggctcggggggtggtctccaggctccagcagcgctgcatgactcgacagtcgacggccccccaccagcccctgccgccgcgtaccgcgtgcactgctcgctgaacataaacacggagacggggcggctgtcggcgcggcggcccaacctccagaaccagccggccttggaaaaggatcggtacggcgtgcgccgcgccttcaccgcagacctcgctgcagggcacacgctggtggtggccgactatgggcagctggagctgcgcatcctggcccacatggccaactgccggtccatgatcgaggccttcgaggcggggggcgacttccactcccgcaccgcgctcggcatgtatgatcacatcaaggcggccgtggccagcggtgcgcgggttggggtggggtga

SEQ ID NO: 4004 - DNA, 1803 bp, Chlorella protothecoides
atgatcttgttctccctgctgccttcccaggtgtcctgcctgccaaaaattccagccaatctaccaggatctggccgcgcacttccaaaaagatccaggactcgtcgtggcccgcgtggactgcgcagagtatgtgagtgtggcatgcatgcttgccgcaaccgcctgggaactgacctgagtggggccagcctcaacgacgttgctggctgggaggggtgcccacgggattgccactcagcgccacacccctgcccctctcacggcagaaggatcgctgaccaagatcgcggccgtaagaatcttggacaacattgtcaaggagctgaaggggtgagagttagcgtgcatggactcaacagtgggtcggagaggggctggctggctgcctgccgtccgcggggagtgctggtggaagcccttgaatctgcagttcaaaccacccccctgctactcctgggcaatgcaacacctcgcatggctgcggccaggcctcatcccaagctctcgcactctaaacacagtgtcatggacgcctccaaggaggcttcggcgctgggacgcaaggccggcggggagggcgcgggccaggggtccgaggccctgcgcatcctgccagctcccgtgaccgccagcctgaacgatgtcgagggcgccacgatggagtcctggcgcgtggtcacggacgcgcccgccgtcctgacgggggctgacgcacgccaggcgctggcggactggctcgcgctgctggcacgcacgcaccccagcctcctgcggagtccaggctgtgacccctcactccctcgcacgcgcacactgaaccgtctgtgcaggtgccaggcgggcgcggcggccatttccacccagctagataccctctggccgggggaccaggagaggcccctgcctggcctgctgcagctggacatgtgtcctggatctgagttcaagcacccgcggtgcaggttcctccggcactggggtatcgaggtcacgctccaccccctgagcccctcccaacccacgacacccgccacaagcacaggcgtaccagacctgtggatcggctgcgggggccaagggcgatggcttcacatgcggcctgtggcagctgctccacaccacctccgtccgcatcgccgacgccccgcgcgccggcgccaactggcttgtggccgtgcgcggcttcgtgcgccacttcttcctctgcagcgagtgcagcgaccacttcgtcaagatggccaccgacgcggcggcggcgcgtgtggccagccggcgggatgccgtgctgtggctgtggcgggcacacaaccgggccagcctgcgcctggcggtggaggaggacggcggcggggggcggcgccacgagcagtggcccaccagtctgctctgcacgcgctgcaaggtggaggacagcgaccccacggagggctgggtggaggaggaggtgttcgccttcctcatgacctactttggtgcacagggcgcggcgcagaccccgcagaccagctcccggtcggtgcagctggggaaggcgggagcgggaaatggatggggcgccgctgccctcatcttcctcgcggtggctgtggcgctggctgcggtgacaaagggggtggcgcagtactcgcccgtgaaggtcagagccttctgagcactgggcctgggtgtgctggacctggtccacggggcaaggctgagtcggctgctccggagagcctcatgcctccagattcatatctctgtcggctcttcattgctgttttccctcatcccatatgtattgaaagctcggtgaagtga

SEQ ID NO: 4005 - DNA, 522 bp, Chlorella protothecoides
atggctgcatccaggtggtttgaacgtcagacagacggcagtgatcgtgagcggcgtgaggtggacttgggcggcaaggagtttgagcctgacctcatcccaccagagtggaaccagtggctgcgcaggacgcgagtagaaccgccatctgaagaggacatcgcaaagtgcgttgtctttggggaactgggatttcgaggacggtgccactcatgtggctgtgcttgcaggggcaaggcattcaggcaacaggtgcagagcagggcagcgttccatgctgcagaggacatgcggcgcgcagcccgggcacgatcaagcgtggaggaggagtatgacagcactgatttcatccatcagctgactgcccagagcaccgacgctcctcccaagcacattccacacggcgaggaagatgtccttcaatcgcgtgccagtggatttccggagcaaggactgacagtcggcgccgtcaggaaacgcggagcatgcagaggtggctcgtctgccagtagtggtggctga

SEQ ID NO: 4006 - DNA, 1140 bp, Chlorella protothecoides
  modified_base (891)..(1025): a, c, t, g, unknown or other
atggtggcaaccacggaggtgaatgggacggcagggcccatcatccccgtggggtccgcccagtcctccctccctgcccctgacctggctggactggatacccagacccggaaaatcgggctcatctacccccctcccgacattcgggcgattgcggacaagaccgccctttacgtcttcaagaacggccccgacttcgagcgccgggtgcgcgccaacgaggctgagaacaccaagttcagcttcctgaagcccggggacccctaccatgcctactaccagcacaagctggcggagcatgccgcccccgcggcagaggaagaggcccctgctgcggccagcgcagccgctgccgccccggccgcggcgccggccgccgcgccggcgcccacccccgccgcgccctccgtgctggcccccacccagcccctggccgcccctgcggaggaggtgtacacggtgcatgtgcccgagggcctcacccctctggacctggacgtgatcaagctgacagcggcagcggtggcgcgcaacggcaagaagttcctcaccgagcttgcctcgcgtgagcacgcctcgccccagttcaacttcctcaagcccacgcactcgctcttcgccttcttcaccgccctctgcgacgcctactccgcggtgctgatgccgcccaagggcctggccgccgaactggcggccgacgccggctcgcgggcgcgcgtgctcgagcgcgcgctgcgccggctggagtgggagcgcgcgcgcgactcggcggcgcgcgccgcgggcgacgcggaggaggcggagcgcgcggccatgcagtccatcgactggcacgactttgtggtggtggagaccatcgacttcttcgaggacgagacgggggcgctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgaggctgcacaggcggaggccgcggcggcagggggggcggcggccgtggacgagcaggcgctgcccatggacgcagaggagcgggcgctggtggcgcaggccgcgggcgcg

SEQ ID NO: 4007 - DNA, 588 bp, Chlorella protothecoides
atgccaatactccattccccttccctggcaccgcaaaggtggtttgtggccgaggacgcggcagccagggtgcgcacgctgtgctgccgcggggtttcctggacccaccccagccacgactccctcggcctggcgaaggccctgctggccgcctggcccgcgcctgcgcctggtgtgccgggcctctccctgcattccggggtggctggcctggctcaggacctggcagcccaggacctggcagcccaggtggggccctggctcgactctgcgcccgccagcatacggctggtggggcacagcctggggggcagcctggtgcaggcgctgctggctcagcgcggcgctggctgggccgcccgcggtgtggagctggtgacctttggctcgccccccgtgctcgccctcaacgcggcgccgcccgccgaagacggcgctgggggggagcatgccatgctgagcatgctggggctgccctcggcgaggcactacgtcctgggcaaggacccggtgccggggctcctcctttccgccaagcccctcctcacctccctgggcgtgggtcgccttggtggggcgcttgggtga

SEQ ID NO: 4008 - DNA, 351 bp, Chlorella protothecoides
atggccctgcacagccacccacgctgccgcctgctgggcagggaggggcccggccggcgcttcgcagaccgcgccctgaactcctggctggcgcgtaccttccatgctgtgcacgctgcggcgccgcagcccgtggcccttgggccccacggtctgcaccacgcccacctcttccgcgcgcatgctgccgggcagggcctgggcctgctcttccacgccgcagagtatcctgcctactgcgagcaggggttccccgttcacctggggtactgtcaggcgggcagcaccttgcagtacagcccagacaccatggcctggcgcaactttgtctggtgggcgggcgggaagtga

SEQ ID NO: 4009 - DNA, 993 bp, Chlorella protothecoides
atggccgtcctctgtcaagtagacagtgccgtcgctgacctgaaatcaatcaaggctactgagggccagcagaccgagatgcgtgccatcctggagcgcctgcacgcctcccggctggaagatgccgcctcgcactcatccggcgaggaggagggcgaggaggagatccgggagggcgagctctcggaggccacgattcggcgcatcctggcccgtgccgaagctgggggtgagctggaagtggtggaagaagacctcactcccgcagagctggctgcctttcacgctgcactggagtctgaggaggtggggcgcatggtgcagccatgggtgccgtggtggaccctggaagctgcccgggaccccctcctgccgctgtcggcgctaaccaagaacccaccctcacccttgctgccctgcatcctgcctcagctcctctacgcctactgctacacgcttcgacgccacaacggcgagcctgacgtggacgcactgggcgccggcgagacgctgctgatgctctggccgggtacgaaagatccaccaccaccctcccctgtgcatgcgctgcgccaaactctggccgacgcagtggggagcggtcgtggcggcgccccccacgctttcttcgtggctgtggttggggacgctgtgcagctgctgcggctggggaggagtgccgtgctgctggccctggtggatgccgctcggatggcgagccgtgcgcgcagcgctgccgaagacctcgaggacgacgcagtgccggagcggatgcggcagggtcgaaaggcgtttgtcaggcagctggcggcagtagagaagaagctggtcttcttcctggcttgggcaaacgagctggacgacgggacgctggaaagcctgggtgacggactggccctctttctggaagaggagaccgcaaatattaaggctcagaacgaagcccgtcagaggcctcccgccacccctgtgcctgtcatcaccgagttgtga

SEQ ID NO: 4010 - DNA, 357 bp, Chlorella protothecoides
atgactgctcagtaccgtgagtggggatgcgctgcagaaccgacagcctctctgttgacattcaaagtacgcaaaagccccgtcccctgcccgccatgcctgcccaggtacgggggctcactggcggcgctggacacggggccatcgtcgccactcaaccagcgcctggtgtaccccggcttggaggcgctcggtacggtgtacgagggtagctttggcgactggctggccgatgtgtactacatatcttggtgggcagagagacggcgccagcagcgcatcctggtgtctctgcccggcattccccatgcccctgcccgccggcggcgtcctgagctcgggcgacaagggggctga

SEQ ID NO: 4011 - DNA, 756 bp, Chlorella protothecoides
atgacgacccccgtgggtaccacagcggagctggccaccccccccgctgagcccgaggccgccgggccaaaggtactgggcatgtccgaggtcgccggcgcgggtttcctggccgcccagcgtgaattccacgagcgctgccccaacaccccgcccccccacgtcctggtggtgaacacgctggcgggggcgcaggctgcggccgcgcggctcctgtcccccgagctcaggggccgggtgtttgcctgcgataccgaggtctccgccatcgacgtcacctcccagtccccatgctgccacggcgacctcatctgtttctccatccactgcgggcccgacgtcgactttgggggcggggcgtcgcccagcgtgcagagcacgctgtgggtcgacacctacctcgacggcgacgcctccaggaaggaggaggcggcggagatcctctccctcttcgcccccttcttctcgtccccggaccaccccaaggtctggcacaacttctcatttgaccggcacatcgtggagcgcgccggggttaaacacgctggctttgaggcggacaccatgcacatggcacggctgtgggactcctcgcgctccggcaagctgacatactccctggagtcgctgtcctctgacgtcgcgctgatgggctccagcgccgtgcccaagatcgggatgaaggacctgtttgcgcggccgaacaagagggccgacggcactaacggcaaggggttttggcgggcagacgggtga

SEQ ID NO: 4012 - DNA, 450 bp, Chlorella protothecoides
atggtggcggctgcagcgctgcacagccacaccagagtcaccctcctcaacccatcaacattgaccccgcagatcgggccgagggacgtggcgtctgggacatgtgccatcgcgcgccgtgaccgtcctggaaaggaaggcaaggagtttggcgtcccgctggctccagagctcctggtgcaggaggtcctgaagcggctggatgaggtccaggctgagctgctggaaagggcgaccaggttcagggacgagcatatcctggatgtgtcctcccactcccagttcttggaggtcattgagcaaggcagcgacgagcaggaagtcgccctgaaggaggaaagcggtgcgacgctgcggtgcttccccctggagcagcctgacggggggggcacctgcttcctgaccgggaaaccggccgatcaggtggccctgtttgcaaaggcgtactga

SEQ ID NO: 4013 - DNA, 831 bp, Chlorella protothecoides
atgggtggggagtgcaactacctgctgcgcgtggaccgggggcgcctggccttcgtccccgactccgagtggaagagcgagttcatggccagctggcgcgaagacgacatccacgagctgctggagaccgcggagcggctgctgctggagggcgcggagcgcctgcgcctccccgtcagcgtggtgcgtaaggagcgcgcggtgggcgtggtcccctccgcgcccaccatctacgaggtgctggaggagctggcgctgaccgtgcacgccggcctgctggcgggaccgacccccaacctccccttctgcgccttcaatgggggcaacgacgtcttcgtggacgtgggcaacaagagcatcgggctggaggcgctgatgcgctacgtcggcgtggggcccgaccaggccctgcacgccggggaccggttcaccgactcggggaacgacgtggccacgcgcgactgctgctccatcatctgggtggccaacccggaggagaccgacttcttcatcaagatcctgctggcagacatcgagaagcgggaggggaggtgggggaatgggggaccgcccgcgtccgcacagggaatgtacactgcctttgtctgtgggatcagcgaggatggtgcagggggcgtcaagaacgaggtgtgctgtctctgctttgctggtcatctcaacgacttcacaccccccttggcaaacctcttgaaccctcacctgggtgtaatgctccagcacctccttgccgtgttcacgccccaagccagactccttgtagccaccaaagggcaccgccgcatccagaacatggtgtgtgttcacctgtag

SEQ ID NO: 4014 - DNA, 657 bp, Chlorella protothecoides
atgcacggtgtccacagcaacaacaaagaggactgcagccacatctcatgtccaaacatcattcggtcgctgttcctgcagagcatctcatcgtatcatcggcacaccggcgttcgaaccagctccgtcatggcggacgcctccaaacgcccgctttcagacggggaggaggccggacccagtggtgcgctggtggagatcaagaggcaacgattggacgagggcgccgtcgttcccgctggacccgcctcatccctggcgaccaagccgcaggtgagcaggggtccagtgctcctgtgcccggtccccctttcaccgcacacctccgttggcaatacacagggtccatcccgcacgtctgcgcttctggcgcccaccatgctgctcacaggccacgcggatcaggtgttcaccctgaagttcaacccggacggtgatgtcctggccagtgggagctacgacaagaccatcctcctgtaccgcacctacggggagtgcgagaacttcctgcaaataaaaggtggggtgccgggctgcagctgggaacgtaggtgggggagggggaaaggctcgggcaggtggtgggagcgcctgatcggcgctgcagccccctcgcccacagctcatgccccttctcgaacaacccacattgaatag

SEQ ID NO: 4015 - DNA, 1845 bp, Chlorella protothecoides
  modified_base (997)..(1006): a, c, t, g, unknown or other
  modified_base (1465)..(1474): a, c, t, g, unknown or other
atgccccttctcgaacaccccacattgaatagggcacaagaacgggatcctggagctgcactggacgccagacggcctgaacctggtctcctgctctccagaccgcactgtgcgggcctgggacgccagcaccgggcagcaggtgaagaagatgagcgagcacggcgacatcgtcaactcctgctgccccctgaagcgcggcagcccgctgcttgtgtcgggctccgacgacggcaccgccaaggtgagcctgtcgtgggagtggtgcttgttatgggggaaagggaaggttgggggcgtggagggttgactggcgtgggcaccacactcgctagattgctgaaatgccctggaagtcccaccacagtccctccccctcccgcaatccgccaggtctgggacctgcgcagcaaacggtcggtggccaccttcacggaaaagtaccaggtcctggcagtggcctggtcggaggccggggacgcggtgtacacgggcggcatcgagaacgtggtgcgcgcgtgggacctgcgccggggcgccccctccctgaccctggcggggcacgccgacacggtcacgggcctggcgacgtcgcccgacggcgcgcacctgctcagtaactccatggacggcacgctgcgggtgtgggatgtgcggccctacgcggcgcaggaccgctgccaacgggtggtgacggggcatgtgcacaacttcgagcgcaacctgctgcgctgcgcctggagccccgatggggagcgcgtgaccgccgggtcggcggaccgcatggtctacgtctggcggtctgccgacggcgcggtccagtacgcgctgccggggcacggcggcagcgtgaatgaggtggtgttccaccccaccgagcccatcgtcgccagcgccagcagcgacaagaccgtgtacatgggggagctggcagcagcaggtctctcctcgcccgagccttcggggggcagtgcgctggccgtgggagggagtggcnnnnnnnnnngtggtgctcagagcaggtctctcctcgtccgagcctacgggaggcagtgcgctggccgtgggagggagtggcaaggcacaggcaagcttgacagcccgcagcgatgtcctccagtggcaactctctggtgcctgccatcgctttgctgcctcctccttgatgcctggcggctcttgagccccctcatgcactcccctcccctcctccagacatcctccagtcccccccaagcgcacacagcatgtaatgacctgacctcacaccactgtttgcaagctcgagctccttcaaaaggtgtcaagcatggagctgcacgggacaacgcaatgcgcgggggtggaggtgctcggacggcgaatctcagggcgcggtgcagcaacccgattcccaccacctccggaatgcgtcagtcggccgcgccaccccccgccgctcccccaagagaactgctgggcatcnnnnnnnnnngacatggcgctgcacggacaacgcaatgcgcggggtccgaggtgctcggacggcgattcccagggcgcgtcgcagcaacccgattcccaccacctccagaacgcgtcagtcggccgcgccgcccccagccgctcccccaagagaactgctgggcatctcatgcaggtccaggtccaggaactggtgccgcagcacaggacccagcaggtctggaggccagtccagagggttggggttggcgtgcaagaaggtggcggccgctgccctcgcctgctctaagagagcggcatcgcgcggcagcgagcacgcctggaagtttgggggtggggattcaaaggaaggggggaatatggcggcagggctggtgttga

SEQ ID NO: 4016 - DNA, 537 bp, Chlorella protothecoides
cgcggcgaccgcgcgcgcgccgccgcgggcctcgccgacggcagcgtggcgctggcggtgggtacccacgcgctgctctccgagggcaccgcctttgcgcgcctgggcctggtggtaatcgacgagcagcaccgcttcggcgtcgcgcagcgcgggcggctggccggtaaggcacggccgccgccccacgtcctgtccatgagcgccacgcccatcccgcgctccctggccctgctcatgcacggcgacctgagccacgtggtcatccgcgagcagccgccgggccgggggccggtggcgacgcgggtgctggactcgcgtgacgaggccgcacggcggcaggtgtgtctaccagcacatcctggaggaggtggaggcggggggccaggcgtacatcatctgccccctggtggaggaaagcgcggcgccgggcttcgacgatctcagggccgtgacggaggagcacgcgaggctgacgcgggagggggtgctgccggggcacctgtgcggcctcctgcacggccgaatgaccggtga

SEQ ID NO: 4017 - DNA, 261 bp, Chlorella protothecoides
atgtcgccaatggacattggagaggctggggtctgcaccgctcgagaggggtggggggcgtgctcgctgccgcgcgatgccgctctcttagagcaggcgagggcagcggccgccaccttcttgcacgccaaccccaaccctctggactggcctccagacctgctgggtcctgtgctgcggcaccagttcctggacctggacctgcatgagatgcccagcagttctcttgggggagcggctgggggcggcgcggccgactga

SEQ ID NO: 4018 - DNA, 369 bp, Chlorella protothecoides
atgtaccgactcatcaacggcgactactatgggttccgagatgaggatgatggcgtgctgctgaaggtggaggcagaggcggaggcccagctgcgagcccaggcaagcctgagggccatccaggagtgggagcagcaggaggcgcagcggcagtccagcgccgctgccgctcgggggacctccgccacagtgcaggtggaccctgctgagtcagcgccccagtttgtggcctacgtacccctgcccgacgcccaggagatcgaggcacgtgtgctggaggggaagaaggcggcactgctgagcaagtatgcctccgaggccctgcaggcagaacaggcccaggcccggcagctgttgaaccggggatga

SEQ ID NO: 4019 - DNA, 498 bp, Chlorella protothecoides
atggagagcagcctttgccccagtgcatccccattcgaccacactctctcacacacaccgcatgcttgcaggatacgagacctgaatgacgagatcaataagctcatgagagagaaggtgcactgggagcgccggatcgtggagctcggtggcccagattactctaagacgggaccaagggtgacggactctgaggggcgtgtgatggccgagaccagcggtcgaggggccgggtaccgttactttggcgctgccaagaacctgcctggcgtcaaggagctgtttgagaaggaggcaccgcgccaggtggggagatgggttgttgcaagggggagggctatgggtgcactgcagctgggtatgcaggagatagggctggagctcgtgcaagtaaaacaagtctctttcatgcaggcacgcgcagagcggtgctgctgccgcgcatcctgcatcggtcgcattcaagtatactcccttctccccgccgatgcctcatga

SEQ ID NO: 4020 - DNA, 4167 bp, Chlorella protothecoides
atggtatctgccccacccccacccttctccctcctcaaacccttttctccaatcgatgcagagtccaccaaccagttcccggcggacgccagcgacgagggcgaggtattctacgaggccctgtcgcggtcgcagcgacgctccagcgccgggaccagcgccgccgccagtcgctacttcagcgcgggcggcagtgtggacagcgagggggcgagcacgctgcagctcgaccccggccccgcctgggtggaggagggcggggcggagagtcccctgggccccagcccacgcatcgccagccccccgcccctcgccgtgacggcgccgcagctcctctggcgcctgggcggcggcggcggcgggggcgtgccaaacggcgagacgcggtgcacagccgcgctgcatgcccgcctggcgagggatattctgatcggcggcgaggtgaacctggtcgttccggtcctcgccttccacgcctcggccgacgtcggggcctgggaggaggccgccgcctgcgtgttgaaccacgtggggctgatgggcggcgcactgcccgacctccgtgcgttggtgactgcagaggagaacagcgccgggggcgacgcgggcgacccggtcggcacgagcgaaccaggcgacacagggccctccacggcctaccccctgcgctggcacgtgcgctgcgcctgcctgcgcgcgacgctggtgtgcaacgccgaggagtccggcccggggtcggccccgccctcgccgtttcacagtgtgcgaatggcagacagacactctggcgaagtccagagctggcgggggcccatcctcgcccttacccttcaggccagccttgaggcagaggcgagggtgggagcggacgtgggactcgctgcggttacgaaaacggaggctggggcaatcgctgatgcagcgcccgaagcggcgtggtggctgcagctgcgcgttcctgggctgctgctgagtgcgggcctgggctctgcagtttctgatgcagaggagcgggagcatggcgccgcgccgagcctctcactcggcgcggggctggcggggatcgccggcttcgagctgcgctgtgtcgggcctgttgctccccgcccagacggcccggatcgccaggcgctgccagtgctggatgctgaacccatcgccaaggaggaggaaggccaggcaccgggcgctgctctactcacgagcatcgtatcatcagcacagagcgcggagcctccggggccgactccgcagtcccccgaggagccgccggggtcatcggcgcacgccgtgcaggtggatctcgcgctggcgcgtggctcggtgtggctgagccaggagacggcgggtgtggccctggcgctgacgcaggcgctgacgctgctcgcgcaccgtctgcaggcgcaggccgccgaggcgatgccgcacggcggcgccgcgcggcgtgccgtgcgggacaagggtgatgatgccaaggctctcaccgcctgggagctacgtgcccaagccggcatcctagctgttctcgtcggggtcgggggcgtggacggcgtggggcgcgggcgctgccccttactccaggcggcggctcacgacctgaaagcgtgcgccggctctgggactgccacggcgcagctgggctgccggctggaggtccggagctgggcgccgcagctggccggctgggagccggtggtcgagccgtggcaggtgcgcctggcgctgcgtggcgcgctggaaagcgcggggccggggccgaccccgccgctgtcgctgtccctcgaatccgacgacctgctggagctgacggcgagcgagggcggggtggcggccgcggcgcgcgcccttcagtcctacgccttcctctccaccctgaccctggcgggtgcgggggaggcggtgcgcgccgcgcaggcagctgcgggggagccggcgctggcggggggctggacgctggtcaacgccacgggggcctcggtggagctgtggatgggggggctcgtcggcgggggtgccgccgaggccggccctgggggttggtcgggcacgtcgggccggcgagacatgactgctctcgagcggccccacctcacggtgatcccgggtgagcgcgtggacctccctgtctggcccggctccgatgacaccctggctgacctggcggccgggtgcgccgggtaccccgaccccatgctgggcgtgcggccggcaggatggcgaggcgacatgaccggatgctcacccgacccctccgacccaccctgcccgccacgccacacccgggtgtacttccgcggctcgggcggcacggcgggttgcgtgcccctggccgcccccggcacccacacgtatggcgggccctggcctggcgcaggtggccaggttccggggtcgcggggggatggcgccccccgaccccgcgtgctggccagcgtggcgcgcggccccgacccctgggccggcacctctgtggtgctgcactctggcctgcgcctggtcaaccgcggcggcgtggcgctggaggtgcggctgcacacgcccctcggcttcgtggccgaggccagcccccgggccagcctgggcgcgctgcagccgggccagggcctgtggctgcccgtgcagcacgcgctgctgagcgcgctgagcttcaggcccctggctgtcggcggttgtcacggtgccggccacgacgggcatcatcaaggcggtacgcatggcggtaccgtcagccgcaccggatcgggcgtgctcttctcgcaggcggggcccggtgcagccctggcgaggcacccccccttgcacccgcccgtggtggctgccggttcgacgaccggcggcccaccccccgcgccggcgctcctggcgcgaaggtcgctcgaccgcgccaggagctttggtgccagtggccccttggagtggagtgagtcggtccccgtctcgcagctggtgggaggggccagggcgggcgcagccgccgccggcaccttccagttgacgtgccgccaggcgccgggctcccccggcctggacgccccgctggccctcagcgtcggctcccagcgcctggccggggagttcgaggaaactcccccgcgcgatgagcgcacgtggccgctgcccgctccctctgaccccagcggcgcgctggccatcgtggtgggcgcccccctcgtgctcctcaacagcctgcccgtgccggtggaggtgggcgtgggcggccagcagttgaccctgggccccctccagcgccgcgccctgcacgggctggaggaggcgcgggcgcaacggctgcgcctgcggcccgccggctacgcgcccgtggaggcggccctgctctcgcccgccatgctgggcgcgctgggcgccgaggccgctgagcgccaggaggagatcgaggtggtggtgagctggaggggtagtgggaggagggtacaccggggagagtcggtgtctgggcgtctggctgatgaccgccccccttggaagttcagcaaccactgcatcctgccctgcgctcttataaacaaggagctgcctccccacccttcttcctccggccccaccggcctgggggcccagcaggcggtgcggtgggtgagggacacccccctccagctggtggaggtggggcagagcgggcacagcgtgggcgtggtcctgcgccacggcctcgacccggggagcggggcgcgcgtgctgcgcctgacctgcacgctctggatcttcaactgcacggggcagccgctggcgctgcggcaggcgcacgaagacgccggccacttcaccgaggccgagcgggcggccgccgcggaggacagggcatgcggagagatgggggaggagcatgccttggcaggagaggagggggggaagttcagggaggcggcccagcgcaagccagggaaagccatgcagcatgagctctatgcctggctcgcgcccctggcccttccgccggagctcctccggccgcggggcccgccgagcgtgaccgcctcggctgcgggggcgcccgcgcgctcccccatgctcctctcgcccgccaggggggaagccgcgtcgagcatgcgcctgaactcggcgacctcctccctcgcgcccctcagccgcgccgcctcctcggtggacgtcggggtcgcgggaggtgcgcgggggtccgtggtctga

SEQ ID NO: 4021 - DNA, 417 bp, Chlorella protothecoides
gcgcgcctcgtgggcctcgcccgcgacgtgacgctgccgcccctcgccaccgccaccggcgcctcgctgacggggcacggcctgcgtgagaccgtggccgagctgccgggccgcgtgccgggggacgcctgcgccatcaggtggggggggcgtcggtggtggtggggagaggagtcgactgtgtgggtgctggcatggcgatacgaggggggcggggatgaccagccgctttgctgcagcacactccatcctctgggcgagggcacaggaacatacccgtggttgtatgcagcccccgacactccaccactcccttcaaaccacattccgataggcacttggcgggcccaccgccggacggccccaggcccccccacccccaccccgccaccgcgccctccacgcgctttgccctgg

SEQ ID NO: 4022 - DNA, 738 bp, Chlorella protothecoides
atgcaccgcgtggctggtgtatctgcgctgtgttccggatgtctatcgagggagtctgtcggaggccgtcgccctttgttcgaaaggagttcgattgccaaaacacgatcggaagtgtggcgggaagaaataggctcgacaggtgcagggacattatggcctggtcacactaccatggcactgcttacaaattttacactccatgaactgtttgtcactttgaaccgcgctgttgtgtatgggagcgtgctgcatgctccacaccaatcgttttgtgcacgatgcaaccttgatgcgcagcctccagccctatgtcatatcaccgggggaacgcgcgggcgcgctgccgtgtgtgatacatatatgcttgaagacacagtcctgtgcccgctgtcacagatcgatccgagagctccgatgtctgagccagcgctcgaagctggagctcaatcagcaagagcgggtgtccaagcatttaccgatgtccttgctgagcctcgagtggatatggcacggctgagggccttggcagcccagggagttccggaagtcaagggcctacgatctacagtctggaagctgtgcctggggtaccttccagtcgtcaaagctgctagagcgcggcatctggatcggaaacgggcggagtacgaacacttcatcaaggtagcggtgcgaggcaacgggaaagatgtggaatggcaagctggagaacccaaatttcagcatgacggctag

SEQ ID NO: 4023 - DNA, 459 bp, Chlorella protothecoides
atgcatggcccccctccgacccacctcttgcgtgacgccctcacaggtgctgccgatgaggaggagcggggccgcgccgaggcggacgccttcttctgcttcatggagctggtgtcggggtgccgggaccacttctgccagcagctggacgactcggccgccgggattaaggcaacgctggcccgcctggccgaccgcctacgcgcgctggacgctgagctggcggagcacctgctggaccgcaacggcgtggccccccactactttgccttccgctggatcacgctgatgctgacgcaggagttccccttcccggacagcctgcgcctctgggacgggctgctcgcgggcgggtcgcgcggcggcgaggacctgttgcgcttttgcctcgccatgctcgtgatcgtgcggcaggacatcctgcaggtgactaggcgatggggagggccatgggaatga

SEQ ID NO: 4024 - DNA, 351 bp, Chlorella protothecoides
atggaccccctggaagccagcacaagcttcctgaccacacgcctgcagcggccgcgcagcccggaggccgccaccctggccctccgccccgcgctccaggccgtggtggcagacctggctgcctgcctggagggcaccgcctcacttggccacgcggcctccctcctgctggtcggaccgcggcagagcggcaagaccctggcggtggagcgcgcgctgcgcacgctgtgcgcccggcacaaccggggtgagggcgctgagcccagcgtgggggtggtgcgcctggcgggctgggcccacgccgaggaaagaacggctttccgagacacggcgcggcagctctgcgagtga

SEQ ID NO: 4025 - DNA, 513 bp, Chlorella protothecoides
atggcaggagtttggcaggtcccacgccagctctcccacccctctcggctccgcacccctccccgcctcgcccgacacgctgagccggtcctccctcccacacggcgatcacccgctgtccgccgcccccgacagccagtggcggcagcgtttccaggacgaagagatgctggctcagatagatcgcgatgtcttgcgcacccaccccgacctccacttcttcagcggcgagggagaggccgccacgcagcatcgcagggcaagggctgcgaggctgattctgcgggatgcagaggcaggcgacccctgtctgagctgcagcaggaccatgatctcatgccaacaataaagcaagccaagcactatccgcaggccatgtctcgcgcactcttcatttatgcaaagctcaaccccggcatcaagtatgtgcaaggcatgaacgagctcctggcccccctgtactacgtcttttacacaggtgggcaccgggtgggcaccggtggcagggtgtag

SEQ ID NO: 4026 - DNA, 300 bp, Chlorella protothecoides
atgcccaacaggtggatgggctacagcaaggcgggctctgctaggtcaagcactctcacggaccttggtttgtccgtcgacgccatcaagatgcgtccctttgaggtcatcacggcgcgatcctccaagattttggtggctgtcgagtgcctcaaggctggacagaaggcttgcaccgcggacaaggatggcaacattggaactgggaacaagggcaagaacaactttggcaacaagaatgtgggcgacaacaacatcggtgagcatgatgggacagtcagatctgctgcaaatgaataa

SEQ ID NO: 4027 - DNA, 825 bp, Chlorella protothecoides
atgacgagcttgggatctcaaacacccactgacaagcttgcagctggccgtcgtaagttggaggagttcaagcggaagaagcaggcagccctggctgccaaggcagcgggtggcggtgtcctggcaatgggtggcggtgccccgcttgctgctcccgccgcatcaccccaaccacccgctggagagccccggccacctgcccctgctcctcaacagactggagtggtcaggtcgcttaccttccagcaccctactgaggcagttcctcctcgccagctgtctgcagacactgctgggctccgccagctagagccagcaccagggccgaccgccgccgcagctgccccgccagcaatggcagcggcggaaagtgtggatgcaccatttgcatctgctggtcctcatgagatcttgcatcccgagaaacagcgcgaacagcaaggccccgcctccacagatttagcaagcacatcagccccgccgccgtcctcccaagctctccctgcccagtcccagacgagccccgcccccacacatcctgacgctcacgaggccgaggccaggatcgcggcgctgcaggccagcaacgccgccctggcgcgccagctggaaagcatggaggctgccatgcgcgaaggtcaggaggccctggagcggcggctgcaggactcggaccgcaacctggacaaggtgctgagggagctggaggccacagatgcggagcgcgcatgcctgcagcgcgagaaggccgacctcgtgggtgagcaaaaggggaaggaggggagatgtgtgctattgatgcgggcttggactgtgttgttgtag

SEQ ID NO: 4028 - DNA, 345 bp, Chlorella protothecoides
atggatggatttttgaagagcgtgggaggggcttggagctccctgaccgagaagtatccccagttgacgcagctggaggagcgcgtcgtcactctgctgcccaggctgtcaccagagcatgtgatccagctgggccccaagcggtatagggtgatccgcaccctcggggagggaggctactccaccgtgtacctcgtacgggagctgagcgagaggagtggagatcttgggacagctcccgccgagccgccagggccggacctggcactcaagcaggtgtggaacactgttgcgagccaggatgagaaaaggcaggaggtccagtgcacccccaggagcacctga

SEQ ID NO: 4029 - DNA, 384 bp, Chlorella protothecoides
atgtgcttggcatgtagtactctttcagagcaggccccacgctgcacgctgctggagaaaataccgccggcctcaccaaaccttaccgcccctacgggatctcccacgacgcagcacgggtccgcgtgggatgcggtgcaccgtgccgcagcgcccccgcccctgcgcaccgtgctttccatcttcatccagctgtgcgccgcgctggaggcggtgcacgccgcgggcctgtcgcaccgggacgtgaagccgcagaatttactgatggaggcgcgtccaggcgccacgccgcgcaccgtgctgatggacctcggcagcgccggcccggccgccgtgcccgtgcgcgatcggggtcatgccctggagctccaggaggaggcggag

SEQ ID NO: 4030 - DNA, 1140 bp, Chlorella protothecoides
  modified_base (160)..(169): a, c, t, g, unknown or other
  modified_base (223)..(232): a, c, t, g, unknown or other
  modified_base (680)..(822): a, c, t, g, unknown or other
atgttcgatgatcccttgaagcacgatcgagcattctgtagtactatgcaaacaatgctgcgcaagcgggttcacgagtcgtcacccggccatactgagggggaacaagccatgcagagacccgggtcggtttcgacaggcgcacaacgctctcaagcannnnnnnnnngtgcaaacaatgctgcgcaagcagtcagatccattgttaccgagaagcatcacnnnnnnnnnngctcttcatgcattctaaaaggcattaggagtttcacgcttctgtccgcggggcaacacatgcagggtctgctcgccgccaccaatcggtactcgttttcacagcagttctgcgtgtcgacaagcgtcatcatgcagtacagcaaagcaatggccatggccgtactggctgttgccctcctcgccgcacctgtcggcgctgtgaaggccattaccgactgggaggacgccttctttggtttcctcggtctgacagttggttacaaatcacctgtccaaccccgcagcatcacccactacggcggctccccggacggcatggatcccagttctccgtcctttggaacctccgaggtgattattcagcgctgctcttgtgttcgccctgctccatgtcggtcattggcagggcccatgatgtccccatgtcggccgctcggctcgtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctacccctacttctccgtggctgccttctcaccttccaaccactactaccagtctgacgccctgaaggcctgcggccagtgcttccagattcagtgcgaggagggccgtaacggcaagactggcgtgtgcaagactgatgcccagggcgaacccctgtccatcctggtcatgatctccgacgtgtgccccgagtgcgaggccaaccacatcgacgttcagtccctggcctttggcaaggtgtgtgcgctatgccttggtgtcgtcaacagattgtttctttcaaatggcatgccctgctctgcttgccctccctaa

SEQ ID NO: 4031 - DNA, 408 bp, Chlorella protothecoides
atgcagtgcctgaaggagtgcggggacctgctcagctccggcgcctctgtcctcttcttccctgagggtacgcggagcaaggacggcaagctgcacgcctttaaaaagggggccttctccgtggcagccaagaggaaggtgccagtagtccccatcacgctccaaggaacaggggagctgatgcccgtgggcgccgagggcaggctattttcaggaaccatcaagctcttccagcccaatgcacccacggtgccccctgcgtacacgctcaccgcacaggtccgggtgcacccggccgtcccgcccagccaggcggtcgccatgatggcagcggcccaggccgccgtggcgtcgggcctcccccgggataagctggggcctgacgtcctgcgggcagtccagagttga

SEQ ID NO: 4032 - DNA, 300 bp, Chlorella protothecoides
atgctgaccgagtatgcccagggccccaactgtatcatgcactgcctgccgtcaggctcctatgacccacagaagcatacgtcgtgggaggcttgcgctcgagcagagctctcagaggaggcccacctcgagggcggcacatggcactgcctactgccggctgggcacgtgggggtgccggagaccaagtggtgcgccaaccgcttcacgcccttcctctgcatcgggccccggcctgccatgcagcccaggccacgcgatgccgaggaaagcaccatccaggtactggcagggtcctga

SEQ ID NO: 4033 - DNA, 906 bp, Chlorella protothecoides
atgtccgaggccaagaagtcgcccatcaacccggtctgggccgccatcaagcccttcgtgaacggtggcctgtccggcatgggtgccacctgcatcatccagcccgtggacatggtgaaggtgcggctgcagctgggcgacaagggctcccccctgaccattgccaagaacctggccaagtcccagggcgtgggcgcgctgtaccgcggcctgtcggcgggcctggtgcgccaggccacctacaccaccgcccgcctgggcctgtacaactacatcttcgaggcggccaaggggctgaatgagggccggccgctgccgctgtggcagaaggcggtgtgcgggctgtccgccggcggcctgggcgcgctggtcggctcccccgccgacctcacgctcatccgcatgcaggccgacaccacgctgcccgcggagcagcgccgcaactacaagggcgtgggcgacgccttcctgcgcatcgcgcgcgaggagggcgcgtcggggctgttcaccggagcggggcccactgtggtgcgcgccatggcgctcaacatgggcatgctcgcctccaacgaccaggccaaggagctgctggaggagtggggctttgccaagggcggcagcgtggtgaccctgggcggggccaccatcgccggcttcttcgcctccgcctgctccctgccctttgactatgtcaagacccagctgcagaagcagaagcccgacgccagcgggaagctgccctactccggggctgcggactgtgcgctcaagacgctcaaggagggcggcgtgctcaagttctacaccggcttccccacctacttcatccggatcgctccccacgtcgtcctcaccctgtccttcctctccgccctccccaagctccaggccaagtacggcctctga

SEQ ID NO: 4034 - DNA, 207 bp, Chlorella protothecoides
atgctgcagggcggtaacggctacgtgttccagggcatggatggtggggcggtgcaggcggcagtggggcgcgcgatggcagactacagggagcgcccgggcgagtggcaaggcctcgtgctgcgggtcctcgacgatggcgatgcgtggagctgggatggcccaacagaggagtacctcgatatatacagcaaggtactggcctga

SEQ ID NO: 4035 - DNA, 528 bp, Chlorella protothecoides
atgtaccttggtgtcggtgcgccccgcggagaggatggtgtccaccgaccgctgcgagcagtactccatgaggagggagggtgggtccaggcacaggcccaggtactggcagcagttggggtgccgcaaccgcgccatgatgctggcctcctgcgcaaggggtggggattgcaggcgccgcggcgggtgaggactcgggtcgggtctgacgggggcttcaccgacctgcgatcatcctgtccatcgagcgatgcgatgcacacgccccccgaaggggcctcccaggcgcggtcgagacgtggaagtctgcgacccgccgtccctgcgcccgggcgcaccaggtgcgccccaaccccccacctcgggccctcagacgcacaccgcccctcacagcgccacctcccgccatgcatgcccacgctgggctgcaccctccccccggccatgaccagccccacggacacccttccccccccctcccgcgaagcaacctcgaccatcaccgcaccttctgcagctggtccagca

SEQ ID NO: 4036 - DNA, 288 bp, Chlorella protothecoides
atgctgtacctgcacacgcggcagcctgccatcatccatcgcgacctcaagtctgcaaatctgctggtggactcccagtggcacgtcaagcaaccagagggtctcgcatgcatcccgccgctcgctttggggaggcgtctcctgcagcccctgtccttctttccttctgcggaaccacccaaccctgaccccacggccacgcccctgcagatcgcggacttcaaccttagcagggccatggagagtgaggtgatgatgagcaccatctgcataaccaaccccaggtag

SEQ ID NO: 4037 - DNA, 612 bp, Chlorella protothecoides
atggggctggggcaaatggcctccatgtgccagggatgccgcctcctgtctgagcagcgcactcgaatcgtcacggcctgcctcgaccagagcagcggcgcgagcctcgccgttcccgagcccagtgccatgcccgccggcagcttccgggggtacgagccgtacgtggcgctgatgacgcggtgctgggagatcgagcctgccgcgcggcccgagatggccgaggtcgcggcccgcctgcgcgacatcctgcgctcggagctgctggcggcacgctcccggcgcttgcgctccgggcagctgccgggcggaggcgtgccggagccgcagcagcgctacgcacgcgtgcgcagcgctgcgcccagccctttctcccaggggccctcctccgccgaggggtcgctggtgagcgagggcgggctgtcgccgggcatcggcttcacgtcgggcaccgcgtcggggacgccgccgggcaccgcctcgaccacgctcagcggcagcctcgaggtggggcgggggccggcgggcgcgccggcccccgccgcgcccgctgccgtcgacgacgccgagctggcggagaggctgggcagcaacgagcccgcgtttctctga

SEQ ID NO: 4038 - DNA, 507 bp, Chlorella protothecoides
atggtgcaggccgaggatgctggcgccccgatgggtgcgcccctaccaaaggggctcaggatgacgttccgtctggacgacggaaccaccatccgaagctcaggggaaggcaaggctaccgttctcaaggccagggagtcgtatgccgcggggttgctctccgagacccacctcctgcgagtccaggcactcctgtgcgaggtccacgctaaattgccggacgaggggcccctcaagaccctgtccctcagcagcaagcgcagtgccgagactgatgtcgaggtaggcacgggcattctgctgccctgctggttgggggcgttgggtgctccccacatacccttttccccttgggatgtggtggatgcacgccccagccagcactgccccgcccacgtatcgatacataacatgaagaaaatcatagttgatgccatcgacagcacaatcacacggaccctttacaggctctggacatcgtctctgccaagcggtcgcattccctga

SEQ ID NO: 4039 - DNA, 387 bp, Chlorella protothecoides
atgatgacgaagcaggaagccaaggcggcccgcaaaaaggcggcccgcaaggagaaactggcccttgaagggcgggcggcggcgggtctgccaccaccgcccaaggccccccagcatgggggaggggccaggatcgaggccatccccttgccaccccggaaggataagcagaaggccatccccttgccaccccgaaaagacaagcagaaggtggccaagaacatgggttacggccagttcgagcggcacaccaccggcatcgggtccaagctcctcagcaagtggggctttgcgggcgaaggtgctgggctgggcaaggacggagtggggctgacagagccgctcctggtgtcgcagcgtgcgaggcagcgaggattgggggcgtag

SEQ ID NO: 4040 - DNA, 234 bp, Chlorella protothecoides
atggtggacaaggtgatcaccgccctgggggggcccaaggatgccgcagcgctgggcttcacagtggccgtggacgccaagctggtgccggactactacaccatcgtgcgcaaccccatccacctgggcgagattcgcggccgcctgcgcaagtctgcttacgccgatccgtccggcttctaccaggtggggggagagatggttggtagaatgaaaggggaggggagggggtga

SEQ ID NO: 4041 - DNA, 2355 bp, Chlorella protothecoides
  modified_base (356)..(365): a, c, t, g, unknown or other
  modified_base (2254)..(2263): a, c, t, g, unknown or other
atggtgccccaggcagcttgggaggcgggtgagtctggggcagggcaatggattgcatgctgcatccggcactcgtgcccgcactggacggcacacacgtgcaggcaaccctccccacccaccacaaaccctgcgtgcaggccaacctggctcgcacagcaattttcagagtaccagggtcagcatgggcgaggaggagcccgcctcctgcgccaccacctccgtgccggtcatgctggcggccactggcatccacggcgtggccgtcgatgtgtgggtgagtggctccaaggggaggtagtgggtagacatgcatgggggtattctgctggcctgggcacctcgaagcttgctannnnnnnnnntgagtggctccaaggggaggtagtgggtagccatgcatgggggttttctgctggcctgggcacctggaagcttgctgaggaagggccagcattgacctctctatcctcccttccatttggcagtggggagccgtggagaggtcgcccaggaggatgcggggtctgctggccatacagacattacaggatgctgcttgcggatgttggggggttgtttaacgttccccactcaaatgcccatgcccccttgccccaggtggtgatgagctttcatgcctgcgggggcaatgttggggacaacgccctggtgcccctcccaccctgggtccacaaggtcggcgacagcgaccctgacatcttcttcaccgaccggccccgggagtcgagccccgggcaacgcaaccgggagtacatttcctggtttgcagagacggagccggggttgcttcgaggtcgctccgtcatggagtgctacattgacttcatgagggggtttggtaacttcagcggggtgccctgtggggtgctgtcggccgccctcgtgtcgatcgctcccttccagcgatgctgcttgatgtttggcaaggaggaagcagggagaaagaacaagggtgtgggacagccatcttcacaacgccttccctcaccattgtcgaagggcattccgggacgagttcatgggcgagctgggctcgctcatagaggaggtagttgtcgggtccggtccgtgtggagagctgcgatacccagcctacccagagacaaacggctggcgctttccttcaaggaggaagccgggaggctgattgaaggggtgtcctgggagagtatagctggtgtggcagtgtatcagccgcctgactcgcgcccactgcacccctcgtcgcagggcatcggcgaattccagtgctatgacaggcgggccttggccagcctggcgcgcgccgcaggtgccgccggccacccggagtggggcaactctggcccttcaaacgctgggagctacaattcacatccagaggtgcgagtgtctcaacgtgcgggggtgcaaacgcgcatgagggggggtgattctgtcggccattccgctcctaggccggcagctctgaagccgtgggcctgggtggtggtgctgctgcgagaggggggtatagccgtgccagggctcgcttctaatgtgccggcgtgccaggggtccaaacctgatccagtcttgctctttttgcccaccagctcagcatgccctcattacaatgcaggagacgggctttttccagacctggaatgggggttggcagtccccgcagggcgagtttttcctgggctggtactcggacgccctcctagagcatggggagcgcatgctcacggccgtgacttccgtgttcaactccccagggagctcaagcagcgagattgccggggtctaacaactctcatgctgtcccgtgctgaccctgtcgtccctgggtctggctcaacatacagctctgacacgatggtggggtcgccccacacctcggtcggggtcggaggcaccgtgagcccggctccctctagctcccccaacccccgcacccgcggcaggggccccccatcacaaaacccaggcggcgggcctgtggcgacgtggcagggcgacggaccgcccccggctccccccagccactctttccacctgccccagcccccgccggcaaatggcacccccgacggaatgatggccgccgtcagtttcgccggcatggcgtcgcccggcggcgcgggagggttcaacggcccctttggcagcgccagcctgctgccccccgccgcgcggcccgaccaggagtcggcggcgcagcgtctgctgccccccgccgcgcggcccggcccggactccgccgcannnnnnnnnngcggcccgaccaggagtcggcggcgcagcgcctgctggcccccgccacgcggcccggcccggactccgccgcgcagcggctgccctggaact

SEQ ID NO: 4042 - DNA, 2079 bp, Chlorella protothecoides
  modified_base (402)..(411): a, c, t, g, unknown or other
  modified_base (1486)..(1495): a, c, t, g, unknown or other
  modified_base (1628)..(1637): a, c, t, g, unknown or other
  modified_base (1748)..(1757): a, c, t, g, unknown or other
  modified_base (1945)..(1954): a, c, t, g, unknown or other
atggacgtgctgcaaggtttcaattctctctcgcctgccactttcgagtccgggcgcgcttcaggccgcaacagggcaggcatcccggaattgtggttcaggcaggaagatcaaccctcctactccgacaacgaacttgagcatgcacaggctttgaacaccaccgtcgaatcgccacattgtaaattccttcagcagtggagcttcgtccaccacgccatcccctggaggcgagcgggctgggatggcgaatatgcctgcacaggagtcccttattatgtaccccttgagtacatatacatttggtcagaaggccgcagtggtggagaagcatggctcagtccccgtccctcatatatggctgatgctttatcaaatggtacctgcactggatctgttgtnnnnnnnnnngttggccgatgtagctcatatatagctgatgcttcatcaaatggtacctgcactggatctgttgtcgatgacaggcgtgtcacgctgggcagcacctgtccctcacccactgctgggccgccctccccgtgcccaatgcaggtatgccctggagggcatccggcgctctgtggatgcggtgctcctagtgcatgcccacaaccacccgcacatcctcctcctccagctgggatccaccttcttcaagctgccgggtggccgactcagacccggagaagatggtgtgtgaaccaagccggggaggagttcttagggcggggcgaaggtgcacgggatggcttggcttaccgccggcacagtcttgctgcatggcggacccctcacagggtccctctcgcctgtgctctccctctcccagaggccacggggctgatgcggaagctgaacaaggcactcgctcccgagaaggatagcatgaagccagattggcgactaggggacctgcttgcaactttctatagagatctctggagaagccctgccctgccatcagtatcattgctctgcacacttaatacccccaaaccactccacgattccaggcccaactttgagaacttcctctacccctactgcccgccacacatcgagcggcctaaggaggttaggagcctgtacctcgtccatctgccggaaaaatgcttcttctcccgtcggaccctgcaaaccgacgtcagggagtgggtccgtcacaccagtatcttgctctcgctctcacatcctgcctgtctccactggtcgcacaaggtccctcaaaaccagaaactcctggccgtgccgctgttcgagatctacgatcacatgtcacggtatggccccctcatctccgcggtgccgcagctgctgtcccgctatgcgctgcgcctgatacggccagacggcggggtagcggcggcccccggcgcagtcaccacacagcccccccgtgcagctccggaggcggcaagcggtggcccaacgaggggcacagacaacgggagcgttgatgcatcagggcctctggggaatggagagnnnnnnnnnncaccctgcaagccgacctcagggagcgggtccggcacaccagtatcttgctctcgctcccacatcctgccctgtctccactggatagtgtgcacaagagggggttggagcatggttattgagcagtccagggnnnnnnnnnngcccaggcggggggaagggtgcctcaggagcagccaccagccccgccctctgaattcatggatagtgtacacccgggggagttggagcatggttattgagcagtccagggnnnnnnnnnngctcccccgagcagctccggaggtggcaaacggtggcccaacaaggggcacagaccacgggagcggcttgcgccggttgctagcagcttcttcccgcgaaagggatatcgctggcgtaggtggttgcctcaaatggcgaaccgaggggttgggggtaggaggaaaggaaggggaagcagggggtccannnnnnnnnncggacgggatatcgctggcgcagatggttgcctctaatggcgaaccgagggggtggggggtaggaggaaaggaaggggaagtaggggtccaccaaaagctgtgggacgaggtgcaatctcaataa

SEQ ID NO: 4043 - DNA, 588 bp, Chlorella protothecoides
atggacagcgctctcctcacgtgctcgcagaccgtggtgacaggctgcaagggcccaggcgtcgacctgagcgaccgcgcctccgcgaccctggtcggcggggcggtgcaagagaacgtggggggcgtgtggctctgggaccaggcgcgagcccagctgagcggcgtgaggctggaggggggcccttcgcatgccatcatggtgttcgaggagggcgccgagcttgtcgcagaggtggggcgggtggcggtatggggggcggagcacccagcagggagggtgctgggagtctcccgtgggcagggcagctgcaatggggcgctggagccgcgaatctcagtgtgtccattgccctgccaggccgaccatgtgggctgcgccactggagctggcatgtctgagcacccatcctcccacattctccatgtgcaggattgcgccatctgtggcaccttgcatggtccagagggggtcctgcatgccgtccccgcgaccaacacggtgacaccgccagggcgccacaccggctggcccctggaggatggaccgttccagtttgtgcccaaccgattcacgcggaagcagtag

SEQ ID NO: 4044 - DNA, 204 bp, Chlorella protothecoides
atggtcaagtgctcaggggacgatgcggtgaatgtctgccagggcgccgcccccctgtttgtggactgcgagctgacggccaggaaatccggggtgagggcgttcgacagcgccgcgccgcgcctgctccggtgcaccatcgagaaatgcggggaggcgggggtcaagctcctggagagcgccaagtgcgacctcacagagtga

SEQ ID NO: 4045 - DNA, 906 bp, Chlorella protothecoides
atgctgcggcccagcacccaggccgaggaggaagaggtcgaggggactctgcactgggatgcgggcagccacaggcacgcacccgaccctccctgtgcgcactggggtcaccggccctcagacgcgcacagggccgcgggcaacgccgcactcgcggcgggggactgtgctgcggcgctgcgccactatgcgctgggcttggccgagccctccgcttctccgcgggacacggccgtcctgcactgcaacatggcggccgcccacctgcggctgggagccgccgccaaggcggccgccgcatgcgagcgcgcgcatcgactgcgccccgactggcacaaacccctgttccggctggcccgggcgcggcaggcgctggggcagtgggcggctgccgcagcggcggcgcgacgcggcacccagctggcggggccggccgatgtgcccagcttccaggccctgcaggatgaagttgcggtctcagcctttgtggccggcagcctcgctgggtttggtggagcccggctggaggtgcgtagcgccggggacgaagcctggctcgggggcccagcaccccacgatccgcatttggatgggccggaggccaccgagcctggtgaggtggtcaagtacctgcccgcaggaacaggggcttgtctccaaccgccggccgctggcatcgagtcggcgagcctcgaggccaaagccaggtctggcggcgcgctggtccccgcggaggcaagtgggctggccttgaagatcaccggcgcgagtcaagacctggcagagtggagggcgccatcagggccacgccgcacctccttccggagcctcaaagaggccgtggcagccgccgaagacggcgacaccatcgtcctgctggccggggtccacaatggcatggggtga

SEQ ID NO: 4046 - DNA, 636 bp, Chlorella protothecoides
atggcgctcctcgctgtgacaggaccaattgtcgacacggccttcgtacaggagattgctgcagcgcatgcattagctgtgtctagtctcaagctagtcactcaggcgacgaagctggaggacaaagctctccccgcgagcgcatttgacacggtcgtctcggttgctagcacgtctggggaacacagccttgcctacctgggcaggcttgcactctgtctgagacctggaggggcgcttgtagtttctgagccgggtgcgtctccagctggactccagaagaatctcaccctagctggcctgggcactgcatcagcaggccccctggacagcgtcgtctcttccaagccggcatgggagaccggcgcgagagccgcaatctccctcaggaagaagccggctgcagttcaggccgcacctgcctggaagctgagcgttgacgacgaggatgatgacatcatcgacgatgagcagctgctcacagcagaggacctcgttcgccctgcaccagcaggtgaggtcggactgcatccggggttcgtgaggttggcgctttctgtgagatcactcacccccatccatccctgccactccatcttgtgcaatccgcagcgccaggttgcggccccgcagtga

SEQ ID NO: 4047 - DNA, 1830 bp, Chlorella protothecoides
  modified_base (1048)..(1057): a, c, t, g, unknown or other
  modified_base (1635)..(1644): a, c, t, g, unknown or other
  modified_base (1752)..(1769): a, c, t, g, unknown or other
atgttgggcgctctgcaccctgcagagcttcagatctgccacatatctcgcttctcatggtttaaaagagcacctgctgggcgagctcgagctgctggacgcaggtggcaggtcccccgcgccgagcaccaggaggctcccgcaaaggctgggcgcgacgccctcgcaggccttgatgccggggccctgtgcctggagatagagcccggcaccaataactcccgctgcatctacgccagcaccgacgtgccggcccccaaggagaccctctggcgactgctcaccgactaccagcacctcaatgacttcatcccgggtgcgttgttgtgggaacccctggccaggccggcactcggacctgtcgccagcctggccgtcaaccaggagctggagtcctttcccgacggctgcaaactgctccaggtggggcagcaggagctggccctgggcttcaaattcacggcgcggtgcgtgctgaacatccgggagcaccccgacggcatccctggccgcctgctgggacccaatggcggcagcggggctggcaatggtgatcgtggccggtccgcgccgctagacggctcctccttccccgcaccgcgctcgcagatgggggttgatgcgccgcacgccgacattgtgtttgagtcggtgcaaggcgatttccaggagctggagacctttcccgacggctgcaagctgctccaggttgggcagcaggagctggccctgggcttcaagttcacggcgcggtgcgttctggacatccgagagcaccccgatggcatccctggccgcctgctgagacccaacggcggcagcggggctggcaatggtgatcgtggccggtccgcgccgctagacggctcctccttccctgcgccgcgctcgcagatggggaccgctgcgccgcacgccgacatcgtgttcgagtcggtgcagggcgatttccaggtactcgtagggcttggagaggggggagctgggcttctaccaggagtggctgttgtgagccctttgcgcactgtctggctgtacatggactccnnnnnnnnnncctatcaggagcggctgttgcccgggacacctcgcgcgcccacctgtcctactcccttttcgtccggccgcagcgctggctccccgtgcaactggtgcagccccgcatcgagcaggagatccgggccaacctgcttgccgtctgccggcacgccgcctgctgccacgcggcggcgggcgggggcgagccggacgccacctgacgtggtcaattcttttcatcttgcccaagggcgcgcgctgatgccgtgcacgtccacagtttccatgccgtcgctgcctcctgaagttgaagtagacgtgcaggatgccgcggtcgaagacggacttgaagcctttcttgtgattgtactccctgcgtgcgtgcgtgtgagggtgctgtgtgccgcggttgtgtggcgctcactcctcttgcggtccaggttaccaagacgatgccctttgcttgggcctgtcgatccctgcggcatccccacccaccaagggacccccccgcaccctcctgaaaaacaccccaaaaatgcgcaccagtccttgttgacgattcggaaggcgatgtcctcgtacggcggacccgcnnnnnnnnnnatcgaagacggacttgaaacctttcttgtgattgtactccctgcatgcgtgtgtgtaagggcgttgtgtgccgcaggtgtgtggcgctcactcctcttgcggtccagnnnnnnnnnnnnnnnnnncccgccacggcgttggggtccttctcgatcttatacaccggcgacttggacttgtcgatga

SEQ ID NO: 4048 - DNA, 450 bp, Chlorella protothecoides
  modified_base (412)..(421): a, c, t, g, unknown or other
atgcggtcggggcgggagccgggcgccagcggcgcgggagacacggcagaggaggcgcgcctgcgcgccgccgccggcgcggccatgggcgacctgggcacctcgggcgacgcgccctttggtggcgaggtggcgctggagagccaggcttactggtggcacgagaagtaccgcccgcgccggcccaagtacttcaatcgcgtgcacacggggtacgagtggaacaagtacaaccagacgcattacgatggtgacaacccgccgcccaagagcgtgcaggtgggtgaggggtgttgctgcgggtggggtgctttgattatttttttgaggagggtctgttcattcatggcccggcatgttgtgagcgttggggatgcctctcataggctggggtggggaactgaaaggcagnnnnnnnnnnggggtgttgctgcgggtggggtgctttga

SEQ ID NO: 4049 - DNA, 1563 bp, Chlorella protothecoides
atgcacgtggccgagctgcggcagcaggtgcgcctgctccagaccctgggctacggagagagcgcgggtgcggagggcttggacggcgtgacggccgcgctggcggagcgcagccggcggcttgagcacgagctcaccctggcgcggctggcggccacccaggcgcagagccaccccaactcctcaggcgcgagcgacgcggccgaggcgcaggcggcttccttggcgtccgagctggaagccgcgcagcagctggctggccgcctggaggaggacctggtgctggcgcagcgccaggtggcggcctctgggtcggggcccgcggagcaggggcccaacggcggcccgggcgccggccccgatcctggcgccgccgcggggggcggcagggaagacgaggcgccctccatgctggcggtgatgagcgggcagcgggaccgcttccgtgcgcgcgtgcgcgagctggaggagcacctgctcgtgcagacgcagcagctggcacgggtgggagcgtgtggggcggctcgggcgtggtttgactggatgcatgcaggagggggagctgtgctccctgcggactggctgggtcgcattgagtgcacggagcacgcacgacagcgattcacagactccatccccggcgaccctgagcgctcctggcgatgcacagactccacccccggcgaccctgagcgctcccgggtgcaggagttgggccctggcgcccccggcctttcgcgcctgccatgccctccccccctcctcattatgatgcgcactcatccacaatgccaggctgggaacgatctggaggcggcgagggccgacaacctggcgctggcggagcggctcaagtatgtccaggtgcgtcgggcgtcaacttcaggcggggcgtttgcaggacactctgagggagtgtgggcgggagcaaggcccccccccggggggaagggcgggggggggggacatttattgcaaggcatcactgccccaaagatgaaacaaccctgtccccgagccaccgccgcgcccggcctgcagagctatggccggagctatggccgggtccaggccgggggggatgtggagagcggggcggacgcggtggggcggtacatgaagcagtacgaggacggcgtcaaccccttcaacggtgggtcagcagcgggagggcccagatgtcgcccggagaggaggtgccctggcgcagcacacgaccctgctgcttgcctgctgcatccgaaacctgtcatgcctgctgccccacgccgcccactcctcatccgtcaacctttcctcttctctccatctcctcccagcgttccgagccaaggagaggacggcggcgacgcggggcatgccgctgacagagcgcgccgcgtaccgcatcggggcggtggtggcgaggtcgcgtactgccaggtcggcgctgatggcctacgccctggtcctccactgcgtcatcttcctcgtcctggccaggtgggctgccgctgcagcaagtgggagcgcctgatgcgtgggctgggatcgaggaacgcctgcggagggcggcgggtctag

SEQ ID NO: 4050 - DNA, 468 bp, Chlorella protothecoides
atgtacgctgggggatgggaaacaaagacgccaggatgcgcttccatggtgtatcctgacagcagccgtggcattcttgctaatattcttcaatggaaggcgtttcgtgagaaacttgagggcaatttgatgcagaggggccacgtgatggccacattggacgagatattcggggaggaacaggcgcaggacgatggtctgcccgaggagttcaagaccatgtctgcagacgacattcagcggagaacgcggctcctcgagaccgagctgcgggtgctgcgggaggagaacaaccggctgaaccacgacaaggcaggcctggctgagcgcatcaaggacaatcacgagaagatcaagctgaacaaccagcttccctacctggtgggcaacatcgtcgaggtcctggacgtggaccctgacgaggaggaggaggaggatggtgaggcgtgggagcacggaggagggtaa

SEQ ID NO: 4051 - DNA, 393 bp, Chlorella protothecoides
atgctggagctgctcaaccagctggacggattctcctcccaggacgacgtcaagatcatcgccgcgaccaaccggccagacatcctggaccccgccctcatgcgatcaggccggctggaccgcaagatcgagttcccccaccccaacgaggaggcacggtccaagatcctgcgcatccactcgcgcaagatgaatgtctccccggacgtcaacttcgacgagctgggccgctccaccgacgacttcaacgccgcgcagctcaaggcggtgtgcgtggaggcgggcatgctggcgctgcggcgggacgccacggagatcaagcatgaggacttcaacgacgccatcatagaggtgcaggcaaagaagaagacgtccctgcagtactacgcctga

SEQ ID NO: 4052 - DNA, 180 bp, Chlorella protothecoides
atgaagcggacggtggagcgctttgtgttccgcatcaagctgctgctcgccgagacggatcaggccgacgccttctggctgggggcgctgaagcacaagaacctgcagggccaggaagcgtccagccaggtggattgcaggcctggcgtgccgttgctgagttgggttccagcgtggtga

SEQ ID NO: 4053 - DNA, 813 bp, Chlorella protothecoides
atgcgttctttcaagccgccaccaccaccgcacatacacaaattcgtaggtgctaatgcgtaccaggacgcctccaagaagggcaagtgcgtggtgctgaagaccagcacacgccagacagtgttcctgcccgtggcggggctggtggaccctgccaccctcaagcccggggacctggtgggggtgaacaaggactcctacctcatcctggacacgctgccggcggagtacgactccagggtcaaggccatggaggtggatgagaagcccagcgaggactacaccgacatcgggggcctggataagcaggttggagagtcagagggggagagggagtgtgcgtgcgtgcgtcgcctccagtgccccgcttgcaggctcctcctccctggtgtctgcattgccctgagtggatgtagcgctcggtgttgtccactggcatcccattccccttgcacactccccgctcaacactcgcagatccaggagctgcgggaggccattgtcctgcccatcacgcacaaggaccgcttcaagtcgctgggcatcaggccgcccaagggcgtgctcctgcacggccctcctggcacgggtaagacgctgatcgcgcgagcgtgcgcggcgcagaccaacgccaccttcctgaagcttgcggggccggccctggtccagatgttcatcggggacggggccaagatcgtgcgcgacgcctttgccctggcgcgtgagaagtcgcccgccatcatcttcatcgacgagattgacgcgataggtgcgcgccgctggtgtccgtctccctggggtggtgggtgctga

SEQ ID NO: 4054 - DNA, 966 bp, Chlorella protothecoides
  modified_base (386)..(395): a, c, t, g, unknown or other
  modified_base (825)..(834): a, c, t, g, unknown or other
atgagcggcgacagccccggcaccagtcgggtgtcattgggagacctgaccgagtacgacaccctcatcctccccacgggggactccccctccccggcgcgctctgagccccccccgccgccgctcacgtcccaggacgtctccgcggcggccgcggcgaccatgctggcctttgcggagatgccctactccgccaccggccagtccctgcacgaggccggcacggcggggaccctggcgggggtgaagcggcccaaccccgagcccgacagcggggccggggcctggacgcccaggagccccaccgcgccggcgccggaccccggcggcccggccgccgccagcagcgcggggggggtgccctccggcgcggggggcacaggccnnnnnnnnnnggaccccggcggcccggccgccgccagcagtgcggggggggtgccttccggcgcggggggcacaggaatggggtcggccgcgctggagcactcgggcacggccgggtcggtggagagcggggagcagggcggcaggaaagcgcggctggtgtggacccaggagctgcacaaccgcttcatcaacgcgctgagccacctggtgaggctgctgggggggtggggcatgggacgagggctggggcgcggctggggcaaggggggtggacaccgtcgctgcaggggcgggcacccgtggtctcgacctggatgctgtccccggagtgggatgcaaggcacaggagggctggcctgggaccccgtagtcggatgggcgtgtgagaacactcgtgcactcgcccctcaccacctcccctcgcctccgatctctttnnnnnnnnnngagggctggggcgcggctggggcaagggggttggacgccgtcgttgcaggcgcgggcatccgtggtctcgacctggatgctgtcccaggagtgggatgcaaggcacaggagggctggcctgggaccctgtag

SEQ ID NO: 4055 - DNA, 1035 bp, Chlorella protothecoides
  modified_base (420)..(429): a, c, t, g, unknown or other
gcggcgcccccgcgcgcgccgcgcgccgagccggagctgcaggaccgcgtgagcttccggcgcatccgcgcgccgcgcggcgacgcgctggccggcgtctacctgggccagttcgggccgcatgggcccgaggtggtgcagctggcgcgcagccgccgcgacggcgacgagtgggtgcacgccaccaagatcacgggcgaccgcaacgtgccggcaggggagctttcgttcaaggcgcgtgtggggcgggagcaccgcctgcccaccgccgtggagggctacccgccggagctgggggtgaccgcacgctacgctggccgcggccgcgttgccgagccggtgagtgagacacgattggggggcccccgttcgttgcgggcccgggactgttgttggggtcacggcttgccttggagtgtnnnnnnnnnnccccccgttcgttgtggcccgggacttttgttggggtcacggcttgccttggagtgtccaggggtgggtcaggagcgacagggagcacatccaagcacgggcctgcgtgatcggctcagcgccggtacccttggtcctgcccttcaccccatccttgaaaccctcgtcccgatctaccactcccctcccttcgacgtcagggctaccactcccctccctccgacgtcaggggttcaagaacccgcggtgggtgaatgccgagctgctccagtttgcgtcgggcaaccccatgacccgcggcgcggagctgggcatcgtcttcagcgtctcccgcacccagcgctacctcatcctcttcaaccgcgtggacttggagtccctggaggaggacgcttcctccctggggccctgatgttttcggcgacgcgcttgcgggggcggccgctgccttggattttttgggagcctcgacgctccccccctttctcgttgccgtttccctgggtcgcaaagcccgtttcccctgtcacccgcgtcgcgcctgctcctggtgccgcctgcacactgattttgtctacatatactcatcgacgtgagtgtgtttga

SEQ ID NO: 4056 - DNA, 750 bp, Chlorella protothecoides
  modified_base (656)..(665): a, c, t, g, unknown or other
atggggccttcttcccgacaaggagatgcagggattgccggtgggcagaagggctcggactctggccgagagccaaggctgtggcacgatggaagcacccacccagcaaacacacatcggcgcagccttgagaaggagctcaaggagttggaggagaggatcgaggtggcctcggcccgacggggtctgggtgtgggcatggaggacatcaacaagaagaacaggaacatcaacttccaggtggggctggagggggccgagggcatgtttgtttgtatcaaggaagcgctctccccacagcacgcggagtgctacggcagcaggcttgccaggtacccttggggaatggcgcccctgccgccgtgcagcatgcctgtaccctggcatccatcgccgacccaagatgtcacctcgtcaccgcgcctccccctggcgcagaatgccctgaacaatgtctcgaacaaggtgctggaagggcctggtggcgctaccaaggccgagggtagcaagaccttggaccccttctcccgtcgggtcacccgcccccaaaactactggagcacaaagggcgaggaggcagggacggctgccgaagcggcctccggtgcgtggatggtcctcgcaatgggcgggggggggccgtcgcatgcgcaaannnnnnnnnnggacggctgccgaagcggcctccggtgcgttgatggtcctcgcaatgggcgggggtgggccgtcgcgtgcgcaacgcgatcttga

SEQ ID NO: 4057 - DNA, 645 bp, Chlorella protothecoides
atgggaaaggcagttgcgaggctgttgttgcaagccatcagggttgccaacaagttctgggcggcgcttcattcctctgagcctgtacccgtatgtcagggcctgagccaacccttacacgcactcccgcccggcgccgcagggactctgggcagccctggcgcagcccctaccccttcgggccgaaccaggagaagacgagcacctggctgcgggtggcgcgcggcttcagcgagcgcggcatgcccctggccctggtctccaactcggctgtcagcgaggccgaattcgaggcctggcagcgcgcctgcagcgcagaccgccggccccagctggggcgcacggaggttgccgaggttgcccgccgcatcaaggacgccgagacgtgagctgcaggctgtggggttcccgaggcaggcccaggccgaggatgcattgtggcagagaccctgcgccgacgctttaccttctcgacccaaacacgcacacaggtatacctacaccgccgccgacgtggcggcggtgttggagcgcaagcgcgccaagggcgagggcgcccggaatgccgccctggagagggcgcggctggagcgggaaagggacgcggccgcagaggcgggggacgtcgtccgacatgcagagtga

SEQ ID NO: 4058 - DNA, 1017 bp, Chlorella protothecoides
atgccagccctggcgcttgcgctggcgggctcgagcccgacgctgccctccatccatcccggagtctcagccttgcctctgtccccccccacaaaccttcccgaccttgcaggtagcttctcgctgggtctcgtgggccaggtcattaccgccatcctggtggtgctcctcatcgtcatcatgtgctgctggcgccgcgtcatcctgttccgacgcgcggccgccacgccgcgcgagtcgcgcggctggcccctcgtccgcgccgtgctgtcggcgcggtgggcgccacaggcggcactgccccccagcccccgcatgtccagcgtcggcgagccgggggggctcccccgcctgggtccggtccgcgctgcgcccatcaaaccccccatcgtcgtggtcatgccggacgggaccacgctgtgcaccgccagcgtggtggatgggccctccgacgctgaggaggatgaggacgggcgcagccgccaggacaaatccgaggagggctccggcgccgccccagcgcccctccctggcgccgacccggcccccctgcccggcgccgcgcttgcgggggatgcgtggcatggcagccccggcgcgctcgccgcccggcaggcctcctcgctggagatggcggagcggggcgcgcggcaccgccacggcaggaggtcgcggcggcacggaaggcggggcgtgccggccatccccatgttcagcatggaggtagatgacgacgacagcgggggcgagcccgcagttcccgcgccggtccccgtgccgggtgacttccccgcagttcccgcgccgggtgacttgcctgcaattcccgcgccgggcgacttgcctgcagttcctgcgccgggtagtctgtctgccagccctgcgccggctgactcgcctgcagtacccacatcgaatgccttgcccgccggacacacggggggaagtctgcccgctgcggacctgggaggtcctgaccgggcgggggcggcgcggccggcctcaccgggcccctga

SEQ ID NO: 4059 - DNA, 663 bp, Chlorella protothecoides
atgagcggactgacgggggtgtgggatcaactggtggatgctgtctgtcgaccaccccgtgatgactcctacaccgacgaggaccttgtgggtgggcagcgggcctcctttcgcctcggcaaggcccggtactatcgccaggacctggaggtgggggtgtgtcaaagggccggtggggagcatgccaggccagtggctcagccaccttggcccggccccgtggtgttggatgcgtgcatcgtgtacactgcattacgctttgttcagaggctgatagcgtgccacctgcatctgcattttcaagaggatccatgcaccgacactcgcctgaagctcccccgccaaatcaccagcctgcctgacctccccccgcagctgcacaacgagcgcggcgagcgcctgctgtgcagccacttccggccctgcatcgtcgctagcaaggacgggcgcctgccggtcgtggtgtactgccactgcaactcgggcagccggcgcgacgccgaggagatcatctaccacttcctgccccgccacgtcaccgtcttcagcctggacttttcggtgcgctgggtgggtgacacactctcagtgggctgcatccttggtctggggcacaggcggggcggaggttgtcgtggtaacaaggagggtctccctgcctga

SEQ ID NO: 4060 - DNA, 933 bp, Chlorella protothecoides
atgcctcctcccctcttcacacaccctcagggctccggccgctcccagggcgagtgggtgaccctgggcgcgcgggaggtggacgacgtggcgacggcggtgcgctatctgcgcgacgaaggctcggccctgaccatcggcctgtggggccgcagcatgggcagcgtggcctccatgctctacgcgcgcgccgacccctccatcgccggcctggtgctggactcgccctttgccaggctgcgcgacctcatgctggagctgggctccagcgacgacagcctgcgcatgccgcgcgccatcgccaaggtcgcgctggcggtgctcaagcgctccgtgcgccggcgggcggggttcagcatcgacgacgtggcgccggtggaggcggtgcccgcggtccagtgccccgcgctgtttgggcacggcgcggaggacacctttgtctcggcggagcacagccggcggctggtgcgcgcctacggcggcgaggcgcgcctccgcctcttcgacggcgaccacaactcgggaccggattggtcggggtcgaaaggccagctaggtgatgggcaaggccatcgcagcggcaggccaggcatcacagggcacggcgacctcggccacccacttccaatccttgcagtgcggcctgacgacttctacgaggaggcggttggcttcatgctgagcgcgctgcgtgtggaagagctgctgggcttcgatgtgttcctcatggaccctgcggctgccggcgccgcgctttcctcaggcgccggcgcgccccgcgcccggcggcttgggcggggcggggcggcggggggcgggggccccacggccgccgccgccgagctggccgcggacgaggaggacgacgcgctggcggccgcgctggcgctgtccatgcaggagcgccgggcggggaggtgcgtgctgctttga

SEQ ID NO: 4061 - DNA, 1086 bp, Chlorella protothecoides
atgacggagctagagcgagagttcgagctggcggagcgtgcggagcggcggcagcaggaggtgcagcgccgcaagctgctgaagcagacggggaaggcggcccaggaggcggcgcacggccccgtcccggcggggcccacagtggcggggacccggagtcggggcgagacgctggcgggggagggcgcggggcggtccatgcgcagcgggcgggaggagagggaggaggccgccaagaagacggccatgcaggagctggtggctgccaggaaggcgcggacggagggcaggggcccggctgccgacgaggaggcggagagggacgagagcctttccaggtccccttcgccccgccgtgcgcggctgccgtcggatgatgaggacgaggcactgtcaggcatgcatgggggggcagccgggctcgaggctgggtcaggtggctgtcgtctaccgctggacgacacaaaggaatgtcaactcacagaacatcacgccacgctctcctctcccccatcagacctggaggaggacggcgcggcgggtgggtggaaaccgcggcaagaggacgaggaggaggaggacgaggccgcctttgaggacgtgtgcagcgtcatcgtccctcgctacaagctcgaaaagtggctgggggagcccttcttcgccgccaccatgcccggctgcatggtgaggagcgaggagggtggagcgagttattttccagggctggggcatctgggctgcatgaccttttccagcaggggtcgccgtgagagctcaagggaccccccgtcaccccgctgcgctgtgaccgtcgctccaccctttccacaccctcggcctgcttggtcccaggcccctcccctcttgcccctccccctcctcctttcttgctcaggtccgcgtctctctgggtacacgtacatgctccgacggcatcgcgcggccccactacatgctggcgcaggttgtggacgtcgaggagcgcgccccgggagtctacaagtgagcgcagtggggggggggggtgccattgggaatcacaggggagcggcgggaggggaggtcgcctgggacagggagttgtga

SEQ ID NO: 4062 - DNA, 162 bp, Chlorella protothecoides
atggtcgggggtgtgacacccaagaagggcggcaccacccacctgggcctccccgtgttcgacacggtggcggaggcacgggcggcaacgggggccaccgccactgccatctacgtcccgcccccgtttgccgccgcggccatcatggaggcgctggaggcg

SEQ ID NO: 4063 - DNA, 1368 bp, Chlorella protothecoides
  modified_base (420)..(429): a, c, t, g, unknown or other
  modified_base (750)..(759): a, c, t, g, unknown or other
  modified_base (912)..(921): a, c, t, g, unknown or other
  modified_base (1115)..(1124): a, c, t, g, unknown or other
atggtgtcgacattgtcctcagtggtaaggcagaggctccctgcttggctgatctgctgccctgatggtatggagattgttgtcgaaggtcatgtgcatgcattcgagcgcaccttccctgtctacaactacaccctgaatgactgtggccccgtgcacctcactctgggtgatggcggcaacattgagaaaccctcacagctcctgtgttccacccccgctacacatgagcaggcccggtacccatccaactacgaggccagcggcagctccaatgccctctggtactctgtgaatgtcggcccggcccacatcgccttcatcacttcctatgctgattacgaccaggattctgctcaggtggggctggctttccgtgcaccaatctcaaggctggcctctggcactttaacctttgcnnnnnnnnnngaggattctgctcaggtggggctggcattccgtgcaccaattttaaggctggcctctggcactttaacctttgcatcggatcctgttgcatctcatcacggcatcctgtgcaagggtgagtggagcgctcaggacggagacgccctggctcatggtggccttccatgccccttggtgcgcgcgagtcgtgtgtgtgagcgggagtgcctgcgctcgaatgcctcgtaccactgggggcaggaaggcgaccagaatgccgagccccacgggtcccagcccgcgctagccattacccctgtgcatcgaggatcccgtttcccnnnnnnnnnngatgccgagccccgcgggtcccagccgcccctagccactacccctgtgcatcgaggatcccgtttcccaaccatgcaggagcaaaggggctgcgtggtgtctgcgagccggctcctcaccacgccctgtcttgccgagacatcccctcacccnnnnnnnnnnatctgcgaggcggctcctcaccgtgccctgtcttgccgagacatcccctcacccagctcctcgcccaacgcccaccctcttctatcctcaggtcatgtgcatgcctacgagcgcaccttccccgtctacaactacaccagtcgcaaggagttatctggtcacgactcactgcctttcttctctattgcaacacnnnnnnnnnnttcctcgcccaacgcccaccctcttctaccctcaggtcatgtgcacgcctacgagcgcaccttccccatctacaactacaccgtgagtggaagggctgtgggggctgagcactggatccaaatcttctcgcggatctttgcgcgcagggtaaataatcgatgggtggggataggaactgacctcatcatcctctcattacctgccatggatgtgtggtgcaagtgcgacaagcctgatcactga

SEQ ID NO: 4064 - DNA, 450 bp, Chlorella protothecoides
  modified_base (160)..(293): a, c, t, g, unknown or other
ggaggaggtgcgcgccgccgcggaggccgcggcgcgcgaggccgaggagcggcgcaaggcgcaggagcgcgcgcggcgcgagaccgagcgcatccagcgcgagatggaggagcgggagcaggaggagctgaagaccttcctggcgtccaaggggcgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgccaaggcggcggcggagctggcgcgccgcctggcgcgcctggctaagtcgctggaccacgcggagcgcgcgcggcgcgaggaggaggccccgctgctggagcgcgcctgggctgcgcgcgcggccgaggacgccgacctcgccgccgagctg

SEQ ID NO: 4065 - DNA, 1953 bp, Chlorella protothecoides
  modified_base (194)..(203): a, c, t, g, unknown or other
  modified_base (787)..(796): a, c, t, g, unknown or other
  modified_base (1052)..(1061): a, c, t, g, unknown or other
  modified_base (1284)..(1293): a, c, t, g, unknown or other
  modified_base (1472)..(1481): a, c, t, g, unknown or other
  modified_base (1552)..(1594): a, c, t, g, unknown or other
  modified_base (1866)..(1889): a, c, t, g, unknown or other
atggggcggaagacgtgggagagcatccccgccaagttccgtcctctgccggggcgcctcaacgtgatcctcacccgctccgcctcgggggagaacaccagcatcctggggaatggtgagcatgcaggtctgcattgcactgggctgtgggccggtgccttgcggtgggggtgctgcgtggtcctcccctccannnnnnnnnnattgcactgggctgtgggccggtgccttgcagtgggggagctgcatggtcctcccctcccctgcactcgccgtggacgtgcaggcctcccgtccaggcccctcctcccaccctcctccactcccccaggcggccagcccggcgcccccgccccccctgcctgcgaggcgctgcagcagcccagcctgtccgcggcgctgtccctgctcgcctcgcccgcctacgcgccgcgcctggagtcggtcttcgtcatcggcggcggcgaggtgtacgccgaggccctgcgctcgcccgcgctggacgcggtgcacctgacgcgcgtggaggtcgacacgccctgcgacacccacctccccccgctccccgccgacgagtggcggctgtggtccgcgggcgcgccgcgccgcgacgccggcacgcgctacgccttcctctgctacacgcggcgcggcgcggcggcgcccccgcgcctgccccccgcgctggccgcgccccacgaggagcagcagtacctggggctggtgcgacgcgtgctggcgcacggcgcgcgccgcggcgaccgcaccggcacgggaaccctggctnnnnnnnnnncgcgccccacgaggagcagcagtacctgggcctggtgcgacgcgtgctggcgcacggcgcgtgccgcgccgaccgcaccggcacgggaaccctggcgctgttcggggagggcatgcgcttcaacctgcgccacaccttccccctgctcaccaccaagcgcgtcttctggaggggtgcgcggggcgccggcgccgcgggctgcgcggcgctgttttcggctctgttttgttgtcttctgttgcgggggagggtgggnnnnnnnnnnccaagcgcgtcttctggaggggtgcgcgggacgccgcgcagcccgcggagcggcgctgttttcggctctgttttgttgttgttttctgttgcgggagaggggggccgaggagcgtgtgtgtcgggctgttggggggaaaggtcgtcgatgccagcgccgcggtccaacaagcagctcccctgccgaggcttggatgaggagaggatcgggggaatggattgtnnnnnnnnnnggtccaacaagcagctcccctgccgaggctcggatgaggagaggaccgggggaatggatggccaggctgagcggccgctcgcctccccgcccagccccccatcatccccaggctcagggtcgacagcagcacgctgccacccggtgcacccgcccctccggcgcgcccgggccctgccnnnnnnnnnntcatccccaggctcagggtcgacagcagcatgctgccacccggtgcatccgcccctccggtgcacccgcgnnnnnnnnnnnnnnnnnnnnnnnnnnnnnnnnnnnnnnnnnnngcccccccccaaaaacaggcgtggctgaggagctgctctggtttgtctccggcgcgaccaacgcgcgcctgctggccgaccgcggcgtgcacatctgggacggcaacgggtcgcgcgagttcctggacgcgcgcggcctgggacaccgcgaggagggcgacctgggtccggtgtacggcttccagtggcgccactttggcgcggcctacgccggcatgcacgccgactaccggggtgggtgggtgccgggactgtgggggaagggggcgtgnnnnnnnnnnnnnnnnnnnnnnnncgccgacatgcacgccgactaccggggtgggtggttgccgggactgtgggggaagggggcgggg

SEQ ID NO: 4066 - DNA, 1575 bp, Chlorella protothecoides
atggctgaccagctcagcaagctcgtggaggtgattcatggggaaatcgtgaccctttgcctgcctagacagctggcgtgccggcctggtaagctcctgtgttttccccctacaggagggtctgcattccaacaagaaccaggcggagcgcgaattcctcctgaagaatgtgaaggtgcgacggcaagctgtgtggagcatgttagcgagctgatctcggtgcgtccaggctctttcccaagacatcccgttgacagcctagtgattgccactatattcctggcagctgccgtcttgtacaaccgacccgaatacattggcctggaaggtagatgtgggcgcctggttgctggggggggtgggactccctgcagagcctctcatgatacacccaaggctctggaagccagcaatactccagccaatgctgcggcggcatcagaagatgccaaatctgccagccaagacacggagagcgagcccacattggttgaagatgctggtacagagagtgaggaaggtgagctcgggaaggaaaaggctgaagccacatctgagaccactctcgagtcaaaggaggaatccactgcagtcgaggacgccacaactcaagcaagtgttgacgctaacctcaaagagttgaagaaagaggctgcgaagaccaacgaggaagcagccgctgctgtgcgagaggccgaggctgaagcggtggaagagcaagctaccactgaagaagcaactgagggagaggcagcgaccgcccaatcggagactaccaccgctgaggctgacacatctgctgctacggcggagactaccgccgctgaggctgacacatctgctgctatggcggagactatcgccgctgaggctgaagcgtcggatgctactgttgagggtaccgctaccgaggatgagagcacggctgctgaggccgagaccacccctgccgcaacagaccccactgatgctgaggccgagaccacccctgccgaaacagaccccaccgatgctgaggcgacgaccacctctgctgaggcaacgaccacctctgctgcggcaggagagagcggggctggcacggagcaggctgggggtgaggcaggtgacactgctgtcggtgccgagcaatctacctccactgtagaggccgaggctgctgctgctgcagcgaccgaggccgcgagtgcggccacagagacagctgcggaggcgacgacaaccgcgcaggaggccgggaagagtgctggtgaggcagcggaggacgctgcaggcgtcagccaaaaggctgcaaaggatgcgacgggggtggcggagctggctgctgatgcacagaaagctgctggcaagaagaaggatcagagacctgacagcatgtccgggccctttgggtgcacagggcatcctgagctcaggctctcaaagccgctaagatcgcacaacattccagccccaacatgcagcgatgatgcgcggtcacagaggaacgcggatgtggagctgcagactgcatgcctttgctggggcccctgccatgcacgggattgctccgaatattcccgaccaccaccttga

SEQ ID NO: 4067 - DNA, 876 bp, Chlorella protothecoides
atggagcccacccacgccacctcacagtcgttcgtgtcgtaccgcgtcacgtaccgccctgcctcaggccccggctcctccgtccaccccgcgggcgtcatccggcgcttcagcgactttgactggctgaagaagcagctccgggccaaccaccgggagcagcttcacatgtgcggagctctgcagggcaacgccaggtttggggggtttccaagccctcgccatggcccaacccttgctctgctgcgtggctgccttcctgtcttgtggctgctcatcgctgccctgcgcccactcagcctcgcatgcggccccctccctctcatcggcccaggctgcatcgtcccccccctgcccgagaagaacgtggtcgaaaagtacaagctgacggacgagttcatcgagcagcggcgcgccgcgctggcggtgttcatgaatcgcctggcggcgcacccggtgctgcgacactcccccgccttccagctgttcctggacgccgacgaggcggggtttgcgcgcgaggtggcgcgcaccgccggcgaggccggcggcgccggcgtgctggcggcggccgcctcggggtcgcccgccgccgccgtcgcctcggcggtgtccctgctgcgcagcctgggcgccagcgccagcggcctggtcagccgccagctggcgccgccgtcggaggaggaggaggacggcgagtacctgcgcgtgcgcgggtacctgcaccgcctggagcgccacgtggcggaggtgcacggccaggccgcgcgcctcgcccggcaccaggccgcgctggccgacgcgctgaccgggtttggcgaggccgtggcagacctgggcgctgaccgtgagaaggagggggagccaggggtttga

SEQ ID NO: 4068 - DNA, 738 bp, Chlorella protothecoides
atggcggctgtagtgccgtgccggagaccactggcggtggccagctcgtccccctccacagcccatggcctgcgcggggcgacactaccaccgtgccgcccctcacactgcgccccgaccccttccaggcagcgtgcccacccccgcccccgcccctgctccgggttccgggccacctccagcccagaagctgaagcagctgctgtgacagctgcaccgcccgagggcctggcctccggcgcggtgggcgcgtccctggccgccctccccgcttccgacctggagacgcccacccccggcttcgcctccatcgccgccgcgcttgcggccatcgccgcgggggagctggtgctggtgctggactcggaggaccgcgagaatgagggcgacctgatcggcgccgcggaccgcatcaccacgcgcgccaccgccttcctggtgcgccacaccagcggcgtggtgtgcgtgggcatgcgcggcgcggacctggaccgcctccgcctgccgctcatggtgcacagcgcggagaacgaggaggggttgtacaccgccttcacggtgaccgtggacgcgcggcacggcatcaccaccggcatctcggccgaggagcgcggcatcacgctgcgcgcgctgggaaaccccgccacccgcgcccaggacctgcggcggcctgggcacatcttccccctccgcgcccggccggtaggtttttggggtcgtgtttcctgcgtttcctag

SEQ ID NO: 4069 - DNA, 768 bp, Chlorella protothecoides
atgacatcgctgccgtccccgctgtcggcctgccccgaccccaaagtcgcagacctggtcctggcggtcagggcctgcccagagagcgccggggcgtggtgggccctcctggcctgcctggaggcccggcccctgcccggcctggacctgctgcaggtctacacgcaagccacccgtgccgtgccccgccaggggaaccaaggctccgacgcctacgttcgtctctggctgggctttgcccgccagcagtggtgcgtcggagtgagcgtgagagagggcatgtcgagcgacagagggcccacagcacccacggcgcctgcagtgcttttgagcgtcatgccggggcaccgggatcgcgacgacgcgcgcgacacgctgaagacgctgcgccgtcaggcgatcgggagcagctcccccctgctcttcctggaatgggcggcgctggagtgggattccggcgcgcgggaccgggcctccgccgtcctggccaagggcctgagggacggcgccgagccgccggccgcgctggaggcggccctggccgacgtggcggccggggtctggaggccggtgcccctctggcagcagtccgcagcgccggcggggccgcacacggccgcgctgacctgccccgccagcacctacgaggccttcgtgaccccgggcgccgaggcggagagacccgcgcgggccagccacacacacacgctggtgagcgcggccttgctgggaccaggctttccctttcatgggtgtgggagaggatga

SEQ ID NO: 4070 - DNA, 717 bp, Chlorella protothecoides
atgaagggcaaggagcagagcatggttgaggatgggatgattcaagcagggccccagattcccccgtgtcaatccagcactcctgtcggcagctctcggggtgcgtcgtcctcgctgctttccccccacccctccacccccccgctcatgcacctgcccacccctcgccctgcatcatccggccaggcccgcctcgcccagcacccactgcgccaaggtctgggcgccgaatccggtggcgctgccgtccttgtcgctgaacacgggcgcggcggcgtccaggtgcacccaggccacgcgctcggtgtccacgaactcgttgaggaagagggcagcgtggatgctgccccccgcccgcccgcccacgttcttgtagtccgcgatggggctcttcagcgcgtcggcgtacgccttctcaagcggcatgcgccacaccttctcgcccgcgcgccgtgcggcggcggccaccgcctcggccgccgcgtcgctggagccatacaggccagctatggcggggcccagcgcgatcatgcacgcgccggtcagcgtcgcgatgtccaccaccgcgtccagctggccctggttctgaacgtacagcagcgcgtccgccagggtcaaacgcccctctgcgtggtcgggtgtttgaggggggtgggtgggtgggtgcagcagcattgcaccgtcaatgctggcctcctcgtgcaggatcggtgctaa

SEQ ID NO: 4071 - DNA, 1980 bp, Chlorella protothecoides
  modified_base (388)..(397): a, c, t, g, unknown or other
atgacagaaggtcaatacatcatgggaggacattcggtcacctgtcgtgcccagtatacaatgagagactccatctctgcagcactgtcgacgccagcgagcagggaccttgatgttcatagtctgaaggcaggattgctccatgccttgccaaaattcgggctgggaacaggtcaacccctgctggttgtgaatgccactactggactgctgagcctctgctttgtcagtggaggggttactctttgccaaaaactgcgcgatccattcttcggaacttacaatcgaggtggtagaatgtctcagaagatgccactgagggcaagcttccggctgagtgatcagattgcatctcgcttttcacaagatagacctgagtgcatcctgnnnnnnnnnnatgcaggggttactctttgccaaaaactgcacgatccattttttggaaactacaatcgaagtggtagaatgtctcaagagatgccactgagggcaagcttccggctgagtgatcacattacatctcgtgtttcacaaggtggacctgagtgcatccttctagccttctaccgcgcgctgctgttggattcgccgacaccgaggcgccgcagcccgtcccaagggatggcacctccggggggctatgccgcgggcacgctgaccatggccgcgctgctgacggccctcacctcgtctcagggcctgctgaccactgccagtaaaactggcgggtcctacgcctacaacttcgccacagtgccattcctggccgaggccctgaaactaggcatcagctacaacctcctgcggcgccagcgcaaggaggaccccaaggccgcccagtgcaccaccaacccgcgcaccgtcgccctgttcctggtgccctccatcatctacatgctgcacaacaacgtgcagcccaagggtgtacaggctggaaccatcgaggtcctggcagagcaggctcgtgcttgtaatgaaactgaagactctagtgcatgtacagacatccccacccagcacgtgcagcctgacagcccccgccctcccccacacaacacagttctacctgctgcggtatgtggacccagccacctaccagatcctgggcaacctgaagatcgtcaccacgggcatcctcttccgcatctgcctgcggcgccaactcagcctgctgcagtggatcgcgctctgcctgctggccatcggggccaccaccagccagatcaacacggactgcagccagggcagcaccaagtccctcatgtcggcgcccctcgcgtctgcagcccttccctccccacccctcccgccccagggctatgcctttggcgcgctgagcgccacgctctccgccgtggcggccgtgtacacggagtgggtgatgaagcacaacagcgacagcctgtactggcagaacatgcagctctacggctttggcgtggtgttcaacggcctggctctggtgctcggcagcggcggctcgggctcgggcggggccgccctcgccgacctcctgcacggctacacccccgtcacctggctggtggttgccaacctggccttcagcggcctccttgtttcctgggtcatgaagtttgcaggcaagggaaatgggatgcaggggagggggaagggcatagggcttgtatgctctcgcttggaatgcagagtcccggctttgctaccacgctgtgttctgttacaaccctggcccctccctcgtggggcacagaaactcacaccctccaccccttccccccttgcctcccagactccatcgtcaaggtgtatgccacctccctggccatgctgctcaccaccggcgtgtccatcgccttcttcggcctggaccccagcctgcagctggggctgggcctggcggtggcctgcgtctccgtcgtcctctactacgtcagcccggagaagctggcgctgccgccgggcgggagcgccgccagcagggcgctgctgcccaagtga

SEQ ID NO: 4072 - DNA, 222 bp, Chlorella protothecoides
atgcaggcccccggtggcgcctttgaaacgccggctccagtggccgtggtgtacatttgcggcgactgcggagcagaaaacaccatcagagcagtggatgtcattcggtgtcgtgagtgcgggtaccggattctgtacaagaagcggacaaagcgtgtcgtccagtacgaagctcggtgcgtccgtgttgtgtgcagaatgcttcctgaagtcactgtggcg

SEQ ID NO: 4073 - DNA, 951 bp, Chlorella protothecoides
atgtacccgctctgccctggacccagccgtgccatgagttccctcacccctgcccgcaaccgcacagccggacctggtgcccgtgggagaggaccagaggcagcacctggagctgacacgggacctggcggagcgcatgaacagcctgtacggaggaaaacggggcaagaagctgggcctgcgcggctcgcgcctcttcagggtgcccgaggcaggcattgtggaccgtggcggccgctgcatgtccctcctggtgagccaaggacccgtagcaccttgcaggagttgcttggcaggcatgagccatgtgcaatcaccccctcgccagagtctgggcacagggaaggagcctgtccagtgcccgctccaccgcccctcctccaccccgcctcccctccccaggacgggacggtgaagatgtccaagtccgcggagtcggacgccagccgcatcaacctcctggacccgccagacctgatccggaaaaaggtccagcgcgccaagaccgacgcccaggatgggctacgctggggcgacccggaccggccagaggccgccaacctgctcaccatctaccagaccatcaccgggcggccccaggtggggctggaggggtctttgtttgggaatcatggagcggccagcgtacggacatctgcgtactacgctggacagtgtgcgatgctcgatgcattctctgcacccctcgctccgcgtcaaccgtcaggaggaggtggcggaggaggtggcggccatgcgctggggcacgttcaagccgctgctggcagaggcgctggtggagcacttggcccccatccagcagcgctacgccgacatcatggccgacccgcagactctggacgacatcctggagaaggcaagcgcgcgggggaaaggggtatgcagcccgcaaggtcggccagcgcatatgtttggtcctcctgtgcctga

SEQ ID NO: 4074 - DNA, 747 bp, Chlorella protothecoides
atgatcgagatgatgaagatcgacatgggcgggtctggcgccgtcctgggcgcggccaagaccctggccttgctcaagcctgagggcatcgaggtgcactttgtaatcgccgcctgcgagaacatggtggcggggggcggcatgcgcccgggggacatcctggtggcctccaacgggaagacggtggagatcaacaacaccgacgcagcaccgatcctgcacgaggaggccagcattgacggtgcaatgctgctgcacccacccacccacccccctcaaacacccgaccacgcagaggggcgtttgaccctggcggacgcgctgctgtacgttcagaaccagggccagctggacgcggtggtggacatcgcgacgctgaccggcgcgtgcatgatcgcgctgggccccgccatagctggcctgtatggctccagcgacgcggcggccgaggcggtggccgccgccgcacggcgcgcgggcgagaaggtgtggcgcatgccgcttgagaaggcgtacgccgacgcgctgaagagccccatcgcggactacaagaacgtgggcgggcgggcggggggcagcatccacgctgccctcttcctcaacgagttcgtggacaccgagcgcgtggcctgggtgcacctggacgccgccgcgcccgtgttcagcgacaaggacggcagcgccaccggattcggcgcccagaccttggcgcagtgggtgctgggcgaggcgggcctggccggatga

SEQ ID NO: 4075 - DNA, 723 bp, Chlorella protothecoides
atggttcggggacccacggcctacttcctctttgccgacgccgtgagggccgatgtccaggaggagctgcaggccagacagcccgctggcaaaatctcggtggcgatcctgggcaaggcgataggcgagcgatggcaagctctcagcgaggaggagaaacaggtcttcaaggaccaagctgcagcaaaggcagcggcaatggcatggctgtgctcgaccctttcacgaacagctgccaacacctttcccgccacagagcttgcggcgagcgaggaccctcagggcgcgggtgaccccgagtccagcgatccctcccccagcaccgcccctgcctccctccccacctccctggtgaagaagatcatgaccatggacagcgacgtgtcgcgagtgagcgcagagggtctgcgtgcggtaggcgctgccaccgaggcgttcctaggcctgctggccgccggggcgctggccagggctgccggcgacaagcgaaagaacttcaggtttggggatgtcctggccctggccctgaaggaccggcgcctgatcgacatggggctggccgaggtcttgcagcaggatccacagtttagagaggcatgcgaggcagtggacgcctcggccaagcccaaatctgccagagcagcagctgtgggggacatcgaggacgtgggcatgagaaaattgaccgccttcttccaaggtccgacactggtggcctcttaa

SEQ ID NO: 4076 - DNA, 192 bp, Chlorella protothecoides
atgcacctgatgtgccatttcctggaggcggccaaggcggagggtcactcgcaggcccccgcgctggcggggctgggccgctacttcctggaggtcgagcactcgccggagcaggcgtcgcgctgcttcaagcgcgcgctggccctggaccccaccctggagttaccaggtggcgcggtggtggaggagtga

SEQ ID NO: 4077 - DNA, 288 bp, Chlorella protothecoides
atgagctcttgtggggcatggttgcatcgcctggcaagcggcacccggtgcggcgcccaggctagccggtactcccggaggcaccatggcgagcgagccctgcatgccgggctcaggccccaggcttcaagcgcagccggcaccgccaagcccagcagcacggagaccaagcccaggtgggcggagtttgacgccgagacacctaccggcacgctccacctgggtaactacctgggcgccattcgcggctggaccgccctgcagcatgagtatggtgcgagcttgtga

SEQ ID NO: 4078 - DNA, 486 bp, Chlorella protothecoides
atgggcgcgggggtggcgggggcaggcgaggggacggcgcccggggtcccgccccgtgccgccgccgacgagaagcaggcctcgaactcgggggcgccgctggaccggtggtcccacgtctcggccacgagcaggaccgccccgtcagagacccctctccctgcatcggccctgctgagaccctggtcgcgcgccaaggaagcccaggccgcacgggagcgcgccggtttccacgagcaaatgccgcgcggcgtgttcgaggcggacgagggcctgcaggagcggcgggtgctggagtacctggccctgggcgacctgcaggcggcggttggcttcctgctggccagcccgccggaccgcagcgcgcgctactaccgcgacgcgctgtgcacgctggccatggcctttgccgtgggtgacgacgccggcacgcgcgagcggggcggcgcgggggccggcgacggggggcccccggaggggacgccg

SEQ ID NO: 4079 - DNA, 837 bp, Chlorella protothecoides
  modified_base (415)..(424): a, c, t, g, unknown or other
atgccggcacattggcgtcttaaactactcagaatctcatcgagccagcgcctcccccgcagacatgtgttcggtgcgagcacggaagcccgtcggaacctcgtccgggtcgacgaccagacccttggctggacgtttgggaacaccctggtcctcgcagatgtggagacaagcacccaacgcttgtcctctgcattcgcccacggaatcacagccctggagagcctccctggtcgacagctgctcgcggtggcagaggggggggcgcacccctgcgtgtctctgatcgaggtctccaccctgcgccgccggaaacagttgacgccgccccccgcgtcatgccgggtgcggagaggtattctgatgtgttgctgtgacagagagtgcgttaccaatccacctgcttatcagaatnnnnnnnnnngccgccccccgcgtcatgccgggtgcggaggggtattctgttgtgttgctgtgacagagagtgcgttcccaatccacctgctcatcagagctcctgaatcctgccccactgcagagcatactctctgtgggggccacagggaatggaaaatttgtcgcaggtctcgtgtgggcgggtcccaacctcccagtctcggtccttgtgtgggcctgggagcgttcgcgcgtggctgcgaccctcacagtgctgaaccagagcgccggagagcgtccgccggaactggaccttgccttcagcgcacctggtgggagaagcgggagaggggtttggatgtgcgaggtgcctggacagcctggccaattccgcccatgcagatggctgcaccatgcgccaagcagcgcctggctgggtga

SEQ ID NO: 4080 - DNA, 276 bp, Chlorella protothecoides
atgcaggaagcagatacctctcggcgcacagagctccttccttgggccaatgaggtgttggtgggccgagaggagctctcatccctgagagggacagtcgaggagctgcaggatcaggtgaaggacattacagggcaacacgattaccagcttcacatgagagaggtagaggctgctgagaagctggcagccctccgagccgagcatgcagctgagctccaggctggcctcgacaagtgcgcgcgagacggggcaggagccagatacctcatatga

SEQ ID NO: 4081 - DNA, 339 bp, Chlorella protothecoides
atggaggagctttcagaccctgttcatcctagcttgacgagggagtctactctcactcagcacggcaccctgtgtggtcggcctgaacctgctgaagcatggcgggggttcctccctcctttccagagcccgcctcgacctgcacacccacaggcgctctgggcgctggcagcagtgtccaagtccggggtggcctccaggcggtctgccgccaattccatcgtccaggctgcaaagaaggctgtgtccggcgacagcgagcgccgcctcttctcggagatgggatctttctgcgagcagctgattcgactctgtttccaccaggcccggcagaagtaa

SEQ ID NO: 4082 - DNA, 240 bp, Chlorella protothecoides
atggaggccgcgggggtgctgaaccgcctgttcctggaggaccctcgtgcgcggcggcgcggcctgagcctgcgtcgcttcgccgtgctccccctgaccgaggactgcgggctggtggagtgggtgccgcacacggtgggcctgaggcactgcgtgcaggacgtgtatgcggcggagggcctcttctcccgcgagaccaccaacggcaagataaaggccatgtacgacgccgccgcgcag

SEQ ID NO: 4083 - DNA, 774 bp, Chlorella protothecoides
atggcctctgtgaatgtcctcgagccaccctcaaacacagcaaacctacacgcctcacctcctccctctccccaccaactccaccccctgaacctccaggtgccaggctggagtggtcgtgaagctggcccgggtgatggcggagtcggggcagggcacgcaggacgacatcataggggacgccggaacccatgccatccgagccccaaccaggcgcctcacccctaccaacccgcaggcctgttccagcgcggcatctcgctccagccaggcagggaggacgtctacttccgctacgccgtgttcctggacaagatgctgctggacgcgcgggcgcggcagcggggcgagacgcgtgcggccgcggggaagcacatggaccgtctgcacggccggtccaagctgaagctgggcgaggaccggccctacctggagatcctgctggaggtcctgcgcatgtacggccggggcctggtgctgggcagccggcacgtctaccaggccctcccccgcctgctcaccctctggttcgagcacggcggcggcggccagggaggcccagcggcggccgcccccagcgccaaggaccgcgagtgcgcggccgccgtggcggcgctgatgcaggagctggcgcgcagcgtgcccctgcacgtctggctgaccgcgctgccgcagctcacctcccgcatctgccacccggatgccgaggtggcgggggtgacgcgcggtatcatcacccgggtgacacaggtctacccccaccaggtgcggtag

SEQ ID NO: 4084 - DNA, 609 bp, Chlorella protothecoides
atggcgcccgagatcctgggttcccacaagtacgacgccaaggcggacctgtggagcgtgggggccatcctgtttgagatggtgggcgggcgcccgcccttcaccggcgccaaccagctgcagctgctgcgcagcatccagcgcgcgcccgcgcggctaccggagggcgccgctgccgcgctgtcggcgccctgccgcgcgctgatcgccgcgctgctgcgccccaaccccgtggagcgcatctccttcgaggagttcttccgccaccccttcctgtcgctcgcgcctctgggggcccccggcgcgcgcgacccagggccccccccctccacctgggccgccaccaccagccgcgcggacttcgcctccacgccgccctacgtgctgcactccgggatcgcggggcgcggggcccagcccatgccccgctctcgctccgccgccggtttcgggcagcaggttgtggggttcgatggccccggcctgacggcgccggggacgaacgcagccgccgtgcacgccgcggtgccgctgggcgcgctgagccacgcgctgcgctcgcgcgcctcgctggacgccgcacgtgagggggctgtcgtcgcggcgcgc

SEQ ID NO: 4085 - DNA, 222 bp, Chlorella protothecoides
atggcaagaaagcgagcgcagcgggaggctcgggccaccgaggaggccatcgccgccggcatgctgagcgtccggagcctggcaaagaaacggcggcgtgagtccagcgcagcaagaccacgggaccagggcctgcaggaggacggcggcagcttcagggcgggtgtcatgcgcgtgagcaggcccccgcccccgagtgccaagagaggcgggaggcggtga

SEQ ID NO: 4086 - DNA, 864 bp, Chlorella protothecoides
atggaggggatgggcgtggtggcgctgaagcccatgaagggctacaaggaggtgtgggacgagctcgccggcacgcaggccaagggccgaaaggtgtcgacgaatgtggactgcgtcggtctgcctgacacctggctccagcccgccatcgctcggggcttgctgcaaccaatcccagccgcacgccgccaccgttggtgggtgagtcccttggagaaccctgggcgggggaaggcggcagcagtgccatgcacggagcatcaattcttagtcttaccgtgcggcgggctgttctctatcaccaccatcgacacacaattgcagagcctgctgtctgcagactggcgccgattggtcactcgggacgatgcagggctgcagtcgccgtacggcgaggtgtatgcctgccccagctcttgggggaccctgctcatggccagccacgggcctcggctccgaagaaagggcctccagccaccgcgcgactgggttgacctcctgaacccagcgctggggggcaggatagccctggacgacagcccccgcgtgctcctcgccgccgcgctgggcacgttgggccttgaccccggcgccaccgccactgacgtcgcccggtgcggtgtccgcgccggagacctgagggcgcgcgtgcgccgcctgcgcgcggcgacgcgcgtttttggaaaggacggcgcgcacgtgcgcgcgctggagggcggggacgtggatgtggcggtggggtggggcgacgcgctcgtgggcacggcgcagcgctgcaccggggtcgtgctctccgcgcccgcctcgggcacgctgctctgggccgatctgtgggcggtaccgcggggggcgcagggcgggtga

SEQ ID NO: 4087 - DNA, 294 bp, Chlorella protothecoides
atgaggcccagcccctcaccccccccgatccccacctccaagcagactcgcagccggctgtatctggtgatggagttttgcgccggcggtgacctgtcccagttcctgcgccacggcagggtgttgccggaggcgacggcgcgccacttcctccgccagctggcggcggggctgcgggagatgtgggcgcaccacctcgtccatgtgttgccattggcgtgtgggctgtgcatgaagggggccgccccggccagaatccgttcggtgtggatgctgccaccccacagcccgtga

SEQ ID NO: 4088 - DNA, 252 bp, Chlorella protothecoides
atggagatctcgggcccacgcctggtcggcgactgggaggttggtgctcacgtcggctctggctccttcgccatagtgtggcgaggccggcaccggctgacgggccaggatgctgccataaaggagatcaacctctccagactgaacgccaaattgcgttccagcctggagagcgaggtcaccatcctccggcgaataaagcacgcaaacatcgtccggctcttggacgtcatagaggtgggaggggtttag

SEQ ID NO: 4089 - DNA, 546 bp, Chlorella protothecoides
aagcgcgcccagacgtcgtactggacgcaggaggagaaggacgcgttctacgcggccttccagggctggggccgcgactgggccgcgctgcgccgcgcggtgccggccaagactctgacccagatcaagaactactaccagaactaccgcagcaagctgggcctggaccggctgggccaggtcccggacgacggcgcgggcgtcggccccgtggctggccccgtgcgcaagcggaaaggtgggcggggcggcggggtggagtgggtgaggggagcggggtctgcggtgtggcttgccgattgttgggcgcgtgctcccactgacctcggccagccactggttcccgtaccgtgtcgtgtggcccacggcctggacgcgacgaccgccacacacctctccctccccaccacccgcttcacctcccccccttgctgcagctggcaaggagggatcggggcgcgaccccggccacggggacacgggcccggaggtcggcgccgccgcgagcggcagcggagccgcgcgcgcggcgaagggccgcggcct

SEQ ID NO: 4090 - DNA, 1581 bp, Chlorella protothecoides
atgccagggagccgtcaagcgattcggaaagtccatgcaaacgtcatgggacgtgccatgccccacaaattcaggaacgggaatcgcccctcagccaactgcgcatcagctatggctggggaacgggcggtcagggcacccagcaacgggcactcgatggacgccgagaccacctcacccgtgctcctagccttggccaagcgtcttcgcaatcagcgaaagaagctgcgtggcatcgatgagattcaagccaaggctgatgtcggcaaggccctcaacgccgatcaggaggcagccctggccagcaaggcgtccatcgtggcagcggtggaggagctggagcggctgaccaagctgctgaaggagcccctggccgaggaggtggccgctgccaggcaggagggcgaggctgctgctgccgcccgtgccccaccttcccccaccaagtctgatgcggagtggctggccgagagggaggatgccgtggccaaagctgtgggccccctgcgtcagcagctgagcgaggcgaagacgaacgccgccgcagacgccaaggccgccaagctggccgcggccgcccgagaggcagctgccaagaaggagggcgaggccctgggccggaaggcctgcgttgactctagtggtcatgaggagacagcactgactccgggatgggttcctccacctgtgactgagaccctgggtctcccccctcgtcccccacgcctccacccattccccgtcgcatatcccctcgcaggtgctggacccctttgcgctgcagcacgacgtctcgcactacgagcgccacgtctgcctcatgtacgcccagcaggcgggcattcccctgacccccgccgacatcaccaacgtggccgtgtttgcgcgcatggtctccagtcgcgtgttcaacacccagctcagccatgccgtgagtggatgtggggtgggatgacgggcgtggtgtgcagtgtgacgttcactggacagttgtttgcatcttcctggctcctgcgggtgcccatgatgtggaggaggagacgtgattctgcgcacacacccaaaaaccctcgcatcatctcgcgtcggtcacccaccccgctacccccctccccctccccacgacccacaggaggccctgggcctgagcaaggacctggccctcaaggctctgctccaccccaacgagccgctgctgggcgacgccacgacgggcgccgacctggccgaggtggtgaagagcatccaggccctggactacgtggcgctggtgcccaacctgcagggcgtggctggggacgcgggcccggcgccccgcccaggccacgagcacgagggcccaggcgcgggcccacgccgccagttgggcgaccccgccgtggtcggccccgtggtcgggtccgtggccggccccccctccctggccgggcccggtgccgggtccgctgctgcggcggcgacggagggcggcgaggctctgacccccgcggctgcggccgccgcctcgggcgagaacctggtcgaccactttttcgggcaggcgtcttcccgccccgcctcgcgccaggccgagggactcgt

SEQ ID NO: 4091 - DNA, 597 bp, Chlorella protothecoides
atgctcaactttccaatttccttggccccgcaggatggggacaggttctggcgcatgcctgaagcatacgtgcgcggcaacaccatcaagtaccttcgagttcctgatgaggtgcattctggggtggcacacgggatcccgcgtctagtattgcaccaggtcattgacaaggccaaggaggagacgctccggagggatggtgagcttcgctgtggtgatgccttcctgattgggggcgctgggatcacctgtcacgggcgtgaggatcgccagctgcattcctctgttgttccctgtccggatgtgtctcgtgttgttccatcaggtgcttgttggttgcactgcagacattccttccacaagcccatcctccatcccccctctactgctgcagagaagcgaccgagtgtcggcagcaggggacgcggccgggggccgggccgagggggccgggacggtggcggcggcaggggaggacgggacggcggcggcggcaggggaggccgagatggcggcggcggcaggggaggccggggtgcccccaatggtggcagagggggcggtggcgggaggggaccccccgcagacctacagtag

SEQ ID NO: 4092 - DNA, 2175 bp, Chlorella protothecoides
  modified_base (349)..(358): a, c, t, g, unknown or other
  modified_base (501)..(510): a, c, t, g, unknown or other
  modified_base (1036)..(1045): a, c, t, g, unknown or other
atgcgttcgtgcccccacccccctgcaaggcgctcatctttcaccattatgcagagggacgaggaggaggcggctcgcgtgtatgaggagtttgtgaaggactttggcgggggccggccaagcgggactggctttgtgcgcggcggcgtcatccagcctgggagcaggggcgatgcctccgcgagtgggtccaggcaggagaagaagctgtacatgccctcgctgcatggtccaggcatcgctggggtgtttggtgactccaaggaagaggccgacgatgagcctgcggtgggcggggtcttgcccacgtctgtgttcacatgtgatgactcatccatgcaggaggcannnnnnnnnntatttgtttcgcatggaggcggcgcccgtgccgccaaagggcagcaagcccaagcgaatcgatctcttcctggagaacatgaagaagtgaggggctggcagggcaagcgtctgatgatttgcaagagtagctgtggggaattnnnnnnnnnngaagaagtgaggggctggcagggcaagcgtttgatgatttgcaagagtagctgtggggaaactggtgtccagactgcggcgggccttcctgggtctcccctgtcagatggtcaccttggccccaaggagcagatgcagcgggagctgaggaaggagctcaacctcccccctgccgacgacgactttgccgagcgtgggtcccacgacgtgaacgaccccgcctccacaaacctgtacgttggcaacatggccccaaccgtggacgagcagatcctgctgcgcgagtttggccgcttcggccccatcggctcggtcaaggtcatgtggccgcgggacgaggagcagcgccgccggggacgaaacaccggcttcgtgctcttcatggtgggtggggatcgcctttgtttgggcaagggatgggtgggaaggccttcctgggtcggggaaacattcgcccttggccctctgccctcacatccccccacgtccccacctcacccaccctgcaaccaccccctcattcccnnnnnnnnnngggtggggatcgcctttgtttgggcaaggggaagggcggggagggcttgctgggtgggggaaacatttgcccttgcccccctgcccacacatcccccaacatccccacctcacccaccctgcaacctccccctcattccgcgacagctgcgggacgacgcagaccgagcgcgggaggcgctggacggcgctttcttgcatgagatgccgctgaacattgggtggggcaaggccatgcccctgcccacggcccccatttggcccccgcctggcggcttggcggtggaggagggcgcgccgctctaccctgcgccccccgcccccggccccgacggccgctggacctggcgggaggcggtgccggtggtgccgcacggcgcgcgcgacgatgcggcgcaggggccgctgggccgtggaccccggatcgtggtgcacccccccgccgacgagcgcacgcgcttcgtcatcgacgccgtggcctactacgtcatccgtgacggctgctccttcgagcaggtggtgatggagcgggagttgggcaaccccgagttcgccttcttgctggacaccacgtcggcggagcacgcctactaccgatggcgcctcttctcccttgcgtctggcgacagcctgcgcaggtggcagggaggaggaggaggagggggggggttctggaaatggatgtcggttaaagctgcggggagatttccagaccaggagcccctgggctggcgggtggagcccttcctgatggtggaggagagcaacgcgtgggtccctccccccatgactgtcggcgccgcggggatcgccaagacggcggcgcagggcgggggcgggcggcgccggcccgaggaggcgcggccgctgtcggaggcgcagcgcgatcgcttcgaggactgcctgcgccggctgaccatggcgcgggaggacatctgcgctgccatgatgtttgcgttggagatggcggactctggtgcggcgcggcggtggttgggaatcggggggggagggggggtccctccgtgcaaagggtgcttccttgggccacagggcatggcactcccttcacgaaggatgcctcgtgtgctacccaggctgtgtgacacctgcgcgccctctcacacttga

SEQ ID NO: 4093 - DNA, 318 bp, Chlorella protothecoides
atgggccacatcttctatcgccaggagaagtggagcctggccgagtaccacttccggcgggccactgccatccaccctacctcctccgtcctgcgctgttatctgggcatggcgctgcggcgcctggaacggctggaagaagcgctccttgagctccacagggcgatcgctgcggaccccaagaacccactggcgaggtttgaggcagcaaacgtgctgctggcctgcgagaggccacgggacgcgctgcacgagctccaggcgctgcacgtgggtgcctgggttgtgatctgggcaccacgttgtgtggagagatga

SEQ ID NO: 4094 - DNA, 1158 bp, Chlorella protothecoides
atgctggtgctcagctaccacctccaggcggccaccatgtgcgagttcagccgcgaggagttcgaggggggcctggcccgcctggcctgcgactccctgtccaagctcagggcggcgctgccggggctgcgggctcagctggacgacgcctccaggttcccagagatctacaagtacgcctacctcttctccaggggcagtggttggggttccaagaggacagggtgggtgggttgcaaagggggtgctgcctgccagagggaagcctgctgccccttcgacctgatcccaagctccagagctcgagactccccagacaagacccgttctgacccaatggaggtcaccctccgccccctcatttcgatgtgcaatccccttgcccccattcccccacaccctcgcaacccccaaccccatgcctcaaacaatcacaacagggagaagggccagaagtgcgtgcagcaggacgtcgccatcgccatgtggcagctgctcctgcccgcccaccgctggcgctacacgcaggactggtgcgacttcctgcaggccaagcacaaccgcgccatctcgcgcgacacctggaatcagctgctggacttcatcctcagcgtcagcccggacttcagcgactacgacgacgctggggcctggccctacctgatagacgagttcgtggagcacatgcgcgagaagcagcagcagcagggttctgagcgctctgtgacgcatgtgctcgagggtcagagctgggatcacaggggtcggaggtcgcggggttcccgggaccagcgtcgagggctcccaggctcaccgtcgagggcttcccgggaccagcttcagaccacgcgcaaacctacgctgcgccccgcagggtcagcgccacggcctcccgccaacccctcacatctcctcgtccagcccgtcctcggtgacgcgcagcctctcgatggcgcccttgatgagctcgctgtcggccgcaggaggctgcaggtccagcgccgcgcagaagcagcgcatcgcctggtccacctccccgagccgcttgtgcaccttgcccatctggaagtaggtgctgacctcctgcggcgcgacgtcctgcagggggggttcaggaagggggatgtttgggtggggcgggacggggcgaggttatga

SEQ ID NO: 4095 - DNA, 306 bp, Chlorella protothecoides
atggcgagtcgtgtgaccaagccgcagcgggagaagctggcacaggtggtgggggtgacaggcgcctcaacccgcaccgccctggagtgcctgacggccacggggtggagcctggaggccgcagtggactactactactcctctggagcctaccccgctgcgcgtgggggcaggggccccaagacagacaagtgcgtggctgggagatggtttgggttccacttgcaaggggggaaacacgaccagccagcgcactgccctgcaagtctgtccgcaaccggggcctggaacagcggtcgatgctga

SEQ ID NO: 4096 - DNA, 519 bp, Chlorella protothecoides
  modified_base (68)..(77): a, c, t, g, unknown or other
atggagcctgcaccggcatttttagggccccagcatcccggcatggcctcgattgggggtgcccccannnnnnnnnnccccttgctggagcaccgcgccgcggacccatgtgacgcactcacctcgagagggccttcgacatcaacgacccgtgcttctccaccgaccagttcaggatgtacgagttcaaggtatggtcctcatgggatgctgaagcggtggggaactgggacgctgatagacctgcatggaggctttgcaccaggaccacgcctcataggtctccatgttgaagaatggcaagcagtcactcctcccatcacggcatgttcaactcagatcaagcgctgccctcgtgcacgtccacacgactggacgggctgtccctttgcgcacccagatacgttgcagctgggtggggtggagcgtgggccgaggtttggctgccatgcaccatgtgccggctggagtgcaactgggtggatgccttggctgaagacagtgactcatgtcttctga

SEQ ID NO: 4097 - DNA, 351 bp, Chlorella protothecoides
atgcaccaggcgatggaccgcgcgcaccgcctggggcagcgccgctcggtcaacgtgtaccgcctgatcctggcggggacgctggaggaggaaatcatgtccctccaacgcttcaagctggacgtggcgggggcggtggtcaacgccgacaacgcctcgctggagggcatggatgcggggcgggtgctggacctgctgggcgacgccgccaaggcgagcgaggcgcgggacggtggcgaggcggcgaagaagaagaagggggggctggccggcatgctggccgagctgccggacgtggaggaggctgtcgaccagtacgcggccgagttctcgaggcccgagacggattga

SEQ ID NO: 4098 - DNA, 360 bp, Chlorella protothecoides
atgcatctcaagccgggcgacggcacgcaccccgaccttttcttctggagtcaggaaccggcgggcagccaggccggcgcagcgctgctcgcgctcatgcgccccttaccctcaccccctccgccggccgagccgcccgtcgcggatgctgccgtccccatcggggcctcggcactggcggcagccctgggcaacctgggcgcggcggcagggaacgggtcgagcggcgcccgggcaggccccgccggcgggccctccctggcgagcgtgctccgccccgccaccctggttcccctcctcgcgcgccgccccgagctggtggcggcgatggccccccacctccccaaggcccacaggtga

SEQ ID NO: 4099 - DNA, 498 bp, Chlorella protothecoides
atgccgcagagggtgcagcagcccgccacccgcgccccccggcagcctcccagctcggagcacgacggcccgccgggcatgccccctgccccgcccctgccccgccgcaggaccccggaggccatcgcacacctcgtcaccacgccccagttccggcacacgctggatgtgctgacgcaggcgctgaacagcgggcagctgcacccctcccactttggcgtcccggcagaggtcggtgggcgtgcggtgctggtgcccgagggggcaggggcggacgaggccggaggatggatgtggaacccttctgccctcctcccaggaaccaagtgctccctgctcaccagtgtgacccagaggtggtgctcaggtgtgagggaccgccgcatgatccaaaaacatatgctctccctccatccaaccatgctgcagggatttggcacgctggcgctgctccagggtcttcaacggcaagccgaccagcagaagccaaaagactga

SEQ ID NO: 4100 - DNA, 3186 bp, Chlorella protothecoides
  modified_base (96)..(105): a, c, t, g, unknown or other
  modified_base (307)..(316): a, c, t, g, unknown or other
  modified_base (1462)..(1471): a, c, t, g, unknown or other
  modified_base (2172)..(2181): a, c, t, g, unknown or other
  modified_base (3044)..(3105): a, c, t, g, unknown or other
atggcgctgccgctgcctcaggctcatgcaggggcccctcgtccacacactcttccacgcagcgcccagacacgctcaccatggccttgccctgannnnnnnnnncgctgcctcaggctcatgcaggggcccctcatccacacactcttccacacagcacccagacatgctcaccatggccttgccctggtcgacgcccatccctccctccatcccccctcggaacatggggtcgggaggaggtggcctgggagatgctcaggggaagggggaaggcccgatcggtccgtgtggggcgtgcaccgtnnnnnnnnnngtggcctgggagatgctcaggggaaggggggcggcctgatcggtccgtgtggggcgtgcaccgcgggggtcaacccttttgcagggcctttgacctgcagggcctgcaccagtctgcacaaacttccggcagtgaaacctaaacaatctcctactgacaacgtggggcatcgcggatttgagttttcctccccaccctcactccgtcgggtcccgcggtacccggaccccagtactggaggaggggacggggcgcagacccgacctcctgcccagcacatgactggggccggcagggccattgatcgccctccattcattgcattgttacatagagggcgactcataagtgcggtgtcctatcacctacatttccctcgacctgaagtcaaacttgcgccatctgcgtcatggtgcagacaccgcctgcctgccgccatggaggagatcatgaagaagcgccagaaggccctggatgaggcctatgaggcacagtgggatggtggtcggggatcgcaccacccagattacgacccggaggccaccggggagggcgtggtcaaggcctcccgggagaccgaggagctgtacaacgccatcgtgaagaacgacatcaagaccgtgtacaagaagatcgaggagggtgcggatgttaatttcctctttggccgagcctacaagtgccctgaggggtacacccctctgatggtggcagcccacagggggcgcctggagtgtgccaaggcgctgctgcgtgccggcgccgaccccaactttgtcaataatggcggcgacctgaccctgttctgggccctggacggcggtgagtgcatggggcatgctgcagggtgctgtagttggagttctgctgggaagggcgacctgcagtgtgacgagacgggagtctctggcgggggatggcatgagccacggaggccgcacgcttcacagccagcccccaccccgattgtgcaggcgtggagatcaccaagctgctgcatgactatggcgcggatctggatgccgtgtcgcccaaggattggacccctctctcgtacgcaaaggccaaaggaaagtacggcgccaccgaggagaagggcatctaccccgagcacttcttcccaacacgccttcttcgctacgatannnnnnnnnnggtccatcattgggatgcaggagaatccaccatggcatgtgactcggcacttcttcccgacacgccttcttcgctacgatgcaggatgtgctgaagttttatggggctacgaagtatggctctgggccaccagctctgggcgatcgatcgcctcgggagtcgtacaacccccgtggagagggcttcctgcgcgagaggggcagctaccagaccccccaggagcacccttgagcctgttgcagagggattggagatgctgtgcctgctgtgctgggaggatctcgccaaggatgaggaattgcccgcgggcaaacgtgcagacaatggggcttgacagcccgacgacagagacaggcaccgcgcttccagatcacattggcatgcagttgcggcttctcggaaacagggcacagagcgaggcaagcggtcgaggaccgctgggcgcatggggctcggcgccgtcaagctcaaagggttgcaccctttgcggcgatcgcagcacctgccggggctcatgcaggaagcaaggaggagctgggacgggccacatggaccctcctccatacaatggctgcccagtttccggatcgaccggctcccagtcagcagcgcgacgtcaagaatctggtgcggggggccactgccactccttgtgggtcgtgatgtattccggaaagacgaggcatcaacagatctgtcannnnnnnnnngggccactgccactccttgtgggtcgtgatctattccggaaagacggggcatcacctgatctgtccagccgttctacagatcgacatcctcacgcgcatgtatccgtgtggcgaatgtgcagctcacttcaaggagcttgtaaggaacaacccgccgcgggtggccagtgggcccgagctgcagcagtacatgtgcgagttacacaaccaggtcaaccagcgcctgcgcaagccggccttcaactgcgcgctggcgggggcgaggtggcgggccctggactgcgacgaggacggcgtcgctgcgtgcgccattcaaccggcaaattcgtcgcttggtgcacggcggtggccgtggtagtgcagggatttcaaggatttagactcaggaatcgccaggcaggagaagatgaagcaaggagtcaagattggccgccagcgcccccccgcgcggccggcaccaacgttctcaccgcttctggttgggccggaactgctcgccgacgggtcgctgaatgtagcgcttctcctcgtcctcctgcttggccttgggcggcttcagcccccccagcgccaccgacccgcccttggacttcttgggcttcttgctggcgaagtcgcgccaggtgcccacccgcccctcccgcgtcttctcccaccgtcgctcgtggtcgcgcgcgcgcttggcctccgccttctcctgcttgtgctccgccttggcccgctccgtctcctcctcgatccgccggttcagcttgcgccgacgccactccgagttggccagcacctcccgcgccttcagcttccaggcctcgtgaaactgggctgtgccctcgtacgcggcctgcacgccctccgtgcccgcnnnnnnnnnnnnnnnnnnnnnnnnnnnnnnnnnnnnnnnnnnnnnnnnnnnnnnnnnnnnnnttcatcgtggccgccactcgcaccgccgcgtcgtgcttggcggccttgcgccaggccttcagcacctcctctatgaggggg

SEQ ID NO: 4101 - DNA, 1359 bp, Chlorella protothecoides
atgcccagctccgccgtctacctgaacgtgtatgacctcatagagcacaatgactggacctactggtgcggcgtgggcatcttccactcaggagtcgaggtgtacggtgtggagtatgcttatggaggacatgagtacgatgccccaggtgcgctccaggggatgcaggggcctccagggtgcaaggctcgcgatgtcgcattgttgtgtctttctggctatgcacaggggccccgcggctctgctcgaacaggacggcgcctgccctcaggagctcctccgtcgttccgattgtccacaggcgtgtttgccaccaatccccggcaagctcccgggacggtgacgttccgcgaacccgtgctggtgggggagacggacatgacgccccgagaggtgtatgccatggtgcaggagctgggccagatcttcaggggcaacgcatatcacctgctgcagcagaactgcaacaccttttctgacgagctctgctatcgcctgacgggccagagggcacccccatgggtaggtcaaccgtctggccaactttgcggtgtccctgcactgcctcctgccccagggctgggttcccccactccgacccccaaccgccgcccaggccgaggagcagcggctgctcgcgcccggttcagccgacctggactcctccacgctgtcgccgccctcacagcagccctttttggtctcggccccgcagctcgtagcgtgatgcatcttggaaagcccctggctccatccccaaactcccgacatcatgcgcatggagggttggcagccaggctgggccagactgcccctttcgccccagggcacccctcttgccaaactcatgcttgtaccatgcctccttctcgtgcaacactttgccctgcaccacacctcttccctgcttgccattgcagctctgcctcccattctgtgcccccgacggggctttgcgcctgtaacgcagccaggtttgctgatgcagcggccaggtttgctgatgcagtgggtggatgcattcaggggcctgtgcttcttcactctgcactatataccacacgctgcacccccgacagagctccccccaaggttcaggccttctgggcaaacatgcggccaaaggagttgcgctcgctggcggcgccctccctcctcgcccgcgccagcgccgcccgcacctcctccacgccggccgccggccagccgccgctggcgcggtcggcgtccgccaggtcggcgtcggcgagaccgtactggtgccgacctacattggccttggcgcgtcgcagccgcgctcgcgcgttgtctgggtcgagggccaggactttgtcgcagaattccaccgccaggccgtag

SEQ ID NO: 4102 - DNA, 414 bp, Chlorella protothecoides
gcctggcgcaaggccgccaagcacgacgcggcggtgcgagccgcgtacgagggcacagcccagtttcacgaggcctggaagctgaaggcgcgggaggtgctggccaactcggagtggcgtcggcgcaagctgaaccggcggatcgaggaggagacggagcgggccaaggcggagcacaagcaggagaaggcggaggccaagcgcgcgcgcgaccacgagcgacggtgggagaagacgcgggaggggcgggtgggcacctggcgcgacttcgccagcaagaagcccaagaagtccaagggcgggtcggtggcgctgggggggctgaagccgcccaaggccaagcaggaggacgaggagaagcgctacattcagcgacccgtcggcgagcagttccggcccaaccagaagcggtga

SEQ ID NO: 4103 - DNA, 1362 bp, Chlorella protothecoides
atgagcctgaggcagcggcagcgccattattctgattcttcagtctccgctccagcctcacctcgcgacctcaggccctccccgcccaccacccctgaaacaaaaacacaggaggccagcttcaaggagttcctggcccggcccgagaacgcggcggtggtggagaagcagcagcgcaaggaggtgcggcaggccctctctgcccaggagcgtgcccagctggagggcctgcgctccgcggtgctgggcgccgacttcgaggcgcagcgcggtgtggccccattcctccgcacgccctgcctgcggcgcgtggtgcagagcttcgccaacgacccgcgcggcgacttctccgcctgggccgccaacccgcgcgtgctggagatgctggcggccgcgcaggccctgctggactcggggtccatgaccgaggcggagatggagcatgtcatgctggcccaactgcgcgacccctcccacgaggcccacgccgagttccagcggaaagcgcggcgcgtggcgcgcctgcccaccgacgccctggtcggggcgctgaacgagcacggcgtggccggggctgggaaggaagggggaggggtgctgctcctgcatacagacgctgagcggaccccagccccagaccaagggatcggaagccggctcactccttctcaaccgcctgactccccgctttccaccaacgcaccccccgtttgccattccatcacgcagctgaccgagcggcgcaagggcaatgaactgtaccgggcgcggcgatacgaggcggcgctggcggcctacacccgtgccgccgcggtggtggagtttgtggagggcttgggcagcgccgaccaggctgaggtggtgctcaaccgcgtggcggtgtacaacaacatcgcggcggtgcacctggagcaaaagggtggggcctgcagaacgagaagctttgctgcaatcgtccatctgggcggccgggaaggtaccctcccccccttgtcccgccccatgcaagcaccttgcgcaaggggtggggcggatatccacagaaaccggccagcccgccgacccaccgctggtacccccccaccccgctcgcaggactacggcctggcggtggaattctgcgacaaagtcctggccctcgacccagacaacgcgcgagcgcggctgcgacgcgccaaggccaatgtaggtcggcaccagtacggtctcgccgacgccgacctggcggacgccgaccgcgccagcggcggctggccggcggccggcgtggaggaggtgcgggcggcgctggcgcgggcgaggagggagggcgccgccagcgagcgcaactcctttggccgcatgtttgcccagaaggcctga

SEQ ID NO: 4104 - DNA, 669 bp, Chlorella protothecoides
  modified_base (34)..(43): a, c, t, g, unknown or other
  modified_base (429)..(438): a, c, t, g, unknown or other
atggggatcgtgatgatggaggcatcggttcctnnnnnnnnnnatggccagtatgaggactatgagggggccattggcatgtgtgggccaggtttagtcattcttgctccgacccactgtctcttggaaactcacccagtacctccaccccgccgaatcacaaagggcgacgaactggtgacgggcgacgtcttctactttgactacggcgtcatcgtctgctggggcctgtcccaggctgcggagagggatgtgattcggagcttggccgggccagccctggtcgaccccctgtccacccaggaggtgggtttcggcttggattttcttatggaagagcggcaccgtgtggctttagagggaacctctcaggtgttgtcacactgtcctactgtcgctcctcccatccctccacccagatcgaggtgnnnnnnnnnngaccccctgtccacccaggaggtgggtttcagcttggattttcttattgaagagcggcaccgtgtggctgtagagggaatctctcaagtgttgtcacactgtcctactgtctctccccccatccctccacccagatcgaggttgatgagttcaactttcattacaccgtgcacgagaagccccacatccagaacgacaccttcacgagtgagtgggtggttggggtggtga

SEQ ID NO: 4105 - DNA, 1107 bp, Chlorella protothecoides
  modified_base (572)..(581): a, c, t, g, unknown or other
  modified_base (868)..(877): a, c, t, g, unknown or other
atgcgcagcagggatcgtgtcgctgggcgatgtcgagctcggggaaaaggagcccggaggtgcagctgtctcgtagattgtagcgtgccccgggtcgaacggctcaatatgaatccgagccgggcgtgctgggccaaaaccccaacatcatttggaggactccttcgagatcggttctcgcaccactgctcttcccgagaagcacaccctaggctccctgcacgagctggagcctcgatgaaaaagaacgcaccggcgttggggtatcagcccatcccgaatcgccctgcatctcctctggaccgtccaggggctgcggctgcccctgccctaaatagacgcccagcgccaccccagccagctgcatccggggcggagccccgtcggccacagaggctcgcaaatgttgggtccataaaacccatcgcgcctggccagccggcaccccctgggcggagtagagagcgcttcatctctctgccagaggagctgcaaacacctgatgacctgtcgcggagcctacctgccgagcaccccaccatttttgagctcttttcacagaacctgtgcannnnnnnnnngcaaacacctgatgacctgtcgcggagccttcctgccgagcacccaaccatttttgaggtgagcgggagagactgtggaggcccgaagtggcgctgggggccaggagccagccgtaatgagctccagcctcttctgtgggacaggttgtcgagtgctgtagatcacgttgacatgttgctttcaacctgcccgtacagctctttgtacagaacctgtgccctctcgccgacatgcaagctccccttcgaccctgcggccagcctccccaaacccacccttttttgtnnnnnnnnnngacatgcaagctccccttcgaccctgcggctagcctccccaaacccaccctcttttaatctgcgcgcaggatctgcccgacgtggatgggcggccaggcatgcgaggacgcatcaccatctactgtattgccgagtccctggacaggaaatcgctggagctgcggctgagggagcgtgggggtgtggctctgctgcacacctttccagacgtcttatatggccagtatga

SEQ ID NO: 4106 - DNA, 1530 bp, Chlorella protothecoides
atggagcatcctgaccaggaatccgtcgaccccaacgaggcgggacggccccgccccgctgctgcaaaacggagaatgtctgccatcgatggcacccccacccgtctccagcccaagcgcaaggcgaaagacagacggcgcgtcagcttcgccccctccctgacctctgtccaattcttcaacaaggtgcgggcgggcagtcagattttcgaacctccaccgccacctccgccagatgcgacagcgttgacatcaaattgccccctggcttccgaaatgacctcaaatccaccaccacaggatgaggacaacagcggcgagctcgcccccggccggagcaggtttggggtgccagacatcccgcagggtccctgggaggaccaggagccctccgccacggtgactgcggaggtcccgcccccgagccccatggacgtcagcatggagctgacagagccctggcagagggagacacagcccgcagatgaggtgacggcgagcgtgccctctctgggcgatctgctctcctccgagccggatgccacggagagcatcaccgccgccgtcccgggcctgtcctccctcgtcgatgagtcccgcgaggaggtcgcgctgacccaagccccggaagctgggccggtgcccgacggcgcagacatggatgtcacgctgctcgacggtgagcttgcgggctgccggcgggcaggggggatctttgcagggttggaccttctggtgggtgcaccagcgtgcctacatcaccatcttgtgcaccctgcctgcaactgtcgagacttggggatgcgccccctgctcttgacgggatcccattgccccttcccaggcctggcaggcggatccggggcccagggccaggaagaggagagcgtgcagccctctcccggcctgagcgaggatgggaacgagcagggccccgccctggcctccaagtggggcttcaaccctgggtgcgaggacaccatggatctcaacctggagctgcatgggcgcatgatcatgggcgaccacacctacggccgcctctacggcgacgtcacggggagcgccgccagcctggaagagggggaggccggggcagaggaggaggatggcgaggaggaggaagagcggctcggcgagcaggacggcggggcaaggctcggtgagcagggcggcctctcaccggagcggaacactggactgccggccccggatcgtgacctcgatgccggcgccgggcgggcagaggaaagtgatctggacagcatcgagcctgcatgctccccgcccccggagcacccccggtccctggaggtctccccgaccgccgaggagcgcagggcccttgggcccatgcaggacgaccaggtgcccgccagcgagcccgtgtggacggccccggccttcctgccgccctacatgatggcctccggctcccaggtgcggaggacaggtggcatgcaggcgctgggactggtgtggaaatgtggttggggcacatcgcactcctcctccgacgtgcacccatga

SEQ ID NO: 4107 - DNA, 1089 bp, Chlorella protothecoides
  modified_base (1029)..(1038): a, c, t, g, unknown or other
atgatggcctccgactttgagaagatggccagcggtcccagtcacaaggcgcccgagcgaggtgcggggatgagcagcatcgagcgtgtgcgggggcatggagaccctgttgcagatttgtgccctgggatgcgccgggtgcgctgtaccacccctttgcacactcggacagctgcgttgtgctctttgtcgacccttgccccatgctcatccgcagggcaccgcgacgacgacttcctggagcgctccttctggtccagcgtgaccatcaacccgcccctgtacggcgcagacgtggccgtgtccttcttcgacgagcgcctggactttggctggaacctgcggcgcctgggctgcctgctgtcgcagtacgacgtgcccgagatccccggcgtcacctcgcccatggcctactttggcacctggaagtccttcttcggctggcacaaggaggacatcgacctgtactccatcaactacaaccacgccggcgcggccaagatctggtactgcgtgtccccccgcgacggccacacctttgaccgcatggcccgcggcctcttccccgagctgcacgccgcctgcccggcctttgtgcggcacaaggacatcatgatctcgccgcgcctcctgcgcgccgcgggcgtgcccttcgtccaggcgcgacaggagccgggcgagttcatcgtgctgaacgccgcggcctaccactccggcttcaacctggggttcaacattgccgaagcggtgaactttgcgctgccggagtggctgccggtgggccgcgccgcgctcaactgcgagtgctcggccatgtccgacggcgtgtgcctggacatgggcatctttttcccggacctgcgccgtgaggacagcagcagcggggaggaggaggagggcgaggaggaggaggggagcgaggaggaggatgaggaggcaagcggggaggacgaggaggcgggggccggggccgccagcagcagcgaggaggagagcgcggcggcgagcagcagccaggaccgcgaccgnnnnnnnnnncgacggcgtgtgcctggacatgggcatcttcttctcggacctgcgccgtga

SEQ ID NO: 4108 - DNA, 237 bp, Chlorella protothecoides
atgcagcgggcaaagtgcagcgaggaggagcgggcgtcgctggcgcagttccacccgctggacgagctgcagctgcggccagatgcctttcctgccttcctgtgcgacacgctggggttccggctggtgcgacgcctgcagccaggggaggcagcctcggggttccaccgcatataccgaccctcctacatgatctcgggccagatgcagggtgtcgaacactacgaggacggctag

SEQ ID NO: 4109 - DNA, 1083 bp, Chlorella protothecoides
atgcctgggcaaaggatcccctcggcctccatgccccatgagatgcaggcagaaggggtgcggcagctggagatgcaagcccattgcatgtcatgcttcatcccctcgagatgtggatgctgtgcaggagggcatgagtcgctcggtcaatcaggtatgattgctccaaagctgtcgcaccctggggtgtgcaaccctctccaggctggaatcgtcagtccaatggccaaccttttcaccaacctgcccaaaccctgtccctggcagctgtgcacggatgccctgcgggctatgcttgccggggacgaaagggcggcggagcgagaggccgccaagtgccgtgatttggctgtacgagttgccggagcggggcggcagccgtctggtcaccagtaccaacagacggttgcgtttctgagcgtgctggagcagatgctgcagcacaacatgcccagcacccacgccctggatgaacagcatgcgcgctccctcgaccgcctgctgaaccaggtggggctttcactatgtatttgttttccgggtggggttgagttgtctggtggccaagactcggcggtgctggagcagggcacgcattcggcacacccgctgaagatctccggttcggagtggaaagtgggggatggtgaccaggctgcccaggagccgcagttcagcacctgggaggaggccctgggcgggggcccccacccaggcgccgccgggccgcggcgcgacccccctcctggtgcctcgaggtcacagccggggaggcacaccgccctgtacaacgacctgggcgtgaccggcggtgcgacccgcgccgacatccgggccgccttccggaagggggcgctgacctggcacccggatgtgaacgccgctccggaggcccccgctcgcttcgcccgcctcgcagaggcgtacggtgggctgggcgacgccgggcgcacgcctgctcggcttgcggtggagggtggggcgtgtttcgagggggacgtcgcccgtgccgcccacactgcccccgccctccgcacccaccgcagaggtgctgtacgacgaggagctgcgcaggagctatga

SEQ ID NO: 4110 - DNA, 552 bp, Chlorella protothecoides
atgggccaggctccctccgtcaaggaggcccaggtggtggccgacgagatcttcagcgactttgtgtcgcaggaggtggacaaggtggagatcatctacaccaagttcgtgtcgctcatcgcctctgagcctgtggtccagacgctgctcccgctgtcccccatcggcgaggtatgcgacgtggatggcaactgcgtggacgccgcggaggacgaggttttcaagctgaccacgcgggaggggcagctggtggtggagtctgagaagacggccaagacggaccctagcgactttgaggccggcctcatcttcgagcaggacccggtgcagatcgtggacgcgctgctgccgctgtacctcaactccacgctgctgcgcagcctgcaggaggccctggcctcggagctggcggcgcgcatgaatgccatgagctccgcctcggacaacgcggcggagctgcgcaaggggctcaaccaggtgtacaaccgcaagcgtcaggccaagatcacgaccgagctgagcgagatcgtggccggcgcgagctcggtgtga

SEQ ID NO: 4111 - DNA, 570 bp, Chlorella protothecoides
  modified_base (505)..(514): a, c, t, g, unknown or other
gcggcctgcgcccccggcgccgcgcccggcggcgacgcgcgcacgctctgcgccctgcaggccctggccgggcccggcgctggcgacgacgacgcggcggtgatcgacgcccagcacctgttcagcgtctacgtgcacgcgccgcccggggtgcaggacagctcgctgccgcccctgttccaggggcgcctggtcagcaggcgcatcgacgccgcctgggggtcccacggcctggtggaggccgcgcgcaacctgctgtgggaggcgtacaaggagcccaccaaccagaggttcatgctcgtcagcgagagcgacatccccctctacgacccgatgaccatgtaccagcaggtgggtgtccctggggggcgttgggggggggcggttgtagagtgtggtcacatggggatcggaaactgcgcccctgcttcccatctgggtggtatggggccccagcgcactcctgtccttgatgtgaacctgcttgattcgggtgttgatcggnnnnnnnnnnggcgcccctgcttcccacctgggtggtacggggccccagcgcactcctgtccttga

SEQ ID NO: 4112 - DNA, 2037 bp, Chlorella protothecoides
  modified_base (711)..(720): a, c, t, g, unknown or other
  modified_base (1289)..(1298): a, c, t, g, unknown or other
  modified_base (1618)..(1627): a, c, t, g, unknown or other
  modified_base (1761)..(1770): a, c, t, g, unknown or other
atgctcaatctcaagcctcatgcccacgtcagtacactctatcgccaccatccgccccgctcacgttccaatgccttgccgctatcccctccccaccctgcagcttgtcagcgaggagggctcacgcgtcaatggctgcgcccacagccgcacagaccgaagacgctggacgtggcggatgagggtgagaaagagggaattaggatgtttggccccatggaggtgatgtctcatgggatacaggctgtgtcacccaaccctgcatggccacttatgggcgagactgcctcaccggcttcatgcatccctcagcgcaaacctgaaggcgtaccactggcggaagagcacacagtggtgagtggacttgcagggcaccacgaagagagggtgcatgaccctcccttccacgtcgcacttggccacaggttcatgctgacaaggccccacgccgaattggtcctgggggacacagaagtctacaggagaagtctacaggaggtgcgccgggtggaaggcgtgaaagggggcacgaatcgtgctgggtgtgggaaatgtttgcaaatgaagacaatcgcttggctggtcacagaagcatggaaactggggcttgtgtgtaaacattgctcgtcgggcttgacgttgcgaatattgtgtacaatggcgcgcgtgtgtatcaagaatggcaccttgtgtcgcgcgtcaggcgccctnnnnnnnnnngaactggggcttgtgtgtgaacattgctcgtcgggcttgacattgcgaatattgcgtacaatggcgcgcgtgtgtatcaagactggcaccttgtgtcgcgcgtcaggcgccctttttccaccacgccccagccaaatcaccgctttgtcacacctcggcagatttgaggagcattgctggtacggctgggacaacgattaccgacgctggagggactgtttcagcgacgaggtgggaactgttgtactgaccctcgtttcagggtcccttcattggtctgctgtggagggaggcaaccccctcggccccccttcttccctgccctgcagcactacatgccgaccctatttgccgtgcacaagatccaaactgactcgaactgcggcgcggtgggcgtggccgccacaaattggagtggcggtgcccacccccggtcttacaggttggtgtgtcagggtgtgcgttggagcactgcgattcgaatgctgctccagggtacattctgggatacaacgatccaagtctcatcaaaggtccaagtcgctgattcttgcagcctgcctgagtannnnnnnnnnccaaatgctgctccggggtacattctgggacacaacgatccaagtctcatcaaaggtccgagtcgctgattcttgcagcctgcctgagtatgtctatgcccacccttcaccacagtctctcaccttctcaccgcagccaagaggacgtcacgcccgcgctcctgacagaggcactgaggtcgccgcaggacggctgcgatgcccagtctgcgtgggaggcggcccagaagatgtttgtcaaggtggacgaggccttcaacaggtgtgggggggttggtggtggggaatgggaggggaggggaagagtctgaggaagaaannnnnnnnnnccaaggtggacgaggcctttaacagtcgaggcagcctggtggtcgttctcctgcctcaagtctatcccggccttttgcatactgagacaccgcgcaaaacaacatcccacaccacgcagcggcctgtgcaaggnnnnnnnnnnccctgcctcaagtccatcccggccttttgcatactgagacaccgcccaaaacaaaatcccacaccacgcagcggcctgtgcaaggtgcccctgccggagtacgagagccatctgacctcgctgtgcaaggtcacggcgcgcaagttcccggtggaggtggtccagcagaccgccacgctcttcacggactgcaacaacggcctccacctgctggcccccggcgtgtgcgctgcacacgctgagcaaggcggcgagtcgctgtcctag

SEQ ID NO: 4113 - DNA, 2166 bp, Chlorella protothecoides
atggtgacgacaagtaccttcccgcgtacggattgcgcgtcttgcacggcgcagcgcgggccggacacctatcaccgtcaagtcaaacaccgcgcatttctggacgaccatggccgccaaatccattgcgctgatgaccgtgaagctctcgaggcagtagcctctgcaagtgcgaccttctcgcttcactcgcgcacaagtagttgggcgacttccgtggtgggaggaatcaagcacggcacccgctgggctctcgctgaagctatcggagggaaaacatccccagaccctggttctagtactgattggcgcgtcccagctcctagcgggcgctgccagacgatgaagaaggtggtcgtgaaaccccaagctacggggaccatccgggcactgctaggcgagaggaaactcgtcattggcctgctggaatcgtgtccgtgcatggctttcatggtcactttcgaaaactgccaggctgaccgatggtgcacagacgggccggggttgcaagcccccatctcttgtattggaagcagcaaccttctttcaagctttgagaatgagaccattcacaccgcccccccacaggtctcccctttgtacctggaatttcccacaaactcaaccttgtcggacactgacgcatccggcgcacctgcagagcctgagcaggctccaaaaccacctgagaacgctgcaaaggaggcgttggaggcagagcctgccctcctggaggacccagtgacagaagaacagagcagggacgattgcgcacagacgttgagtgcaagtctcgcatcacatttgtcatccaaaacactttgtgcttgtcgtcacgcccctcaggcactgggcgtcccgaaggttgcacttctcttccttgcaaaagagaacatatggctgcatgaatcgtggcggctctggttccagtcagcgtctggcgtcctcccgctacgatcgcttcagaagcatggctgctcaagatccacagtcaccctcccagaggcatgtcgaggacgaggagttctagcaagcactgaggtggcagaggaagacatcattgcacagcagagcctcttcagtgtctttgtgcatgtcccacctgaggcctcgcctgtcacccccgtcgtggctcgaagcccacaagtgcaccctcacaacttaccgcagagaccaagatcgcgcccctgttccgcaaccacgtgcttccgaggcgcacaatggcaaagtgggggagcatgcggctcgtctatgcggcccgcctgctcatgcacgaggcgttcaaggaccctgccaaccaaaggtgcgcgtggctgtgcggtgaagggaggtaccttgcatggccagctggccaggcacgccgcccctcatgcaacggcctcgttcggcacgtgggctgccctgggtggcgctgaccctcctcctgcttcccgccctgcatccaggttccttctcgtgagcgagagcgacctgcccctctttgatcccgtgaccatgcactatcaggtgagagcatacctggccatttctgagtcgctctcccggatatctgcatgtccgagctcctccgtagataggtatagatggaacaagcgactaaaggtagggtcctttgtgttgtgtgagtgcctagctgagggcaggcctgcatcagagtcgcctgcggcgtatgttcgcggacacatcacatccttccccacatgtggggtccaatgcaatgctgagggtcccttccgcctcaacactcatgcagtcggcagtgctgaagacgagtcactggcgaaaggcctcccagtggtgagagggtctctttggtgcaaggtgtatggttgtacttctaccacatgtaccatcgctctcatcagcaccctgaaaacacgactccatcttcttaattctccccttcccaggactgctctgattgtgctcccccgcccagattggggcagtctttgtgccatcatggatttacctggcatggctcctggtcaggctgtcaagcagagcacccaaaatgctctgcacttacgctccgacacaggttcgaaaagtactgctacccggggtacgacccctctgtgcaccggacgcggagctgctatggcgacgaggtgggccttggatgacgggggcatggagggccacagaggccactgctggaactga

SEQ ID NO: 4114 - DNA, 1503 bp, Chlorella protothecoides
  modified_base (339)..(348): a, c, t, g, unknown or other
  modified_base (1377)..(1386): a, c, t, g, unknown or other
atgccggccatcagcatgcagggcaggctgcggtcagggcagctcagggggcctggatgccacaggaccgcacgagcgcacgctgtgccatatcctccgtgggctcccacccacggcattttgcccacgcaggacacaagcttctcacggcaagcatccctgggtatcccccccacacctagcctggatgacgacaggagccgggatgccaagcagctgcagaacagtatagcaggtaatgcggtgactcattccttgattgttggggctgatataggcgaaaaggtgtgcatcatgcaaggtgcgaagtgctggatgagtggttgggagttcgcagtnnnnnnnnnnactgtgccatatcctccgtgtgctcccacccatggcattttgcccacgcaggacacgagcttttcacggcaagcatccctggtcacaaggtatggcctggtggcccaatcggcacccagcccccctcctgttcatcccgcatctcctctggccgtactcaaaccggcaagcagctgggatgagcgcgggaacacctgcaacatggcattggaattggatcgtgtggccttgctcttcctaacaaaaggcgacctcttccaccaccagacatggagtgcctggtcggcgcagggaatgctcccagtctcaaacgtggaggaggcagtgtgcaacaacttcacaaccgcggaggccctgcgcagcttctgtgacatgaccggcaccgactctgaggggcagcgcgccttggaccccgatgaggtggtattggatcggcagtacctgttcagcgtgtatgtccatgcgccgcccaacattgcaggcaggcagggctggattctgtcaggaggaagggtgaatgacatgatggtgtcagtaacacacagcattcctctccctacttacttgcaccttgcagagaaggatatgagaccgcttttcaagggaaggctcatcaaggataggatatacactggctggggatcacaccaactcgtggaggctgagagaaacctgctgtggcacgcctaccaagaccctgccaacactagtgttctgcatgccaagtacgtttgtagaggcccactgcccaatatgcagactaccacttttcaacccatggctcacctcgactgccaacagccaggtgcggtgacggtgaaggaattgtgttgggaactccttcctccgggatgtaaagctacaccggtgtgtcctgggcgctgcactaccaaggcttcttctcaactgacggcagtggttttccatcctcatgcatttacacaccacatccaggtgatggccgagaacctgtcacgagtgaatgcctgcaagagtgccaaccaggaccatcggcgctggagctggcgnnnnnnnnnnttcaaactcactatgcagggccaactggagccctgtctccgtcttttcttttctagggatgtaaagctacactggtgtgtcctgggcgctacactaccaaggcttcttctcaactga

SEQ ID NO: 4115 - DNA, 2376 bp, Chlorella protothecoides
  modified_base (172)..(199): a, c, t, g, unknown or other
  modified_base (1320)..(1329): a, c, t, g, unknown or other
  modified_base (1626)..(1635): a, c, t, g, unknown or other
  modified_base (2235)..(2244): a, c, t, g, unknown or other
atgagggttgcaagcaacgcttccgaatctccagatcatgccgtgcttgctgatgcactgatgtatgctcaaatgcctttgcttgcagagaaagggcctgaagagctcgcactggcggaagagctctcaatgtattccgcaggcgagttttggaatgcagcagggttgtcannnnnnnnnnnnnnnnnnnnnnnnnnnnaccttccctatgccttccattccacagctttgaggcccactgcaggggggggtacgattcggactaccgacgaaatagggattgcttcagtgatgaggtgggtagaggtgcaaagtgtatcagcttggggaatgcagtcgttcatgtgcggtgtaggaggcctgtcatcaagccactacgacgccccttctcctgatgtgcatgcactgcttccgaaagtgattgccatccgtttgactgccatcccgttatccgttgccacacccgcagcactacctttccaccctactagcatcgcgtggcgttcagacagaggagaattgcgaagtgtatggcatcacctccacggaatgggcttacgagggctggcatccgcacccgcattcctacgcgtgagctggcctgttgcacttccaggttgtgatttacttgttcatccgatgtgtatgcaaagttgcctctctcttcccaatgacaggcccagggaggtgaacgcgcctctgatccgtcgcctgaggggatcagccgacagctgcaagccagagacactgatcgccgaggcaatggcagggttcgtgcacgtggcctcgatcgcgccatacaggcaagtcatacattgggtgggagggtgggccaagcttgcacttatctgcagaaggctcccttgttcccttgatggggaaattgagctgccctgggctcctcatcatcgagaatacctaacaaagcatcaatcgcatgcccacagtggtcctgagtgcgaggggtcccgtgatgcgggccctatcctctcctcggggaccgccctgccctcgacctgctacgtgctggcgcggaagttcccaaagattacggcgcggctggtgtaccgcgtcatgacgaactgcagctcgggacttgacctgctggcccctggacagtgtctcgagggcggggagatgtggatgcggaatacccagcttatgcacaattattcatccattattgtgatttgcgaacttgatattatggcaggggcaggggtaaaagctgattctgggcgcgcttggtatggtcgagcacaggacaatacagcaagtgggaacaacttcgcatccaacctcttgcgacccaaatatacnnnnnnnnnnaacaggacagtacagcaagtgggaacagctccgcatccaacctcttgcgacccaaatatactctctcaacatgcgaggacaaggtatttcgtatcatggtcccgccctggtgtgcggaaatcagaaagacatgctacactcgggacgtctatgagccctccgatgactcttttgctctatgcgatgctctcgggagcgttctacagggtgcatcaggccccgcaccccagctctggaccaatagaaagggcacgggcaccaaataagcctccacctgcccacataatgcacctgcannnnnnnnnnaaatcaacgctgtacctcttcccagtgcatcctggaccttgtagatgcctggaaatagggagtgggagcgggtatgtcatctgctcggccgtgcgactcctgcacgccttgggtgtgcacccagcccatgtaatggccactgactgcagtgctgccgctctggaagctacagcagggaccttgcaagctcaccaggcctccacctgcccacataatgcacctgcatcttgtgatttgtctcaacccgagctctttgatcacgccaatcccctccaacagattgagggtgcagacctggtgcaaacagaccttgtggcggggctgggagatcggctgcagggatgcgtggacctgctcctgttcaatccaccctacgtcccgacccccgatggcgaggtcaccctcggcaccaccatcacggctgcatgggcgggagggtggaaagggaggcgagtcatcgaccggctgctgccccaggtcccaggcctcctgtcgtgcactggccacttcctcatggtgtctgtggctgccaacgagcctgagggcatgcagggtccattgcttaggagccctcactgttatgcttataaagagcgcttnnnnnnnnnnactgtggctgccaacgagcctgagggtgagtgcccactgccctctgatgcaggcagggagggattgcgcgtaagtgcttggaccctaggcacatccaaactgtgtcacaggcatgcaggatccattgcttag

SEQ ID NO: 4116 - DNA, 657 bp, Chlorella protothecoides
atgctactagaccagcgaagccggcagggcttccctatcaagctgctcgtcgcctgtgcgattttcatctctggactggaggtcctgagccatcatgattacctgcccaccattccctgggcgagcctggtcagctcgggcgcgtcgctccggcccgcccgagacccacctttcaccgccaccgggccgggcgtggaagatcacgtgtggggtcttcccccagcggaccacgatatctccaaccctgcgcttctggaggcgccccaggtcctcgtgagcagtccagacacatgtgcccaggagccgagcccctgtcccccctacgaccaggcgctggcagtgcccaaggtggctctactctttctcactcaaggcgtgatgcaccatgcggaggcatgggccctctggtttgcatcggctgctggacacatcccattggcaaacctgcggcaggcgggctgcgacgcatggcacagatccatcctgggaccgctgggagcctgtgacagcagcgtaggacccaaggaggcagcagagctggatccagaagacatcatcggcgcccaacacctcttctctgtctacctccatgtaccccttgatcgagacggtgagaaaattgaatgggtgctgcaggccccttgtgtttttgaatag

SEQ ID NO: 4117 - DNA, 2517 bp, Chlorella protothecoides
  modified_base (1122)..(1131): a, c, t, g, unknown or other
  modified_base (1469)..(1478): a, c, t, g, unknown or other
  modified_base (2473)..(2492): a, c, t, g, unknown or other
atgtggtgtaccccccctgcccccggaacccttgcccaaaccccgcaccgtgctgtcggaaggtcataccgctgcaggctcggtgaagttctcaccaccccagtctcgggcctggaggtgactcatcggccaggtgcctgcgtccccgcaccccccctcccgtcatgctgcggctcatcaagcgcaactcggggctgctgcagcagctgcgcgggtatgctgcctcctctgaggccgcggtgatgcagggacagtgggatcgccatcggcctcgcggagccgggttggcgcatcgaccgtggacccccagatgttgagaacacccctgctctgggtttccaccctggcgaacggcctgcgtgtggccagcgagtctgtgccctttgccgagacggccacggtgggcgtgtacatcgacgccggcagccggttcgagaccgatgccaccaacggcgcggcccactttctggagcacatggcgttcaagggcacggccagccgcggtgtgcgcgacctggaggtggagatcgagaacctgggcgggcacctgaacgcatacaccagccgcgagcagacggcctactacgccaaggtgttccagaaggatgtgccccaggcggtggccatcctggccgacatcctgcagaacagcaagctggaggagcgcgccatcgcgcgcgagcgcgacgtcatcctgcgcgagcagcaggagatcgagggcatcccggaggaggtgctcttcgaccacctccacgccaccgccttccagcactcccccctgggccgcaccatcctggggcccgcggagaacatccgctccctcacccgcgccgacctggtggactacatcaccaccaactaccgcgcgccgcgcatcgtggtggccgctgcgggcgccgtcgatcacgaggccctggtggccgcggtggagaagggctttgggaagctgccctccgacgggcccacggcctcccagctcgtggacaaggtgcgttggtgattgggaagggggtggacgcccgggtgtcatgcggggccgggggacaaagaggggcgcggtggcagcgaggagcgggggcgactcaagcctcccgacccctttctgaacctcaggagcccgcnnnnnnnnnnccaaggtgcgtcggtgattggaaaggggggggcacccgggtgtcatccggggccgggggacaaagaggggcgcagtggcagcgaggagcgcggatgactcaagcctgccgacccctttctgaacctcaggagcccgcgctgtacaccggcagcgaggtgcgcatcagggaccctgaccaggccaatctgcactttgccctggcctacaagggcgcctcctgggccgaccccgactcggttcccctcatggtcatccagacattgcttccctcaacccccgcccacccaccaacccactcatcatccgcagacgctgctgggcgcgtgggagaagaacnnnnnnnnnnctcgtgtgtggtgggggggtggggggactcgatgcttagcaggctgtacctcagtggcggtgctcgggcgcgagtgcctaggcattccttccctcgacccccacccacccacccacccactcatcatgcacagacgctgctgggcgcgtgggagaagaactctggcgctgggtccgaggcggccagccccctggtccagcccctggcggtcaacggtctggccaactccttcatggccttcaacaccaactaccacgacaccggcctgtttggcgtctacgccgtggccgacaacgacgccgaccatgaggacctggcctggaccatcctgcacaagatcacggggctgacctacggtgtgagccagaccgacgtggaccgcgccaagaaccagctcaaggcctccatcctgttctccggcgatggcaccacaggcacgtgggatcttgtgaggtgtagtgaagatgagggggagctgggcgggaggaggggtgaggagggagggagctcttgcgatggactcgctccgaggtggccaccctcgcccgtcgttctcaccctgcctttcaccaaccaacccccaggcatggcggaggacatcggccgcaacctgctcgtctacggacgccgcatccccaaggccgagctgtttgcgcgcatcgacgcggtggacgcagccgcggtcaaggacgtcgcctaccgcttcttcaacgaccaggtgggagggagagatagagaggtggaggaactgaggggtgcaagaaaggtggatgaggatgggtctgcaaggcgcaggtgggtgagaatgggtctgcaaggcgcaggtgcttcctgcacaaaacctaccaccgccgaggtcaatgaaactgccccgcatgctgctcctcaccatcttcagaacaacaccccgcaggatgtggccgtggctgccctgggggacacacagttcctgcccgattacacgtggctgcgccggaggacatactggctgcggnnnnnnnnnnnnnnnnnnnngtcttcctggctcactccacattag

SEQ ID NO: 4118 - DNA, 714 bp, Chlorella protothecoides
  modified_base (634)..(643): a, c, t, g, unknown or other
atgcacgccgtggagctggccctgcagggctacgatgatccccagccacacctgctagctcgagtgagggagcacctggcagaatgccaggatgatgcagcagtgtgcctagtatgcctggagaccatagcatcagcaggtagggatgctggagtggtgactgcctgtagccctggagagccgtcgatgccatacaagagtgcttggcgccacgcctcccacccccctcactcatccccagaagcggtgtggtactgtcgtggggggtgctacgtgatgacccaccttggctgcgcacagtcctgggcgcggcagcagctggacgcggcagacgccaagacaatccacagcctgggtcaaatcgagcgtgaccccggccaggccccgcccacgtgggcctgtcccaagtgccgccatgagtatgcagcctctgccatcccccgggactactcctgcttctgcggcaaggtggcagagcccgcggccgacccctggctcctggcgcacaggtgcgatcttggagtcggagggctggaggggtcccttcacgatggtgtcgtgactggcgtgcaggcagtgcatgctgccgtgccagtggggcccgaccatgcttggtcagagcttgcagagcagnnnnnnnnnncgctgacgtgccagtggggcttgaccatgcttggtcagagcttgcagagcagactgccatcgtgcacctga

SEQ ID NO: 4119 - DNA, 213 bp, Chlorella protothecoides
atgctgcaggaactggggcaacctcccctgtatgggggctgggtccagaagttcaacgaggcaggcatcagcgtcgtgaccctggacaatcagggctgtggccgctcagatggtgccaggaacctccggtactttgtggagtccttccaggactacgtgaacgacgtcctgctcctgcgccggtgggtgtcgagatgcaccaagccacgttaa

SEQ ID NO: 4120 - DNA, 378 bp, Chlorella protothecoides
atgagcgcgtgccaccaggctcagtccattggcctggttgaagtgctcactgatgtcctggccaaaggtgtaccctgcgccgcgcggcgagatgccccacccgcaccggtcgtcggggtcggaccagagcaggtcgcacatgggcccctcgtgggggacttcctgcacccggtccaggccgcggatgtggtccagggtgtccagggtggggctcagcccaccatggaggcagaaaatctgttccgagggggagtgggggtagggcaaggttacaggagactcatggagagcagaggatgtagcgcttcacaggaggacaggggctggcgcaaacccaaagaaggattcatggatgctaaatcgcagacctctcggtga

SEQ ID NO: 4121 - DNA, 471 bp, Chlorella protothecoides
atggggtgtcggcggtggctggcaataggggccagctcctgcccttggcgtggggagcctatccatcatctagggcttggtggggtccattgtcatcgcaacatcttcttcaggcactcacccatcgccctctgcatgggttccacgacgcaggtgcggtacagggaccggatcaccatcctgcgcggcaaccacgagagcaggcagatcacccaggtctacggcttctacgacgagtgcctgcgaaagtatggcactgccaacgtctggaagtacttcaccgacctctttgactaccttcccctgactgcgctcgtggagaaccaggtacaattattgctgcggtcgtggaatgctggtggtttggagggccaggagtggttttcatggggccctgcttttagagccggcacaccggggggtcactcccctgtgagccagtctcagaccaccgagaggtctgcgatttag

SEQ ID NO: 4122 - DNA, 906 bp, Chlorella protothecoides
atgtcgcgccctgtcacaattcaagctccaaatgaggatttggggcttggtgcgagtccctcccttcgtcacttgagcgtatggaatacacttctaaggggggattggcggaggtgctcagcgtgctatgctcccagcattcactcagaacccctccctgccggagcagtcgaagatccaactggaaacacggaaacattgatggggagggtgaccctgcggaagagaggtgcaagggcccagcatgtcagacttttcgacacacggcacagagcggcactcggaggccgatacctcgtcgcaggagattgcaggcatccccctgacctcgccagcgccaaccgcggtgtactcaggcggtcctggttgccctcctttgtgtcgaatatctggccgaggcggccacccacgatggcgacgccgccattggatcattacaaggacatcgatgcacaaatagatcagctcctgcagtgcaaaccgctgtcggaggcggaggtccaggctctgtgcgtgaaggctcagggaattttcgtcgaggagtccaacgtccagcccgtgaaatgccccgtgacggtgcgaataataaggcagcttttattttctgatggcaagcgtacattgggcgacgatatgccgcgagatgcacaagtcacacgcaccttcctccacttgcgatcactcacacttgccgggtgtgtggttgcatgtccagccctatcccatggaaaccaccgccgaaacgtccgcccttcgcaccctaggtttgcggcgacattcatggccagttccaggacctggtggagctgttccggatcggtgggaactgcccagatactaactacctcttcatgggcgactatgtggaccgcggctatcactctgtggagacggcctcgctcctag

SEQ ID NO: 4123 - DNA, 528 bp, Chlorella protothecoides
atgcacccatgcacaaccacccccacaaccaagttccccaacccactctcgcgtgttgatgtccagcatctgacagagggtgatggcgatcaggctggtcttccccgtgccggactgcgcctgggcgatcacgtcccggcccgagatgatgggcaggatggcacgctgctggatggcggacggcttctcgaagccgtaggtgtagacgccgcgcaggaggtcctgcttcaggttcatggcgtcaaaggtggacaccaccctcacgcccttgctcgtctcgaactccaggctggcatcgccctggatcacgccgccgcccgagcggggactgtgtgtgtgtgtgttgggagggcagagggtgggcgagggagcggcaggtgccagggaagaggactgccagacgcgggcgacagcgcgcccctccgtccgtccagtgcgtgcgccggctggtacaacgggtgcaagtactcttcgagctacaaacacatgacggggaatgtacccactgggctcccagcctggcgctga

SEQ ID NO: 4124 - DNA, 1905 bp, Chlorella protothecoides
  modified_base (791)..(800): a, c, t, g, unknown or other
  modified_base (1547)..(1556): a, c, t, g, unknown or other
atgtgcacacactctcctctgcacacacacataaaacacacattcaagccccccacacgctcctccctgcagggtgcaggcgctggtggtgtcgccaacacgcgagctggccacacagacggagaagaacatcctggccatcggcgacttcatgaatgtgcaggcacacgcctgcatcgggggcaagtccgtgggcgaggacatccggcggctggaggcgggggtgcacatcgtgtctggcaccccgggccgcgtgtacgacatgatcaagcgacgcagcctgcgcacgcgcgccatccgcacgctggtgctggacgaggcggacgagatgctgtccaaggggttcaaggagcagatctacgacgtgtaccgctacctgccccccgagacccaggtggtgctggtgtcggccacactgccgcacgaggtgctggagatgacgcacaagttcatgacagacccggtgcgcatcctggtcaagcgcgacgagctgacgctggagggcatcaagcagttcttcgtggccgtggagcgggaggagtggaagttcgacaccctctgcgacctctacgacaccctcaccatcacccaggccgtcattttctgcaacaccaagcgcaaggtgtgggtgggtgggtgttcccggctgtggccgccgcgcctggtcccgccaccagtctagggaggctcggcactgtttacccaccatgtccatgctcctcccttccgggcttggctctcctaaccctaaccctacaccacatgacagctcccaacgcactcaaatcccnnnnnnnnnngactgtttacccaccatttccatgctcctcccttccgtgcttagctctcctaaccctaagcctacacaacatgacagctcccaacgcactcaaatccccccccttccccccaaaggtggattggctgacggacaagatgcgacagaacaacttcactgtttcggccatgcatggcgacatgccccagaaggagcgcgacgccatcatggacgagtttcgctccggcgccacgcgcgtgctcatcaccaccgacgtctgggcgcggggtctggacgtgcagcaggtttcgctggtgatcaactacgacctgcccaacaaccgcgagctctacatccaccgcatcgggcgcagcgggcggttcgggcgcaagggcgtcgccatcaacttcgtgaagaatgatgacatcaagatcctgcgcgacatcgagcagtactacgccacgcaggtggacgagatgcccatgaacggacaagggccttacagggcagggaaagccaggcaggggttcaagggatgcaagcagtgcggtttgggcatgatacaactggctcgaataacagggcaggatcgaggagggccggtgaagggtgccctgcgaggggcgggtgccctggagcgggcacccgacggcatcgcacggcgaggctggggcattcctcatgaaggggtgaggggcagcacattgtcatgcggtcatcgaggcagtgccgccagcctcatagaagggaggggcataaagggagttannnnnnnnnnttgcgaggggcgggtgcactggagcgggcacccggcggcatcgcacggcgaggctggggcatttttcttgaaggggcctccagtgtgggccttgttggggagtcgttcaggagctgcagcagctggccacagtaaactctggtgcactctttacctggtcttccagggtttagcgacactaccaaaagggctggccgcgccgccacagcgagtggggctagtgtgcacgggggggctagtgtgcacggggcaccagctctgcagagagctgtcaccaggggggaccatgcgtgtgctggtcggcatgccgcgccgacagccccccataccgtcactccccctgagatga

SEQ ID NO: 4125 - DNA, 1020 bp, Chlorella protothecoides
atgcagtcgcccctgctcaccttcctgcgccggctcgaggcccagaacatctggcgcgtgacttacaatgccctgccccagcagcagtacagctccacggctgtccaggatcaggcggaaggtgggggaagagcctggggtgtggggggagcagggagagggtgctactcaggccttgatgtgttggcatcccacctgccctcgcgccggcattggccaggactggtaggcccctggcctgttgtgagtctcacggtgaaccgtcacccctctcctggtcatgctccccacttcttatcccaggaccccccccccccccccccaccctctccttcctcagagccctcccgctccaccaccgagtggtacaacgacgaatcgctgagcgcacaggacgcgctgaagctgctggtggcgcgcatccaggcctccgggccggtgaagcagcaccacctgcaggagctgtatcagcgctgccgaaccggagacgagctggaccgtgccctgaagctgacgcggctcaactacttggcacgtggcgcgctggagcagcacgcgcccttctcccaccgcacctccaaggccctggtgtcccaggccatgcagctgggcgtgcccgaggtggcggcacgtgcgctggagcactcagccgagttcggcctgcccgctgactcggccaaggaggccacccccctgctcatctactactccaagcagggcgacctgctggccatgttcgagctgtatgaggtgatgaagcggcgggggcgccatcctggccccgatgtctgctatgtcctggtcaagggctgcgtggactggggcaggcccgacctggcgcgcaccgtggtgcaggagttccgggatgcgggcgtacgcatccgggagggcaccctggcctacatggagcgccggcccaccatgggcctggaggcggcgctgcccagcaccgcagagttctcgggcgcgatcatgggcggcgccgggggggcgcttgccgcgcgcgccgcgccgcgctga

SEQ ID NO: 4126 - DNA, 528 bp, Chlorella protothecoides
atggaagaggaagcgggagtacttgcacccgttgtaccagccggcgcacgcactggacggacggaggggcgcgctgtcgcccgcgtctggcagtcctcttccctggcacctgccgctccctcgcccaccctctgccctcccaacacacacacacacagtccccgctcgggcggcggcgtgatccagggcgatgccagcctggagttcgagacgagcaagggcgtgagggtggtgtccacctttgacgccatgaacctgaagcaggacctcctgcgcggcgtctacacctacggcttcgagaagccgtccgccatccagcagcgtgccatcctgcccatcatctcgggccgggacgtgatcgcccaggcgcagtccggcacggggaagaccagcctgatcgccatcaccctctgtcagatgctggacatcaacacgcgagagtgggttggggaacttggttgtgggggtggttgtgcatggctagaattggggagggcgtgggggcttgggggagaagggggggagtaa

SEQ ID NO: 4127 - DNA, 540 bp, Chlorella protothecoides
atgacggcctgggtgatggtcgcagagggtgtcgaacttccactcctcccgctccacggccacgaagaactgcttgatgccctccagcgtcagctcgtcgcgcttgaccaggatgcgcaccgggtctgtcatgaacttgtgcgtcatctccagcacctcgtgcggcagtgtggccgacaccagcaccacctgggtctcggggggcaggtagcggtacacgtcgtagatctgctccttgaaccccttggacagcatctcgtccgcctcgtccagcaccagcgtgcggatggcgcgcgtgcgcaggctgcgtcgcttgatcatgtcgtacacgcggcccggggtgccagacacgatgtgcacccccgcctccagccgccggatgtcctcgcccacggacttgcccccgatgcaggcgtgtgcctgcacattcatgaagtcgccgatggccaggatgttcttctccgtctgtgtggccagctcgcgtgttggcgacaccaccagcgcctgcaccctgcagggaggagcgtgtggggggcttga

SEQ ID NO: 4128 - DNA, 453 bp, Chlorella protothecoides
atgctgcgccaggacctcatccgcgacatccacttcatctggaacgcggaccggcgcgagttccacaccatcatcgccctcggtctggacgtggcagggcacccgcgcatcacgcacggcggcttctcggccgccgtgctggacgagaccacgggcggcctggtattcgaggggaagaaggacggcagcctgggccccggccgcgccttcaccgcgcggctggaggtggactaccgcaagcccatgcccgtggacaccgagatcgtgtgcaccgcgcgcctgctgaacaccgaggggcgcaagatctggaccgaggcggagctgcgggacaggccgggaggcacgctctacgccgtggccaaggccctctacgtcaccgtgcgcgccgaggccgagccgcgcggagaggagagggcggcggaggacggagcggcggaggagggccgggcgtga

SEQ ID NO: 4129 - DNA, 1518 bp, Chlorella protothecoides
  modified_base (818)..(827): a, c, t, g, unknown or other
atggcgtgcagcccttcttgctccagcaagggcaccaacccgagaaccaccaatccgcagaggaacgcgggcaggaaggcaccgcgacgtgcccctgcaccggtaatcagagctccaccgaggcagttggctccctgggcggcacggacgcaggtcttccgacgagccgtgggcgcaccaccctcgcccggccggacctccagcaccacctccctaggcagccacgacctaccggatgccttggccgcgagtgtggcggtgacgccttcagagccttctcagtccgccttctcgcgggcgctgcatgcctacaccactgctttgcgggaccaccccaccgcgaccaaggctgtcaccagtttcctgggctttggcatcggggatgccatcgcccagagcatcggcgcgcccttcgacatcacccgtaacattcgtatgagtctgtatggtctgatccttgatgggcccctgggccacaaatggtaccagatcctggattccaaggtctaccccgaggatcccacttgtacaaaagctgtgttgatcaagactgcagcagatcagctgatctgggcaccgatcatgactgccgtattctttgcgttcttgaagaccatggaagctgtagctcctatggacttggctcatgtctgccggaatcagttcccctttcctgtctcgcctcacacccacccgattccctccctctgccccaggccaccccgagctcattttgcccaccatccaagacaagctggtgcgggtggtgctggccaactatatgctctggcccatggcacacatcatcaacttcaagnnnnnnnnnnagtgctggccaactatatgctatggcccatggcacacatcatcaacttcaagtttgtccccagccagcaccgagtgctgtttaacaacgtcgtgtcggtgagtgccctggatgatggtgcaggggaaggaggggatgatgctaactgggttcccagcgctgaggccccatcgcagtgcagcagcttgcgtggcttgcctccgctgcctgacctgcgcttattggcagggtgtggaggggcggctgctgaccaagctgccgtgcgccaagcgcccagatgtgctggactcgctgcatgtgggcgaccttgtgcggcaaacggcagccctggagcggctgctgggggcctggggcatccaggacggctatgtccgaggcacaagtatcttttcagcacattggtggatcaagtgccgatggttcaggtacgtcattgctgtgccagcccccatgcattattcatcattagtcactatccaactcacgcagggactgccgagccccgatgtggccagcgacctgcttgggcagtatgtcgacctgaagcagcagctggtccggaaagtgtgtgggctgccattctgagcacttctgcaggacattttctttcgtccctcagggacgcgctggccccacagggccgcaagcagccagaattcttgtcatacccctccctagcttgcagtgaatga

SEQ ID NO: 4130 - DNA, 243 bp, Chlorella protothecoides
atgagatggcagggagtggtggagttggagcaagggaccgcgccgatgagccgtggccctggctgtgaggatcttatcgtacgccctgcccacaaacgagcacccccctgctctgcgccgcaggagattgccgccgaaatcagggccgagcagagccccaggcgccttcacacagtgcgcggcaaggtctacgagctcctcgtcaactgcatccccccagaggtgggtgcagtgcctgtgtga

SEQ ID NO: 4131 - DNA, 435 bp, Chlorella protothecoides
  modified_base (229)..(291): a, c, t, g, unknown or other
atgccgagggggagtgggtgctcctggggtgttgcgcctggtctcgcgcctggccttcatagtcacagattggacctccacagtgttttcctacctatccctcccacccacccactcgcgctcttcgtgcccgtcaggtatgtggtccaggagatcatccaggagatggccaagaatcggcccgtgggcgtcagctccgagcgcatgttcaaggtgcggggccgcatgnnnnnnnnnnnnnnnnnnnnnnnnnnnnnnnnnnnnnnnnnnnnnnnnnnnnnnnnnnnnnnngggggggcgcttcgatgtgagcatgtgtgtactctccagcaagcctgtgagggtcagcgcctcggagcctgcagagaattccagctctgggagtacacctcacctgctgtgcctccccctccgtcagatgctgatcctgaatga

SEQ ID NO: 4132 - DNA, 441 bp, Chlorella protothecoides
atgcagcgtggcggtgcggtttgtgctcttgctctgccgagcgaggtatggatcgaagtgcttagccgattaaacggtcaggacctggcccgtgctctgtgcacctgcaaagctttctctcgtttgcaacagcccgtttggcaagctgcctgcttcaaaagatggaacaagtggtcatcatacctcgaccccgcctcgcactggcgtcgacaatatgaattgctctgcctgcgggagctggcagagcagaccgtggcggacgtaggtcagatacgcaacgcccagcaattcgtctccgatcggcaccgcgccgtactcgtggagtggatgtgcgaggtgaggggatcggctggacggtcggagggtgccatgccaacgggtgttgacattgcggcgtgtcggtgctccgtacccgaccccccccgaccctgtgccccgtaa

SEQ ID NO: 4133 - DNA, 399 bp, Chlorella protothecoides
atggagtcttccttctccaatcgtggggatagggaagaggatgctcgccccgccctgccccagagggcgtacctgcagattgccctgtatgcttccggcaatgccctggcagccctcatagggcttcttttatggaacctgtatgcggtgctggccgactaccgggatgcagcagtgtacgctctcctctgctcggtggcccttaggggcccaaaaacttggctggtggattaccttgggcgcgagctggctcacaggagcatacttcagtccctgttcaacctggcgtgcctccccctgaccacattggtggaggcatggatggagggccgggtcttaatgctgaggtggcagcagctggccgtggaaagacaccgccaggtgaggctgatgccctga

SEQ ID NO: 4134 - DNA, 375 bp, Chlorella protothecoides
atgccggaaggtgagaggtcactggactctgaccagaccccccgggctccgcagatctcgcaaaacgattgcccgcacgccctgttctacggccccccgggggctggcaagaagactctcatcctggcgctcctgcgggaggtgtatggccccggcgtggagaaggtgaggccagagagcccgtgccaagctcgctgctcgcgccgcacccacgcgcctgctgctcccctcgtcaccccaacccagctgaaagtggagtgcaagccctggaagatcgagctgcccacccgcacgctggaggtggaattcaccacgctggccagcgcataccatgtggagctgaaccccagcgatgtgggtaacaacgaccggtga

SEQ ID NO: 4135 - DNA, 393 bp, Chlorella protothecoides
atggagggctcgggaaggcctgaggtggacgctcctcctcccccgagcgtggcagtccagcggaccctggaggccctccgacttcgtgtcaaggagtatgacatggcacgcgccaaggatcgtctcaccatcgcggtggtgcgcggtgcatgtgcggggctcgcggttcgaggtggcctgcatgccgtctcgtacctggcgggcaggctcatgaggaggaggcgcagggagcagcccccgtccggccccacccctgtggagagactggtcgagaccctgcgctatggcgccttcctggggacctttggaggggtgtatgtctcggccgacgagctcatcgccatgctcctggggcggtcaaggtatgggtggcagcgggttgtggagttgtag

SEQ ID NO: 4136 - DNA, 186 bp, Chlorella protothecoides
atgcgccggttggcgctggagctgatgcagaagctggacgacgagctgcggcagagcgtggcggagcaggccgccttcttcgagcaccggctgcaggagggttccaaggccatcttccacatcgaggcctttgtggcgaggttcatggccgactacaagaacttcctgctcgcagccatggcatga

SEQ ID NO: 4137 - DNA, 498 bp, Chlorella protothecoides
atgttcaagggcgggcagaagaaggacaatgccctggatctcagcaagctggtggacaagactgtccgtgtaaagctcgctgggggacgtgaaggtgtgcgaggagtggaaggagtactcaaagggttcgaccagctgctgaatctggtgctcgatgaatccactgagttcctgcgaggtcggtggtgcccgggggcaccctgcactggttggccggctgctgcacaatggggacgagacacggacactgggcctggtggtgtgtcgtgggacgagtgtgacgctggtggcgccaactgcaggcaccgaggagatcgccaaccccttcatccagccagaggaggaggcatgagcgcgtgcgccaaggcttaccatttggtgctgcccaggaaacacgagcatgcgctgcagctgctagcgcacatggaggaggcagggggagcgcctctgaacgaactctgcttgcccggcatgcgagcctgctccatcgattcctga

SEQ ID NO: 4138 - DNA, 2031 bp, Chlorella protothecoides
atggtgtttgaggggtgggtggtggaccacctgtccgcatggctgggccacttcttcgacctccagcgcgatcagctgcgcatcagcttgtggaggggtgagatggagcttcaagctttgaattgggcgtacgagcctgcgtgccgcccggctttgggaattacgggcgtgactctggagaacatccccatccgcttggatgccctggagtacctccagctgccgttccggctcactgcggggaacataggccggctgcagctccagatcccctggcaagcgctgcgctcccccctgatcctagaggtggcggatgccaggctggaggcgtgcctcagggggccagaggaactgtggcaggagcccgccgaggcccgagcctgggccggcaaggaggcgcgactggcaggggtggaggccagcgccctggctgggccggaaggcgcccaagaaagcgcgacggcggtccctgccccttcccagggctccacgggcctcctctggggggcgctgtccagcctggcctccttcctggtcaaccgcctccagatccgattcaccaatgtcagcctggtcctcatggaccctggcacggggctgggggtggaggtgcgcctgccctccgtgcacacatgctcgccgtctgtcgcgctgcgcatgctgggcgcggccctggacgaggcactggggcaggagggcgacgaccccggcatggtgcacaaggacgtcgccctggcggccgtctctgtctggctcctccagggggagcctggcgtgggtacggacgcaaacggctggggggaagtgggcgcaaccagcctcggcatcgaccccacacaagcccccctgggatccctccccctgctgccgccctgcgacggcgtgctgcacctgggcaccaccgccgcgctttctaatggcacgttgcgcgcagattgcacactgacgctgccctccctgcgcctgtcgctgagcgacgcgacgctggcaggggtggtgtgcctggccgacgccgccgagcgggtctcgcgccaaaatcgggcggccctgttctgccccgcctcatggcgcctgaagtctgggggacgcgaggggtttgccaggcgcatgtgggtctttgcgctgaatggcgtgctgaggagcgacgctcggtgggacgcgggcgtgacggcgtgggtgccggcgcacaagcgtgcagagcgccggaagcggtacatccggctgtaccgcgcggtcctggagcggccggtgcagccggctgcaggagtgggcgctgcaaagggaagcggcggcggcggcgacgccgtcgaggagccctgctgctccatgctggaggcggcggagaggaagctgtgcctgccggacatcaccctctgccgcgccgtggcggcacgcatggcggccgcgtccctggccaaggccgccgcagccgccaagcgcaagaaaacggggccgaaggccgtcccttcccccggacaacttctccttgcagcggccgggcctgcgtcggatgagaaagggctgattggggttgatctggcgccggctggactcagaggcgccgccatgcccgaggagggcgcccctccaacaagagacgacacacgcaccgaggaggggttgtctgttcctcccgctgatgcgatgacggccgccagcgccctggccacagccgctgctggcagcgtgccggaggccgcactgcgccccggcaaccccggctcggagctgccgcgtccgggtgcagaaggcgacggcgttcccgtttcagagggcacgccagagcaggggctcgcgctttccacccgccccgtgtccccgcacgctgcggctcgccggggcgtggtctcgcgcggcgtgtctgccatggcgggcttcttcggcgccctacctcgacgagcgggctatgcacagcatcatcccaatcctcccgatccttccctgccccctgcagccgccgcgcccggcgccccccgacgaggaggaggccgcccgcctgctggcggccatggaggtcgacaccgtggatga

SEQ ID NO: 4139 - DNA, 327 bp, Chlorella protothecoides
atggtattgcgggtgctgggagatgggcggcggtacattgcatccattcgaacggagaactggatcatcggcgaggccagctcccatgacgtgtaccaggccttcttgtttgccagggaaggggagtggacggaggtggagatcccgctggctcgcttcctgctgacctacaaggggcggctggtggagacgcatgtgcagatgaaccggtcccgcattgtcagctttggtctggccctggccgccggggactaccagcaggaggggccttactccctaggcctggactggataaaggtgatcgacagcaggcgactcgaccgatga

SEQ ID NO: 4140 - DNA, 447 bp, Chlorella protothecoides
atggcgttcgctcgccttctgcgcagcacgcaacgatacctcgagagagaaggcgacagtgcacctacagactcccctggtgccctgcaccatgcagttcgggagcccatccccacatttgagcagcgcctcttcgacttctccacccccgcatccctggcacggtgggcgacgttctccgacacagagctgggtggtcgatcaacagcctccctgatcgcatccacctctcacccggctacaaacgacttcgaccaaatcagcccctgttcctcgcatctacagggcactgcggtgttccaagggaccttcagccgtgaaactggggccgacgcggatgagcgactcaaacgcagtggctttgtgggcatgaacacccgggaatatgatggaggatgtgtggcagctcaacgcaagatgcactccgctgccctagccggcctctga

SEQ ID NO: 4141 - DNA, 624 bp, Chlorella protothecoides
atgcaggagggttatgatctcggcggcgtggacctggaggccctggatggggaggccattgtatcggcactcaggcaggcggccgaggggctcagggtagcgcggggccccgccggcatgcgggacctggaggctggcctgcccgctggcgtgagcatcagcgccgcagaggtcccgccctccgagctgaagcgtatgctggagttccccgccgactgggggcccagcgagtggggtgagcgcgatgctgcggggcagcaaagtgcaccctcttttgcgagccccagccctgcacagccccgagccgggccgggtcccatccccttcctgcccgaccgtgacactctggtacggcgcatggagaagcactgggggcccctggacagctaccgcgggatcgccagcagctcagccggcggcctggtcatcacgggcgtccagatcggcaaggtctggatcggcatccagccgatgctggggatcgagggggacccaatgcgcctgctgttcgatcgggacctcacgccgcacccgcagtacgccgccttctacctctggctccaggtgccctggatgggcgaggttctgtggactggggtggtgatcgtgctccaggagggctga

SEQ ID NO: 4142 - DNA, 483 bp, Chlorella protothecoides
atgcccgacctcaccccccaaccacccaccctcacttggcagctgctggaggggcgcctcttctcctcgggcctgcacgtgctcggcaagccgcccagccgcgaagaaagcctggaatatctggccgcctacttcggcgacagggtcccacgcgaggcgctggagcgcgtggcggcgggggagtccgttcagaacgtgcacgtcggcggtgcggcacatcccgaggccccgagcctgctggaggaggcgcagagcatcgcctcgcttctggggcagaacggcgaggagctgcgtggcctgacgcgcgcgctgagcgggcagtgggtccagccggcgccgggcggcgacctgctgcgggacgggccgggtgtactgcccacgggccgcaacatcttcgccctggacccgtaccgcatgccctcgcccgctgcgctcctgcgcggcagccgcgccgccgagtccattctggcggcccacaggtga

SEQ ID NO: 4143 - DNA, 468 bp, Chlorella protothecoides
atgcacggcacggcggagtggctgccgggctcgcctctgggctcctcggcgctcagctggccggacgtgctgcacggcgacatgcccaacatttacctctacgccgccaacaacccctccgagtcgctcgtggccaagcgcagggggtttgccactgtgatcagccacaacgtgcccccctacggccgcgcggggctgtacaagcagctggcggagctgagggagctgctggctgactatcgggaagcccctgggtccagcaaagacatgcggggcaccatcgtcagtcttgtcgtggcctcaggcctggaggaggatgtggttctggaacaggacggggtcacctttgacgcagacatcgtgggcgacctttcactggaggccttcaacagcttcaccttccgcctgacccagtacctccaggcagggacaaggctcggggggtcatggtcccattccatgccatga

SEQ ID NO: 4144 - DNA, 1020 bp, Chlorella protothecoides
gcggccgccgccgagccggaggcgggcgccgaggaggaggaggccgaggccgcgccggcgcggggcgcgccgggcagcggtttgcagctggcggacctgtccaaccccctggtcatggccccggacagcgacggcggcctggaccgcctgccgcccccgcccgtggcgctggcactgacgctgtcggtggccaacaccggcgaggaggccttcaccttcaccacgggcctgcgcacgcgcctggctaccgaggacgcgcgcacgcacggccagtacatcaaggccgtggggctgcacggtgcgggatgtggagtgggagtgggcaggtcagggtacattccgggccgcatcccatggggagggggggaggctggcgcgtcgcttcgtcatgccctgggaatgagtggtgtgccctgctctgttgcgatgcccgctgaacacccctctggcgttgccctgcttgggtgccagatgtacattggcggcttagttcctgtcccacccacaggcaagcacacgctgcgccgcgagtccaaccccgcccggccccgcatccgcgtggagaacgagcaagcggtgagcttcggcgggcgccagctggaccgcgtgtacgtcgactgcggcgcgcgcgagttcatcgcggtctgccccggccatgccgcgcacgttgaggtgaagaacctgcgcggcttcgacgacgtggcgctggaccaccccgcgctgtcctacccggaggaagcgcggtggtcggtgggcatcgcgcccgcgcgcgtcgccaggcccgtcaggcgcgtgtgtggggagcgggaagggggggaatcagggaggggtcctcttcctgagcagcaacggggtcctgggcacggggagggcggctgtgctgggtccctgaccgcacagtacctcttcccaccctctctcgcaggctggagccgggggagacgtggacgggggaggcccatctcatcgcgcggcaggagtactgggaccaggcgccgtgggagagggaggcggggctga

SEQ ID NO: 4145 - DNA, 345 bp, Chlorella protothecoides
atggcgcattgcaccatcacgtccaagaatgtgtcttcccctcgcgccctcgaaattggctggggcgaggacagggagctcaaggacgacaattacaccgttgccttgccccaccacttcgatactcttgcggttgcacacagaaagctctcggtgatcgatctgatccgtgagcgctggggctggctcctgatcttcttcggcggcctggtgctggccgcgctggtcgtggaggcctttgaggacgttttgaaacacaacgtggagctatcgtactttgtccccctcctcattgggcacggcgggaacaccggcagccagagcaacgccaccgtcatcaggtag

SEQ ID NO: 4146 - DNA, 705 bp, Chlorella protothecoides
atgtctgggtggcggccctctgtagaaacacccgttgcgcgtgagctcgacgcttcacgcccgagctgggaggctggtcacgctggggacctctggatcatgccatacttcccatcctccctttcccccggaaaaccatcgctcggtcctgaatcgcagggcgctggccctgggccacgtcaagcccagcgactacctgcgcgtaatggccaaggaggccggggcagggaccttcatgggcgccatgctgggcctcatgatcctgggcttcagcttcctctgggacagcatctccacccaggtcggccttgtggtcgccatctccctgccggtgagcggggttggagtgacgggggaggagcgccaggggggaggaggttgctggccaggagcacacaccatgcacgtgcattcagggagtgggcaggcagcggctcggagtgcggggccggggcgccgatgccgccatctcggcgcggccaggccctgagatcgggtgcgccagcctccactcttctccgctttctccacaccccgcagctggtctcgctgtgggccaacgttctgggcggcgtcttccccctgctctccgcgcgcttcggcttcaaccccgccgtcaccagcgccccactcatgaccaccgtggtcgactcctcgggcctcatcatctacttttacatcgccaagatcgtcatgaagatgtag

SEQ ID NO: 4147 - DNA, 1560 bp, Chlorella protothecoides
  modified_base (310)..(319): a, c, t, g, unknown or other
atgatcagcagtgcagtgggcatggaggttagtcctctccaggaaatgcctaatgatgcacccaaccagctcttcaatgggcggctggagggagccagggccagtcgcccagcctcccctctccgaccttccatcactcctccctcttcacccccgtccccacccacgactgcagacatcgactttggcgcgctgccccggaacctgaggagcaccgacccggcggcgcgcggccgattcgacctcgagcacaaggaggccctggcctcgctgcgcgtggcgctggcccgcctggcgcccaacctgcgcnnnnnnnnnnagcacaaggaggccctggcctcgctgcgcgcggcgctggcccgcctggcacccaacctacgtgccgcggcgcagttcgaggcggtgcgcgcccgcgagcgcgagcacctggaggagctggaggccgcgcggcgcgcagagcgagctgccgcggcggcctttgccgccgtgcgtgccgctcggcacgacgccttcaccgccgccttcgagcacgtggcggcctgcatcgatcccatctacaaggtcgaggtcagccctggcgcccagccgatcacaggctctgaacacccagggcagcctcacctggccagcgcgcgcagtgccaccgaacccctcctcgtccctccctcccctggcacaggagctgacgagcagcgcggtgcacccctctggcggccaggcctacctggcgctggacagtgcggacgagcccttctgcgccggggtcaagttcagcgccatgcccccgaccaagcgcttccgggacatggaggcgctgagcgggggcgagaagaccgtggcggccctggccctcctcttcgccgtcctcaggtgtgtcgagtggggtctggtggtcggggtgagggggtctcatgcccaggtctggggcccagtgtcggccctggcttcgcacgcttggcggccagcttcaggggtcctcacctcgccccatctgcatcccctccccaccccaccccaccccacacttctcccgccagcttccggccctgccccttcttcgtgatggacgaggtggatgcggccctggacgcggccaacgtggtgcgggtcgccaactacctgcgccacatgacgcgccgctccaccaatggctccttccaggtgcgtgatcgcgggaggagggagccgggagcctgccaccccgaccccgcacagtccatgggtcccgcgtgtcgactcagcacccacctgccccgcctgcttgacacggcggcgcccgcgttcaccgtgcctgagaccggcgcgcaccttcgacgccaccctcccgtccaacaccctattctccacgcagggcatcgtgatcagcctgaaggacagcttctacgacaaggccgatgcgctggtgggggtgtgccgccacccggacaccagcgcctccgccaccttcaccctggacctgaacgcctacggggatgtggtggcccagtgaggggtgacccatgcgctcagcggtgctgtgacaaaacacgtgcgagacctgacgggcaggctgcgttctga

SEQ ID NO: 4148 - DNA, 1929 bp, Chlorella protothecoides
  modified_base (108)..(117): a, c, t, g, unknown or other
  modified_base (234)..(243): a, c, t, g, unknown or other
  modified_base (1569)..(1578): a, c, t, g, unknown or other
atgagaccacttgagctcacagccatgtttgagcagatctcggggtctgctgcttacaaagaggtgactgtgatgtgtccttggagcaggattcagggtgtcaagcannnnnnnnnntctcggggtctgctgcttacaaagaggccccaggtcgaatcactcattgagccttctttcaaacatatgaccatgctgacacgcagacatgttgtccactcgatgtcatgcatgttnnnnnnnnnnaggccccaggagtatgaacgagcggaccaggaaagggcagcagctgaagcgcgcctctcagtcattcacgcagcaaagaaatcgatagcacatggtgaggagctttggcttgggtgggtgtggggcaggcaattgactgcttggcaggatatcccattcatgaactccagctctgtcacccctctcctcagaaccaattacattttccacattcctgcagagaaaaagcagaagaaagaggagaaggaggaggcagatcgtgctatcgccctccagaaagaaatcgacgagcggcgcgctacccactttttgtggagcctcttccaccttcgtcaggatgagcttgctgcccggcaagaggccgatgccaagcgcgagggcattgctcagatccagaaggacatcaaggtgtgccttgaaggatgggccccactctttttcatgtgctggcacctgtcgtacatattcattgacggcacgtgcctgcctccctgccgcagcgactgcgggggtgtcgatgcattctctgcgcaggatcaatgcccaggcacagcctgcggggtcatgccgccgaccctccacccccaaccacctctgcaggccaacaaggcgctgctggagtctcagcgccgccagcaggcctcgctggccaagaagcggctgctcctggaaaccaggatccgcaagatgacggccgagctggatcggggcagtcccgacctgatcagggtgcgggaggagctgagccgcggcgccaagcggctcgcgtccctgcagaagcagctggaggagggccggcatggcgtggaggagcagagggctcggcacgccgccctggagcggcagctggaaagcctgaacgatggtgggtgggcagggaagtgtgtgcctgggtgcagcgcgggcgtgtgctccgctgggcaggacgggtgtgaggttgtgacccggatgcagcgcctcacatcccacaccgcctccctcccccatctcaccccagcgctggcccagctggacgccgatgtggcagccgcctcgagcgacgagctggcgatgtcggagacgctgctggccgagtacgcccggctgaaggccgaggtgggggcccaggtgtcagcactggagctcgatcgcgccgcgctttcctccacgcaccaggcggagcaggaggcgcagcgcctagcgcaggccagcctggaggctgtagatgcgcgcatcgccggcctgggtgggtggagatgtgtcggggggaaacaggccttggcagtggggcatacgctcacctccgccgactttgggattgcttatgagaccctgtgcccgccgctnnnnnnnnnncctgggtgggtggagatgtgtcggggggaacaggccttggcagtggggcatgcgctcacctccgccgactttgggattgcgcatgagaccctgtgcccgccgccgcgatccatcgccacagagacagagcgtgtcgaggccgaggagcggctggccgcggccaaggagcgggtgcaggagctcgcgggtcggctggcgacgctgcaggcggagcgggagggggccagtggggagcgtcggcgcgtggactccagggtgggtggggtgggtccatgggggagcagtgccagggcattgcttcaggcactagccagatgcatgagatgctgcaccacactgctgtgttggtag

SEQ ID NO: 4149 - DNA, 453 bp, Chlorella protothecoides
atgggggtcggcggcaaggccatcccgcccaacgtggacaaggtgcagcggggacgggacatggaggcgccgccatgggactcgctgtcttgcgcccgcccagtgcagcccacatcgaggctcggcggggatgaaggccccggagcgctgggcaggcaaccacgtcctcaatgcctagatataaaagaaccatccctttcccccaaaacccgccaggtcaccgccatccagtccgatgccaagttcatcctgctggtggaaaaggacgccgccttcatgcgcctggcagaggaccgcttctacaacacctacccctgcatcatcatcaccgcaaagggccagcctgacgttgccacgaggtgggggtcacaagttgcagtccccggtagactatacgatttggagctggcagtgccagtctgcttcgtggcactggttcctcgcgtggtgtga

SEQ ID NO: 4150 - DNA, 1887 bp, Chlorella protothecoides
  modified_base (1611)..(1620): a, c, t, g, unknown or other
atgaacatgtcgtacgattcctccaacctcaccacgccagacatcaagtggttgggcgtccggccgtcagacctggaccgcttcagcattccggagcaggagggtaagggggtcttggcagctgtcaccaccaataaaacactgcgccggcgttgtgcaccccctcatggtacacacggcgggtcgtgcccaaccctccatgcagctggaggaggactttgtcaaagcaaacccagactgggtgcgggagctgcagctaatggtacgaggtgtcggggtgcacgcgactggaggattgggctccccgtcctgattcgtgatgcaagaaaacagcatctcatagccattgaaacttcacataaatttggctgtgcggattcgaggagggttagtcaacagcgcccgccctcctacgtcatcaaatcgaacgtaagattcgacaacaaatctcggattctgcctgatccccgtcgtgcgggctgtgtgcatggcgttcgaaaccaaggacaccaccagcaactcgctactttgttcgcacacaaatccatttcatcgaagacgtatctgacagcagtctgggcaacctgtggctcttgtgtgaagcaggttttctgtccccgcccgaccccgccgttctcaagaattcaagctgccgaacctgccattgcccacctctggacatcctctttaccgcacatgtgtcgcataagtactataaatccggcgcttcggcggcaagacaccaaggaggttaccgtcaaggacgtacagaagatacatgctatgacggaacagtgcctgttgcatgggctgacgaaagccgagacccaggcagcgctcgccggtttccgggtgcatccgaagattacggaaattggtacggacgcggccctcgcggtgggtttgggttgcagcttcctagagggtgctcaaccaccccccacgagtcctgattctgcccccgttcctcgcctttccatgtggcacagactggagcttgaaaatccggagtattttgctgcttattatgctgcccttcgcgctaaggtgtggtgggagagggggagagagagagagtgcgggcgtcgcgcggccgcaatcctgaggatggaggccccacacccactccccctcgattatcagcacagaatgaattctctcccggaccaccctcccctctgccagttgaggtctgaggcaaggaaggatctcacaggaccccttcccattgtgagagagcctcgccacagtcagctgcccctatgttgtaccctttttgatatgagctcgaactttgtgcctacacgatcgtggcctttacccccaagaaacggtggccagatctctgcacaccttgtgaccaggccgcccgactcttttcacagtaatttgaacttgacagcccattctactccccacttcagtgtctcaaacttgaatggcatgcactctgccctgccgctgggcatcattgtgttcctcaccgtcgccctacctgctgtgctttccacccttcctgcaatggaccccaacctgaaacgagagtctcaccctctctgcagtgtcatgcaagcctgtgcacaccgaaccgcactgcagattcgccaagtnnnnnnnnnngcagctctgcagcgtcatgcaagcctgtgtacaccgaaccgcactgcagattcgccaagtgtgttcttattctcaatgcgacaaggggtcgattcgtttcatcaatgcccagcgccgatgcgatgcccattgaggttgactcagtggcaggcaggagcacaagatgtgcggaggattagtccaatgtcagagggctggatcctgtcccctaagtcccagcaggagcttgttctcccccgacacctcggggctgatgtaggcgactag

SEQ ID NO: 4151 - DNA, 1257 bp, Chlorella protothecoides
  modified_base (682)..(691): a, c, t, g, unknown or other
atgctgtactccagtgaaatctatgcagacgaggtggagaagcacagactgaagtgccccgcccacctccagatccaggcccagcgggccgccccgtactaccagctggacatcaatgccggcgcggccctggacgtggacccgattcccggcgcctgcctgcctggccacagcgtggcggagcgcagggcagcctatgccgcgaccctggggcccgatggcttggacgacctcatcgagcgcgtctgccaggctgccgagagggtgagtcacactcgcgacgtctgctggcgtggcaggggtgcatggccgttgatggcggggctttctggtggccagaacccacgccgagcatgttgtggaaaccgtcgacgcccgatgatgccagcccatgctgccgcggcggcggcgccccccgcccccgcccccggggtcacgaccccgccctactccgccaagcacgccgcccagcaggcctccatcgtgggccacctggagcggcacggcctgctgcggtgtgtcgccgacgatgtcatcgtcgagctgggcgcgggaagggggtacctgggggccgcggtggcggggcactgcgcctcgctgacctgcctcgtcctggtcgactgccggggattcaagctcaaggctgacaggcgagggcagggggcggatggagggcaggagnnnnnnnnnngacctgcctcggcagagccctggggcgcactggccacgattcccgtctaccctgtcgcggtggccttccgacagcgctcactccccccaccctcccccccaaactgcagagcgctgcgtcacctggacctgcaccgcctgcgctgcgacctgaaggatttctcgctcgccggctgccccggcttggaccgccccggccccagcggcggtgccccgccccgctcctgggtgggcgtggccaagcacctgtgcggcgccgcctccgactttgcgctgcgggcggcggtggagcaggcgccgcggcgctgccgcgggctgggcctcgccacgtgctgccaccaccgctgctcctggagggcctacgtcgggaaggagtggtttgccgagcgtggcttcgccccggcagagtttgagctggtgtcgtggatgtctggtggggtgatgtgctgcaggatggagagggctggtgagggcttggaagacattaggatggggaacgtgctggctggaccgaccaccagtccctcgcgtgaaggcagcaatgttgatgaaggctgctctgcctaa

SEQ ID NO: 4152 - DNA, 5475 bp, Chlorella protothecoides
  modified_base (785)..(794): a, c, t, g, unknown or other
  modified_base (1179)..(1188): a, c, t, g, unknown or other
  modified_base (2924)..(2933): a, c, t, g, unknown or other
  modified_base (3919)..(3928): a, c, t, g, unknown or other
  modified_base (4684)..(4693): a, c, t, g, unknown or other
  modified_base (4819)..(4828): a, c, t, g, unknown or other
  modified_base (5217)..(5226): a, c, t, g, unknown or other
  modified_base (5443)..(5452): a, c, t, g, unknown or other
atgggagcgcgagggcgcgggcgcggggagcaagatccatgggagacaaaatcacaccccggggccggtcaagatgccggggcgcttgcccccgcagcactcgcagtagggcgggtgccgtggcttcaacgtcatgagcgtctcctgccacaccgcctccaccacctccgccggcgccttggcaaagatggtggcggggtacacccagctgccccaggaggggtgcagcgccaccttgcagcacccggcgttctgtatacggaagctgcacagcgcacacagcgccgccacctcgtcgtacacggcgcatgtgtcacggtgcaccatggacatgccggagcaggggtcaatgtagtctgcccagtacccagaggcctccagccgccggaccaccgccttggcgaggaagaagaactggcaggaggcaggatgagtttgggggtgaggttcaagcacatactgttcaaaggcgagcgtcgcactgcgcgccgctgtcgacgacgctgcgccaaggcttatccccaagcgcagcaacctctgcaagcctcccccagctcaccctctccagcaggcgatccttctcttcctccacttcagggcccctgcccacaagtgaggagggctggtctggattccagaaactgtcattatccaactcatacctttgatgtctatggagggaaacagggcggcgatgtcatccctgaatcgttttggacaggctgctgggttgcaagatggaaggaggagtacttgcggatctcctcatcagcggatgaatcacnnnnnnnnnntgtcatccctgaatcgttttggacaggctgcaacaactcaagctgggcactggcagggttgggtcgcaacccccggcgctcaccctgcaccgacgcttcgatctcgtccccccctgcatggttcaatgagggtatgctactcctgcgccagccatccatcacgaatggccgcacttgcggcatggtggccgcagtgctccggcgtcagggaagtgttttgattctcaggactgtctcgccgccgaaccggaacgcacgaatgcagactgagccgtctgaggcagcctgtgaaggttacatttgtgtgcaggacgatgcttcgagctctcagtacgacccgagtgtcctatcagaggatgcgcaaggctgtggggtagaacgaatnnnnnnnnnnatgcagactgagccgtctgaggcagcctgtaaaggttacatttgtgtgcaggacgacacttcgacttctcagtacaacccgagtgtcctatcagaggatgcgcaaagctgacctgcagggatttctcagcaagcccctcgcctacgtgcattcgcgcaccgcctcagccagggagtcctcgaagatgccaagagcggcgtcaatctccccctcgctcacgttgagtgggggcaggaagcggatcgtctcccgcgcaccggcggagagcagaagcatgtcgcggcgtcccgcggcggcggtcacccgccccgccagccccgccggcgcgggcagcttcccgtcggccgccgccagttccgcggccaccatgagcccccgcccccgcacgtccacgacggcggggaagcgcgaggcgacatccagcaggccgcgcatgagctgcgcgccgcgcgccgtggcgttgcccagcaagtcctcctcccggatgacgtcgatggtggccgcggcagcggcgcagcccagcgtgctcccgccgtacgtcccgcccagcatgcccggggacatggcctggaacagctgcggccgcgctgccaggccggcaaaggggaaccccgaggcgatgcccttggcgaagagcagcatgtccggctgctcggccgacagctgctggtggctccaccaggtccctgtccgcgccatgcccgcctgcacctcgtcgaagatgagcaggataccatggcggtcgcacagcacgcgcagcgcgtccaggaaccccgggggcggcgtgaggaagccgccctcccccaggatgggctcgatcaggatggccgcagtgtccgccggcgcggagtgcatcttcagcatccactccagtgcctccagcgggccgccgcagcaggcgcggccggcgtagtcggcgccgacgccgggcacgttgggggccaggccgtagcccaggccgccggcggcggcgcgcgccttgcagtgcaggcagtaggggtagggcgcggccagcacgcccgacggcagcgggccaaaggtctgccggtagaccgtcttggaggtggtggcggccatggcgccgtaggtccggccgtggaaggcgccgtcaaaggcgatgacgttctggcggcccgtggccgagcgcgcgatcttgatcgcgttgtccaccgcctcgctcccgctgctgacgaagaggtactgggtcaggctggggggcatgatgtcgcggaagcgctccaccaggtcgaccatggggcgggaggcggggaagatgttctgctgggccatgatcatgcgccccgcctgctcctgaatggccgccaccacgcgggggtggcagtggcccgtggacagcacgccgatgccggtggccatgtccaggtgcttgcgcccgtcggtgctccagacgtaggaacccttgccgtagtcggccaccaggtcctgaagggctgcccaccaacccctccaccccgcctcctcaccccgaacttggagacagcgggggacagattttcaagcacggaatccagcgttggaccggccctgggtgccgtagtggtgtgcagggatcggtacaggccccgagtcgccctcaggccggcctccgctgagggcttcatggcagcgagtgtccccgactcccctcccaggcagccgaaagccacacactttgagctggcgatgcagtcagaacaaccccgttttagtcagcaggctttacaattcgacaaagnnnnnnnnnnggggcgatgtcgtggcctgcccgggtcaccaggggcatggcaggccaccagggcccagccaccactgaaaccctgctcacgtcagcacctccgcgcacaccttctggatggtttgcaccgcctcgtcgatgtcctcgtccgacacgatgagcggcggcaccaggcgcacgatgtctccggcgcccgcggtgatgatgagcaggccccgctcgcgcgctgcggccaccacggcccccgccgcctggtccagctggatgcccacgatgaggcccacgccgcgcacctcacggacgtgggggttcccgtccagcgcggcgcgcaggccggcgcgcagggcctcgcccttgcgcgccacctcggccaggaagcgcggctggcggatgatgtcgaaggtggtgaccgccgcctggcagaccagcgggttcccggcaaaggtggacccgtggtcgcccggggccatggcgtccgccacgcgctgactcagcagcaccgccccgatgggcagcccgcccgccagcggcttggccagggtgagcaggtcgggcgtgaccccggcgcgctcgtgcgcccacagcgagccggtgcgtcccaggcccacctgcacctcgtcgaagaccagcagcgcgccggcctcgtcgcaggcgctgcgcaggccgcgcaggaagtcggcgccggggtcgtggatgccgccctcgccctggatgggctccacgaacaccgcggccacgcggccactggaaagcgcggcgcgcaccgcgtccaggtcgccgtagggcaccaggctgctgccgggggtgagcggcgcgaagggcgtgcggtactgcgacttgtaggtcaggctcagcgcgcccagcgtgcgcccgtggaagctgccctcgaaggccagcaggtcggagggcgcggaggccgaggcctcggcatcgtatgggtccacgccggctgtggacgttgtagatgggaaggtggtgagggaaggcatgactcgnnnnnnnnnngcatcgtatgggtccacgccggctgtggacaatgtagatggaaaggtggtgagggaagggatgactcaattgacttcagacacaccatgtgctatggtcaacacgatacaggcaaggtctctgggtctctctctgtcgctacgtgccccacggattcaatgcatagctgggtttctatacaccactacgacggcctggtttttatacactaccacgacggcctggtgggcccacttcctcaacaccacccatcccccttctcaccatcatctgcagtaaggcccacatccccacccagcacacccacctacacttcacccacccctgatcttggcatatttgcgcgcaaacttgatggccgcctcgttggcctcggtgccggagttggcgaagaaggcgcggtccgcgaagctgttctccaccagggccttggccagggccacctggggcacggtgtggaaaaggttgctggtgtgcgccagcagcgcggcctgctcgctcacgctatccacccaggctgggtgggcgtggccaagcgcgttgacggcgatgccagaggtgaagtccaggtactccttgccctccaggtcgtacaggcgggagccctccccatgcgtcagcacgatatcgggccgggagtaggtctgcaggatgtacctgtggggtcatgcagtgagggtgctgaggagaccgttcagggaaaagggattgttacagggcacataacgctggggctctcccataccctcccccacnnnnnnnnnngggtcatgcatctgggtggactcgtgcagggagggggccgctgcggcccgcggggccaccgcctgcaagcacggggtgagatgggagggttggcatggagaggggttcaataccccaccacaccannnnnnnnnngcggcccgcggggccaccgcctgcaagcacagggagacatgggagggttggcatggagaggggttcaacaccccaccacaccgccgagacccatgcaggggatacccatgcggagacttcactcaccctgcgaccgcgatgccccttcctgtcggtcatgccatggtgtactcgagccaccggcctggcgctcaggcaggacgcaagggttgccatccctccagagctctcggaccggacctgctctgcagacgccgcgtgctgcggttttggtgatgggtatgcgtatcgcgtatcggatcgggtgggcttctgccgctaactgccccgcggacgacgtactccagcacgtgtgctcgaccgaggggcgggggggcacgtggcacgtnnnnnnnnnncgtatcgcgtatcggatcgggtgggcttcttctgctaactgccccgcggacgacgcactccagcacgtgtgcttgaccgaggggcagggggggcacgtggcacgtggggtgcttacacacacaaaggatgagcggtggttcccaaagggtagatggttggggtgtagagcactgcaaaggcaaagtgtaatgcggattgagattgaaattgtgaggnnnnnnnnnngagcggtggttcccaaagggtag

SEQ ID NO: 4153 - DNA, 525 bp, Chlorella protothecoides
atgacgctgccggagcgggcagaggactacgtgcacagggttgggcgggtggggcgtgctgatgcactcggcctggccgtctccctggtctcggccctgcccgagaaggtgtggtacgccagcggcaagggccagcggccctggctggcacccagccgccagaacacggcgaccaacgaccggccgggggggcagacggtgtggctggacgagcccggcctgctccgcgacgtggaggagaggctgggcgcggccgtgccgcgcctgccggccgacatggccctgcctgccgacatcgtagcgcggctgggcaggggcccgcaggcctacggcgggggcggcgccgacgctgacctagcggcccaggaggcgctgggccggcgcctggcggcggtgcagccggccctggccgcgctggcaaaactggagcgggacgcgcaggccagcttcttcgacttgaagcgcaagtgggccgaggtggaggcggtgcgcggccgcatgcagaccgtcccgctgggagagtga

SEQ ID NO: 4154 - DNA, 588 bp, Chlorella protothecoides
atgcctatcatcgggttggatacttggtcttggtcccccgggatggggcacaggggtgcggctttcatcgggggtgcaccattccccaggcctccactgcacgatctgtcacaccatgcacatcactctcagtctgtcctgcgtcctgtctacactgctctccttgtcccactcgctgcccggcccctctttcccaccccccacagatcctggggcagagctctgacaagtggctgctgcacaggaccaatagcgagcgtcatcgctgccatgtcgccggcgggggacgcggtggcgctggcgggaagggacggaagactggccattcatgcctaccccacaggagcctgcatcggcggcttcaaggggtgtgcatgcgtaatcaacccccgcctttcccctctggacccccgccagagctattacggcggccttacctgcgtggcctggagcgcagacgggaatctggtggcggcagggggagaggatgacctcatcaccgtctacagcctcgtcagcaaggcggtggctgcggtgtgccaaggccactcctcctggatcaccggcgtcgcgtttgacccctggtga

SEQ ID NO: 4155 - DNA, 1839 bp, Chlorella protothecoides
atgaacgtggtgatggtgggcgcggagtgcgcgccctggtccaagaccggcgggctgggcgacgtgatgcacgcgctgcccaaggcgctggcccagcgcgggcaccgcgtggcggtggtggccccgcgctacgcgcagtaccccgacgcttgggagacgggggtgcgcctgcgcctccgcgtcttccatgcggagcaggaggtcggcttcttccacgccttccaggacggcgtggacttcatcttcgtggaccaccccgccttccacgcgcatgcgggcgacatctacggcggctcccgccacgacgtgctcttccgctgcgcgctgctgtccaaggcggcgctggaggtgccgtggcacgtgccctgcggcggcgtgccctacggcgaggacaacctgctcttcctggccaacgactggcacaccgcgctgctccccgtctacctccaggcccactaccgggaccacggccagctcacctacgcgcgctcggtgctggtgctccacaacgtcgcgcatcaggggcgtgggccgctggccgacctggccctgctggaggtgcccggcgactacgccgagtccttccgcctggacgacccgctgggcggggagcacgccaacgtgatgaaggcaggcgtggccgccgcacaccgcctggtggccgtctcgcgcggctacgcctgggagtgccagacccaggacggcggctgggggctggacgccgtcttcagggaggccgcctggaagctggcgggcgtggtcaacggcatcgacccgcgcgagtgggaccccgccaccgaccgccacctgcagcacgatggctaccggaactacagcctgcaggacatggcggggaaggcggcctgcaaggcagccctgcaaaaggtgtgctctcgggggggtgtgccgggtcccgcccgctcaccccgacgggcaagcgggcggaccgagtgcggcctggggcgcggcccttgcgcaacctgtcggtgcactgatggctcgtgcgccttgggacatgaacacgcacacacacacccgccccctcaccaaacgcaaaaggagctgggcctgccggtggacgtgcggcgcccgctgctgggcttcattgggcgcctggactaccagaagggcgtggacctcatccgcgacaattacgagtggctgatgggggagggcgtgcagctggtgatgcttgggtcggggcgtgaagacctggaggcgtctttgaggtgggcgagtgaaggagccgggctgggggatgggagggatgtgagaaggccggcggggcggtgcgtcgctggcgacctcccgcctgggttctgcgcagggatgggtcccacctgtgggctctcaggatccttgaccaccagcccccttctccacctgcccaaaccccacctccccacacacccctccagggacatggagagccggaaccacgacaagtgccgcggctgggtgggcttctcggcggccatggcccaccgcatcaccgccggcgccgacatcctgctcatgccctctcgcttcgagccctgcggcctgaaccagctctacgccatggcctacggcacggtgcctgtggtgcacgccgtgggcggcctgcgcgacacggtgcaggcctacgacccttacgccaacgccggcaccggctttgtgttcgagtggagcgacgcgggcgccttccgcaacgcgctgggcgacgcgctctacacgctgcgcgagtaccccgactcctttgccggcatccagcgccgcggcatggagcaggacctgacctgggaccacgccgccgcgcagtacgaggacgtgctgctccaggccaagtaccagtggtga

SEQ ID NO: 4156 - DNA, 903 bp, Chlorella protothecoides
atgccttccctcaccaccttcccatctacaacgtccacagccggcgtggacccatacgatgccgaggcctcggcctccgcgccctccgacctgctggccttcgagggcagcttccacgggcgcacgctgggcgcgctgagcctgacctacaagtcgcagtaccgcacgcccttcgcgccgctcacccccggcagcagcctggtgccctacggcgacctggacgcggtgcgcgccgcgctttccagtggccgcgtggccgcggtgttcgtggagcccatccagggcgagggcggcatccacgaccccggcgccgacttcctgcgcggcctgcgcagcgcctgcgacgaggccggcgcgctgctggtcttcgacgaggtgcaggtgggcctgggacgcaccggctcgctgtgggcgcacgagcgcgccggggtcacgcccgacctgctcaccctggccaagccgctggcgggcgggctgcccatcggggcggtgctgctgagtcagcgcgtggcggacgccatggccccgggcgaccacgggtccacctttgccgggaacccgctggtctgccaggcggcggtcaccaccttcgacatcatccgccagccgcgcttcctggccgaggtggcgcgcaagggcgaggccctgcgcgccggcctgcgcgccgcgctggacgggaacccccacgtccgtgaggtgcgcggcgtgggcctcatcgtgggcatccagctggaccaggcggcgggggccgtggtggccgcagcgcgcgagcggggcctgctcatcatcaccgcgggcgccggagacatcgtgcgcctggtgccgccgctcatcgtgtcggacgaggacatcgacgaggcggtgcaaaccatccagaaggtgtgcgcggaggtgctgacgtga

SEQ ID NO: 4157 - DNA, 1056 bp, Chlorella protothecoides
atggccgccgcggagacggggagcggcaagacgggagcctttgcgctgcccgtgctgcaggtggtccaggaggtccgggcggggctcatgcgcgccggcgcgccgactgcggggcgcggcgcagccactgacccagcgcccgccgccgccgtctggaacgcggcggaccgcgacgacgcgctggccatccagcccgacggcctggtctgccagtcccgcagcgaggcggcctggagcggggtgcgcgcctcgctgggcgccgaccccgcgtccggtccccgctactttgaggtcgcggtgtgcgacgaaggcctgtgccgggtgggttgggccgcgccggcctcctccctggagctgggcacggagaaggggtcctggggctacggcggcacgggccggcgcagccacgcgggcgcctttgagccctatggcaggccctacggcctgggcgacgtggtgggcgccgcgctggactggcaggcgcggcgcctctccttcttcctcaacggcaaggacctgggcgtcgcgtacgacctgcccaagccctcaatcacatgcgtcaagtcatgtgctcagcagcgtctgggatctcggcgcctccatgcatgtgtcctgaccctctctcgtcgcccctccaactcacccactcaacccctgcagcacctggcaacgcccctgttcccggccgtcacgctgaagaacgccgagctggcggccaactttggcgcggaggcctggaagtttcccccgcccccgggctaccagggcttcctgcccggcggcagcatcggggagggcctggtctcctgggaggtggccagcgccccagcgcaggcgggctccaatgcggcgcggcggcccctggccctcatcctggagcccacccgcgagctggcggagcagacccacgacaacctgggcctcttctccaagttcctccctgtgcccggcgtccgcaccgccctgtgtgtggggggcaccaaccccaaggccgccgagcgggcgctggccgagggggccgacatcgtgactggcacgcctggtgagagctgttga

SEQ ID NO: 4158 - DNA, 531 bp, Chlorella protothecoides
atggcaacccttgcgtcctgcctgagcgccaggccggtggctcgagtacaccatggcatgaccgacaggaaggggcatcgcggtcgcagggcggtggccccgcgggccgcagcggccccctccctgcacgagtccacccagactggcgcagatctgacggcggaaatcatcgccgatgagaaaaagtgggattgggggaggacctactcccggcccgatatcgtgctgacgcatggggagggctcccgcctgtacgacctggagggcaaggagtacctggacttcacctctggcatcgccgtcaacgcgcttggccacgcccacccagcctgggtggatagcgtgagcgagcaggccgcgctgctggcgcacaccagcaaccttttccacaccgtgccccaggtggccctggccaaggccctggtggagaacagcttcgcggaccgcgccttcttcgccaactccggcaccgaggccaacgaggcggccatcaagtttgcgcgcaaatatgccaagatcaggggtgggtga

SEQ ID NO: 4159 - DNA, 2031 bp, Chlorella protothecoides
atgcagtcggcatgctccacccccagccgtccgtgcatgggtcagaggcggtctgtcatcacatgcgtggcgacgccctcccgtcctcccaccgcccacgggcccaagcggtccaaggtggagatcatcaaggagaagtccgacttcctgcgccacccgctgatgcaggagctggtgaccaaggagaccaacatctctgaggaggcggtgcagctcatgaagttccacggctcctaccagcaggacgaccgggagaagcgggcctttggctccggcaagctctaccagttcatgatgcgcaccaagcagccctccggcctggtctccaacaagctctatctcgtcatggacgagctggccgacctgcacggcatgcgtcacggtccagggcacacctgcgtacactcgtcacccttccacatgggcaccgtcacctcacacacacacacacccaaacataaaatccttccgcagtacggcaacggcacgctgcgcctgaccacgcggcagaccttccagctgcacggcgtgctgaagggcgacctgaagacggtcttctcgtccgtcatcaaggccatgggcagcacgctgggcgcatgtggcgacgtcaaccgcaacgtctgctccccgcccgcgcccttcaccgaccgccccgactacgcggcggtggccaaggtgtcggaggacgtggcggcgctgctggccccccagtctggcgcctactacgacgtgtggctggacggcgagaagttcttcagcctggcgcgggaggacccggcggtcaccgccgcgcggctggacaccagccacggcgcctccttccccggctcgccggagcccatctacggcgacctgttcctgccccgcaagttcaaggtggcggtgacggtgccgggggacaacagcgtggacgtgctgaccaacgacctggtcatcgtggtgctgtccgaccccgccacccgcgccaccacggggtaccacctcatggtgggcggcggcatgggccgctcccacggcaaggcctccaccttcccccacctggcggcggacctgggcacggtggcccccgccgacctcctggcggcggtcaaggcggtggtggcggtgcagcgcgactacggccggcgcgacgaccgcaagcaggcgcggctcaagtacctgatcgtggagtggggcatggacaagttccgcagcgtggccgagcagtacctgggcaagcgcttcggcccccccgccgcgctcccgccctgggagttccggccctacctgggctggatggagcagggcgacggccgcctggcctacggcgtgtacgtgcgcaacggccgggtgcggggcgaggccaagaaggcgctgcgcgcgctggtggagcgccacgacctgcccctgaccatcaccgccaaccagaacctgatcctgcgcgacgtgcggcccgagctgagggacgaggtggaggccacgctcacggctgccggcctgccgggccacgagaccttggacccgctggacgcgctgtccatggcctgccccgccatgcccctctgcggcctggccatcggcgaggcggagcgcgcctcgccagacatcgtgcgccgcctgcgtggcgtgctggaatcgctgggcttccccgccgccgagcgcttcgtcgtccgccgcttcgtcgtccgcgtcacgggctgccccaacggctgcgcgcggccttacatggcggagctgggcctggtgggggacggcgccaccagctaccaggtctggctgggcggcacgcacggcgccacgcagctggcacagctctacgcggagcgcgtgaagctggacgactttgagaagttcttcacgcccctctttgcgctgttcaaggagcagcggctgggtccggaggagagctttggcgagttcgcttctcgggtcggcttcccggcgctacatgcgcgccagctggcggacggcgcggtggaggagcccaaggccaaggggccccgcggcggccgcaagcctgcaggcagcgccagggtggccgcttcaaattga

SEQ ID NO: 4160 - DNA, 468 bp, Chlorella protothecoides
atggagcctagcagttatggacgcgtcgtgcgtctggaggtccaggatttcaaatcgtatcgcggcatcaccgtcatcggacccttccatgacttcaccaccatcatcggtccgaatggcagtggcaagagcaatgtcatggatgccataagcttcgtcctgggtgtgcgcacagcgcacctgcgaggcagcttgagcgagcttctgtactttaactccgacagccagtcgccggaggacaggcccaagactggtcgggtgacgctggtcttccagcctggggacccaggggccgaggaggtgcacttcactcgagccattgtggcctcaggcgacggcagcacacacacgagtcagtatcgtatcaatggcaagcaagtcacgctggaggcatacaacccccgcctcgaggggtttggcgtcctcgtcaaagcacgcaccttcctcgtcttccaggtggggtcatga

SEQ ID NO: 4161 - DNA, 321 bp, Chlorella protothecoides
atggcagagggtgtctgcccaacatcaccgtgcctcacatcaccccaacccccaaagccttgccttgtcccagatcgcctgctggacacgggaaaccaggaagccatccggaagctgttccgccgctttcccaaggcgggggctggcgtggcgcgcctgcaggtcctgctcttctccgccacgctccactcagaggaggtcagggcgctggcgcgggagctgtgccaggacccgatcctggtggaccttcggggcaagaaccacctgccggacacgggtgaggcgggcggcgggagtgtgcctgggtggccttgggagtga

SEQ ID NO: 4162 - DNA, 249 bp, Chlorella protothecoides
atggaggagcggcgggcggccctcgccgccttcaaggccggggaggttcgtttcctggtcgccaccgacgtggccgcgcgtggcatcgacatccaggtggaatgggtggggagggaaaggggaaaggggcacccggcacacatggtctcaccagcgttggacccagcaacggtcaggattgccgagcctgccttattcgtgcaaagggatggctcatcgatgctccacatcagggtcgcagccccctga

SEQ ID NO: 4163 - DNA, 1032 bp, Chlorella protothecoides
atgaaggcgcgggccaaggacatcgagaggctgacggcatccatccaccagatcaccgaccgcgtgtttgcctccttctcaaggaaagtcggcgtcaagagcatccgcgagtgggagcaggaccacctgatgcgcacggagcgggcgtcacgggagaggctccagctcaccacccaggctccctcgcatgcatgcacgtccccctcaccccagatctcaaagctgaccagccagctggagtacgaccggcgcgctgatatcagcgggacagtggctggcctcgagcgcgatctggcagcggagcaggctgcccagggggaactgaacgaggccgaggcaaagctcgtggagagcagcaagggcgggcaggagcgccttgcggcggcccaggaggaaagcgccggcctgcgtgcggcgatcgatgagctggacgcctcggtccgggagctaaagggggtggccctgaaccaagctgcagaaggtgctgctggggctagggagggggaggttgctgtaaagatgattggggatcagcgtgatgcgcacaaagggctgacacaggcgggcacgggacagaagaatgcctggctcattattgtcaagattcaggaacacccttcccgctcgtcctggagacgcaatcctaagaccatcctccgacctactgccctcgccacagtcgctgcagcggagcgtgcgctgaaggccgcctcgagcaacgcagccgccctggccgcgcggcaggtggaggtggcgcaggaggccgagagggagcaggtacccctcccgcgcacggggcgggcggccacgccgttatcggccctggaggaggacggcgaggaggccgccgactccccggcagcaggtggtgttggggaggcggagagggagcaggtgcccctcccgcgcatggggcgggcggccacgccgttatcggccatggaggaggacggcgaggaggctgccgactccccggcagcaggtgatggtggggtggtcagctggttggtgagtccttccaggacagggtga

SEQ ID NO: 4164 - DNA, 993 bp, Chlorella protothecoides
atggcgactcgggaggctcgcaccgcgcaggatgtgctggcgaaagttgaggctctgcgcaaagccgctgcaggcagtaaagggcctgtcaggacgctgtcggacctcggccttccccatgcctgtcgagaggtcgtcgacaaggcagaggtgtctgtcctctccgagatcgagcagtccatcctgcagatcgccgtgagcatcctggagggtgcggggtttcagtacgccattccaaacaggtccaagggcaatcagctctacgaggaacctcctctgcccgagttcccactctgtattcacccttcctacccaaacatccatgccagtggagtcgcactcactcgccggccaccccacccactcgcagagctggaccgaatcgtgctgaagagctccacatcgcagcgtgcttttgcgagcaccgcgacctgccgcaaggcggccatcaccacccgcatcctgcagctcgtccacgagctgtgcaccaagcgcatccacgtcaccaagcgtgacctgttctacaccgatgtcaagctgttcgaggtggggctgggatgtcctttgatgaggcgtgattggatctgggggctcacatccggccgtgcagcgggcctgggtggagcgtctcctggggtgggcatgtcacatggggtgacgtgcatgcacacaagatggtttggggaacgccgctcatggaccgtgtgttcgccccaccccttgccgtcgcgcgcaccccccaaacccaccgaccccacccaggatcaaggccactcggatgctgtgctggatgacgtcgcgtgcctcttgggctgcacccgctccagcctgaatggtgaggggctttctcggattgagagtaccgggtttccggtaccggttggcaatccctggtccagagtgggagttgatcagcatggaaaccgctccctgccccctcgccaacccctgcagtcatcgcgtcggagaagggagtggtggttgggagactga

SEQ ID NO: 4165 - DNA, 1326 bp, Chlorella protothecoides
  modified_base (337)..(346): a, c, t, g, unknown or other
  modified_base (444)..(453): a, c, t, g, unknown or other
cccggcggccgcgcgccgacgctgctggaggcgctggcggggcggcacgggctgcccgccgcactgcaggccgcccgcagcgccgggcgcctgacgctggacgacgcgcaggcggactacgtcgccgcgctcctgccgcgcgcctgggtggtggagagcaaggcgccaggggatggaggcggcgcgtcggagagcacggcggcaccacccgatctctccgctgcactgacggccgcggtctgctccgtcttcgagatgctgccagagtatgggccgggctacctggccgcctgcatcgagcgggcggggggcagcgccgaggcggccgtcgcggcgnnnnnnnnnntatgggccgggctacctggccgcctgcatcaagcgggcggggggcagcgccgaggccgcccggtggcggcagcagtagggaggggtggcgccgcgaannnnnnnnnnctgctggacggcagtgaaggagtggcgggactggaccgaggagcggactgggccgcctatgccgcctggaaggcccggagccagcccgcgcggccggaagcggtggcggcaacagtagagaggggtggcgccgcgacccccgcgccggcatccacttcatcctcttcaggcgcggccaaagggcggcctccacaagcggtcgtggcgcggtacctgaatgtgcgggaggagcggtaccacaagcagctgcagacggcagcgatggagtcccagtgggagtacgaggacgagtatgatgactcgctggacgagctcgcgccaggggccggggacggcggctccgaggccgacgccggcagggccagaaacgacgccggccccgagcggggggggcccgcgccgcgctttgcagacggcgcgggtgcacgcggcgggcggggcaatgcgccgccgccgcgccgctgggttctggacggccgcgtgtacaactaccggaaggagggcgccacgccggttgccagcgaggagcacctccgccaggtgctggcgcaggccgctgccggcaggcgggagatccacgggctcggccccggcgggaacaagcccctggccgcgccgaggcccgaccttgcgccgcggatggccgctgccgctgcgagcggcggccaggcggccggacaggagcaggggaggcaggggcctgacggggcgcaagggggccgcggcgggcccggccccaggcggggtgggggcggggacccggcttcggaccgcgatcggaagaagaaggaccagcacaaggcggcggtggggaaccaccaccgcaaggaccgggcggcgcagaagcagaatcggggcatggccgctccctga

SEQ ID NO: 4166 - DNA, 564 bp, Chlorella protothecoides
atgggcgacacgaccccaaagggcaccccccccacccccccgcgctccatcccgctgtcgccgctgggcgaggctgcgcgccagctgcacggcggcaacgagctgtggctggcgctggcgctgacgcacgcggcgctgcaggacctggcccccgagcacctggccggtgcgctggcggcgctggcggcgggcgacgcgctttcccgccctgggctgcgcgtggcctaccccgcagcgcccgccgccgcggcggcgctggaggcgctggagggcgcgcggctggagctggagcgcgcgcaggcgggcgcgggggtggaggtccccgtgaccctggatgcacgcgtggcggggctggcgcaggcctgggcggctggcgcgtcctgggcgcagctggccgccgacagcagcctggacgacggcgacgtggcgcgcctgctcatgaggacggtggacctggcgcggcaggccgcgcactgcgagcagctgctgccggaactgcgtgccgccgccaggaaggtggtgcgggccatggaccgcagccccatctccgacctggtgcactaa

SEQ ID NO: 4167 - DNA, 222 bp, Chlorella protothecoides
atgtctcaagctgtattttcatcccgcaccccttccgtccgcaggctcaacagcaaggacgtgacgctgcgctggagccatcgccagggcgacttcatcgtggagccctccttcaacctgggtactgagagcgccgcgatcactgccaggtacaacctggacctcaacaaccgcgtgaccgcccacctcgacttggtgaggaggggtgtaggagcacgatga

SEQ ID NO: 4168 - DNA, 732 bp, Chlorella protothecoides
atgcccagactgccaccctgccagaatccctccttcaagtgctccgccacccacctgagcgccagagtccgcctgccaacccctcagccaccgctcaccccatcgcagcgtaatcgcgggcacgtgatcaacatgagcagcatcgccgggcacgaggcgtatgtgggcggcagcggctactgcgccaccaagcacgccgtcgacgccatgaccaaggccgcccgccacgacctcaacggcactgacatccgcgtcacctccatcagccccggtatgttgttggcagggctggtttgtggttcccattgttggcaccgggagccccatgtccagaaatcagccacgagcaacttgactgcaggaatggggccccctctggggtctcacctggggcctgcacctgtccagtttgctccacagagagctggctgtgccatgccttcccccgtttaccgccgacaccctcttccatcctcatctagccatcattcaacacccgctctcggacaccctgcccccttgccatccaggcgcggtgcgaacggagttcagcgtggtgcggaccaagggcgacctggccgccgaggccgccgtctacgccggcatcgaccccctgcgcgccgccgacatcgccgacaacgtgctctacgcggcgacgcgcccgccccacgtccaggtggccgacatcgtggtgctggccagctaccagagctcggcacgcaacctggcacg

SEQ ID NO: 4169 - DNA, 2886 bp, Chlorella protothecoides
  modified_base (1535)..(1544): a, c, t, g, unknown or other
atgccgacacccccacatgcacctcctcaccttcaccatgcccgggatgaaggttctacagaaagcaagaacggagagaatgttggtgttgaccatcgtggcgacgtcctccagcaagttttcgtggatggcgttggagcccagagccaggccggcattgttgaccagaatatccactgccttgaagtcctccggcagccgatctggcagggaggtgatggcattgatgctctgtacatccaaggactcaacgtagatgggcacctgggatgcgagggggcaacctacaagtcatcaccgccaacacacgcaaaccttgcattcttgagtcagcttgtctttcaaggcttgaaggcgctccaggcggcgtgcgaccaggatgaggcggcaccctgcctcagcaaagcgccaagcacaggcctccccaatgccagagcttgcccctgcaccccatatgcacgtgtggaagcatatgaaattcccagatcaaaggacttatacagtgcggacgccatgtcgagtccaaggacaaagaatggagagggcttgtctgaggacttgtacagtgcggacgccatatcgactccaaggacaaagaatggagagggctcgtctgaggtgtggatcacgtcaggagatggtgatgggtggcaagagcttgcttcgcgtgctgggacctgttcatgggtttactgtcgctcctgtcctcctactcgccctccgctcgaccttgcgggcaccaccacgggacagcggggcgggtgcctggctgccatgacggtgtcgacgtcctgcacagcactggggcggtccatcaccagccttgcgcggttccagctcgactcagctgcgtgctggagcttgcagcaggtagcgcactacgccaaggcctcgggagggtctggtgggggtggccacgcccagaggacgaatcgcctgctcaaggtcctagagccgcagcagacaaccgcagtggcacgaagtctcgaggagctggaggatgcaaggcagcggtgcgaggggtttgggcttaggctgtgtgtgtcactggcacccaggctgggtgagggccaaggacattgctgtggaccctgccaatcctctgacgcccgcccgttttcgctgccccaggtcacgggagtacagccgtctcaagatgcggcagcactgcgcctggcaggccgacctgtcaggcaagctgaagctgaagcaggccgcgctggcggccctgcccgaccacctgcgggcggcggccgaggtccccgacctctccctcttccccctcaaccgcaacgtgtggagggagaccccccccgcagaggccaaggtggtcaaggccgcggcgcacacctcgcggacgcgcaacatcggcaccaagcgccagggctaggcggcgtggagagcgtagagcaggggctggggcggacagatggtgtgttgctagaggtcacgctcttggcttgcacttgcggggtgagaccctcccgccaggaagggcctcacatcgcagcagcgaggactgcctgcacccaaannnnnnnnnncgatgtgttgctggaggtcacgctctgggcttgcacttgcggggtgagacccgcccgccaggaagggccagtcacctcgcagcagcgaggactgcctgcacccaaaggatctccttggaggccagagctcgctccctctccaccccctctcgaaacaaacaagtccacaacacactcaggtgatgacggtgggcttgtcgcgccccgtcagcgcgggcaggtccgacagctccagcgcggtggcgatgatgcccgccagcacgtcctgcgcgtcgcggtcgaagtcggcgggatcgtcgcggtaggtctccacgtacatgcgaatggtggccccagcgctgccagtgcccgacagccggaagatgatgcgcgagccgtcccggaagacgacgcggatgccctggccctttgccaccgagccgtcgatggggtcggtgtaggcaaagttgtcggccgtctccagcacgcggccgcccagctccgtgccgggctgcacgttgtcgatcacgctctcggtcaggtgcgccatgaccttctctgcacgctcgctctccacgccctcgtagtcgtagcgggagtagaagttgcggccgtaggtgcgccagtgctcggtgaccacgtcgcggacggagaccagcgccgcgccctccccccgcccctcgttcttggtcgccaggatgctgagccaggccagcaccgcccagagcccgtccttctcgcgcacgtggtcggcccccgtgccgaagctctcctcgccacagatggagcactgccccgcgtccatcaggttgccgaagaacttccagcccgtgggcgtctcgtggaagggcaggttcaggcgcttggccaccctgtccagggcgccggaggtgggcatggagcgtgccacgcccttcaggcccgccgagaagtaggggatggcggcctgggcgttggccgcgatcaccgccaccgagtcagagggggtgacgaagaaggagcggcccaggatcatgttgcggtcgccgtcgccgtcggaggcggcgccaaagtcgggggcgtcggtgccgaacagccgctccaccagctcgtgggcgtaggtcaggttggggtcggggtgcccgccgccgaaatcctccttgggcacgcagttgagcagggcgtcgggggaggcgcccagctcgtcgacaaacagccggctggcgtaggcgccagtgacggcatgcaacgcgtcatacacaaagctgaagcgggggttggcgaagaagctgcgcagcttggcaaagtcaaacacctcctgcggaaatgggggggaatggtgagttggggtcgggaggatgggtgggggatgtgtggctgctga

SEQ ID NO: 4170 - DNA, 864 bp, Chlorella protothecoides
atggtggtactgagtcattctacagggctgtcagaccagccgttcactctggaacactgcacaaagggggatgaggagggccggaggcatcgggcggggaaaagctctgcatcctggggccccaggacagcatgcagtggcactcctgcgggtcagggcgggctgggcaccggtgatgcaggcagacacacgaaacgcctgcccatgggcacaggccctggaaaaatcagacccggcgcatcaaaggtagggatcggcagcggtacaggccctcccttggccacccgtcacaagacgcgaccaccgttgcaccttgcgctcgcgcatcggcacacacggacagttccagaagccctgcgccacctcggcggccttgtcatcgtagtgccggcaggggcacaggggggcgccgtagtcggtcttgtgctccgccagccccttgatgaccacagcggtcacagacttgtcagaacagaagtaggtgccggtgctgtgcgtgcaaagggaggaaacgttcccgcagcccgagggtgggcgagccatgccggtggcagaacttccgcatcgcctccaggttcttccccggcttggcatcgctcacctctgtggtggtcgacagtgcgaagggagtgggacactgtgcgccgagcaacagatcatgcaggcttgggcatgtcgctgcatgaggcgcaggggtgctcacctggctccgattgggcggcagcagccctgatgccgtgggtgagaggggccctgcgctgcgagcggaaggcctgcccgaccttcacggggcagggcttcagcgagcaggggctctttgttcctaaactggcgacgttcatgatgcaaaaattcagtctgtag

SEQ ID NO: 4171 - DNA, 510 bp, Chlorella protothecoides
atgcatggtccccggcacaccccgagcgcaggtagccagcctgtggacatccgcttcgccatccctttcaagtgccacttcggccagcatttggcggtgatcgggggacccaggcagctggggcaatgggaggccgctgcggcgctgcccatgacctggcaacagggcgatgtctgggcggcctccctcgcatggtgcgccggctgtatggggcagactgccaggcaggggtttgacgaagcgaacagcttcagccttgggagcgccatgctggtagcaaaccccatgcgggaagttgttgcggatgatggcggtacgctggagtacaagtatgtggtgcggaacgacgacctcacggtggcggggtggaaaccagggccaaactgcgagctgcagctgcccaccggctctccgctccgcgccgtgcgggtgtgggacacctgggacgggggctgccagacggtggaggtgtgctgtgtgcgggtgtgggtggtggtagtggtggggtga

SEQ ID NO: 4172 - DNA, 396 bp, Chlorella protothecoides
atgaacccaaggcggtggtgtgtgcccttgcgccgccgcctgatacccaagtacctgggatcttcacgaaagctcacgctcggacttcttacccccctcgcatcccaggtgcccatctacgttgagtccttggatgtacagagcatcaatgccatcacctccctgccagatcggctgccggaggacttcaaggcagtggatattctggtcaacaatgccggcctggctctgggctccaacgccatccacgaaaacttgctggaggacgtcgccacgatggtcaacaccaacattctctccgttcttgctttctgtagaaccttcatcccgggcatggtgaaggtgaggaggtgcatgtgggggtgtcggcatgctattgaacgtacggaagcctga

SEQ ID NO: 4173 - DNA, 207 bp, Chlorella protothecoides
atggcgtccgcactgtataagtcctacagcgttcgcgatcagacggtgctgatctcgggggcaagctctggcattggggaggcctgtgcttggcgctttgctgaggcagggtgccgcctcatcctggtcgcacgccgcctggagcgccttcaagccttgaaagacaagctgactcaagaatgcaaggtttgcgtgtgttggcggtga

SEQ ID NO: 4174 - DNA, 330 bp, Chlorella protothecoides
atgctggagggatttaactgcaccatctttgcctacgggcagacgggcacgggcaagacctacaccatgaccgggggtgatctggcgcagggctcggccgagatgaccgactcggcaggcgtcatcccacgtgccatccaccaggttttctcctacctggagtccctgggggcccaggaattcacggtcaaggcctcctacctggagctgtacaacgaggaggtcaccgacctgctggccctgggcagcgagccgcccaaggtggaaaagaaaggggggggaggagggactggggtgatggcgcacataggtctgctctatggagtgtag

SEQ ID NO: 4175 - DNA, 630 bp, Chlorella protothecoides
atgttgcgcctgtcctccctcgtgccccgtgccactcgctgcgcagcccatcccttgaccctccaagaatcaatcctcgccccgtcgcaggtgggcctggtgccggagatgcgggccttcgcggcgcggagccgcgcggcgctggcggtgtccctgcacgccaccaccgacgaggtccgcaactggctggtgcccatcaaccgccggcacccgctgcgcgagctggtggctgcactggaggagctgttccctgcagaggcgcagcgcgccggccgccacgtgctcgtgcagtacgtgctcctgcgcggggtaaacgacggcgaggcggacgcccaccgcctcgccgacctgctcgcccgcgtgcgctgcaaggtcaacctgatcggcttcaacccgcacccaggcacgcgctttgcgcccagcggggagcgggccacgcaggccttcctcgccgtcctgcggcagaggggttgtgtggtgatgctccgcgcctcgcgcggcggggaggaaatggcggcatgtgggcagctgggggggctggcgggcgggcgcggcgcgggggacggggcgctgccgcgcatcctcccgccgccgcgccgcttcgaggaggtgctggcggctcggagctga

SEQ ID NO: 4176 - DNA, 447 bp, Chlorella protothecoides
atgccgtccagcgagtccgacagtcaaccctcgggctccgcggcgcagggcaagaaggagtccaaatggcacaagcggttcgtccagcagcggctccggggctggtctcccatcctgcatgcccggaacgcggaactttacttcctggccgttggggtgttttgcctggccctgggcatacccatcctagtggcctccctgaacgtcgtggagtacaaggcccgctacgatctggctggtgtcttcgccgacctggactccaacaaccagcaggagctgctgtggggtgcgggcgacgagggcgtgctggtgatggtggagatcgaggtaaccaagcgcatgaccgccccggtgagaggcagggctggcattgcgtggtctggcgagggaggcacactaaagatgcagcgtgaagccatccctgctgccatggcgcagtcccactga

SEQ ID NO: 4177 - DNA, 258 bp, Chlorella protothecoides
atggccagcaggaaggcgacgccccgggccggcccgggtgccggaggccctgctggatccgaagatggagtcaacatccaggtcatactgcggtgccggccccctaccaaggaggaggttgccggcagggcgccgcaggtcgtcaagtgcaacgaggccctgcgggaaatcaccctgaaccagacgctgggagggaagcaactgggtcggacgtaccacttcgaccgggtgagcttactcgaggatgggaatggctga

SEQ ID NO: 4178 - DNA, 420 bp, Chlorella protothecoides
atgatcgtcacggtgctggtgtacaaccggtacaacacgtatggcttccagggcgccaagagcctcatcctgaccaccaacagctgggtggggggaaagaacgtcttcctgggcagtgtctacattgtcatcggcggcctcgcctggctggctgcagcaagcctgttcatcacctacaacctgggtgtgtttgggctggaaagaaggagggaagggggtcccaggctgaggcatgggacatgcgcaaggatccccttcccccaacccaacccaatcaggcctgttctggaagagggggtacggcgatctgtccctcctgtcctgggaggtgaatgggaagggggcgaggccgacggcgcggaccggctcagctcccccaggtacaccctctcaggtgggatcccatggcggggggcatga

SEQ ID NO: 4179 - DNA, 1014 bp, Chlorella protothecoides
  modified_base (736)..(745): a, c, t, g, unknown or other
atgcgcggccttagggcggcgacgctggcgctgcccccctacatggggatgaaccccaccgtcaacgtgagctacctgaagccctaccacggagacagcgatcatcgcccaccgccggtcttcatcaatgacagcggcgcgcccgcctaccttgtggaggccatcctccggcacaagcgcgtcggccgcggctaccagtacctggtgaagtggcagggctaccctgacgacgaggccacctgggagccccgcgccaacctggcgcacctcgacgcctacaaagcctacagggcagcgcaggccgagggcgtgcctgcgaatcgggcgggggaggatgttggtctaacccgcccccacaacagggtttgttgtgggggctggctagactccacgacacggcggcgtggacatggcacagggcacaaacgcaggtggaaagggtggaaggctccggtgagggtgcccccacaaaccctcaccagtctgtactgtaggcctaccaaaggcctgcgctgccctgtaggctttgtaggcgtcgaggtgcgccaggttggcgcggggctcccaggtggcctcgtcgtcagggtagccctgccacttcaccaggtactggtagccgcggccgacgcgcttgtgccggaggatggcctcgacgaggtaggcaggcacgccgctgtcgtcgttgaaaacagggggtgggcgatggtcattgtcgccgtggtagggcttgaggttnnnnnnnnnntgacggtggggttcatccccatggagggggcaagggccagcgtcgcagccccagtgctgcgcatggcggtgatggtaaaggggcccacaaagggggccgccagtttgcggccgttgagcgccacaagtttgacgtgcgcgctgctcagcaagacgggatcgccagccttaaaggtgtgggcctggctcgtccggttggcctgcgaggccatgcgggcgttgttgttgtgggggcgggctggcccccacaacgtggactgctgtatatga

SEQ ID NO: 4180 - DNA, 2139 bp, Chlorella protothecoides
  modified_base (1158)..(1167): a, c, t, g, unknown or other
  modified_base (1722)..(1731): a, c, t, g, unknown or other
atggtgtgtgcttctgtacggaaaagcctttgcattgagcatcgcaagcccccagcttggaatgtcaacccggcgcagcgctgcaggcccgccagcccgagtactgacccccacacccatgcaggtcggcgcgtgttgcgggcaaccctgcagtggtgtacaacgagagcgacctggcaagggcagggttggccgaggaggagcgtaccaagcacgaccggcgcctgctcaaaggtgccaccctcattgtgtttggtcgaggctctggacaggcagtgtcctatggcagttcttagacttcacaacgacgctgtaccggcatcatctccttttggctgtatttcagagcacctgagacgacacctgagacgagtcagtgcctccatgctaaacacaccttccgccggtcttcacgagcccattcaccccactgtcccagaaaacatccgagaggaagtgtacggcgtccagcacctcaccgctctgggcaatcacaccaaggagtggaagcatcagccctgctcttgtccgcataaatccctgtcttgctgcgctaaccagtcttccgcccaccaccattggtcccaggaccctgttcgaggatgggtacgacaagagcggcaaccgcatctacgacaaggtgtcgggtcagacgtgccaccagtgccgccagaagaccctggggctgcgaacccattgctcagagtgccagtccctccacgtgagcaggccggctgcgttggctgccatttagtgttgcccaggcaccacaatgtgtgtagtgactcccatgcagcaccacatcacagccccgtgcttcacatgcacggcgcgctcaccacaccattctgccccctttccaccatgcagggggtgttctgcggcgactgcctcttcatgcggtacggcgagaacgtggaggaggcgctgcaggatagcgagtggaagtgccccggctgccgcgacctctgcaactgctccttccaccgctcgcggcggggctgggcgccgacgggcacgctctaccgccgtgccgtcgccgaaggtggggcggcagaggtgttctatgcggcctgtgccggcaggggggatctcctctggtcgagcggcatgtggctcgcgcactgcgcgtgcacaacctcccccccctcccacctnnnnnnnnnngggcggcagaggtgttctatgcggcctgtgatggcagggtggatctcctctggtcgagcggcgtgtggctcgcgcactacccgtgcacaacctccccccctcccacccgcaggctttgtgtcggtggcgcactacctggtcctcaacaatctggccccggaggcgaggagcgcggccctgcccctgatgcccaaggagctggccgacgccacgcgcgccgagctagaaagggaggcggcggggtgcgatcgcaggtccgcctcgcccgccggccccgccacgccctgcgcgtctggcgaggcggcgcaggaccgggccgcccagcgtccgcaggcgccgggtgaggaggaggcgagcgccagcccctccccagctcgcccgagcggtgaagaggcgggggaggccccgaccggccggcggcgcggcgcgcgccggcagagcacgctgcggagcgatgtgctgggtgcggtcgtgaagaccggcggcatgattgcggcgggcaagcccggcgcgggcaagagagcgggggccactgggaaggccgcgccggccgcnnnnnnnnnncatgattgcggcgggcaagcccggcgcggggaagagagcggggggcaccgggaaggccgcgccggccgtcgagcgcgtcggccgcggtctgcgcaccagctccaggctcgtcgcgggccgagcctgagtctgggcgcagaatcaggacgggcagcccagtgcgtgctgcgtcttgccatcgccatgggcggtcgtaccctctgccaaagcctggtgcatcctggcatccgcccccggaggcagtcaggcatgtgctttggtggacccagcagccagagggcgcccccccctaccaaagcaagcactcggcagcctgcgcccaggccagagccccagcaccgtccggctccacaccccgagaataccacccgacccccacccctcagtgctcctccattgaccgactga

SEQ ID NO: 4181 - DNA, 771 bp, Chlorella protothecoides
atgcatgtccgctggcctccagcggagagcgcaccagtcatcgaacggccagccctgggtaccggcggcgccaggttttgcaaggccaagcccagcaatgcatcttgtgtccaaaaataccctcgtaccttccctccacaggcccgtgtgaacattccggatgagcgcttcacctggctggtggacctgtacaagcccaaggccaccttccccgctttcctggagatcgtggacatcgcggggctggtcaagggagcggcgcagggcgagggcctgggcaacgctttcctgtcgcacatcatggtgagggaggatgtgggtttcctccgcttcagtgacggcgacggcggctggggggaaagcagggcgggaccagggggctatgcagtggcatgtgtgccgacatcagccctcccctcccaacgcgtggttggatcagcctgtcccctgggctctggcccaaaaatccccccacggcaccctcccaggccgtcgacggcatcttccatgtgtgccgcgcctttgatgacgcggacgttgtgcatgtggaagaccgcgtggaccccgtggagggtgagcgggcatggcaattggtgtgggatcccaagtatgcatgcctgccaggtcatgcagcagcagccggcgccttggaccccgccgggtgcggatgggtatcgcgatgccgtagccacctttctcccactcccgcagaccttgagatcgtgcacagcgagctgcgtgccaaggacattgagcgtatccagggcgtga

SEQ ID NO: 4182 - DNA, 1332 bp, Chlorella protothecoides
  modified_base (655)..(664): a, c, t, g, unknown or other
  modified_base (802)..(811): a, c, t, g, unknown or other
  modified_base (1229)..(1238): a, c, t, g, unknown or other
atgtacgagggttgcttgtttggcgaggagattcggggtccctttgcgaaggctgggtgcctgctgcaggagcctgagcttgcaagagaagatgcattgcccatgctccgacggacagcccggctcttggcgggtgatcaagactgcagcactgccctctctcatcataccccataccaatttcatcccctttccaggggcctgaccaaggagcagaaggaggagatggcggccgccgagaaggtgctggcctgggtgcaggagggcaaggacatccgcagcggcgactggacggcaatcgaggtggagttcctgaacaaccaccagttcatctcggccaagcccgtgatctacctagtgaacctgtcggagaaggactacatccgcaagaagaacaagtggctgcccaagctgtttgagtggatccaggcgcacggcggtgcgcagctcatccccttctctggcgccctggaggccaagctgttcgacatgcccgatgacgagaaggaggcctactgcaaggaggtgcgtcgattgggaaggggaggggagattgcgagggaaggtgactcaccatgcatcggagatacgtttgggtttgtgcaaaggcgacccctatgtggcgccccagctgcacgaccctcggcagcaccgnnnnnnnnnngtgggtttgtgcaaaggggacccatacgtggtgccccagctgcacgaccctcggcagcaccgccccctgatgcaaccccggctcctgccttcctgccttcccttgcctcatccccccccccccccccccccccccccnnnnnnnnnntgcacagcatgggtgcacctcggccctgcccaagatcatcgtcgctggcttcaaggcggttcacctcatctacttcttcacgtgtggccccggcgaggtgcgatgctggcaaatcaggaagaactccaaggcgccgcaggctggaaacgcacaagctggatgacgggtgtgctgcgcgcgctgcgctgcggggtgtctggagcacagcgcgtggcccggctgcaggtcgaaggcacacagggacgttgcaaacgcacaagctcgatgacgggtgtgatgcgtgcgctgcgctgcggggtgactggagcgtagcgcgcggcccgccttcaggtcgaaggcacacaggggcgggaggcaaggtcggctcaccagagcatgatcttcttcagagcctcaaccctgcataccctcgacctgnnnnnnnnnncacactgaagcagtcccccacgtgtcaaaccccccacactcacaaacacctccccgacaccacaggcggcgggagcaatccacagcgactttga

SEQ ID NO: 4183 - DNA, 501 bp, Chlorella protothecoides
atgaatatgtctgcttggcggactcggcctgcacgcatgcacgtccccaggccgacgcacttcctcgccctcccactaaaccatgtgcctggcctgcaagccgctgtgagggcaatccagaccgacctggtcggctgtgtgccgtcactggcgcccacccttgtcgatcctgccagtttgcacatcacgcttggagtgctgagtctccagggagaagaggcctgcagggaggtagccgatgttgcccatgccgtcctgcacgccgcaacgcctccagccccgtccatcaccctgacagggctgagtgatttcaaccaccgggtgcgcagctggggtgcacatttcgggcggcaggcggagcctggtcaggctggcagacttgctggagcaagggcttgtgcagcggggcctgatgcagccatctcggcggcccttcactcctcatctcaccctggccaaggtgccaccagcatcgccccgattgaggcaggcacagggtga

SEQ ID NO: 4184 - DNA, 717 bp, Chlorella protothecoides
  modified_base (103)..(112): a, c, t, g, unknown or other
atgtctgcgcggcggtaccgcggcgtagccaatgacccgaagaatgtgggcagaaacacaagtgccccaaaggtggacttcaatccacgccctccgccatggnnnnnnnnnngaacgggagtcgttgcgtccaaatccatcacaagtgcgatctgcactctccgaccgtgcattgttcacgtcggcatttatcgaccgaagtccggtattgatttcttgcaagggcagaaacacaagtgccctaagagtggacttcaatccacgccctccgccatggctgattcagatgtggatgaatatcaaaaacgttgggaggcaagctggaatgcaggtctcaagcccggcgaggtgagcgtgtgcgactcatgcctgcaccacccgctttgctccctgtgctgtggtctggatctcatgcgatgctgcacagtgcgaccccccccctctttcgatcaatacttcgcaccacagagattcgatgcatgtcaatcatcgcctgcactactcgacctgctgaaaaggggaaccgtggctgtggaggggaagagggtcttcgtgccgggctgtggcagagggtacgaccccgtgaccttcatcaaggctggcgccaaggaggccatcggcctggagcttgccccttcggcagtgagtgactcgagggtgcagtgtgagccgtgtgcagtgttggccgagtgcgcggttgatgcggaaacacactga

SEQ ID NO: 4185 - DNA, 735 bp, Chlorella protothecoides
atgtggcagcaccacaggcagctgctggaggccggcccagcgggcgccgaggcgcttgcggcccggctcatggccggcaggccaggcccaggcggcctgttgccccgacagggccgcagacgtggcgcaggaacctgcacggaccagcaccacccgctgccggcggggctggggcccggggccccggcggcgggttcgagcaggcggcctgttgtcgtgcccgggacaaacctcttcctggcgctggacgccgaccaggacaggcttgccctcctcgtggatctggtgctggacctgcggacggcgacgggcgaggactgtggcgctgcgccaggcgccacagcggccaggctgggcatgctggccttgcccgtgccgccctgcaagcgcgacaaggcgggcctgctccggcgcctccccgccgtcctggacgcggtctgccccgcgctgcggggcgggcgacgcgtgggcatgctgggcgacgccggcggcgacgcgctcgccggcgcggccgtcgccgtcctggcggcgctctactccatcgacgccgccggcgggctccgtccgagggagggcgggccgggcaccgggacccccgccgtcagcaagacggatgtgcagaggtacctgggcgtcgtggcggcggccagccccgccgcccgcccgaccaggggcatgctgaagcaggtgtttgcctactttcatgctgagcaggcgcgggcggcggcgggctga

SEQ ID NO: 4186 - DNA, 273 bp, Chlorella protothecoides
atgctcgcaatcagcaaggccttctcccgggcgttgggcgggcgagggatcgaaactctgggggtacgtgcctatgccaaggcactcggcgatcagagcaccctccccctgtccaccggtcggccccggttagtcatcctgggcaccgggtggggcggggcgcgtctggcccgcgacatcgatcccaagaagtttgacatcacggtgattgacgtggagacgggggatctgggtgatccaggggccccctgcgctgagggaatgtgggcataa

SEQ ID NO: 4187 - DNA, 603 bp, Chlorella protothecoides
atgatccaggaggagcgtgcggcggcggggcagcccacgggccgccccatcccctgtatctttgggctgggggacgtggcggccacgcaggagacgccactgcccgcgctggcccaggtggcggagcagcaggggcggtacctggcccgcgcgctgaacgaggcggcggggcagccgggcggactggcgggcgggctggagggcgcgccgcccttccagtaccaccacctgggcagcatggccagcgtggggggcaccagcgccgtcatcgagctgggcgggagcgggcagcaacatgtgcgctggagcgggttcacctcctggatcgcgtggcgctccgcctacctcacccgcctgggcaccatgaagcaccgcctgtacgtcatgagcgactggaccatgtccctcatcttcggacgggcggggagtcgcgctagtatggtgggtgggtggatcagtgttgccggcacgcagtcgacagtacgggatggcaggcgtcaaggtgcggcccctgcgctgctcgagcccggatacctggcttgcaacccaaaccttgccggcccacgatcgctgcagggatgtgtccaagtggtgagcgtttga

SEQ ID NO: 4188 - DNA, 300 bp, Chlorella protothecoides
atgcaatccacaggttccgggctcaccgggtaccttgccctcacaggcgccctttcgggggccgtggaggccctcaccgccgccccgctcctgctgtaccccgccaaggcgctgatcgcctggcccctgctgtaccactacggcggcggcgtgcgccacctgtactgggacgagtacaagtacggcatccaggtggacaagacctcgccgctggaggtccccgccgtgacggccagcagcaggggcctgctgtacggcagcatcgcggcgtcggtgctgctggccgcagtcagcctctga

SEQ ID NO: 4189 - DNA, 1101 bp, Chlorella protothecoides
  modified_base (480)..(489): a, c, t, g, unknown or other
  modified_base (682)..(691): a, c, t, g, unknown or other
atggtgggacggggcttgcgtgcgcggagcagcgtcaactactcggacaaggcgccagacgtgggtaacaccccggcatggctgaggacgaccaagtccttcacctccccggaatctgccggctcggataaggagaacgccaaagacctgaattcggcagcgccagctgtcgtggccaagaccaaggcagctcgggggcgtcccagcgggctgagcaagaaagccctcgctgcaacctcccccaaggatgggcccccctccgatgctgctgcccgggtagacctcgtcacccaggatgttgacggccctgacgcaaagcaggatgtcaagcggtcacgtcccaagagcgccggcgcgcccctggcacccgtcgaggcaacaaaggccggccaggacaccacagtttcacccaccgacctcacagccgatgtgcccgaggaccctccaagagccagccaggagcctgcaaggaccaaggcnnnnnnnnnnaaggccggccaggacaccacagtttcacccgccgaccttacagtcgacgtgcccgaggaccctccaagatccatccaggagcctgcaaggaccaaggtgattgccatttcggagcctcccacccagccagacccggctccccggagctcggccccggcgccacccccgccggggcccagcggggactctgatnnnnnnnnnnagccagacccggctccccggagctcggcccgggcgccacccccgccgagccccggcggggactctgacctgctccaggacctgcgccggggcgtcacgctgcaggcggagtacgacgccctgcagcggcagtatgaggagctgaaggaggccaagatcaacgaggaggtgcaggccctgctggagcggcacaaccagcatgtgtcggaggtggagagggcggcggagggcctggtggccaggtggcaggatcgcgcagaggccatgcgcgcgctggccgacgaggcgctggcggccgacgcggtcggcgccctgcaggcagagctggccgaggcgcaggaccagctggcggaggcccgcctcgcgctgctggagcgagagaaggagctggtcgccctgagggccaggtag

SEQ ID NO: 4190 - DNA, 2001 bp, Chlorella protothecoides
  modified_base (425)..(434): a, c, t, g, unknown or other
  modified_base (729)..(738): a, c, t, g, unknown or other
atgggaggtggggcaggtggggtccacgacgaccaggggcaagccctcatcccccgccgaggagaggcccgggtcgatgggaaagcggaagatgtgcggcaggccaaactcctccacaatcttctcccctgtgatttgggggtggaaggggggagtgtggaggagtccaccgaaagcgtcgccccattatgtgggagctcaaaatgtgagccagaagctgcagcgccaggccttcaagcgctacgctcctgctctcccacctgcgccctggccaaagggacggtgccggacgccgtccacctcgaagtaggacatgttttccaccacagccacgcagggcacctgtcatcgtgtatcacttccacgcagccacacgcacacacagctggcattgacgcttcactcaccgcgagccgcgcaaacannnnnnnnnnggccacacgcacacacagctgtcatccacgcttcactcaccgcgagccgcgcaaacatgcgtatgcccttggcgacatcgatgaaggccaggcgctggggtgtggtaacgatgacagcggccgacagcgcacaggtctgacacagggtgagctgaatgtcgcccgtcccgggcgggaagtcgatgacgaggtaatccaggtcgccccactctgtggtcgtcagcagctgttggatgagacctggaaaggatgccatggtgtgcgagggaagggtgatcttccctggccatgccannnnnnnnnnccctggaaaggatggcgtggtgtgcaagggaagggtgatcttccctggccatgccaagactctcccaagcaatcggagcggggcagagctccgagaatcgcagcaccaattgttcctcagagggatgagcccaacaacaagaagtgcaaccttcccacccctgccacaagtgtttttgcggctggtaaggggcaggagctgctccaggacggccagggcatcggtggacgaacagagaacttgatgctgggcgatgggctggcagcatcagccgccctctccgcccctctccagcactggagtgtttttgcggctggtaaggggcaggatcagctccaggacggccagggcagcggtggacgaacagagaacttgatgctgggcgataggctcacagcatcagccgccctctccgccctctccagcaccagtgcaatggcagccctctactcgcctttgtctccgggtccatggcaagcaccctggactctggggagatcatggtgggcaggcttgggccggcggccacgcacggggcaaagcagcgaagcagcagctgcggcaagcaagggtcccatggggagcagaggccacacagcgccatgcccaggacaccgtcgacccctgcacccacctcccttgcaggacgacacagcgatgatgtggcgcacaccgcgcaggcccccaggcttcccggccgcctcggccccctggcccgggacctgcgctgggggcgaggcggtgatggccacctcggcggtcctgacccagtccagcgcccggacggcctcctccgcctgccgcttgaactcgtccttcacagggcaggccggcgtggtgaggttcaggcgcaggctgaccgcgccgctggccaggtcgatggccaggtcgtggacgaagccgcagtccacgatgttcttgccaaggtcggggtccatgatgacagacagggcctgcagcaccccctcctccgcggagccatgggtcagcggggggctggaggggcgatctacctgggagtggggtgcggggcggggagctcagggcaagggggaagcatggggcggatcggggcctgagccaggccatgctgggtcgctggtcccggcgtgctcccggtcatgcaagccgaggcatgggccgggaagtgatacctgcgagacctcttctgacgccatagacatgcgagcgacgcccggcttgccatcgtgcctccgtgacgagaatgtcggtgcgggggcagccctgcgaggcgcaggttga

SEQ ID NO: 4191 - DNA, 504 bp, Chlorella protothecoides
  modified_base (339)..(348): a, c, t, g, unknown or other
atgggtacacgctggttctctcttggagaccagacttgctggggaccctccttccaggcagtcttgcagctgggtttcaaggtaggcgtagaaggtggatggaacccccagttcttccctcgactggaaggcatcatggccatcttctctcgtccggacacagcactctctgtgtggcttcatgtcctcgccaccagtctcttctcagcccagaatctttgtagacaaggtgagaacggtgctcacggcttcctccagggctatgaccaaggcatcctctgtgggacaatgcgttcatgcgcagagtattgtgcagccggcacacaagaaaattcctcnnnnnnnnnngtcctccagggctatgaccaaggcatactctgtgggacaatgcactcatgcgcagagtgttgtgcagccggcacacaagaaaattcctctccttgttcccttcacgctgcagtcttggttcaaccaccagccccaggagttaatcctccaagctga

SEQ ID NO: 4192 - DNA, 1035 bp, Chlorella protothecoides
  modified_base (625)..(634): a, c, t, g, unknown or other
atgtcctcgcctgactgcgctcactcagcttccatcaccaccatgcccctccccttccccctccacctcgcaaggtatgggaccgggctgtccttgggcagcggcgtcacgctcggacacctccgggagtcgcggcctgggaagtttgggacctggttccgggcgcaggcgaactccgcggaccctgatgtggacgccgccgcggcggggaagggggcggaggtgttctttgccctgaatgcgtccgccgtggagctgccagacatcgagcggtatgccaccgacagcctggatgccagcaagcccctgatcacgtggaacctggcgctggacaccctccgcgcagacctggggaggcttgctgctggggatgcgcagtgcagcgctttcaatgacatgccacccagcctgaatgtcatgcacactgacacccgctccctgcctacccctgcagggctcctggggttcccatcaaaagccttgcatgaccgcttcctctcctttttcaagcctgtgctctatgtccgcccccgggattactccaagcattgtggtgatgcactgatgaatgcagcgatgcgtcttcaactgacaacactcttccactttcctctcgccccctccnnnnnnnnnntccccgagattactccaagcgatgcgtcttcaactgacgacactcttccactttcctctcgccccctccccacagagcactgcctcgcctccatacatctccaactacagcggaatcctgttccgggagttcccgggggagtggaaggtcatgctgcagcaaccaaatggctcttacactgtcgtggaaggtgtgtgtccagttgctgggttcagtggagctgcactctgtcgacatatgttagccgacccactcggtacaccctgggagagttcaaggatgtgttgatgcgggcggccgggctcgacactgacgcccaggggtccctgctgtccttccttcgcaaaggatacaaggtgggatcagggcacgacgggaaaggttcatatgtattggattga

SEQ ID NO: 4193 - DNA, 1236 bp, Chlorella protothecoides
  modified_base (431)..(440): a, c, t, g, unknown or other
atgagggttgcgctgcgtccggcagtgggcatgcttcatcgggctcctggcaccaaaggaatgtgtggtgggatctgtaacctgggggcctctcgactgtgcatcttccccgaccaacccacgcaggagcacggcgtggattacgtcgtgctggcggggtacctgaagctcatccccccccagctggtgcgggccttcccccgggccatgctgaacatccacccgggcctccttcccgcctttggcggcagcggcctgtatgggcttcgagtccactccgccgtgatcgcgtctggggcccgcctctccggccccaccgtgcactttgtggacgagggctacgacactggtgcgtgctttctttctcttcctgttgggaaggtggggctactgaacgcctgggttggttttacgaggcccgggtcccccgnnnnnnnnnntggacgagggctacgacactggtgcgtgctctctttctcttcctgttgggaagggggggctactgaacgccggggttggttttacgaggccccagttccccaatggtgctgcggcacacgcgaggagggtcgtggcactgcatgcctcgagctggcggcacggctccccccacccctcctcattcccctcatccccttccccaggtcccatccttgcgcaagtcagcgttgccgtatcccccctggacagcccccagcagctggcggcacgagtgctggccgaggtatgtatttggcggctggtgtggaaagcgtgcctggctcgcatggatatgagaaggagcccgtgaacagacatgcatgcacacctgcacaaccaaacacccacctgctcgaccccacaggagcacaagctgtaccctcgctgcgtagcagccctctgcgagggcaggatctcctggagggaggatggcatccccatcatgtggaccgctgcctgagggggggcttaaactgtcggacacagcttctgaaccagattccagctctgcctcatgtgggcagcaagcttgatgcggataggagggatgtgaatccaggagctcagataggatcctgcggccggaaaggaaatccgctccacagggctcgacagggcaccctatcactctctccaggcgggcgagagctccttgtcctccctctcctcccaccaagtcttggtctgcggaatgagcatgcggcacgtgtgagggtgcacgcatgtacatcatgcaactcgatccaacacatatga

SEQ ID NO: 4194 - DNA, 834 bp, Chlorella protothecoides
  modified_base (597)..(606): a, c, t, g, unknown or other
  modified_base (727)..(736): a, c, t, g, unknown or other
atgatcacgccgacgggccatcaccccgagcgacccgggatatcgatgtcttgcagaattggaaagacatattgctgcctgcagctaccatcagggccatgcaagcgttgcagtgccattccaatggcgctcggaaggcggccaggagcatcatgtttaaggaggagggatccaactggcagaccgtccttccctccattccgcgcctccagtgccgagcgcgagaactcgaggcctgtggcgcccaagtatgtggctggggagggcgaattccctagcagcagcaatgagcagcacggagacgaggaggcccccgagatacagctgctcctggcagcctgcggggtcggactggcagccggcgccagcattgttggcttcaacctgtgcatccacgccgtgcagagcctgatcagccacgagttcctgggcaacgcggagccctggattcttttagttttgccccccgctctgggtggtgtcgcggtggggctgctgggcgtcgcagtgggggggtacgatgacccccccacgccggggtcaaaggaggctcttcccgggccccaaggggagccagaggagcaggcagcaagtgtnnnnnnnnnnttggcgcccagatatgtggctggggagggcgaattccccagcagcagcaatgagcaacacggagacgaggaggcccctgagatacagctcctcctggcagcctgcggggtcggactggcannnnnnnnnnccagcagtctcccatggcaccatgctgcttgtcaacatgttgtgtggtgccgacatcagcctggagtgcagccagctgggtggaatcattcgttgtga

SEQ ID NO: 4195 - DNA, 1551 bp, Chlorella protothecoides
  modified_base (18)..(27): a, c, t, g, unknown or other
  modified_base (1372)..(1381): a, c, t, g, unknown or other
atggggcgcacgttggcnnnnnnnnnnccaggctggcgtcttccaggcctgggccaagggcgtgcgtctgctcgtccccggcgccggggcggggggcctgcacgcgctgctggccgcgggggcgggggcgggcgtggccgcgggcttcaacgcccccctctccggcgtgctcttcgcgctggagagcgtgctgcagccaggccagggcgagcagaaagcgcgcccggcgcccagcctgaccctggccatggtgctgctggcagccgcgctggcggcagccgtgtcccaggcggggctgggctcctccccggccttccgagtgccggcctaccggtgagtgggtggggggtgtggaaggccgtggttgtaatgccgcgtgcaaggctgagcagctgcctctgcgctgcgcgctgcacagccccaccttgttctcaagcaaatgcagtgcagtcgctgacccaacgatccacgcccattccctccgtgcttccccctccccagactggagtcgtacgccgagctgcccctcttcctcgcgctgggcacgctgtgcggcctggtggccacctccttcacgtactccgtcggcgtggcagaggacgctttcaaggacctgacgccgggggggcagggggagggcgaccccagcggcgacgcagacggcggccgccaatccatcggggcctgcgcctggcgtgccctcatgccggcggtcggcggcctcacgacgggggtgctgagcttgggccaccccgagatcctgtaccacggcttcgacaacgtgaacgccatcctctccgtctccagccgcctgtcggcctgggacctgtcggagctggtggtgctcaagatcatcgccacctccatgagccgcggcagcggtctgcaggtaccgctggggtgtgggtggggagggggctcggccatgctgtgttcggccgcgctgagcttcgtaggctgaataggaagtgtctgacagcagtgttgtggcacatgggatggtgtcctgggggcggctcacagcacatctgtggattaaaaggcaagggtccgcctgggacccggcccagcgcctccccagaactcgatcactccgcctcctcccgccatccaagtaaatgtctcctccactccctcaagggcgggctgtacgcgccctccatcttcatcggcgcggcgctgggctcggcctacggcctggcgctgcagggcacgctgggcacgctgggcgtcccgctgtcagcgcccgaggcctacgcgctggtgggcgtggcggcggtgctggcctccgcctgcggcgtcccgctcaccgccgcgctgctggtcttcgagctgacgcgtgattacctcatcctgctgcccacgctgggcnnnnnnnnnnagcgtcccactcaccgcagcgctgctggtgttcgagctgacgcgcgattacctcatcctgctgcccacgctgggcgcggtggggctcagcttctgggtgggcgcgcgcacggagccgggcgtgcggcgcgcgggccgcgcgcggacggagcggcggcggcgcgagcgcgg

SEQ ID NO: 4196 - DNA, 192 bp, Chlorella protothecoides
atgtcgacccttgatcggtgtcccgagtacatctacatgctggcaggattcaaggacagtgcggatcaattcctggatgccaacatccaactcgccattgcggccggcagggtgattcacaaggagacagggaagaaggtccatctcctgctgccggatggcaccgagtaccggcgagccatggggctgtga

SEQ ID NO: 4197 - DNA, 591 bp, Chlorella protothecoides
atgaccgggagcacgccgggaccagcgacccagcatggcctggctcaggccccgatccgccccatgcttcccccttgccctgagctccccgccccgcaccccactcccagccccccgctgacccatggctccgcggaggagggggtgctgcaggccctgtctgtcatcatggaccccgaccttggcaagaacatcgtggactgcggcttcgtccacgacctggccatcgacctggccagcggcgcggtcagcctgcgcctgaacctcaccacgccggcctgccctgtgaaggacgagttcaagcggcaggcggaggaggccgtccgggcgctggactgggtcaggaccgccgaggtggccatcaccgcctcgcccccagcgcaggtcccgggccagggggccgaggcggccgggaagcctgggggcctgcgcggtgtgcgccacatcatcgctgtgtcgtcctgcaagggaggtgggtgcaggggtcgacggtgtcctgggcatggcgctgtgtggcctctgctccccatgggacccttgcttgccgcagctgctgcttcgctgctttgccccgtgcgtggccgcccttaa

SEQ ID NO: 4198 - DNA, 318 bp, Chlorella protothecoides
atggcatcctttccaggtctcatccaacagctgctgacgaccacagagtggggcgacctggattacctcgtcatcgacttcccgcccgggacgggcgacattcagctcaccctgtgtcagacctgtgcgctgtcggccgctgtcatcgttaccacaccccagcgcctggccttcatcgatgtcgccaagggcatacgcatgtttgcgcggctcgcggtgccctgcgtggctgtggtggaaaacatgtcctacttcgaggtggacggcgtccggcaccgtccctttggccagggcgcaggtgggagagcaggagcgtag

SEQ ID NO: 4199 - DNA, 663 bp, Chlorella protothecoides
atgccgctgcgtgagtacacaaaggagccgcacaagaccaacaaggatgccgactcgctgccagggagcgcgcaggtgcgaactttgatccactgcatcggggccacggaatgctcgtccatgctgtgcatggcggggccggctgaacgctcacatgcgaaagagcctgcacaatcaccaagcgatgcatgcacagggatgagtcggtgtgcggcagcctgggccggctgcgtggcgcaccggcctggtgtctgcgcctcgacagcaagtgcacatgcgggggtccggatcgcggcatcgcgacgaatacggcttcattgtgcgaagcagccaccgtattctcgtagaccccggcacctccattccctgacagccagcgtggttggcgcgcagcaggtccggggcgccccggcagtggcgccagccaacctggccgttttcgtctccggcgggggctccaacttccgagccatccaggaggcgtgcgcagcgggtgccatcaagggtcgggtggcggtggtggtgaccaacgcccctcaatgcggtggagcgcagtacgccgagcgtctgggcatccctgtgctcgtatacccctcgtccaagtctgcgaagggatgcacccctgatgagctggtggctgcccttagagaggtaggggcatga

SEQ ID NO: 4200 - DNA, 798 bp, Chlorella protothecoides
gggcgccgagcgcatggtcggcagggccggcggcaggcccgcgtccgagctcgaccccgcctcgccgggcgcgggtccggagggtggcgaccccgcctcctctggcccggccgcctcgggccccggctccgaacccccccctgcctcgccaccgggcttccgccccggtcgccctttcctggggcgcgccagcgcggcggagtgccgcagcgtggacctgtacgagaagctgaaccacatcagcgaggggacctatggcgtggtgtaccgagcgcgcaacagcgagacgggcgagatctgcgcgctgaagcgcgtgaagctggacaaggagcgcgacggcttcccgctgaccgcgctgcgggagatcaacatcctgctgtccctgcgccaccccaacatcgtcaacgtgtcggaggtggtggtggggtccagcctggactcggtgttcatggtcatggagtacggcgaccacgacctggcgggggtcatgcgccggcgcctgcgccagcccttctcccccgccgaggccaagacgctgatgaccgcgctgctggcgggcgtggcctacctgcacgacaactgggtgctgcaccgcgacctcaagacctccaacatcctgtacaccaatcagggcgtgctcaaggtctgcgactttgggctggcgcgccagtacggctcccccctcaaaccctacacccacatggtggtcaccctgtggtaccgcgccccagagctcctcctaggtgtgtgtcggggcgggttgtttgtgtgtgtgtgtcagggagggtgggggagtag

SEQ ID NO: 4201 - DNA, 1374 bp, Chlorella protothecoides
  modified_base (1200)..(1209): a, c, t, g, unknown or other
atgtcagctgccgccttgcgatgcatcctgagcgtgccttggatacgcacgggtcagcatcgcagcatagtcagaagctcgtcacggatctccgaggcatcgcctggaggcccgcatcggcaacttcagcagcaggccattggtgcggcgctgtcgggaacaggaacggggtctcggaatgcaacattgtcctccatagtccatgcacgagaaggtcggtgtgcctcatcctctcctggactgcacaatgacaccttcacatcacaggtgcctgcccctagaccattggtgctcgtcgttagtggacccagtggggtcggcaaggatgcagtgctcaacacattccaaaaggccaacccagacctccatttcattgtcacagccaccacgaggtcagatgccttggctagaggctgtgcagaagggcgaatggcgcagtttgagacctggatcaaggagggccaactgctggaacatgcgctcgtctatggcgattacaaaggaatccctcgaccccaggcaagaccctctgggcggttgttcagcagatgccctggggccgatctcaggatgaaatttacatacaatgcgagaattgctcttcaatgtcaggtggaagccgcaattgctgctggaaaggatgtcatcctcagaattgatgtccaaggcgcagccactgttcgctccatgctgccgggagtggggattgcttgctttgtggctcgatggtcctgcaatttgtgggctcatttcgactatctgaccagcacccccttgtcccacgtgctcactacccaacttcaggttgctgagacagaaaagagtctagtacaacgactcattgcgaggaagactgataagctgagaccagggccttcttttcagttgccctttctccccacacatcccacaaatccaacctctctgcaggagagtctcgtcaagcgagtccagactgccaaggccgagctcgagcgtgcacaagagttcgattatgtggtggttaacgccgatggggcgatggagaggacggtggcgcacatacaggccatccttgaggcagagaaggcaaaattgcaagcgcattcatgccatttgcgactgccctggggactgatggtggaccattcggtggctcaaaggtgtaggccattgcagcccgtccctgaagcagctgatgtggctcggcagagctgcaannnnnnnnnngtggctcaaaggtgtaggccattgcagcccctccctgaagcagctaatgtggctcggcagagctgcgcttggcaagcaatgtttgcttcttcacccctgactgcgactccctccggagacgctttttctcgatgtaacagagttgaccaagccaatacaatctag

SEQ ID NO: 4202 - DNA, 411 bp, Chlorella protothecoides
atgcaaagatccacatgcctccgagtcgtggcggttctggctgagccctccaaggcggaggtgtatcaaccggcaaaaccccatgccccagcgccctaccatcgcaaggtgcgtggggcacgaggccgcccgcctgagctctgggtgtccggtgccaagcttggtcatgccccacatcgcatgaacaacaagggcgagaggcggccaaccgacctggagctctacaacgggctgtggctgggacagacggtcctggggcgagtggtggtatctaccaggaagggggccagggttgagattctcgaggcccacaacacccccacggacaacctgcgccacaggcatgggtgcgctgagcgtttgggagtgcttggatggggcgacgaggttgatgccggcggcctggggtag

SEQ ID NO: 4203 - DNA, 294 bp, Chlorella protothecoides
atggtgcgccgcatagaccggaatggggtcttcattggcatcaaggacaccatggagacggggctgctccacatcagcaacgtgtctcgcaagcatgtcccagacgtgtcggaggtgttttccgtgggagagatggtctgggtgatggtcatgggattcgagcctggattcggcaaggtgtccttctccacagcggagttggaggtagaggacggagacatcatgaccaacaaggagttgtgctgggagaacaggggtgagtggctgggttgggagatgatgagcatggagtga

SEQ ID NO: 4204 - DNA, 480 bp, Chlorella protothecoides
atgccaataaccgacgggccgcttgccgtcagggataccgcagaggtgcgggagtgccagggtctatcgcggcccctggtcccggttggattgatccgtcccttccaggtcaaggccctgcccacgcccgaggccgtgaccggcaacccaaacaacactgcgggccccttgctgtcagccttcctccacgatcggaggaccatgtggcaccggggctggcagctgcagagctgcaaccgtgaggaccgggagaacgtgatgatgcgtgtcgagggcgtgaatggcggcggcctcgtcagcagggtctgcggcctgcccatctttgtcccctactcccaactgcacaaggacagggacctgcgatatagtgaagaggtgtggaccagtgcagaggggagaagggaacaggtgtctgagagtaatcgtatggaggagccagcagcgtccaaagctctggctgcagcctcacggggcgtgtag

SEQ ID NO: 4205 - DNA, 579 bp, Chlorella protothecoides
atggccgagctgctcacgcgggagccgctgttccctggcaagggcgagatcgaccagctgggcaagatctttggcctgctgggcacgcccaccgaggagacctggccggggctggaccgcctgcccaacttccgcaagttcaacttcaggcaggagaggaagaacacgctgcgagccgccttcccgcccccgggtccggtgtttgatgggcggcccacgctgagcgaagcagggttcgacctcctctcctccctgctctccctgtgcccgatttgcatgcgccatggcccagtctctgcgagcatggctgagtcgggtggcttcccattgccactgcaccgagccctttcaccatcgattcccaccaccaccaccacccccgcaggagaggcggatatctgccgccgaggcgctgcagcatccctggttcaaggagcatcccctgcccaaggacacggcgctcatgcccaccttcccatccaccgcggccgcccccagcagccggcgctgaccctgacggcactgccttgcctgaccctggaatgctcggccccctcaccgcagcccagcttgaaatga

SEQ ID NO: 4206 - DNA, 2325 bp, Chlorella protothecoides
atgtctcacaggtgcgtgccctgcgtggcctgggacacgacgtcatggtggtgtcggggggcccagagggctgggaatttatccttggggggagcattgctatatggcgtggaacagtgcgcccttggcaagtaccatggccgaactctcaagttgaatgattcacagcgagtacgaggtgtgccggaatggtcttctgacaatccctacccgaactcgttctcgaatcagatccccctgccttcctggggcacgctggacagcagctgcagccaccgggagtttgctgcaggcgtggccgcctccgccatcctctccgccatcctctccttctgccccgacgccgtgctgggggtggactggcacgccctgcgcccctaccaagccatgaaggcggcctgggaggctacccatgccgcagcactgagggatgcgccgggctgccgagcacccccgctggtgtacatgaactaccgcctgcatggccgcaccgacccggcctgccaggccctggaggtggaggcgctcggtgcctccgcgctctccctgctgctgtgcagggccgatcgccgcgcggcgctggacatgctggggacaagcgatggtctgcgccccggcccagacctgcgcgtcctcctcccgccgctgcgatctgacctggcggggatcggcgccccggcggcggcggccctggccccgtgccgcaccttcctgacttgcgccgtgcgcgtggcgccggagaaggcgcccgaccgctttgtggagctcgtcgaagagctggcgcaccgtggcgcgctcggcaacctcacgcccctgatctgcggctcgggctggggcggcgcctggggtacgagcctcgcggcgaggctgctggcggccgcgccgcaggctgtagtgcacacccgcttcctggggccggcggggctggccgaaatcttcgccgccacgctgctcaatgtccacccctgcgagcacgacgcctacggcatgaccatcgtggaggccgccagccagggtgggggaagggaggaggggttgagcggggtttggaagtgttggcgatgtgggtgccatggtgcccggggggcggccgcagcacaagtgccgttggacatcacaccacccctcggccataggacctcctcacgatcagttggcaacaagaataacggggcgattgcatgtgaacggtcctttgacgtcgagcccaccactgcctccctttctttccctgctggcaggggcccccagcctgggcatcccgggactggcggcagaggtggagcggctggtggcagacccccaagccctgcagcgagtcggggcaaaggctcgggagaaggcgcggtcctggggggaggtggacaatgcccaccagctcgctacctgggtagaagcggtggtgcgagtgcacgcagcagcacaggaacgagaatcatcgtcgtgactcctgaggtcgaagggccatgcgcacgagcgctgggcaggctgactgggaattatgttgcagtgcccatgcacatcaagctgactgaaatttcatcagcacctctttccctagatcgccctttcgtcacggggacttcccaacgtggtcacccaccgcagtactattcccgcccaatccagcttaattaccgaggtctaatgggatcggatgcgttctggatggcaaggccctcaaggatcgatatgcacgtcccactctgggcgcgagagccaggctttaacggcctccgacctccgctgcatccacggccaggcgttggctccaactccctcatgcccctccgtggaccggcaagcacagcgcagcatctcacggacccccgcccagcccaggcccaggttggcttccacgttcctcgccaccaggccctggaactcccgcggcgagcacagcccacggcagtcctcgatgagggcctctgccgccgcggtctcctccgtcagcaggcgccagaggtggggcatagcgtgctcgttgatccagttgtggttgatgctgagcgccggcgaggcattgagcacttcatggtgccagccgctgggcacgaagatcgcgtccccgggctgctggatgacttctcgcgccgcctgcctggcctgagccagccccggccacccctcgccggacggtccatgcagcgtgcgggccagttgctttgtccccgggcggtacatgtgctcggtgtgggagggggggaccagggtccagtgcttgaccccagcgatgttcaccgaccagctgtgactcatcaacacgtcgtggtgcaggggggtggaggaccccttgcatcattttgggggaggggggtgcagtga

SEQ ID NO: 4207 - DNA, 528 bp, Chlorella protothecoides
  modified_base (279)..(288): a, c, t, g, unknown or other
atgatgagcacctcgcatcccgaaccagcagcaccggtcgccacacccgtagttgatgcgagagagctcacctatgagggctttgtgaacgattacatggctgtcggggaacccgtcatcgtccgtgggctcacagacgactgggcagcagtgagggagtgggtgacgccggaaggcctcccagatctggacttcctggtgcgcaaatttgggcacagccgaatctgcgtgtccgactgctcccaggcgtccgagtacggcgcgcagcccgcagagagnnnnnnnnnngacgccggaaggcctcccagatctggactttctggtccgcaaatttgggcacagccgaatttgcgtgtccgactgctcccaggcatccgagtacggcgcgcagcccgcagagatcatgtccctggcggagtacgtgtcctggtggaggcgtccagaccgggagggagttctatacctcaaggactggcactttgccgccgagcatcccgagtaccaggtgggaaggggttgcacccctag

SEQ ID NO: 4208 - DNA, 1455 bp, Chlorella protothecoides
cgccgcgtggccgcggcgggcggcgacgccgccgctgcgctgtttcccgccctgctcgccgcgggcggcggcggcgtgctgctggagagcgcgcagcgtgtcgcctcgcgagaggacgacgagggtgaggaggaggaggaggaggaggaggaggatgccgccgaggccgccgccggcgcatcgagcgaggccgggtccgacagccgccggcccgcactgctggacaatgacgaggatgcggaggatggcgacgcgcctcccttgaccgccgaccaggacgccaacgatgaggaggagggcgccgcgactccggccgccgccctgcgcggcgacccctgcgcctgtatcgagacgatgcgcgcggtgctggcctcggtgtcctccaagcgcctgctcaccgcggcgcaggagtgcgacctgggcgagatggtccaggcgcggctgggcctgctggaggtccgcgcgcagctgcgcgcggcgcggggcgagggaggagggggtttggacccccaggcgacatcctcgggcccggctgccggcgacgacgggcacgccacgcatggtgccgcacctgcgcgctcgtgcccggctgcttctgccagccacggagaccctgccgcctccatcaccaccgcgcgcgctccgccggcggtgtcgccgcgcgagtgggccgcggcggcggggctgacgcccgcggagctccagatgcggctgcacctgggcctgcaggcgcgggagatgatggtggcctgcaacgcgcgcctggtggcggcggccgcacatcggtacactgggcgcggcctgagccattccgacctcgtgtcggagggcatgcagggcctgcgcacgggcgtggagcgattcgacccgcgccgcggcttccgcctctccacctacgtcacgtggtggatccgtcaggccctggggcgggccacccaggcccagggccgcctcgtctccctccccgtctctgtcgtcgaccgcttccggcgcctggtccgcgccgaggtggtgctgtgcgatcagctgggccggccgcccacccaggacgagctggccgcggcggcgggcatgagtgccaagcgcctggtccaggtgcaggccgccatccgcaagcccgcggtgctgaacgaggccgagggcgaccgcgacgaggagggcggcctgcagccatccgccgccttcgtcatcgactccacggaggaccccatgctgcgcgccatgcaggcgctgaagcgcgtggagctggacgacgtgcttcgcgggctgccgcggcgcgaggtgtcggtcatcaaaaaccggtttgggctggaggacgggcgggagcgcacgctgggccagtgtggcacctcccacgaagtgcacgtgaggcgggggcaggggggaaagggcgcaggtggagggcggaaggggcgcgcaggcgcatggcaccgaggtgcacaccagcagacgcaa

SEQ ID NO: 4209 - DNA, 279 bp, Chlorella protothecoides
atggtggagctggatgcgtttgaggcacctgatttcgaccctgtgacgtatgtgaacgactactgtcagaagaagagccaggatgcgcccatggataggtaccttacagagctggagctcagactgcagctcgcaagcgaggacatcgtcgggaaattggcggatgccagctcccgagcctctctccgggtgccttctgcactgaaggagctgctaaacatacaggcacgtcgccagtccagtagagttaaacacgcagaaggcattcgcgtatcctga

SEQ ID NO: 4210 - DNA, 1332 bp, Chlorella protothecoides
atgtcgagaggttcgtggacctgttccacggccccgtccgatcatctgtgcggaagctctggtcgcaggcgccagcctggcggacgccctcaccctccactccgctcccaaacccccgacccgcgcctgctcccccacagtctgccatcagcaacgcattacatcagggttccgggcagatcgaagcactcaaccatgcccagcgccaccagcaccaaggttaccacgggagggtccaaccagagccccggcccgaaatccagacccctgaaggatacaggggacgagggcggtgccgcatgggccactggtgattttggaaattctctggccaccccgcagaagtcggaggccaaggagagcaagaggtccgccccggacagcaccagcaaggagcccgtggaggagaacgaggacatgccgaaggcgcaggaggccggcgaggccaaagcaccgcgcatcaagggcctggagacctttgacggcaagctggtgccttttgccgcaggtggggcccgaggcacgatggagggggggggggcaagagtgcgagcacgatcgctgccgagcatgggccctggttgcgtgactggaccgtcgcatgcaagggtctgggcaagcacgtcgcgcacatcgaccattcttcggcccccccacgccatcgcaggtttcgagaacatggtgcgcacggccccagtctacaggtcccaccgcctgcatgccatcaaccccaccgccgcggtctctgatgatgtcagctacctctacaccctggtaggatggggagcttctttccgaggttccttggacgggagccataagagtgactgctcaagtgtttcggcatgcattgtgcagaaattctccaccacctcaaaatctgcagccttccctcaaaaatgcctgatcgcctcctgccccatgctgccctgcaggattctgggcgcgtcacccccgcctctgccgctgccgaccccaactacgatgccgagttcatccgcaacaccaccgcggccagcaagggcggtcttttccagagcctgttgcagcccatcaagtaggtgcaggcagccggagtacgacccacccacccctgaacacactgcctccatgatacggatgaaacggaccgggctcgctgtgtgggtgggccttgggcctcaccccacgttgcgtgctgccctggacattgacccatcccctcttaaaatgtatggtccatgcgcttttgcatgctccctgaccatgttaagttctggcttcagaatgaagacgggctgcgcgggcgggccaaggtccatgatcgtggctgccctggcagcagggcgatag

SEQ ID NO: 4211 - DNA, 1245 bp, Chlorella protothecoides
  modified_base (84)..(93): a, c, t, g, unknown or other
atggaacacctgaccatcatcctgccctgtccaatccaatgcttgccctctgactcccccgctgcagcttttccttttacatcnnnnnnnnnncggagattggaattaagagccagggtttcatctcattgcgtcaatggaataccttaccatcatcctgccctgcgcggccgtcagagggaaggggaagagggtgcaggggagggggaccctcggggcgtacggctcgccagcgtcagctaccgggactcgcacggaccgggactccccgctcggcacactccctcccgcaccacgctccgtctacttggcactggtggccaccaccttgccgagcatgacggcggtgtttccatccaggaacgcaatgcgggacaggccctcgcagttcttgaaggagtccaccaccaggggctggcagggctcgaacacgacctcggccatctcgttggccttcagggagtggggctcctccagcttcttgccaccggtctccttgcccaccttccagttgatcttggtgatgcggcaggcggagcggccacaccgcacgaagccgatgggggagtaccccgccttgacctcgccggggatgtccagggtctggatctgggcggtgaagtccttcacgggcttcatggtggagtccgacttcagcaccatcacgtcgccggtgcggggcaggttgttcttgtccaggcccttgatgttcatgcccacgttgtcgccggggcccgccttgtccacgcgcttgtggtgcatctccacggtgaacaccttgccggtgcaggggttggcggcggtgtgggtgggcatgaacaccacctcgtcaccgggcttcacgatgccctgctccacacggcccgccagcacatcgcccacgcccttgatcttgtaggcgccggagatgggcaggcgcaggggcgcgtcggccttgcgctcggggacgtccaccatgtcgttcagggcgtccagcagcgtgtgcacatgcaccttgcgcttgatgatgtccacgtccacgccagtccaccagggcatgttggtggacttggtgatcaagttgtcgcccatccacccggagatggggacgatggggacggacttctggacgaagtcgggcttccagcccacgcggatgagcatgtggcgcatctcgttggcaatctccttgtagcggtcctcctgtggcaaggaagggtgttggggagggggggtgagcctgggctgacagaaatgtgtgactag

SEQ ID NO: 4212 - DNA, 1566 bp, Chlorella protothecoides
  modified_base (778)..(787): a, c, t, g, unknown or other
  modified_base (910)..(919): a, c, t, g, unknown or other
atgcttcccagtatgttagacccgcgtcagtgtaccacaacgagcattgaagtggcattgtcaactgattacttggcaagtaggagtccctgccatacgaaggtcaggggggagtctcacgaatatgaacagacgctggtaggggattccccgcgctcagggtcggaaccacctgggaagattctcaagaatagcactcagtcccttcacttgctcaccagcacctctcaacgcgtcgagggtgactggagccctgccggtccgggccccggcaccatgaagcgcatcttcggtcgcaaggagaaggtcccgcctccctcactggatcaggccactgacaaactgaacacgcggggggacaccatcgatgagaagatcaggaagctggatgcggagctggtgaagcaccgggagaacatcaagcgcacacggcccgggcccgcccaggaggcggccaagcggcgggcgttgaccgtgctgaagcagaagaagctgtacgagagccagcgtgaccagctgtacaaccagcagtacaacatagagcagaccagcttcgccatccagtccatgcaggactcggtgcacacagtgcaggccatggcggtgcgcagggtcgtggcgcggggagtgatgacctggaggggcgccgcgagtggggtgggccagaagctgggtacaccttctttttacctctggcctcaaggacacacgtcgcgcattcagctcccctggagagtcgtccaacctcctcacaaacccctccacggacaggctgccnnnnnnnnnnggattgcatgctcgctggcggggaggctacggggcaccatgcatcttcgtaatgcgacatccaagtcccgccgtcgcatgctgtgccgggggaacccctcttcctgtgtctgctcaggtccannnnnnnnnnatgcgagtggggtgggccagaagctgggtacatcttctttttacctctggcctcaggggcacacgtcgcgcattcacctcccctggagaggcgtccaaccccctcacaaacccctccacggacaggctgccggcaaggagctgaaacagactatgaagcacaaggatctgcgcatcgagaacatagagtccatgcaggacagcatgcaggacctgctggacatgcaacacgagatcacggaggcacttggcgccaactacgcgaccccagacgacatcgacgagtcagagctcatgggggagctggatgcgctagaggacgagctcacaatggagagcgaggctgggggcagcgtgcctgcctacctgcaggaaccggacctcccggcagcccccactgcccaggctgcgggggccgagggcaccgacagctttgggctgccggcggtgccggccatgccccaacgaacttcactgaagctgaaattgtctaccaggctcttggtctgtagcacaaggaggggaaggcacagcatgtggcggaatctcggttggcactctgtcagcttgaatggggaagccaccgccaactattccagcttcagccacaatgtgccacgtctttgtccatctgctgatgctctttag

SEQ ID NO: 4213 - DNA, 768 bp, Chlorella protothecoides
atggtcccgctggccgccgagctgcagtgggcccctgcacgccagggtctggtgcagtccgccttcctctggggctacatggccacgcagttgctggggggctgggcggccgacaagtatggagagaatggacgaatggattcattcgagcctggtatcgcagccctcaccagtcacaccctgccttccaaatgcccacacagcatgttgcaggccggcccactcatcgtcagttgtctcgcttgtgacccaccaccacaagcttacctcccactgatccaacctttcacccccctttcatcatcaatacgcaggcaagacggtgctgggctggggcatcgcctggttctccctttccagcctgctcctccccttgctggcggtcacccccctcacccgctccctgggccttgtcctccccgccgtactcctcacccgcttcctggtgggcctgggggagggcgtggccatgcctgccatgatcagcctggtggcccaacgcgtcagccccgcccgctccagcgccgcgctgggcgccgcctataccggcttccactccggaaacctgctgggcctggtgctgtcgccctggctcatcgcgcgcggtggctggcgcgcgcccttcctcgcctttggcgcggcggggctgcccctgctggcggcctgggccatcgtcgtgccggggagggcgggcgggggcgcgcagcgcgcacggcggggggcgggagccgtgcgcggccaccgcttggcggacctgctgggcaatag

SEQ ID NO: 4214 - DNA, 543 bp, Chlorella protothecoides
  modified_base (492)..(501): a, c, t, g, unknown or other
atgggtgacccgtccacgacctccccagtcgacgtcgacgaggagttcgggggggcgctgggcctcacatcgccgcccaaattaaatcctggcctgcccaccgttcaagtggaccctgacttactaaatgatgatctatatggcgacttggtggatgaaagaggcacaggaggcacgctcttgggactacagcttgcccaggagagggcgcgtatcaaacagacaactgatgaacttgaggcgcaaaaggcagagaacagcagactgggggaggccctgtcagccatgacacaggagcgggacgccctactccacaacatctcggtcctgtacaagacagccaagctggagattaccaggaaggacgcagagatcaaggagctcagatccaggttagggatgtggttcgtgtatgaagggtgctctatggcggcggatacaataccattctgcttttgtgaggtggggcgatgggcgttctctaaaacctannnnnnnnnncaaggagctcagatccaggttagggatgtgcttcgtgtatga

SEQ ID NO: 4215 - DNA, 516 bp, Chlorella protothecoides
atgagccaactgctgcaacgccagaggccttcatgtatccctcccccccgcctcaactgcccaggtttcatcgtccccggcaaccctcatgacgacgtccagctccagttcgacctgagcctgatcgaagcggcgcgggcactggtgggcctggccgccctcgaggggctggcccccgcggcgcgcgccgcgctggaggcgctgggcctggcgggcgccccggggtcgagcgccgcggtggctgtgcggcgggccagggccggcgtccaaggaccctgcgacgcgaggctgctggcgggcctgcgggctgtgagcgcgcagcctgctgagctggaggggctcacgctgcgggcgctgggagactgggccagtcccctcagcctcgtcagcgaggtgggcgggggtccgctgtggcctgatgatgagttttggtggctggcgcagggtcgccatggcatgcgtctgatcctcagttacaaactcatcgacctcactgcttccaggattgtgtcttga

SEQ ID NO: 4216 - DNA, 381 bp, Chlorella protothecoides
atgccatgccccctccccgccacaaacgagcaggccaaggcgctgcggacgctgacggggctgtgcgccatctcgctgtcccacttcccgacaaccgctgaggaggatgcagaggttctgaggaaaggaggaatgtcggggcccatggcgctggccgtgcagttccgcctggagaagaagaggatactggatgccggcatcaaagcctgcgcggcccggattcggggagaacccctcactcatccttcacaccctcccgacccaggaactacaaggctgacaaaattgcaggcttggtcttcccctgcctgccccaagatactatacaacaatttgctgcagcacagcagctgtggcatccttgatcgcaagttgggttaa

SEQ ID NO: 4217 - DNA, 1263 bp, Chlorella protothecoides
atgtgcggacgcaccaacaccacgctgcgtcgtgacgagatcgtgcgagtggcgggcaccagtcgatggaccggcgagagtgccttcaatcccagttacaatgccgccccaggtgccacgcgctcacctgtggtgcgcgtggtacaggggatggggagggagatatgcaccatgcgatggggcctggtcccctcctacaccaagcctgacgagctgcctgacttctggcgcatgttcaatgcccgcagcgagaccctggcggagaagcccaccttccagaggctcctctcccgtcagcgctgcctcgtccccgtggcgggcttctacgagtggaagaaggaggtgggagcggtgtggaccatgagcgcacgagtgacaggcttgggtggagtgaggatgtttgggcaagggttgcagagccacacctgtgatcatagtctccatcactcctccaccaacacctggcagactcgggtcccaggctggggtggctgcacgaccgcatgccagtcatcctcgacaccaaggattctcaagacctctggttgctcgatgggcccggcgaccccaaagctgggtgggtgggtggatggatgtgcgggctggggtcctgtgggagggttcttcgaagtcatcttgcaagctgagagcagagcaggtatttcgccaagttacccacccatgccgtggctcagtctctcagccatgataccactcctccccaatctcccttgcaggacgtggagcgcggtctgtggtccctacattggcgaggacctggtgtggcaccccgtgacgccagaaatgggcagccccaagctccagggccccgagtgctgcgccgagctgaaacggcccaccatcacccagttcttcgagaagaagagtggagcaaaaaggaagactgacagcacacttgaggatactccaggagggaaactcgcacgcaacagcgacgaggtcggtgagaccaggggctcccagcagatctctcagatggggtcacaacctgcgacggcagctccagccatcaagaaggagtctccccaacccagcgatgctgttggggcggccggggacgcaaagggacagggcgaccggcaagatcccatagagaaggaggaggtggtggaggagccaacccctaaatccagtcctcagcctaaatccaagcccagtccagcagggaagggtgcttttagcagtccggatccctctgagaagcaggcatccatcacacaattcttttccaagaaaagctga

SEQ ID NO: 4218 - DNA, 1128 bp, Chlorella protothecoides
  modified_base (190)..(199): a, c, t, g, unknown or other
gagcaggccggcagcggcggcgccggcctgctgctgggcgcgccgctgcgcgccgcgtcggcctccagcggcaccctggtttcgctcaccgctctgcgctggctgcacggcctcctgctgcaagagcgcgcgtcgctcgccgcagccgcggcggctgaggacagtaccggccccaatggcgcggcctcgnnnnnnnnnnctctgcgctggctgcacggcctcctgctgcgagagcgcgcgtcgctcgccgcagctgcggcggctgaggacggtaccggccccaatggcgcggcctcacccgggcggccgccggcgcagcaccccctgcaccagcagtacccggtcattctggaggcggtcctgctcagcctgggcagcgccaaccccgagatcctggcggccgcccgtgcgctgaaccagctgctgctggaggcggtggggcgggagacgccggccgctccgacgcgcacgaggaggcgcggcgcgtcggtgggcggcgacgccgcgctgtcctccagcgccggcagcccggctggcgcgccgccgcccccctccctgccctccgccgacggcgacccgggggccccaacccctccgccagccatcgacacccccgccctgctcgcctccacggtgggcgcgctggagtccagctccgaggcggtcaagcttgcggcgctgcagtggctccccgccctcctccgccgctccttccacgaggtgtttggtgcgctgcccgccctcctccgcgcgctggtggagagcctgggcgccagctcggcggccgtggcggtgcaggcgctggcggtgctgggcgacgtggcactgcgcccagggcacagccacgacgtgctggcgggcgtggccgacgccttccgcgggccggcgggggccaagctgctgcagcgccgcggcgtgctcattgtgcagaccctggcagagcgcctggggggcttgcaggtcctgctcaagctcagcagcctggcggctgaggatccggaccccgcttttggcgccgcgctggtgcaggttgttggttttggggggggtgaggggaggggggggaggaaatgcaagtgcgagaaagggaggggtgcagcttgggagggacatggcggtggggggtga

SEQ ID NO: 4219 - DNA, 453 bp, Chlorella protothecoides
atgcctgcgccgtccaccagccctggcgccctgctgtcctcctgggtgatgttgcgggggggcagcgtgcacagcgcgctgcacgtccgcaccagtcccaccgccgggctgggcctgggggtcagcagcgccgtgtccccgggaacgatcctggtccgcctccccctggccgcccagctgggggcgggcggcgcggcggactcagacctgcagaccctcctcgaccgggtcccggcggagctctggggcgcccgcctcggcctgcacgccctgcgagagcgcgccgtgggggagggcgccggcgccttctggccctacatcgccgcgctgcctagcgccttccccggcgtgcccctcttcttccccagggaggccgtagaggccctgcaatatccccccatcgtccagcaggttttagggggtccattgggtggggtaggggtagggagctag

SEQ ID NO: 4220 - DNA, 486 bp, Chlorella protothecoides
atgcgtagggggcccctggaccgatgcgtggcgtggttgcgtgactcattacccccaaccccccaccccactccacctcgcccaggcggcgaggcgcagcagctggcgggcatgctggagggcgccggggacggcgccagcctggagcggctgtactgcgcggcggtgctgccgccgctgcgcgccacctgggagcaggtggaccccgccagggcgccctttgtctccgcgctgccccaattcttcgagcaggtgctgggcctgctgcgcggcgaggccggctggctggcggaagccatgccctgccgcgcgcccgccctgctccacgccctggtcacagccttgttcgaggccgttgaggccgagcacggcgcacgcctggccgccgccctggccgcgccgcgcgggtccccggttccgctggagcgcctggcggccgcccgcgccgcggcgctggactttgtgcacggcgcggcggaggcgatc

SEQ ID NO: 4221 - DNA, 513 bp, Chlorella protothecoides
atggcggaggtccaggagcgggtaaacgcctcggccgtggggcccggcgcccaggcggtggacaccctgcgccagctggaaagggtgaaggggcgcatgcagaccgcggccgacaccctggaggtgggcgccggggcgggcggggagggtcatgccagggagacggactcggcttcccatggcccccggccttgtaccatggacgtggcccccccgagccgcccctgcatcgtcaccctcctcccctttatcgaggccagcggcctggcatccctcttccaccgcatggactccctgtttgccgacgaggacctgccggccatcgccgctgcgctggccggcatgcagcgcgggctgcgcgtggtaggggactccgtccccggctttgcggacggccccgcgcgcctggccaccttccaggcccggctgcgggacctagtgcgggcgccgctggtcgccgcgctgcagaaccggcagggtgggccggcgtgggagcagggtgccggctcgtag

SEQ ID NO: 4222 - DNA, 1167 bp, Chlorella protothecoides
atgcaccgagcctcagcactcgtccggacattgaagacgccaaagggtcgctctgcattctctgggtcgcgtggggccggcgtggttgcccgctccgtcctgcctacggacatggtggtgcaaacacgtcaggaccgccgggaggagctgggattcgaggcagttgtcgccaacctctgcagcgccgtggccaatgccggtgcctgccagccgcggtgttcatgtaccagaggcggctgcccaactcctcgagctgggccttgcctgccctgcaaaggccccaacagctgcctggctggtccgcgcccaacctacgtatccgcaacacccgccgccgcgccgcaggtgagcgcgcgccatgccgccgtcctggtcccgctgttcgaggacccggccacgcggcgcacgcacgtggtgctgacgcagcgcgcagcggggctgaggtcccacggcggcgaggtctgcttcccgggggggaagcgggaggagggcgacgccgacgacgtggccaccgccgtgcgggaggcgcaggaggagctggggctggaccccaactcggtccgcgtgctgggttgcctgggccccgtcctttccaagcacctgctgtctgtgaccccggtgctggccaccatccccgcacgccatgccttccaccccaacccggacgaggtgcaggcggtgtttgccccccccttgcacaccttcctggaggcctccgacctccactccagccgggaagccaccttcgccccggggatgccgtacaggtgcgcattgtgcaagggctgttcattctggcctggggcctgcaggcaggactggacccttggcaaaagtacactgtgtcgggcacaaaggcgggaggatgggcaagggccaccgtgggtgcaggaccagcctagcgtaggcctggcaaccggaggcgatcaagatgttgtaggtgttgcagcaagggtgctgaggcctgcgctgacgtggccagtcgcagtggccctggctctcagagcggccgatagggagtggtacagcgtctggggcctgacagcagccatgctcatcgacatcgcctccaaggggtttggcagggatccagactttgaggcgctgccccccgggtatgtccccatgcacgccggcatgtttgatgaccagacccagaccgggtag

SEQ ID NO: 4223 - DNA, 1782 bp, Chlorella protothecoides
  modified_base (500)..(509): a, c, t, g, unknown or other
  modified_base (616)..(625): a, c, t, g, unknown or other
atgcccgtgcgtcctagccgtaggcattgtgccaaagacacgatgacgctcatgtgctgccagctgccggggtcagggcctgagaggcgggttcacaggccggtggtgccttccgcactggctggggggagggcgtggcacctccttgaggaccctcgatgccagctatgtattgtgagtgtcttcgggtcgcttgcttcacgacagcactccggggtttcatctgaccctgctgcgtgcatgctgggtccgggctgtcaggccccactagcatgcactgcctcacgtggtgaccagcagcttgaggagccctttgacatacagcaagatctcggcgcctcccagtttggaggcgccgtacaccctgtccacgaagacgatgggcacttcggcgactgtgtagccgagcgaccgagccctgaccatgatctccatctggaaggcgtagcccttggatgatgcccatgctccgcacccatcccgtgccccaagccatgccnnnnnnnnnncctgaatgaacctgtcaggtctgaaacctgtatggtggaaaggtggatggggaaatctgagagccgttgcatagcaacccttcaacaaactggagcgcagcagggannnnnnnnnngcactcacccctggctgcaggagtgtggccgcgagggtgttggcgccccgactgatgagcttgcgcttgaagttccacccatacacccccccgcccgggccgtaccgggtccccgtcaccacgtcggcgcctgtagctgcctgcttggcaatgaagtccggcaggtacttggggtggtggctcaggtcagcgtccatgatgatgacaaagtcgccagaggcgtactgcagaccatgcacatatgcggtgtggcagcatcgtggggtcagctgcttcaccacgtcctgagttccatcggggctgttgtcgtccacgacgatgatctcgaaacggatcttactgtgagcagtgggacgttgggctcagcagagacactagtaaaaaatgagaaggacatgaataaatgcaatacaatcaactcgcacaacgtccttcgcaatattatctcactggagctcaaaagtttcgaccaggaggtagatgatgatggggatgttctggcgctcattgtaggtggggaggagcacggagtatttggacgtcgtgtgtactcgccggaccaccatgatctggatgtcgggtcacctgacaggcgatcccatgccctgtgcaactttgcacaccgcggtgccgggcgaggggacggtcaggtgacagcttggaaaggacgacctcgagaagagcaaggcactcgcgttcaccccacccggtccacgcagccacctcacgtacctctgtctaggttcaatcgatggaaggttgactgccacattcgccgcgaggcagtcgccaggatgctacctgtcaagagcgtggatcgctccgcaacgatatgcttcgatccgactgggtcgttccttgcggccggcagtgttgccggggccattgatctcagcttcagcacgagctcgacgctggaggtgcgcggaggacaccattgccgccgtgcggtcatcctgcgtggtctggtgcagggccaaccccagtacggatctgaagcccgccggtggagcggtgcatgctcccgagcgtttctcacgcctcacgtggggcaaggggcccgatcccgacaagtaccccgtacgtttgggagcttaggaggggtgcagcgcaagattttcacactcatcggggcagggtcggggaaattgcaatga

SEQ ID NO: 4224 - DNA, 537 bp, Chlorella protothecoides
atgtccgctccagctctgcgcgtgtgcggggtgtcacggccacagggcctctgcgccgcaagggtcatcggcaccagccgcacacaggtgccgctattcgtcgcgaggcctggcaggagtgcgaggtctggatccttgtgcagtgagaagcctgcgggacacgcttcctgtaacatcatgactcggtgggtggcggtggtgcagatctgccgaggaaaccctgcagagcctcgcttggcgccggctcagacgagaagggacgatacagcgagcgctgaagctaccgccgagcaggctgacaccattgctccccatggtgggtctctggtcgacctcatgctgcccagttcccagagagagactgccatcagctcctgcaacaagaccgtcgagctctctgaccgaagtgcggttttggtgacctctatgcggaatggtgtgctccatctggcaaagctgggttgtcttgtctttatgaggagggctttgggcaactgggatcttctgtgttgcgccagggtatgtcctcaggtctaa

SEQ ID NO: 4225 - DNA, 681 bp, Chlorella protothecoides
atgcggacatggtcaccagaagccacaccgtatttcacacctgagttcaactgccgaaggtgctgtggtcatggaacctggcacccgcaccagacgcctagcctttccattcacaaggatcgcgggtcaggaagagctcaagctggccctgctcctcaacgtggtggatccctccattggaggggctctcatcatgggcgacagaggcacaggaaaatctgttgcggtgcgtctggtgctccatgtcgagccctctcttgtggcatgatgatgtgctgccatgccatggtcgcagcatccatgtggcacagccccaagacacactcggtcatgcaatcacaggtcagggctttggtggatgtcctgcctgagatccaggtggtcaaggatgacccctttaactctagccccactgacaacaggtactggaacacgaaaggaagtgcagcctgcacacccgagtccccaccctccttgtctttgcaccccccctctagaccccggcctgatggggcccgagcccctggccgcactcagggcgggcatcccactggagaccgtgcgcaagcccaccccgctcgtggagctgcccctgggagccacggaggaccgcatctgcggcaccatcgacgtcgagaaggcgctgtccgaggggatcaaggtgggtgcgcttgtggttga

SEQ ID NO: 4226 - DNA, 1044 bp, Chlorella protothecoides
atgacggaggaggagtacacctccgtggttgaaaacatgacgctccccgatggcaccctgtttgggctgccggtggtcatggacaccagcgaagagggcatcatcgtcggcgacaagctgctcctgacctacaagggagaggtgggcccagggcgggggcatcagagtggaggaaaaggacatttgccaggggaccagcatgcctgcaccccttgctcccacgcgcgccccaggttgcttggcggggcgccagggcctcattccctggccaccttcacggtcagctccaagtggcgccccaacaaggcgctggaggcgcggcagtgctatggcaccaccgccctggaccaccccgccgtgtccatgatcgcgggggagcgcgggcgctactacctgggcggcggcgtggaggggctgggcctgcccacccgcgagttcccctgcgcgacgcccgcggaggtgcggagcacgctgcccggcggcgtggacgtgctggccttccagtgtcgcaaccccatccaccgcgcgcactacgagctcttcatccgcgcgctggacgcggacaacgtctcccccggcgcggtgtgtctggtgcaccccacctgcgggcccacccaggacgacgacatccccggcatcgtgcggtaccgcacctatgaggtactggccgcggaggtggccaaccccgcgctgcgctgggcctacctgccatactccatgcacatggcggggccgcgggaggccatccagcacatgatcatccgcaagaactatgggtgcacccacttcatcatcggccgcgatatggccggctgcaagtccagcctcacgggggaggacttttacggtgcgctgggggacccgtcggcgggggaggggaaggactgccttccgctcttgcttggtgggagtgcgtgggttggggtgagggtgcagcagacacgaggctgggagtgtcgagagggcccagggatatcgggcagaatacccaaggatcaggagaggccacactcacaccgtctctgcctgagttctctgagttga

SEQ ID NO: 4227 - DNA, 558 bp, Chlorella protothecoides
atgggcaagccctccgcaccctccctgtaccccgcaatgaagaacggggtggaggaggtggccagcgagatcgggttcctggcctggaaccccagcatccaccacgtgctggccacctgcaccggcaagtctggcgtggtggggtgggacctgaagaagcagcggcccatcttccagctggcggagggcggcgcgcgacggcgccacgtttcggtggctgcctggaacccggccattgccacccaggtgctggtggcctcagacgacgacggccagccggggctgctgctctgggacttgcgcagccctgccgcgccgctgcgcgagctgacgggccattcgcgcggcgtgctgggcctgtcctggagcacccaggatgcgggcctgatcctgtcgtcgggcaaggacaaccgcacgctggtgtgggacgtggcgggctgcggcgcgccgcatgcggagctgggcgctgctggccccgccaccaactggaacttcgaggtggcgtgggcgccggggcgcaacgccggcctcttcgccgccgccaccttcgaggggcgc

SEQ ID NO: 4228 - DNA, 225 bp, Chlorella protothecoides
atgaaccccctcatgggctggacttccaccgccgaccccttggagaatgtgcaccgcccgctgtactttgacagcaaggaggcggcggttgcctttgcggagaagaatgggataccaaggacctgtcccttcacccttccagacggtgacaacttttccgtgaagcgcaagggcctgccctctggcgggctgaggagcgagcttggcggcaagaagaagaagtga

SEQ ID NO: 4229 - DNA, 207 bp, Chlorella protothecoides
atggctcgttgcgcgacaggctggaggagcttctccactcagattggggatgacctgccgtcccacggcaccgacttgcaagtcgcgggtggggcgcctcccatggctgcccagcgcaaggtcatcatcttctcgccatctcgggtggcgggccagcacgggctcgcacagaccatcgatgggggtgcgtggggaatgtcgtggtag

SEQ ID NO: 4230 - DNA, 144 bp, Chlorella protothecoides
atggtagaatttgcaagtggtgttaaaggtatggctctaaacttagaaaatgacaacgtaggtgttgtattattcggtagtgacagtactattagcgaaggagatttagtaaaacgtacaggtaccattgttgacgtaccatca

SEQ ID NO: 4231 - DNA, 1758 bp, Chlorella protothecoides
  modified_base (434)..(443): a, c, t, g, unknown or other
gcactagcgcggccgccgcggagggcgggatggcgcgcacgcgcggcgccgaggcggcgccgggcgaggcgcgccactcgtacgcgtgcaggcgggtgccggaggacccggcgtcgatcaccagcacgtagcgcggcgcaggtggggagcggagccagaggaggagcccgccgcccgccagctgggaagggtgcggtgcggagggagggggttggagccggggtggttgggtgggtgggcggacagccgctgaacatgaaacaggcccccaatggccatgcgctcgctctcaccagcagggccagcagtcccaggagcaggactctagggaagctccgtggagcgggagctgcgccggccaggcccatctgctcggaggcgtgggagtgcagccagggggtcgtacatgcaaccaccaccgaactcgggcaccnnnnnnnnnncggagtgcagccagggggtcttacatgcaaccaccaccgaactcgggcaccttcccatgcgcatacgccatgcacagctcacctgggagggcgctttcctcaaccttggagccttgggtcctgggctcgcgctccacatggcctcggggtgggaccccgcgtggacacgcgagagaactcacatgcgcctgctcgtccgcattccctcagcacggcatactgtacattcagggagagtgtcgaggatgtttggcgcgcggaggagccagcaatcaatcctcaacataaagcagtggaacctacctccggcgtttcaaacgccctcattgcgttgtcgcgggccgtcatccccgaccttgcttattccgggcagggtgggcgaatggcgacagcagcacttgagaggcatgccaatcaatcgacgctggatgctgatgatacgatgactccaaacgatgccgagaaccctcacaacgaggcggcgatggacaagagcgcagggcaggacctccagagtcttttcgccgaaggcatcgcctgcatcgcgacccaaaagtacgatctgggagcagagtgcgcattgtctgtggaatccaatcgctccgtatatgcacgcataatgaatgtagctaagaatgacaacctctttcaagacttggagacccggacgctcaccactagagagcaggatatcataagccagagggtgggtgaaaacggccttgcattgttgccttgtctttggggtggctgtgcagagctgcacttggcacctgatcttgccccaggaggatgcaccattactacctcgtcacaggttgctctccagaggcggctctttgaggagtacgaaaagcgtgagatggttcgcaagatccaggaactgagagaggtgtgccctcagatcagcgaggctgctgcggctagggctctagagctctgcaatggcaggtgtggcaaaagtggacaagatcatggtaccagctcatgcggaatcaattctgatggctgccatcacagaccccatcccttgtgctccccatctttcccaccttcactcactcaccccccctcattacgcagcgaggatgaagcggcagcagagctcgtgggcaaccccgcctttaggagtcgagtgatgggtcccgcgcacggaaactctgctcccagcacagcaggccagaagagccaacagccctgggcagccaaaccagatcctgctgtgcggccaaagcttgtagatccaggctccctcaaccactcggtgggtggggcatggtggcgcaagaccatacgcagaacacaagcctgctga

SEQ ID NO: 4232 - DNA, 576 bp, Chlorella protothecoides
atggcttcctcgcgcatgctcactttcaagctgtctccctccacaaggctgttcatccagcgggcggacctgacgaccttccgaggggatgcaatcgtcaacgcagcgaacgagcggatgctggggggtggcggggtggacggcgccatccaccgcgccgcgggccccgacctcctgcgcgcctgccgggcagtggcggaggtccggccgggcgtgaggtgccccaccggtgaatgtcgcctgacggacgcgggcgcgctgcccgcccgccacgtcatccacaccgtgggccccgtctatgacggccccgccacgtcagcgcccctcctggcctccgcctaccgggcctgcctgtgcactgcgcgagacgccgggctggccagcatcgccttcccggccatttcctgtggcgtgtatgggtatccgctgcgggaggcggcgcgcatcgcgctcaacacgtgcagggaggaggcgggtgcggtgcgggaggtgcactttttcctcttcagcgagccaacgctggaggcgtggactgctggagccaaggagctagggctggaggaggaggggggctga

SEQ ID NO: 4233 - DNA, 1518 bp, Chlorella protothecoides
atgctgcagtacgagcgtgagcagtgcagggaggacagcttcctgcaggccgcactgaaactggacgtggtcctgtccggtccccagctggccgtctttgagggaaatggggcggtgctgcgcaatccacgcaccatccccggtgcattctcatccccaaaccccaacaccccaatcgaaatcctcccagcgctgtacaactggagggacggcgaggcgcgcacacaggacgagtcccccggcttcatttgtcctcgggcccagctggtggccctggccctggccatgcccaccacgggccccgaggtcgcggcggcgctgggccggcgcgcgcgctacgtgcttctgcgcgcacgcgaggtcgcggccgtcgtggccggcgcggcggcgcgccaggcgcgcgtggaggagctgcgcagggagtacctgctggccggcggccgggcgcataagaaccaggtggggccggaggatgtcgcacgggcggggccggagaatgtcgcaggggtcgagtctgagagcagagaacccgaggacgcagcgtccaacgccgatcctgagcccgccactccgggcccagcgcccacagccacactggagcctgccgccggctccgcgaagcgcgcgctgcgcccacgtggcatcaagcgcccgctggtcctcgggtcgacggggaagggcctgggcgccgcgctcatcgcgtctgctgcgcaggaaggcgcggcggcgccggcgcggggaggcccggtcagactgagtggcgcggggacgagcgcgagggcgtgcgctgcggcgggcagtggaggaccattgccagaggaggcttcggtcgaggatgatgcggcagcgatcgccagcgtggccgggtctcaaagtggtgagcatgcgaaggacggcgcagaggagctacaggccagcgcaaaagagccgcagcatcaggagcaggcggcggccgtggttaaagctaaagacgccccccccgccccgagtacgctacaaagggaaagcgaggcgggacctgtggctgcggtgccgctcgccgggcccgacccctgcaaacccagggcaggcgcaaaacgggtgccagcggtgcgcatggccggcgcatttggcggcgctctccctgtacctgcaggggccggggcggtgccgcgcgcgctggcggccatccgggcctcgctgaccctcccttttgcgaaacagccggcgggtgtggcagatggcgaggcggcggaggcaccaagtgcccatgccccagaggaggcgaaagctactgagggggacgcactggaccaggcagagcccaccacggcggcagaggtgcggtcggccatggaggcaatgcgcggggttgcggcccctgctggaccccggggaccgcgcgatgacctggcagactaccttcccctgtccctgaacgagcgagcggggaagaaggcgaggcagtacgaggcgggacggcgccatgccgccgcccgcctcgccgcatcaggtgggtgtgatgctgagggggggtga

SEQ ID NO: 4234 - DNA, 357 bp, Chlorella protothecoides
atgcgccagctctggtccacgggctggatccaccaccgcggccgcgtggtctgcgcctccttccttgtgaagaacctgctgctgccctggcagtggggcctgaagcacttttgggacaccctcatcgacgccgacctggagtccgacagcctgggctggcagtactgcgccggctgcctgcgcgatggccatgccctgtcccacatggtggacctggcagaggaggccgcgcggtacgaccccggcggcgcccacgtccggcgctggatacccaccctggcacgcctgcccaactcccacatccactcgccctggaccgcgtccccagacctgctggcggccgcaggtgggcgatga

SEQ ID NO: 4235 - DNA, 315 bp, Chlorella protothecoides
atggtgctgacgtgcatcacctacaccatttcggcggccacttccatgaaggcggtggcagagatcgcctgcgcctggcgcggctccacccagtgcttcgacaccatctggcagatggtgctcatctttggggccctgcagctgttcctgtcccaggtcccctccctcgagtcggcctggtgggtgtccgccatgggcgtcttcaccgccatcttctactcctgcatagccctctccctgggcctcaagtactgtgagtggggcctgggttcgctgcagggagggcccagcatgctcgcaacgcctgtgggttga

SEQ ID NO: 4236 - DNA, 1260 bp, Chlorella protothecoides
atgggcatgggtgtgagtcgcagccatccccgtcctgcccacaccttcccggtacctctctcccccaccccccacccctccgacacccacaggctcccccccccggacgtcttccccatcgcggagatgagcgtgcgcctgcacgacggcaccgtggtggacgttcccgacctgggcgtggcccagcagtacaacctgaccctgcacggcctgcccgcgctgcgcgcctgggcggagcgcgaggtggcggcccgccagcgccccgcctgcgcgaccgagaccatgatcagcaacggcgccaaccacgcgctggagatgatgtgcaacgtgttcctggacgcgggggatgcgctggtgctggaggagtaccactaccccgtggtcacggaggggcacacgttgccgcgcggcgtggaggccctgggcgtggccatcgacgcgcagggcatcgtccccgccagcctggaggcggtgctggaggcgcgcgccgcggcgggccgccccgcgcccaagctgctgtacaccaacccggtggcccagaacccgacgggcgcagtggtgacccgcgagcgcatggccgcggtgtaccgcctgtgccgccggtacggcctgctcatcctggaggacgacccctactactacctgcagtacccggccggcccggagcacgtccccggcaccgacctggcgccgggctacctgtccctggacctcgacggccgcgtggtgcgcgtcgacacctttgccaagatgatggcgccggggctgcgcctgggctggatcacgggcccgccgccggtggtcgccaagctgctgtcctgcatctcctactccaccgcggggccctccaccatctcctccgccatcgccctggccgtgctgcgcgcctgggggcccacggggtacgaaacccacatccgcgccatccagcgccactacgcggccaaggccgccgccgtgcatgccgcggcgcagcgccacctcgccggccttgccgactgggagcagccgcgggcgggcatgttcctctggatcacgctgcgcggcatccccgactcggcccgcatctgggaggccatgcgcgaggccaaggtcgtggcggtgccggggggcgcgttgaacgtcagggcgggaacgccagggttcgcatcccccgccatgcgtatctccttctcctacaacacgccggagcaggtggaggagggcctgcgccgcctggcggccgtcatccgctccgagatggggggcgcgccggcctga

SEQ ID NO: 4237 - DNA, 705 bp, Chlorella protothecoides
atgacttggggcattgcattgggtgctggcggccaggagtggttgggccgccccctcacagtgaccaatacctgtcgaggggcttcccattcccagggatccgggaaagaaacatcagctcctgtggagctcgaggatgacgaattcacggacgctgtgacagagaggctggagctcgtatacgatgcgctggacgacgcgctcaccgcttcggccctggatgcggccggcgcgaagaaagaggggcgcatgaccacccgcccggggcaggaggggcctgggcgggcggcccagcccgtctccggcgccctcgcccccagccccacctcccacggacgctggacccccgatggcacgggccccaagtcgcagctggcgttcgaggacggggtggacaacgccaatgcccgggtgatgccaaagtacgatggcctgtctgccgtgccgacgttcgacggcggcggccaggcggccgctgcggcggcggcgctggcggccgaccaacagccgccgcacccgctgcaggccgtactgagcacgctgaggtaccagccatggcagacggaggctgcgccgccccagctccccctgggattcgacacgacgccctacacctttgtggacacgccgcaagggctgcgggagatgggtgagctggtggggtggctcaaggtggggcttgcctcgtttgtgtgcacgtattga

SEQ ID NO: 4238 - DNA, 288 bp, Chlorella protothecoides
atgaagccggcctccatcatctccatctccgcctcctttgccttctacttcaccgtggccgtggccaactactcggcattcggcaacgacgtccccggattcatcttcgacgcctacccgggccccaagtggctggtcctgattggattcatctgtgagcggtgccagggtggggctctcgaaaggggcctgggcatcgacccggctgcgctccctccaagccctctcgctgggacggccacccgtgctgcaccccctccccgcaacgcccccagcccccccccttga

SEQ ID NO: 4239 - DNA, 483 bp, Chlorella protothecoides
atgcgagcatgccagaccacctcgccgcgacgccctggccccgcccaccctgagtccccagccaacaccacgcgtgtgcagctggcgcgcacttgggctccgtgggcggcatcccaacaccacgcgcgtgcagccggcgcgcgcttgggctccgtgggcggcatcgtgaccaacccggcggacaaggcctttggcgtgctgggctcgctgggggccatcgcctttgcctactcctttgccgtcatcttgctggagatccaggacacgctgcgccaggtgggtcgcgggggaagccaggaggaaggctgcagtgccgggcggctggcagcatctccccagccacgctggccgggcctcgacgtcggcggcgctccgggacgccccctccccctgcgccgggcccctcccacaccacacgaagcccaccctcccacccccctctccacactcccctccctgcctcccagccccccaaggctgtga

SEQ ID NO: 4240 - DNA, 1313 bp, Chlorella protothecoides
gatccggggcgtgcatcgacccagaggttcttggcgcatcacatggtgtccttggaggcctacacacctccgtcatgggctgcacacctgcccaacccgcccacccagcgcctgcgccttgcagtgacgcccagcctcctgcatccctggcccctgccgggcctgccgccaggcctcgagctcttcatcaagcgagacgacctgacgggcatgcagcttagcggcaacaaggtgcgctcgcgtgcgtggattgggcggggtggggcgtggaggaagcgggctggcgctgtgcaacggcgcctgcgctcatctttcctcattccgagcctggccgcaccaggtccgaaagctcgagttcctgctggccaaggccaaggcggagggccacgactctgtcatcaccatcggcggcatccaggtttgactgggcaagaaggcggcgctgtgcaggggtggtgccgagtaacggcacacgggcgctgtgactgctgcgcatgccctgctggaggccgtgacgtcatttgtccacatggcagggagcaaccatgcacgggccacggcggtggcggcgcgctactgcggtctggactcccacctcattctgcgcacctcccgcctggcggcggactccgacccggggctggtggggaacctgctggtggagcggctggtgggcgcccacatccacaccgtgaccaaggaggagtacgcggccgccggctcccgcgccctgaccgcccagctggagcgccagctgcgggggcagggcacgaacccttatgtcatcccggtgggcgggtcaaacggcctgggcacctggggctacctgtcctttgtggaggagctgaggggccaggcggcggacctgggcctcacagacatcgtgctggtgggccttggtgggagtttgtgttcagtatgggcgtggaagggggtgggaaagggatgccgtcggctggcggctggcgtctgcgaatcaggagggagtggcctgccgttccctgcagcacggcagaccgtggcgtgccaggggaggggcgagcccttgccataacccgaccagcgtgcgggagcgggagcaccgccgccggcatcgcgcttggcagccacctggcgggccttggcgtgcgggtacacgggtacgccgtgtgcgacagcgaggactacttctacgccttcatcgacgacctgctagaccaggtcgccccggcagaggcgcgcgggggggcgggcgccagggacctcatcaggtgtcttttgggatggtttgggggtgtgggggtgtggggggtggggagggagagggagcagaa

SEQ ID NO: 4241 - DNA, 819 bp, Chlorella protothecoides
  modified_base (660)..(669): a, c, t, g, unknown or other
atgttggcagagcttgatgcatatcgacagatgaatcaagatcctgctgccacaaggcgcaacgccttagctccgccccccttccgcgtagggttagtccttttctctctcgcgaccttgacgaatcagaagatctggccgaagcaatacctctcgctctcctcgggatccgtgatccttagctctagtcaagtcgtggagtcggcatcatgctccatctacgtcctggaccctgcacgcgacctgggaatgcctgcttgcgactattcggacaccgccatctggccgcatgccctcaagaaaaccggtctcggggggagcaccgtgcccctccaacattgggagtaccagtacgcagtccatctctggctggaagaggctgtcatcgacaatggggcccggaccgacaggctgtcccgggcggatctggtgggtgggtgtggaggagggactgggatcaggtgcagggcgatccaggtgcacaggatatgttcagggtgtaaaggagcagtatcattctatcagtatcgccagcttaagcttccaggaatgtctcgtctccttccccaaagccctctcatcgagcaaggcgctcaccccaccctttatccctcgtcatgccccctccatcccagatattcgtcaacatgcattgctatnnnnnnnnnnttcaacacatctctggctggaagaggctattaccaacagtggggcccggaccgacaggctgtcccgggcagatctggtgggtgggtgtggaggagggactgggatcaggtgcagggctacccaggtgcacaggatttcttcagggtgtaa

SEQ ID NO: 4242 - DNA, 705 bp, Chlorella protothecoides
atgcgctcgtcccgctactgcctggtgctggccggggacaaggcttccagccgccgcggcaccgaggcggccctctccggctgcatcccggtgattgtggggccgccctggcacaccttggtcctggccgacgaaatcgaccacgccgcttccagcgttttcatctccgtgcgccacgtgacctgggtggtggccaacacctcgctggccaggtctgacaatcaccccagcgtgctgacggcctggtacctggacaccgacctaccgcccggacaaatgctgcatgtcgacaccctggacgaggtggtggacgtgctgcgcgcgctgccgcccaaggtcctggccgccaagcaggcggcactggcgcgggaggcctacaagcagttcgacaatcgccccggcgtgctgacggactggtacctggacaccgagctgcgccccggagaaatgttgcacgttgacaccctggccgaggttctgggggtgctgcgtggcatgccgcccgaggtgctggctgccaagcaggctgcgctggcgcgggaggcctacaagcagtactggctgccggccccgggggagaccaagtcgcagctcggagagattgtggtgaagaaactgtgtgaccacgcccagacgctcaaggaccgtggcatcattctaccgcaccccaccccgcttcaggggaggaagctgttggccgagtga

SEQ ID NO: 4243 - DNA, 684 bp, Chlorella protothecoides
atggcgcgccacaagtccatggcagcctggacattcctgatgtttgaaggcagctcctctttaaatccccccacctctttacttttacacagaggcgagaggcgtgactgccaaccgcctgcagaacatcgtgatcacgctggacaaggtcaagatggtgctggcagccccgggccagtcccagggcccagcgatctacctgctgtccgatgccgaggtcctggaccacctctggcacgggtgaagaatctggagggagaccgccagctcgttgcgatgttgtgtcaagttgcggtgtcgcagttgctcagcatctcaccagcacccctgcatgacgacctgcgcccaccattccacacacaactcacacaatcccgccagcgccactcgcagacccgggaggacgtggcgaggctggcggccaggcacggcgctgagcttgcgccagagctggtgtgcctgctgggcatcctgctgcgggacgtggccggcgtcgatgaggcccgcgccgcgctttccgatctcgtgcgggagctgcgccgggttgacgtgggtttgggtggcgggttgacggcgctggccgacgtgttgaccctctacgcccggacccgcacctggtttgccccggagaggggctacgtggtgagcgacatgggtttgcggggacttgctcaacgagagaag

SEQ ID NO: 4244 - DNA, 1308 bp, Chlorella protothecoides
  modified_base (166)..(175): a, c, t, g, unknown or other
  modified_base (812)..(821): a, c, t, g, unknown or other
  modified_base (1123)..(1132): a, c, t, g, unknown or other
atgagccacagctgtaccccaaattgccaggccacggtgatggcctgcgatgggcgccttaccatcgcaatgcacaccctgcgccagatcgcagagggtgaggcggcacctgggcatggcagtgaacacgtcactgtgcaggaggaggggaaagatgattgcggtnnnnnnnnnngcaggaggaggggtagcaagttcatcagcattcatatcccctcgtgccattcaatggcccaaggaatgcttgcccaaaagcaagtgcttgcaggacaaatgattgcggccacgccatcaccgcgacgtgcaggcaagccctctgggcggtacagcagagtgggatacactgaatgtgcatcagcagcagcaccttgtggtgcactttgcatggcaaagcatgctgccctaaggcatgtgccagacaaacccctcctccatttcatcgccaccatcaggggctcctacctctactacactggctcccgtgcattccagacggtcatggcagcaaagcacaattttctgcaccgccaggtctgcctcctccgcgccgcctcgcagccattgaccccggacgacgcggcacgtctccgggtgagggggttgtttttggttgtgggagagtctacgatgcctgggatctggagcgagaggatggccctctgcaggaagcatcccagggccaggccaagggaggttggactggccccttgtgctacccgccttcatggccgctggcaattccatcactccctgcctgtcctccacgcgcgcccccgcctcgccgtagcgtcacggactggggtcaagcgcannnnnnnnnnttccatcactccctgcctgtcctccacgcgtgcccccgcctcgccgcagcgtcacggactggggtcgagcgccctgggctgtgcggtgcaggggcagcgagtgcccgcctggttggagaagtgggcggctcttgtgtgcgagtacctggagcaggagcaggcgagcctctgctcggagctgctcaagcatccgctgggcatctacacagaggccacagcaagcgctggtatgttgcctgtttgggagggaaagggggagatggctgctcactggcaggcagggcgggaggcccatgaattcnnnnnnnnnntccgctgggcatctacacagaggccacagcgagcgctggtatgttgcctgttttggggagggaaaggtggagatggctgctcactggcaggcagggcgggaggtgcatcttgggttcaattgttacgggagctgtttggagtcggagaagacttgatcgaagcaggaccctgctga

SEQ ID NO: 4245 - DNA, 1860 bp, Chlorella protothecoides
  modified_base (89)..(115): a, c, t, g, unknown or other
  modified_base (323)..(332): a, c, t, g, unknown or other
  modified_base (1581)..(1590): a, c, t, g, unknown or other
atggccagaactgcaccaccactcatggcctgggcagctacaggtaggctgagggatgggaggacagtgggggagagggacatgcctgnnnnnnnnnnnnnnnnnnnnnnnnnnncccccctgccctgctctgcctgttccgaagcttggagcacgactgcttcaggtctggctgtgcgtgcctggccgccaacacagagtgcgacgacgcttgcggctgtcctgctcaaggtggggcaacagctggtggggcggaacgatgagggtcagagctgggaggggcatgcagggcctcaaagaggttttgtctgcataggggtgcnnnnnnnnnnaggggccggagtcgagtgttgggtctcgctactcaaggagtgtctgggtgcaagatgttcctgggctgtgaccgtcgggaggtgtgtacagacccttgacctacggcaaggccagaggggactgcatcccagtaccctgaagacctcaccccccacaccaccaagtagagtgcttgaatcgagcgatatctcagaggcagacactacagcttggggtggatgtggaagaaagggacgcctggggcatggactgctacacgcgccgcaacatccaagatgcatgatcttcgtggagatgacggtggatgcaaagaggggttcattctgtacacagaagaccatcaactgctgccatctgcatgttcactcgccctactacctggggtggtgctcaggcacatatgtccttgatccacctcctcccacccaatctcctctaatcccagccgtgctggaaagcaaggcatttggccaggccaagagccccgctcagctgccgcacccggacctgtcccaggacggagcggagggtgggggcaagcccttcggcagctcctccaccaccaaggcagccgcggcggccgtggtggcggccaccgcgggcggccatgccgcgggccttgccctcgccacctcgcctgccggtggagaaatcgaggcggagggggtcgggtctgacgccgcgggcgtgctctcccgcgtgcatgcctggatagagggcgtcctgctgccggccatcaccaagcagggccagcatgggtgggacatcgcccttgccctgaatcacatccgtgagcgagatcaaaaagctgtgcctgccagcgctcgggccgccaaggctgtccttgacaggcttgccaagggagggaacgtctcgattcataataacagtcgtgagatgcatgcgcgcggaacaccgcattgcatggcacttatcccccagccccacactcttgccctcccccacgctaccaggtggggtacaattacttcaggctgcaccccaagggcatggggctggtgtgtaaaaggccagccggcctatcccccctcacctttgttgaggagtatctgggggagatccacaccccctggcgatggtttgagatccaggtgcagcgggattggaaggggcgggccctgtttgctcctgagtggcatgtgcctggcgatatgctctgttcttccaagcaaaggaaagagaggaggaccactgggcggcggctgcactggccactgtgaggagcgnnnnnnnnnntgtttgctcctgagtggcatgtgcctggcggcatgctctgttcttccaagcaaaggaaagagtggggaaccactgagcggcggctgcactggccactgtgacgagctgcccgatttctacaacatagtcttggagcggccaaaggacgacgagcaagggtatgatgtcctcttcatcgacgccgcctccaaggtggagcattcgtgcagcacagccgtgcaacggctgacgcatgtggatgtggcaccccgggcagcgcttgcggcatga

SEQ ID NO: 4246 - DNA, 1602 bp, Chlorella protothecoides
  modified_base (7)..(16): a, c, t, g, unknown or other
  modified_base (1237)..(1246): a, c, t, g, unknown or other
atggcgnnnnnnnnnnaggcaccgctcagaggggctgggatgtccatggtttgggggaatgtgtgtttcatgagtgctagacttccctccattcccctgccactccaacccacagacacatcggctccagatcctcatggcagccacaggagggggtcatgtctacaagatggtgcagaaggaggacgctatcaagtaaggctgtggtgcgggaagagtgtcgcgagctgtacagggcgggcttgcagcctgggggggttgcacatcgggaggtcagccaaggaatggtttccggctgcacaacactcgcccactctacaacgcaggctgaaaggattgtcaaccgaggaccacctcctgtaccagtgcatagcaagggctgggaatgtggattccccaggacccactcccttccctccccctctccctgaagggatttggaccaaggacatgaaacgccggaccaacctgtcccagcccaggatcaacaagatcgtgaaatttctggaggagaagggcatgatcaagttcgtgaagagcgtgcagaatgcgtcgcgcaaggtgggaattctggggacagggtgtgttgttcagctggagggaagaaagggccacatggctggcacagggagggaggaacagggaggcagacagtccagattgacttggggtgctcatcctgtcggcgtagggatgaagcgaaaattggtgtcatggcgatcattacgtcacgctgcgtacagtcacttcccatcctccccctcgcagatgtacatgctgtctgagctggagcctgccaaggagatcacaggagggccctggtatggggatgacggcaagctggacgcctccttcatcgtggagatgcaagggggagtcctgcctggccccggtgatgcagctcactgccccctccagcatgtcctttggcaatttcaaaacccatgctcaccgtggaatggactccaacccgtgcaggccgtcatgagcttcatccgccaccagcgggtgtgcactgccatcgaggtcctggagtttgtggaggagaacaagatctgcacgctctccacgcccctgcagcctgacgacatggcactgctgctgaacaatctggtgtatgatggtcagctggaaagcaaggaggatgaggagggagccctcctctaccgaccggtgcggccccggcaggggtggggaaagaaagtgggggtcctgagaacctgcagggctgcaattnnnnnnnnnncgaccggtgcggccccggcaggggtggggatagaaagtggggtcctgagaacctgcagggctgcaaccggcgcgcaatggaatgcctgcattaaatcctgccctagaggtctcgagctcagcccctgtgctcctgcaccccacaggcgctgcatcacggcctggaatcgacccccctcaccgcctgcccctgcggcgtctgccccatcatccatgactgtgtggaggagggccccatctctcccagcacctgcaactactaccgagaatggctggacttttgagtgtcgagccattgtagccgggagatacctgtcctgtagtgggaactgcctccttgagttggaggacaagtga

SEQ ID NO: 4247 - DNA, 936 bp, Chlorella protothecoides
atgcctcgtgccaatggctgtcgagacgacttggtgctcgcggtgtctgcgcgaggcccagggtgcgccttccatgaccaacgagagccaagcatgcagtgcctgctgagggtgtgcgttgcatccttgcgctcccaaactgccggtggtctccaaggcagacacccctcgctcggaaggtgcacagacggaaacaagacagtggttacccaggggcgggggtggcaggcactcattgatgctcctgtggactgcacctcagctcatcctcacgctttcctcccacaggccgtgatcggcactggggccggcggcctagtgaccctgcgtgagctcctgaaggaggggcaccaggcgacggcctttgagcaggcagaggatgtcgggggcgtctgggtgtatacagaggagaccgagaccgatcccctcggccgagacactggtgtgtgtgcgcaggaggccgggacgacccttgctgcccctgcgagggtgtctagcagagggctgtcacataccgctcagcagacaccgcgccacagaccagcgtccccacaattcacaccacaggaaggaggcaggtgcacagcagcatgtacgcaggactgcgaaccaacttgccgcgtgaggtcatgggctttggccactaccccttcaccaccacattcccagggtcggcggaccctcggcagtttcccacccatgatgaggaggtatctggccgcctatgcggcagagtttggtctggagccccacatcagatttgactccagggtgacccaagtcaggcaggaggaggcctcaaatggggaagctggcgcgccaccacgctggagggtgtcgactgcgtcttcgaaaagccaagcaggggctggtgtgggcaagcaggaggagcgccaggagacctttgatgccgtggtcgtctgcagcggtgggtga

SEQ ID NO: 4248 - DNA, 792 bp, Chlorella protothecoides
atgtgcaacctttgctatagagggttcctgcttcttgacattaaagttcgctacagctacacctaccctttcctggagccgggccatgtgaccgtcgatgacgtgagggtgcggcccctgtacaagcacctgttccctcccgctgacgcgccacggctgtcctttgtcggcctctgcttcaagattgcgcccttcattcagtccgagctccaggcccgctggatagctcggagtctctcgggccgggcgcggacgcttccatctgtcgaggtgaaaatatactgccagggagggaaggctgaagttacagcaaaagcttgcattttaagatgccgatatgcacctcaaagcgaggtccatgcccagccctcacccaacatttgcctgccgtcctgccaggaaatggagagggacgtgcaagcatttgatgcagcgctggaggcggaggggatccccccccgcttcacgcaccgctgccagggggcattgggtaaaagtgcggagcgacctcagagcagcgtcacgctttgcagaggcctcctcttcttacatagcaaggcagcacatcagatttgtcacccagcaagccctttcacgtcgcgctcagggcccatagttgggagctggcgggaagaggtcttcaacgccactgggaagctgaggacggacttccccgagacctaccgcaatgtgggagtgggcggcggcgacaagtgggcccttgccgccgcggtcgaggctcaagccctgagcgagtgggaggaggggggcaggaaacctctaggagagtga

SEQ ID NO: 4249 - DNA, 2160 bp, Chlorella protothecoides
  modified_base (297)..(306): a, c, t, g, unknown or other
  modified_base (401)..(410): a, c, t, g, unknown or other
  modified_base (493)..(554): a, c, t, g, unknown or other
atggctgtacaggtggggcaatactgcatgcaaggctcgcctgctgggtggaggggctgtattttgctgcattacacaagcaaggttctcatagactttgggctcagccagaactcatccctgcccgaggacaagggggtggatctgtatgtcctggaacgtgccttcttgagcgcccacgcagagaagggtccagagctggtgagcatcgcggatggggtgagggagggggacgtgggtgggagtgtgtatggccggtcaatggtccccgccccagacaatcacccggaggccacnnnnnnnnnnaaccgatttgcggaaggtgagggagggggaggtgggtgcgagtgtgtatggccggtcaaaggtccttgccccagacgatcacccggaggccaagnnnnnnnnnnccagcacttccctggtgatgggaggcccgccagctgcagacgcatgctgttcatgtctcaacccttctggagcgcgacgctgnnnnnnnnnnnnnnnnnnnnnnnnnnnnnnnnnnnnnnnnnnnnnnnnnnnnnnnnnnnnnngggaacgatcctaccgcctccaccacacagtccgcgcgaggggccgcaagcgggccatggtgggctagcttgtgcggaaagaagcacctcgaaggctcctgcgaaatcgtcgcttagaaggcgggccgctgtgtggtttacgagaacccttcaactccttcccgcccctatgccccgatctgggcttcatgggcggcagccgactcgttcccggacttgggagggagttcctgtgccggcttcatgccgctgcacaaattatcacatgcgtcgaattctagctgtgatcttggctttcccttcacaatgcccttgcgcgggggtaaggcgtacatcagcacaagcatttgcccttgctcaggagaacgccatggagcccggctggttgcgccgaacccgtatcggcgtgcttgccgccctgtgcatttgcagcctcttcggtcacgcccgagcagcgctggaggacggactggggccaagtgacccttgcccggcatttgccacctcgcccgcccccgctcacgcgatccccgcgccctggcaggacgacccgtgcaccgccttcccagtgacacttaatgtgtcagactacgagatggggtggggaggggagctcatgctcaacctcaccagccctgtttggcacccaaggggacccatggccgaaagcctgcacaccctctccccaccccaggccggacctgatctgctgaaacatgctcaaatatgggtacggacctcggtcaacacctcggaccaggcctccttgttgccagtggtgcgtagcgccgtgatctcaatctgcctgtgcctgacttccatggcctgcaacatcgttggaggcagtggcttggaaacctgctcagggcaggaccctcggtgccccagccggcttatatcccaccatctgaccagccccaccactttgacccccaccatctcacacctccccatcccacaaataaaacctcaggtggcggccgaccacgcatggcggcggctgctgggccggaccgaccggcggtggcacctgccgttcccgccccctgcccccctggacgtcatcctgtaccggaccgcctgcccgcccatcttcgcggctgcggcaatcttggggccgggcagcggcgcggtgctggaccaggccccacgggctggcctggccacatcctcccaggctggccggcagcgcgtggacctcgcccaggcagccgcctcgcccgaacagggcgcggcagacccgccctcggaggtggccctcctgctgccgccgccatcccctacggcgtcggagcagagccccgccctggcgtcgccggagggcggtgggagcgaggggcaatcgccgccgaccccggcggccgcgacggccgcgggggcgccggcctcggaccccggcaccaaccagacgctgtacattgcgctgggcgccggcattggcggcgccctggtgctgggcaccggtgagtgggggggagtgaagggctgggcatttggacaggttgcaccttcccatgccagcgttcaaccaggaggaacgaggccttggattgcaccattgctgtatgttgtgacaagccttaggccacggccctcacaactctaa

SEQ ID NO: 4250 - DNA, 591 bp, Chlorella protothecoides
atgcccaaggggaagaggcaacggaagtttgaggcgaagcacctgcagggcaccattaagcgccggaagcacctgcagagtgtgaatcgcaagcgggaccttccagcctctgcagcaggtgcgacgtcccttgagctggggcacggaccggaccccaagccagctgaggagaagaatgtcgaggagcttgatatcgacgagttcctgtccggagatttcctgcccgaaggcagggcggaggagatgagcgaaggtgactcatccagcagcggcagcgaggctggggacttgaatgcagccgcatctgaatccgatgaggaggaggaaaaggtcgctcctgctgcgactgcggccttggaggaggcagatgagagctcgagcgatgaggaggccgacgacggcactggtctggctgcttcctcggctaagctcacgaatgcggttgcctcccacaaggcggagctggaggctctgcgggagaaggaccctgagttttacaagtatctccaggtgaccgggggttgggtgttcttggcagcatctccaggaccgaggccaacaatggagggtcggagggggttcaaagcttga

SEQ ID NO: 4251 - DNA, 2115 bp, Chlorella protothecoides
atgctggcgtacatcctgcgccgggcgcgcgcctccgtagtgttcctggcgccgtacgagaagatccggcgccgctctctgaaggccgcgctggggctgtttggcagcgcggacgcggccgccagggtgcaggccgtgctctttgtgcgcggcgcggcgctggcgctgggggggtctacactggacgcctgcctcaagggagtggcgcgcgcctttgccgccaacgccaagtttgtcaacgcctcctccctgccggccatcgacttcatgggggccgcggtggtggagctgtacagcatcgacccaggggatttggccattcgacgtatcagatcgccaccttcccgtcggcggtcggtggcacgagacagcatgccgcaccccaccatcttcccgccaccaatgccccatctctccctgcaacattcccctgcagccgcgtcttaccagcacgcctttgaggccatccgcgcgctggcggtgctgctgcgcggcgcgctttccaccaaatccaaggatgcgtaccgcgaggtgtactgctggcagaccgtcaactgcatagagctctgggcgcgcgtgctggccgccgccgccacccgcgcggcgcaggggaaaggcggcgcgggggccaacgacctggctgcgctttcttacccggtcgcccagctggcgctgggcgtggccggcctgctgccgacgccctcctactttcccctgcgcctgcgctgcgtgcgcgcgctgtgcgcgctgagcgcggcgtccggggcattcgtccccgtcgcccccctactcctggagatcctggcctggccggagcttgcccggccggcagggagggggggcgactccggtttcgaccctgccctggtgctgagggcgcccaagaccctgctccgcgacgcggccttccaggaggagatcgtggcgcagaccttggagctgctgacgcagcacctggcacagtgggcgtgccacgtctccttcccggagctggcgcacctcaccaccgtctccctgcgcaggttcgtcaagaactgccccgtcgaccgcttcaggttgggggggttgggggacttgggccggccagtcgagcctccatacgaatgtgcaagcactggcaaaactgggcctggcagcatcggcttcatccaatgcaacgggcagcccagctcccacagcccttcagcgctccagacccaacgagcaacaccacatcatctgctggcacccttgatcactcacacgcgcaggcggagcgggaagcagctgatcgatgcgatcgaccgcaacgtggcctttgtcgggcgagcccgcgatgccgtggagttcagccccaaggacatcacgcaggtggccgccttcctttctacggaggccgccgccaagtctgcgcccctgcagcagtacgcgcgcgtgctggccgccaaggccgccgagcgtgcggccctccgccgcagcgacgacgtcgtgatcggccggcggaagggcggggacggcagcgacgaggacgacgacgggccggctgcggaggaggaggcggaggtggctgtgccgaggggcagcctgctgccaactccggccaagccgaggagcgacgaggaggacgaggaggaggcggcggcgacaaacgctggtgcctccaacggcgtcgacgatctggtgcacgagtacgccctgtcttctgatgacgaggaggaggagggcgctggcaggcggtcacgcccgtcggctcaggccgcagactgtggggctgaggaggaggaggaggagagcgcgtccgacgaggagagcggatcggaggacggccgtgccgccgccagcgacgacgacagcgaagcaagcgacggcgaggagcatgcgctggcttcaggaggcagagggcgcggcagaggcaggggagatggccgcggcaggggccggggagagggccgtggtggaggcaggggagagggccgaggccgaggtaggggagagaggagcgatggcgggcggggccgtggaggtaggggaggctttggacggggtagcccaggcggcaggagaggtggcggcggcggcaggagaggtggcggcggcggcaggagaggtggcggcggcaggagaggccggttttag

SEQ ID NO: 4252 - DNA, 381 bp, Chlorella protothecoides
atgcgccatctggcgcaggcgtacagggctgcctgtcactacggcgacagcgacgaggcgggggaggcggggctgcagatcgcatcctctgccctcttcaaccgcatcatgctcttcatgctggtgcgtgcccgtcgggcgtgggaggagggtgggcggcagccctaccaccacaatcggtcccctgcaccacccatccctcgtcggcccatccccatcatgctcctgcagaaagaggctgacggggtgttcaggaggctgttgggtgtggatgccacctccaccctgcgccctgcctccctcaccaagctcccccgctggaagaaggtggagcccctcatcaagtcgtacctgggcaacaccctgcacctcttaggttga

SEQ ID NO: 4253 - DNA, 696 bp, Chlorella protothecoides
atggatcgccagcaggtctacctgcaggagaccgcatcacgtcgccctgatctggcagaggatctcaccacactaggagagctctatcataagaagctgtggcatgagctgtcggtgaagctggaggagctgatcaacacccctcgccttcaggaggacggggtgctgatcgccctctaccaaaacttcatcgccagctttgcgccgcacatcaacctgctgaagctggcattgtttgccgttgcagcttccaagcagatcaagaaccccgacgtgaggaccgtgggagtgctgggcagggtctcgaggagtttggcctggggtgaggctggccacgaggagggatgctggtgctttcaccccagaaaggtttccttatatcaggccatcccatcttatggagccccttcccctccacaccattgccacgtaccacaggagggcgtagctttcctgcaggatgtcattaccgggctggaaaacctgaagctggctgccgcggtacagcccatcctgtacctcaagatgcacgtcgcgcagtatgaccaggcggcggggcgctgggaggaggcgaacaaggccctggaggcaggggagaagcagctgcaaggcctacaagagaggcaaaatctggaggcgaagcccactgcattcctttgcgccaaccaccaatccctcctcgcctggctgcgatag

SEQ ID NO: 4254 - DNA, 411 bp, Chlorella protothecoides
atgacggcctcggccagtcgcggcacgtacctggccgaagtgcgacaagccatcacgcaggcgctgtgcctgatggactacccctcaccccatgtggaaggacataataagcccgtcatcgaggtggagggcccgggccacgccctcatcgccgcgcccatcgttcttacccgcggcgcccaggagggatgcctggtggagcattccatcaactcctctcgcatctccctgaggttcaaggcccaggacgaggtagagaggtgcatcatcgacacccacctgaagttcctcatgcacagagcgacaatggggagtacggccaacctggtgaactctcgcgctcgcgcgcacagtgtacctcgacattgcttctcagaatcatgcaaggcatgctctaaaattgctatatga

SEQ ID NO: 4255 - DNA, 543 bp, Chlorella protothecoides
atgagtcatcacaaggcccagcaacagtacggcgacttctacaaggctgccctgttgtaccttgcgcatgtgcggcaggagaccctgccagccgacacgcgactggccttggcggtggatgtatcactggccgcactccttggcaagacggtgtacagctttggggagctgctcctccaccccatccacgagcggcagctgcgggagaagatcaccatcctgtccctgaccgagatggtgagcagcctgcctgcagaggaccgcaccctgaccctggaggccatcgggcagcgcaccaagctgcccttggacggcgtcgagttcctgctcatgaaggcgctgagcctgcacctgctggagggggtcatcgaccaggtggctggcaccgtgcaggtgtcctgggtgcagccacgggtgctgaccatggaccaggtgcagcggctgaaggggcggctggatgcctgggtgggccaggtggcgggggtgcagctgagcctgcaggaggcggcggtgggcctggtgccagctaccgtggatgcctga

SEQ ID NO: 4256 - DNA, 1596 bp, Chlorella protothecoides
atgctccggatctggtccaggcttgcgatgcccggggacaggccgccgtgcacacaaaacacggagttgtcaatgagcgccgccaggctgcgcggcagacagggcgcagtggggcgaggtcggggagtgggcagtgtggtgggcagacggtacgaatacgcggccacaccagaggctgccagggtttcacggccccaggagcctgacgggaaggaaggccccgtgccctgcctggccccggtcaaggactggcccgactcattcaggcagtgcgctgcactggcaagggaacgcgccgcacctgaggtagtcgaagacgtctgtgcagtaccgccagacgttggcggagccgtacttgcgcagacactcgtcatagaagccgtagacctgtgtgatctgcctgctctcgtggtttccccgaatcaggaacatgcggtccggataccgcacctgtggcgcaggggacacgtgtgcacgcgggtttgcggggttgggtgtgcgacgtgccgaggcggcgcgtgcgctgggggctgtcggcactcccaggggtggcggctggcctcgagccctcccccgaggagggccagccccatgaacccgcacccaagcacacaccttgagggtcagcaggaggagaaaggtctctacgctgtggaatcccctgtccacgaaatcgcccatgaagaggtagtttgtctgcgcggaggggggagagggaggtcgccaacagccctatcattgcgtggcacagggaatgaggtggacagcatgcgtgggacagggatggatggtcaggcgctggcagtgagcactcccaccaccgacctggtgactcttggtgttcctcccaccttcgctagactcacatatcgtgactggggcctctatgggctcgcatcttttcagctgcacgatccaggcatccaagtccattcagtctctgggttggggagcgagcagaccccgctggaggtctgcgagtacgccccccaaggcgcagcgatcgcctctcgcccccgagcgtcaccgctcaagccgacatgtgtaacggagcctcggcacctcccgatcaccgggggcaggcaggatgaaggtgcgacatcatgggcacgtaattttcacagtatcctcgtatgtgctccagggccgaaccatgaattgtttaggagtggtagtgccagaatctgcagatcagacggaccgcattgccctccaattttcgagtgtccaatcaacccttaccttcaatcaacaagcatgaatgccttcaagttgacttgggagagcattcgagctaatgcggcctcaaatgcggatttgacgtgccgactgatcagcatatctaggcttcgcgtacttttgcaaagtgagattcgaacttataagaagaatatagcagaccgcattattgcctctcggtccacagcattgctattttacagcctcgagttgaacagatgtgctccagggccgaaccatgaagtgtttgggagtggtagtaccagaatctgcagatcaggcggaccgcattgccctccaattttcgagagtccaatcaacccttaccgtcaatcaacaagcatgaatgccttctag

SEQ ID NO: 4257 - DNA, 570 bp, Chlorella protothecoides
  modified_base (173)..(182): a, c, t, g, unknown or other
atgtatgctgcgggtccagggcatgggggaggatgcgagatggggcggtgcgcgcgtggaagcgggcatgtgcgcgcctgggcctctgcatcccaggctggagctcctgccgacactccctcccccctccccaccgcgcatccatcccccaggtggacctcatcgcccgagcnnnnnnnnnncaatgtatgctgcgggttcagggcatggggggggatgcgagacggggcggtgcgcgcgttggagcgggcatgtgcgcgcctgggccactgtatcccaggctggagctcctgccgacgctccctcccgcctccccaccgcgcatgcatcccccaggtggacctcatcgcccgagcgcaccagctggtgatggagggctacaagaccatgttcgattccaagctggtcaccgtgtggtcggcccccaactactgcttccgctgcggcaacgtggctgccatcctctccttcgacgaggccctggagcaggagttccgggtgtttgaggcggcggagggggaggcccgtggagtgcctggcaagcaggctgcgccagactacttcctctga

SEQ ID NO: 4258 - DNA, 1068 bp, Chlorella protothecoides
atgaactctccatgtacagcacgcggtggacagagggatggccgatcagttggtgcgctgcgctcgcctggacaagcagctgagggagctgagtgcttcatgcacgatttttcatccagatgctcggggactgagggcgatccttcgggacggcggaaaggcgtggaccgcttgctgtggagtgcggtcttttacaagcccatcgaagaattccgacgcagattgacctgcggggctcaagacgatgtgacagagaaggtgcaggtcgctggggaggccttcctggacgaggcctatgtgttctacgtcctcctggcctccaagatacagcgcgtgtatggaagcgtgggtctggtgcagagcctggggccggaggacgaagccctcgtggagctcgccggcgcgccacgaggggagcacagcgctagcccccacgccgatgtggaggcggcggtgtgccactgccacgtcgccatgggggacctgctcaggtacaagtcgaccatgcgcaccgctggcgaggtggactgggaggccatagagcgcgcgtatcagacggcggcctccatccacgctgcctcgggggcgcccttcaaccagcttgctgtgctcgcgacctgtcgaccagccccccgtgacccgcttggcgccatgtacaactacctcaggtgggtccggcaattggctggggacacggcccactttcgaggacctccaccccgctatgcacatggcggtcctcatcgctgtgggaggcggtgtgcattacgcagggcaatgggtgcaaccagacccttccctcagtcgcgagccaacctggtgtccctgctgagacagctgaggagggagactgatctttcagcatgccctgatgtcgtcagccgagccaagctcaggtgggaaggcaatcccttttccaagcatggggtggggtggtggggggctcaagctttgaggacgcctgtggcaaccatgctcggccatggcactcccttgcaagctgccatgcaccctcgagggcacgcagcagctgcggcacctgcaatgcagctcggatgcttgctgtag

SEQ ID NO: 4259 - DNA, 585 bp, Chlorella protothecoides
  modified_base (534)..(543): a, c, t, g, unknown or other
atggtgcgccaggccaacccgtttggccctggcctggactcgttcttcggcaccaggacgcgaggtcgaggcagggctggatcatccgcgcgcataatgcagctcggcctcttgctataccatcagatcgctatgttggagaacaaaccacctgtcacgatggcgctggtagccttgcaagtcctgctgcacctccgacctgacggattcgaaggtctgccgtccattgcatccgcctgcctccagccgcacgccatgctcttcaatgtgaggctgctgccgggggatctctgcgctgcctggagtctggcctgtgtcctcaaaggggtggtgggcctgcccatgtccctgaccatgtccacctcatcctcagggcgaatggagccggctattatgggctcccttgctccatgccgacgaggcacacctgttttacaacatgtcctccttcatctggaaggtgcacctgtgaggggtgatggggctgcactcttggggtgcatggagctctgggcccgggtgcgcatgaggtcnnnnnnnnnnacatgtcctccttcatctggaaggtgcacccgtgaggggtga

SEQ ID NO: 4260 - DNA, 2241 bp, Chlorella protothecoides
  modified_base (339)..(348): a, c, t, g, unknown or other
  modified_base (1278)..(1287): a, c, t, g, unknown or other
  modified_base (1646)..(1655): a, c, t, g, unknown or other
  modified_base (2001)..(2010): a, c, t, g, unknown or other
atgacactcttctactctctgccctcagggtctcggcctggaccccagctcgcggtgagagcctccaagggcgacacccccgacgacatcccagagtacttccgtactgagcaggcgacgaagcctgttacccaagagcaacagtaccaatcggtgtcgtcgacctaccgtccagcccctggaccccagtcgagtgctggatctcagatccctcccctggtctgggtgggagtcggtgagttggttgttcgtggggtagagcagcagcacgcccgtatgctgggtgtagcggcaatcttgccatcccgctcaaacccacaggcgtcgtggtggccaccnnnnnnnnnngctgggaccctgccatcctcgccggccgttttgttgacaacctgcattgcaagtcgtgccccagctgggtgtagcggcaatcttgtcctcccactcaaacccacaggcgtcgtggtggccaccctggtcaagcccgtgctcaacttcttcaccggcggcccagccaagctgcagcagctggccatggagcaggccatgaagcagatgatgaagcaggccggcaatggccagggcgccagcccctttggccccgccggcagcccctttggcgccggcccggccagcccctttggggcgggggccggcggcatgccggcaggcttcccctccttccccaccatgccccccaccccagcccctgcggcgcccaagaccgtcgacaccacggccaccaccagtcagactgccagcaccgcaacccctccggcgccggcgaccagcgatgcgcctgcgccgaagcgcgcagcattcgtggacgtgaccccctctgccgccgcgggtcgagaggtggactcctcggagatctcggacctgaggcctggtgccgagaccggtgcggtgcccagcggcagcgccggggccgaggccggggtggcggccggccaaggcccctccagttcggcaggcgcgggccccagcggcgagtctgtggtggacatgctgcggaacccggagatgcagaagacgttgtacccctacctcccggagcacatgcggaacccgcagactttcgagttcatgctttccaacccggagtctcgcgcgcagctggagcagatgatgtcgcagcaggtgggtgttgtgattggggagagtcaggcatctgttcttgcacttacgggggccctaggtgacatggtggctagctcacgagtcccctggtacgtgcgccccgattacccactcccccacaccccccatcacactttnnnnnnnnnncacggaggcactaggtgtcttggtggccagctcacgagtcccctgatggaggtggcggggacgccggagatgaaggacatgatggcctctatggactcggagaaaatgtccaagcagtttgacgcgctgggcatgacgcctgagcagatgatgcagaaggtgatgtctgaccccgagctggcgacgatgatgaccaagcccaatgtcatgacagcgctgatggagatgaacaagaatcccatggccatgttcaaataccagtcggacccagaggtgcggcgcagggcgtgtggggggggtgggtcgcggcaggcctgtcgccctgcgcggggtagatgcgcggtctccagtgtcttgcnnnnnnnnnntgggggggtgggcggcggcaggcctttcgccctgcgaggggtagatgcgcggtctccagtgtcttgcagaggacatatggacggtacagggccgacgtttgcgagccgcccatgtctcgagacccttgctcaaggcacggagtcgttccatcaagcactgacacactgccctgagcctgtgccaagtttgactgatggatcggacccggtagattcggggtgggtgcggggcgcgcacgagaacagcagcggccttgtgatttcagggtacgctgctccctctctgtgcatcggcatgcctggccgtgtgggtagtaacaagctcagcacaggacatctgccaggnnnnnnnnnnatttccgggtgggtgcgaggcgcgcacgagaacagcagcagccttgtgatttcaaaatacgctgctccctctctgtgtagcagcatatctggccgtgtgggtactaacaagctcagcacaggacatctgccaggggcagacgacattctcaaaaataacctaggtgccgtgggggatggaggtggccatgtcaccagcagaccggcatcgaaagcgcaacgggggaagtga

SEQ ID NO: 4261 - DNA, 735 bp, Chlorella protothecoides
atgccgcacccatccacatcttcaagtgctgtggaggacaagcagctctttattctcgccctctgtgacgagttcacggggaccgcgttgcgacccgcgacggagtctgacctggccggcatagattcccctgcctccagccctccgcccatgccccggcacagcgctgcacagcaccgatccatgtccctccaggagattctggcatcgcgggctgcgttcggggggccctcctgctctcactgcggagtcacgggtgggtgccctggagctgggtcaggaggggtggggatggtgtcatcccgggccaccaagcctcacacgcgccccactccccaattcgcagagtccccccagtggcggcgtggacctgcacacaagcccctgctctgcaatgcttgcgggacgcgctacaggtgggacttgctggtacaaccctgcgttgaatggatgcccgcggcctgtgctggctcgctccttcatcgctgttggcatgtttttcacatcggccacctgctcctctaccccacgcaggcggaccaatcagttcctgcccctccacgccacgccggggtcacgcaagcgggccaccagcgccccacagacatgcgcgcaagagaacgccctggaggacaaggcgcacacgggcttcaagcagccgcggttgattgccagcacggcctgaggaggatcccgctttccgttccccacctgccatgctcaggggctgtttga

SEQ ID NO: 4262 - DNA, 1956 bp, Chlorella protothecoides
  modified_base (455)..(464): a, c, t, g, unknown or other
  modified_base (1459)..(1468): a, c, t, g, unknown or other
atgcctcccccctctccccccctttcacaggagtgggacgcgacggtgctggagctgcaccagctgcgcacctcgctgcacaagacacggcaggagctgtcgcatgcgctgtaccagcacgacgcggcgacgcgcgtgatcgcgcgcctgctgcaggagcgcgacggctatcgcgcggccgccgaggccgccgctgctacgcgcgcggccgcgcccgccgacgccaatggcaagcgcggcgcggaggcggacggcggtgaggacggcggcgacgccaagaaggccaagggcggcgtgacggcgcgggtggtggaggcgctgacggcggcgtcggacgagctgtcgcgggggcgcaagaagcgggtcgtgccgccgagcaccgccaccccggaggagcggcgacctggcggccaccgcgggcgccgacggctgcgtgcaggtgtacgacgtggcgnnnnnnnnnngggcagcggcgacctggcggccaccgcgggggcggacggctgcgtgcaggtgtacgacgtgacaggagcgcgcagcgtggcggagctggcggggcactccaagcgcgtgaacgacgtgcgcttcctgggcagcgccgacctgctggcctccgcctccgcggaccgcacggtgcgcctgtggcgccgcggcgaggccgagggcgactacgcggccgccgccacgctggccgaccaggcgggcgaggtcgtggccctggtggtgcacccctccaacgactacctggtggcggccgccgccgatgggacctgggccttctacgacgtcgcccaggccctgtgcctgaccaaggtggccgacgagggggccgcctactccgcggcggccctccaccccgacggcctcatcctgagcacggggacggagggcgcggcggtgaagatctgggaaacgcgcacgcagaaggtgcagtactggcgttttgtggggtggggccctgggtctgggagtgggtgtgcgggatgggggccggaagggggacagggcgggaagcatgatgatgcgattcctggcgccgcgtggggactttctcgcgtcgaacgaggctggatgcgcagtgattgctgttgtggggcggagagactcatgagacgatgcgctgcgggaagtcactgggaatgtggccaacttcgaggggcacactggccgcatcaactcgctgtctttctccgagaacggctactacatggcatccgccgccacagacggcgtccggatctgggacctccgcaagctcaagaccatcaggtgggtgggtgtgttgggggtcctggaggaggccggcctgaaggaggggagggggcgtgcaggaatcttagccgcaacgctgcctgtgtgggcatccctcacccgccacatcacgctcacgcgctcgccaggactctgaatctcttctctgagggaaccccaaccaccgccgtcgcgttcgactactctnnnnnnnnnngcaggaatcttagccgcaacgctgcctgtgcgggcctccctcacccgccacatcacgcccacacgctcgccaggactctgaacctcttctctgagggcaccccaaccaccgccgtcgcgtttgactactccggcctcttcctcggggtcggagggtccgatgtgcgagtggtgggagctaagcaggactgggctgagctggcgacactcaccggcttccccaagaaggtgtgcggagctggctggagcagggtgggagaggggttgggaacgctgctttctctcaggccagaatgcaatgcaggtggtggaccccttccatgcaccgactcccaaccccaccttgccctcccctgccgttgtccgattaagccattgtaccgtccctctcaacctgcgcagggcgtgtcctcactgcgattcggaacagacgccaagcgtctgctggtgggcgcctcagaccacaacctgcgtgtgtttgatgtctga

SEQ ID NO: 4263 - DNA, 2190 bp, Chlorella protothecoides
  modified_base (1087)..(1155): a, c, t, g, unknown or other
  modified_base (1401)..(1410): a, c, t, g, unknown or other
  modified_base (1934)..(2009): a, c, t, g, unknown or other
atggatcctcagcgtgcgtgtggatcggccgctcggcgcattgcgcgcgaccagatggcgcaggccatggcccgactgccagagccgggttcctggtggggcctgcaccagggcgcatcgtgtcccagcccgccccagacctccccatggaggcatagttcccgggagaaggagcatgaaatgcctccatccattggtttagacctatcaggcgatctcccaggacgtggcgatctcgtgatgggcatcgggtactccgggtacgggatcaccggctcccggcatgtcgacagcatattgcaaggggaccttgctgtcccatttcaccaccgggcccgaaagacctttgctcacccttggcccctcactcatcctggtggtctttggcgagaattgggcatcgatttgggagcgcctgccgcttcactgctgtctacttggagacacttcacctcagtccagcctcaagatcttgccccccttgtgtgcccggcttcggaaggacagcgtgcttacacacacgtaacatcaccagcagccctggccaggcatctagttggaggcgcggacgaggttgttgatgaagtgctcgcggttgccggcctggccgccctcgatgaagtgcaggcgcttgtgggagagcccgcccttggccgcagacagcttgaagggccagaggaagttgttcgcctgcttgaaggccgggcccacggtgaagatctcgtgaatcaggtcctccacgcagatgatgttgtgcttgccgagcacgccctccaccacggagttgtcggtgagcgggatgcggttgccgttgaccttgccatgtccgcgcttgtagatcagctcgcgcaccgacttcaggttggggtagccgaaggcgacatagggctccacgcgctgcagcatgctcagcgtggccttgttcaccttcaggaagacggcgttgttgatctggcgcaggcgcaggagctgcaggatcttcttggtcttgggcgcgatgtcgttcacaccgcggatgcgtaccaccagcagcagcttggcctcgggctcgacgtagaagccggacttggccttggcctcgcgcttnnnnnnnnnnnnnnnnnnnnnnnnnnnnnnnnnnnnnnnnnnnnnnnnnnnnnnnnnnnnnnnnnnnnncgggccacgggggacctgatcaatcccgagggtcaaatgcacacctccctgatggagacatgcccgatagtcggtgctgcccagggaaagccgccagaccatgtgctgggaaccatcctcgccccagatggccatgcttgttctccagcacgatgccatgggtcacgatgcaccctctccaacagatgtggatcatctgctagcatccacaccacaggacagctgcctgcaatccctggcagccgnnnnnnnnnnggccatgcttgttctccagcacgatgccataggtcacgattcaccctctccaacagatgtggatcatttgctagcatccacaccacaggacggctgcctgcaatccatggcagccatccctcgcaatcctccccggccaacgccacgccttcctgctcgtacctgggagcggtactccttgacatactgctcggcgcgcttgaagatctccgagcggttagcacgggccttcttctgagcctgtggtgggattttggacggaggcgggggtcgagcgaagtgtccacccctcgcacggccactggcactgcacgctggcgagccccatccctcaccgcgacggtggcagcagccttcttctccgcccactgctcgtccctcttcctcttcttcctgcacgcggtatttgggggggagtccaatcagtatcaccgccgcgacggacagcgaccaggcatcgcgagggggggccggctgcgccactcacaggatggactcgggcactggtgcgggcggcatggtgnnnnnnnnnnnnnnnnnnnnnnnnnnnnnnnnnnnnnnnnnnnnnnnnnnnnnnnnnnnnnnnnnnnnnnnnnnnnggcttccgcgagtcctttgacgggggtcccggcggcagcagtaagtgggggcatgggcattttgaccctgtttccccaaaacccatcgcggcaggccagtgccgagcagattgcaggggaagggaggtgtcgctaccaggggcctggctttcgacggacaccctcttgcaaccctttgtag

SEQ ID NO: 4264 - DNA, 1635 bp, Chlorella protothecoides
atgcctccatggggaggtctggggcgggctgggacacgatgcgccctggtgcaggccccaccaggaacccggctctggcagtcgggccatggcctgcgccatctggtcgcgcgcaatgcgccgagcggccgatccacacgcacgctgaggatccatgctagtgaaaatggtggcgatcccatccttcctcctgtcggcaagggagcgccgggcctggtcagagtggtcctcaagggcgccctcaagtacgcgcatgcatggatttaccccaggacaactggggatttgcctggccttcatcgcatgtttcccacgtcttggtccccagcgctgggccccatcttagcactccatgccccctcccacccacccacctctgaatccagaatcctggggtcggtggtgctgttttccagcctggtgctgggctccgccccctacctcctgtcaaccaagttcggtctggagacggcgctgttcgcggccaatgtggccatgcccgccacgctcagcgtggacggggtgtctgccggctggggcaggccgctgtccatccatggcattgtgctgtccgaggagtggcgcagcgcggggcccaggcaggaccggcaggccggggaggagaccgggctggccccgccgggcgcgcagcgccccctgctccagatcgagcgcgtgacctcgagcgccccactccactccctgctgaccagccgcgccccgctcacgctgacggtgcaccgcccggtcgcggacgcgacgctggggccagacggcacgctgcgcctgctgggcctgctggagcgctgcggcctgctgcgctcccccgcccccctgcaggcggtggcccccgccgaactgctgtgcggcgcgggggagggcaaggcgacccgcgccaccgccgacctgaaggagcgggtcgtgctggcccgggcgctgggtggggcgccggccgcgcaggccgactcggcaggggaccaggctcaccagcacgatccggaggcggcggaggactcggcaggggaccaggctcagcagcacgatccggaggcggcggaggtgaaggccgccgcctttggctggcgcgaggccacgcgccgcttccggctgccggcgctcgaggaggagagcagcgcggggcgcgggtcggagcgccggccgttgatcctggtgcggccagagggcgcggccgcccccgcgccgcacgcctgggaggaggagccggcaaataaaccgctgtcattgcgcgagctggcggtgcggctgtggcgcgggcgggagggccgagcgcagcgcgaggcgcgcgcgcggcggtcgcgcggcgcggtgcccccggcgctccagcgcgccgacgcggccgtggccttctccggcgagctggtcacgccctgggtgcactgcctgaccgccgacggcgcgctcaacctacccctcgccttcaaggaggctgccggcgagcacgtgcacatggaggtgctgcagggcctggccgcgctggaggaggccggaaaggatggcgtgggcgaggacctggcctgggcgcagcgcaggccccagatggtgctcccccttgcggcgggtgggggtggtgggggtgctgctgggggtcgaggtgttgagcgggggagtttgtga

SEQ ID NO: 4265 - DNA, 354 bp, Chlorella protothecoides
atgctgcagcgcgtggagccctatgtcgccttcggctaccccaacctgaagtcggtgcgcgagctgatctacaagcgcggacatggcaaggtcaacggcaaccgcatcccgctcaccgacaactccgtggtggagggcgtgctcggcaagcacaacatcatctgcgtggaggacctgattcacgagatcttcaccgtgggcccggccttcaagcaggcgaacaacttcctctggcccttcaagctgtctgcggccaagggcgggctctcccacaagcgcctgcacttcatcgagggcggccaggccggcaaccgcgagcacttcatcaacaacctcgtccgcgcctccaactag

SEQ ID NO: 4266 - DNA, 615 bp, Chlorella protothecoides
  modified_base (123)..(132): a, c, t, g, unknown or other
  modified_base (360)..(369): a, c, t, g, unknown or other
  modified_base (425)..(434): a, c, t, g, unknown or other
  modified_base (490)..(499): a, c, t, g, unknown or other
atgtgggcgacaacaacatcggtgagcgggatgagggaagtagctgggcgttactggggttttgagtgctgcctgagatggacgaagcggaatgttacccctgtctctctgtgcccctcatcnnnnnnnnnngagggaaggatctccaacaagggaaacctcaactggggtaataacaacaacggcatcaaccaacgctgcaacaacgctgtgggaacccggaagggtcccaacatgtgcagtctgaaagagctccacaagtccatagtgaaagaactaagacagccgccgccgccacccaagaagaagtcgtcgccgccgccgtccaagaagaagccgccgccgcccaagaaggcgttnnnnnnnnnncagccgccgccaccacccaagaagaagtcgccgccgccgccacctaagaagaagtnnnnnnnnnncagccgccgccaccacccaagaagaagtcgtcgccgccaccacccaagaagaaggnnnnnnnnnncccaccgccgccgcccaagaaggcgtccccgccccccccgaagaaggcatccccgtcgcccccaaagaagacgtccccaccacctcccaagaagacgtctccgtcccccaacaaga

SEQ ID NO: 4267 - DNA, 1317 bp, Chlorella protothecoides
  modified_base (211)..(220): a, c, t, g, unknown or other
  modified_base (315)..(343): a, c, t, g, unknown or other
  modified_base (655)..(664): a, c, t, g, unknown or other
atgaacgcgtttctaaatgcggaatcagtcgtaatggtcccacagcctctgattgctgcaggattttacgtatcggcttgtctgctgctgggaggcgcgccacccggtgcacgatggtttgtctctctcagttcagatccccagcgtgataccatccgacgcagagtgttgctcgttctaccgaattggagctgtcccgtgccaacaggcnnnnnnnnnngtaatggtcccacagcctctgattgctgcatgattttacgtatcggctggcctgctgctaggaggtgcgccaccggtgcacgatggtttgtctgnnnnnnnnnnnnnnnnnnnnnnnnnnnnntgagaggtgattgcactcactggaacatgcacgtcgccaccgccctccttcccggtaggttatggaccctcaagtcatcattctgcttgtttcgttctgaccaggctgtggatcggagggagcgtctccgtcggctagcacttgagacgatagaccttgccaaggacccttactacttccgcaatcatctaggccaggtgaggttgacgtgctgtacgagccggtgcataactgcactagatgagcatgcggctcaggaagttgttggggctggagggtcaaatgtgaagttgtgcaaggatgtcttaggannnnnnnnnnaggaagttgttggggctggagggtcaaatgagaagttgtgcatggccctgacgctcctgcctccgagcctggtgcccacccttctgcagatcgagtgtcggctgtgccacaccctccacaccaacgagggaaactacctggctcacacgcaaggcaagcgtcatcagcagaatctggccaagcgtgctgcaagggaagccgcggagcaagagattgcccctgccccccagcgccgagtcgcgattcggaaaacagtgaagattggcaggcctggctatcgtgtgaccaaggagtttgacccagagctggggcgcagtggatacagttgcattcctcgctaccacgagcagggcttcctgcaaccgcgttcagtgagtgcatgcccagcgctatcatctcccagtccacacctatatcacattgcctgctacacgccgcagattgagtacccggagatcgaggaggggttcaagcctcgccaccgcttcatgtcttcatatgagcagcggaaagagccttgggacaagcattaccagtacctactctttgcggcagagccttacgaggtcattgccttcaaggtgccgaccctggaggtggaccgacaccagaccgaccgcctgttcagtcactggtacgaggaacgatcttga

SEQ ID NO: 4268 - DNA, 651 bp, Chlorella protothecoides
atgccgtgtggccctgcgaccctctggttgccccgtttgcacccccctgcagctgtcaaggcggtgctggcagagtaccgcatccacaacgccgacgtccacctcaagggcgactacgatgtggatgacctagtggatgtgatcgagggcaaccgaatatacgtgccctgcatttacgtcatcaacaagatcgatcaggtttgccggattgggggggatgggttgatgcctggtgggtcaccgcccgagtctgttcccaggtctggaatatcaatagtctcccgcgtatctccctcccagatcaccctggaggagctcaatgtcctggatcgactgccccactactgcccggtgtgcgcctaccacgagtggaatctggacggcctggttgagatgatctgggagtacctggacctcctccgaatttacaccaagcccaagggcaagcttccggactacaacgaccccgtcattctcccagcggcgcacagtagtgtggaacacttctgcaaccgcctgcacaaggccatcatcaagcagttcaagtattccctggtctggggctccagcgtcaagcaccggccgcagaaggtggggaaggagcacattctgcaggacgaggacattgtccagattgtgaaacgcgtgtaa

SEQ ID NO: 4269 - DNA, 561 bp, Chlorella protothecoides
atggacgtttggtttcacgtggacagcctgtcttctgcccacgtgtacctgcgcctccccgagggtgtggccatccaggacattccccccgacaccctggaggactgcctgcaactggtgaaggccaactccattcaggggaacaagcagaacaatctgcatgtggtgtacacccccgccagcaacctgaggaagacggcaggcatggacgttgggcaggtgggcttccaccaccagagtgcggtgatccgggtgcccatcctgaagcgtattaacgagatcgtcaaccgtttgaaccgcaccaaggaggagcggcacgtagacctcgaagctgaacgggccgcgtatgaccgagaacagaggggaaaggaaaaggcgcgactacaggaggaggagagcagagaaaaggcgctgaagaagcagcagcaggaggaaaaggcgcggagatcctacgacgccatcatgcttgaggaaaacatgaagaccagcaaggatatggcccagacatatgagaatgttgaagactatgaggtgaggatggtcgagtggtcatgccggtag

SEQ ID NO: 4270 - DNA, 1050 bp, Chlorella protothecoides
atgacagccccttgcgatgtgctcatctgctcccttggcagcccatttgccatatggccctcgccttacccagcctcgatctcgacgacccacgtggggcaggtggtgcgtctggcggtgggccggctgctgctctcgcccaacacccgcgccaacgtgctctgcgccggagccaaggcggaggcccctggccgggccagcctgggcagtctcggcctcggcctggcctcggagccctggcggctgctgcttagtcgcatcggggacaccctgatgctctacctcctgctgcactgcagcatgtggagccgggtgcccaacggcacggtggtgcagctgacgggcccccctatggcacgaattgccagggccagcgtgtttggccggaggcccgaggccgcaagggcgccgggcgcacccgccagcgcaaagctggagccaggtcagcagtttgagcacccacttggcaccggccaggcgacagcgccgtgtcaggcagcagcgcctcaacaagcagcagcgccccaacaagcaccagcgcctcaacaagcatcggcgccccaacagacgatggctgcctcccaggacagtaccacctacctgctgggacccactgggatagagcaggtttgcggcaggagaccggccgccccgtccaggcgaccatccagctggagacgaagaagggaggccattcgcagggcagctgcagcgtcgaccggctcgtttgacgtccctcccacccaggaggtcctcccggccgagtgccaggaagggcccgagggtccctgcggccctcagcttggcttcgcaggctcccggccacagcatgcgcagcaagcccgtgcatcgcccttccagcccgcacagcgcctggcggccatgcagctgccccgacagctcatcttctacagcgccaccttctcggggcgggccgggctgccctcacagcgtacgtccagggttgttgtgtttttgtgggttcaggatgacaagtggctgcggcgggtaagctttcatccctaccaatgtcgggcaccaatcaggtga

SEQ ID NO: 4271 - DNA, 288 bp, Chlorella protothecoides
atgagtgtgctgcagaagatcaaggatatcgaagatgagatggccaagacccagaagaacaaggccacggcggggcacctgggcatgctgaaggccaagctcgccaagcttcgacgagagctgctggagccttcaagtggtgctggcggcggtggcaagggcgatggctttgatgtgaacaaggttggggacgcaagagtgggcctggtggggttcccatcagtgggcaagtccacgctgttgaacaagcttacaggcacattctcggaggtgagagagactgactga

SEQ ID NO: 4272 - DNA, 1143 bp, Chlorella protothecoides
atgaacgacacctactgccgcctgcagcctgtccttcgacgctggcgggcggcacgagtacaggccggcgcgctggccgcggcagagccggtgccccgcgccttcctggccaccatggacgtctcccgcgcctttgacaacatgaatgccgaggcggtggtccgcctcgtcgcgggcctgctcacctcccagcgctactccatggtgcagtacaccgagatcacgccgcgcgccggcggcagcctgaccgtccgctcgcgccgctgcgctctgccggcagacgaccccaccggccccggccccggccccggcgccgggcacacccacgtgctctggagcggcctcggtgcggggcgcggcgtgcagaccggcggtgttgtgggcaccgtcacgcgccaaagcgtgctggccctgctgagccagcacctgcaatgcaacctggtcaggctgcgccggcgctggcacgcgcaggcacggggcgtgccccagggctccacgctttccaccctcctctgctgcatgtacctggcccacgccgaggccgccgcgctggaggaggcggcggcggccagggggcgactcaccctgctggcgcgggcggcccgctgcgagggagggcctgcttcccaggctgcagaggcctccatcgggtcgcggctgggagaggcggtgccggcgggggtgggggtgtcagggtgtcaaggcgaggcaacctctgtatcagggtgtcaaggcgaggcaacctctgtaccaggttcgtgcaccgacagagggactcccgtgcctgcgcggcgccccggggacaacaccccccctgcccccctgccaccccctggcaaccgcgaccccaccaccccggccccgccagagcgccccctgctcctgctcctgcgccagatggacgacttcctgctgctcagcagcgagggcgcggtggccgaggccttcgtggagcgtctggccgtcggcttcccggacctcggcatcgcggtgaactcgctgaagacgcggaccagctggggcggcggcgagcgactggtgcgcagtcgctgcggcgccgccttcctgccctggtgcggcctgctcctgaacgtgaccagcctgggggtccagggcgactacacccgctaccacggcgaccag

SEQ ID NO: 4273 - DNA, 1107 bp, Chlorella protothecoides
  modified_base (1054)..(1063): a, c, t, g, unknown or other
atgcgctcaccagctggtcgaccctgctcacccgtcatgcaagtgtgcccccttaccctccagggagtgctggccccggacgatgccagggccgccatccgggcggggtccgatggcatcgtcgtcagcaaccacggcggccgccagctggacggcacgccctcggcgctggacgtcctgccccacgtggcggccgccgtggcggggcgggtgcccattctgatggacggcggggtgcggagggggaccgatgtgctcaaggttgaaggggcggggttggtcgggggtgccccgaggggggggggactggggcatttgagggggccgacgcagccatgcgcctgggaacgagtgagatgtcggagacggccgtgcaccgaggcgcttccctgtgcaaaaatcctgttgcctcgcgctgggggccagcgccgtgctgattgggcggcccgtgctgtggggcttgaccctggggggggaggagggggtccgtgccgtcctgagcaccatgcgcgccgagctggagctcagcatggcgctgctgggggtggcgagcgtgcaggggctgaaccgcgactacctcgtcccgcccatgggcggggagctggtgctgccagcggcacgcatgtgaggtggcagtgtggtctcgaggaatgcgttcgtatcaaagagtgttggccgcgtcaaaggcttgaaggaatccatcattgcattcacttgttagttgtaatggggcaccggtgctgtttcaacacatcataccagtatccagttcccgttgcttgtgctgaattcgagtctgcatgtgtgagcctgttgttcaaggaactctcatccatggggtcaccggtgccgtgcatggcatctcatcgatgggtggtgcatgctggtgcccagggaacggctgcgaaagccacgtgcgatcgcccgtcccgccccggtcaccattcaagcgatcagaaggctccggccgggcaactgcacggcatttcgaatgctctggtactcgcgcatgagagctcacacaacacattacggagcatcctcacgacaggannnnnnnnnntggtcaccattcaagcgatcagaaggctctggccgggcaactga

SEQ ID NO: 4274 - DNA, 888 bp, Chlorella protothecoides
  modified_base (35)..(44): a, c, t, g, unknown or other
atgctatatcttactgcatgggccctggtccgttnnnnnnnnnnctggcacgtctgccgaccgtatcctgccctaagctcaatgctgtatcttactgcatggcccctggtccgtctcgccgcacttgggacccggcgggggtgccacgcgaatctgggggtcccccaccaacgggttggcccgggcgacagattttccgttcaaattccggcgcgggaagtgcgcccagggcgcgaggagagcacacaggaggcagtttcaacatcctatctacgaaaaggggcgatatccatatgttttcgtgtgattgtacatagagggctacaaattcagcggactggccgcacgagagcactcgccggttggagccccctggcgtcgtcgccagggatgagtagacggaaacacatcacacagaattccctacaggaggaggttacagcacctgctgagaatgagagcatagttagggcagtgggtagcagaggcagcaatatcatggaggtggagtttccatgtgggaggcggaccttgtgcctcattccggctcggttccataagaagctgtggatcaagaatggcaacttcctcatcgtcgaggaggtggaggccatcgatgcggcagtgtctggacagatcgtgaaggtcctctacgccgatcacgtgaagcagctacagcgcatcccaggcgtctggccagaggagtttcgggcagctggttcacctgctgtgcctgacaacccctccatggagcaggagaagagggaggcacgggaacccggctgcctggatggcagctccagcgaggatgatgggctgccacccctggagcgcatcaacaaccgacgagtggtggagtacctcgtgtctgaaagcgacagcgagtga

SEQ ID NO: 4275 - DNA, 438 bp, Chlorella protothecoides
atggcggagcgctggctggctatgcacgcctcgaccaactcccgcttcacccgagcctcgcaagacacacacgccagcctgcctccggaggcagaggaaccccaccgcacccccccctcggtgcgcagacccgtgggacgctcctcccacctggacggcatctccatggagatgtcccccggccggtcggagcgggcctttcgcacgggcaatgagcgcctgtacgaggcatacaacgacctgcacgccctggcccaggactttgagaaaccgtttgatgcccctgccatcctggtggtggggcatcagaccgatggcaaatcaggtgggtgctggaggggtatgggtgctgtgtccgaggtgatctgggtgcaggggtcaacggtgaatgccatcaagaatctgcttacaattggtagcatgcgccgggttctctga

SEQ ID NO: 4276 - DNA, 417 bp, Chlorella protothecoides
atgttgagaggtgaggaagagggtgcgagcgttcttcccccgccacgcccatcacctcccccccccaaacccccaaacacacacacagggaagcgcgacatcgacgacaagctgcactttgacatcccgccccacctcagcctggccaacctcaaggcgctgcaggaggaggcggggcggccggccagcgggcacagccagggctccggcttcgcggcctacttcaccagcctcatcgacccctccttaacctgggactgcatcgcctggctgaagtcggtcactcgcctacccatcctggtcaaggtgggaaggggccccggcagaagcacaccggcagcgaactgcgtcgacgacaggacagcggagggcttgtcgagttccaggctctcgagcgtggcgcggagcggggtgtaa

SEQ ID NO: 4277 - DNA, 300 bp, Chlorella protothecoides
atggagctgcgtcgccgcatcgaccaggtcatggtctggggcaacacgcagcccatactgcccctccgcagggccatctggatcgtgacgggcgggatctggctgtgcgccgcgtactgcgtggccgccgtgggcatgctgctcaccatcgtctttgctccgtttgccctccaagtcctgcgcatcagcctgttcgccctggatggaggcatcacgctggagccatacatcaagaccctgagcttctcagtccaggtgtgcaccgcaggcggcacggctgggcaggtgttgattctatga

SEQ ID NO: 4278 - DNA, 1017 bp, Chlorella protothecoides
atgttcctgcgccccccctcccgcctgctggagccgaccatgctgggcgggtcccccttcttcacctcggtgccctcgggtcgggtgggcaacagcaaggacgccatcttccgctccaatgagcacttccgccaggccgtcgcggagcgcgaggccctggacgtggcaggaaactgtcgcgactccccttcacacccccgaatcacctcccctcccctcccccacccaccacccaaacgactccacacagagctggagtcgcggctggggcggcgcctgggccccggcgagcgttcccgcatcggcgtgggccagctgcgccgcttcgcggagcacctgctgcagcgccgctacctggagaacgtgcccaccatcgtgccggtgctggagcgggagtaccgctgcgcggcgcgcaagctggaggagacccaggcggagctgaacgacctgcaccccgagcgcttgaaggagaagggccgcgtcttccgcgagtccttcatcgccaagctggccctgctcctgcgcggcacggtggccgcgccaccggagcgcttcggcgagaccctggccgacgagcacgtgcgcggcggcgccttcctggaccccctgaccaacaaggccatcgccgtggaggggtcgctgcccaatgcccacatgcgcctgtttggcggcgcgcagtaccaccgtgccatggccgagttcagggcgggtgagctgatggtgctcgtggagtttcattcttgtggcgatgggtcatcgggtgcccatggaggatctgcatgccgcccttgggtgtctctcagggtcgttcaaccccaccccccacacccacacccacccacctgtcatccaccttcaaaaggcatcggagagatgacgtgccccgacatctcacgcgaggagatcgtcaacgcctgcggcatcgacgacttccacgacggcgtcaattacacgcgcaccgcctgcgtcatcgccgtgtccaaggcccgcgacctcttcgagcccttcctgcaccag

SEQ ID NO: 4279 - DNA, 378 bp, Chlorella protothecoides
atggcccacagatcgtctcgatcggcagccttgctcccacggagcagtgtccgcacgaggggcaaggccggcaagggcgaggtctccaatgcctcaccccgtgtggaggatgccgtacagggtcctggcgtcagtgccggcccagaagacgtggaggacagtgaggacgaggaggggtctgagacattctatgggagcctggatggcagcggactgaggatcggcatcgtggtggcacgcttcaacgagctggtcacccgcccccttctggctggagcccgggaaaccctgagccgtcactgggtggacgtcgacaatgatgtcgatgtgaggagggggaagctctggtggatctggccgcgatggctgggggattga

SEQ ID NO: 4280 - DNA, 384 bp, Chlorella protothecoides
atggccaagagcggaaagtacgatgccgtcatcgccatcggagttgtggacactggagtggcccccacctgcagagcatcgcaccccagcgtcccatctcctgctggtgctcattgtgtattgtcaaccccgcaggtcaagggcgcgaccgcccactacgacgccgtggtgggcgccacgaccagcggagtgttgaatgccgccattgacacgggcgtccccgtggtgttcaacgtcctcacctgcgactccatggaccaggcgctggaccgtgctgggggcaaggtcgggaacaagggctcagaggctgcagccaccgcggtggagatggccaatctgctggccagcatgcgggaggttggctcggccgcgccggcatggtga

SEQ ID NO: 4281 - DNA, 276 bp, Chlorella protothecoides
atgcccttcccccttccccaggccctgggtgccaacttctcaggggtgaccagcgccatcctctccttcttccccgacaccgcgaggagcctgcgcctggacaccatctaccccatccagggtttccagcgctggcgagacgaggccgcggggttcgagctggtcttccccagcgcatggagcgcggacctctccgtccgccgcaggctggccgaggacgccagctggcagcgacccagccccggtctgccaccgctgggcctggcgccgaggtga

SEQ ID NO: 4282 - DNA, 450 bp, Chlorella protothecoides
atgagagcaccccgagaaaccaacacatctgcacctgcagatgcgatgccggtcgagatcgtgcagttctgccacgagtacactctgaagcggctccaggcgctgccagaggtggccggcgccgaggccaagctgcgcatggatgggggcaagccgtacgttaccgacaaccacaatttcatcgtggacctctacttccaggagcccctcaaggagccccatgcaggtgtgacagtgggaactggcctgctcgctgggcgtggtctgtggcttctccagcgctgtcctgccaatgtcccccactccccccgcccgcccaccttccgcgcagctgccaaggccatcgccgcagtggagggtgtcgtggagcacggcctcttcctggacatggtggatgtctgcatcattgcaggcgccaacggcgtcgaggtcagggatcggaaagcctag

SEQ ID NO: 4283 - DNA, 396 bp, Chlorella protothecoides
  modified_base (307)..(316): a, c, t, g, unknown or other
atgctgcctccgccgtggtccctgactcgatgtagcctggcccctcctctgcagatggtggagcaggcgtctgccaagtttgtgtgcatcgtagacgactccaagctggttgagggcctcgggggcagcaaaggtgcgcgtgagggttgtcttggtcattgtgtgtggggtcgtgggtccacgatcttgtttgtcctgttgaagagacctgcagcctgggaggtgggtggctcgctgatgcttggtgcttcaaaacaggccttgccgctgctgctcccttttttgtgggatcgtcttgagcgctgtnnnnnnnnnngggcagcaaaggtgcgcgtgagggttgtctcggtcatcgtgtgtggggccgtgggtccaggatcttgtttgtcccgttga

SEQ ID NO: 4284 - DNA, 522 bp, Chlorella protothecoides
atgcaggccagcctgagttcacaagcagcgagcaggtcattcttcacgacgcggccggtgctgcggcgtgccacccaagccaggcgggccctggtcactcgggctctgaacatggacgagctcaagaaacaggccgcctggaaggccgtggagtacgtgaagagcggcgatgttgtgggtttgggcacaggatccactgcagcattcgcagtggaccgcattggcgacctgctgagctctggagagctgaaggacatcgtgggcgtccccacatctgtgcggacctatgagcaggccaaaggtggtcgctcggcagtctcctcttcagctgccccatcaattctctgcccttaccctcgttccacccgctgcccaggccgcggcatccctctggcgaccctgtcggagcagcccaagctggatgtggcaatcgacggcgcggatgaggtggaccccaacctggatgttgtcaagggccggggcggcgcgctcctccgcgagaaggtgaggcggggcgggtga

SEQ ID NO: 4285 - DNA, 915 bp, Chlorella protothecoides
atgggtggaaactgtgtccctctccctcctcgcgatcaggatgatggcccacccccgggcggcacacgtggacccgggtcccccctcttgcagcaaagagtctttggccggcatgggatgctgggtagggaccatgactcgacgcacatccatccactaggttctcacattaccagcacattgcagtgtgtggttgggatcggctgcttgaggcgcttgtgccgactctggtgcaaggagcagggactggcaggggctgcaaccaaactcaaagcgacgacgagggcattggagccgacgcgcactcttcactcggcggcctacaccgcgggcgaggacatgtcgcaggccaggctgagggaggccctcagcgcaggcggccccactaccaaggataggggacctccagtatcagacgggactctcaccgtgaccccagacacaccggaggcagtggagtggcgggctcggcgatcaatcatcgacagcatcgcctcctgctcgacctacctggacgatgatgacgatggtgagaggggacaggggtgcgatggggaatgtgtgcgtacctgcgtcattgcccccgcgcgtgctgctgggggggatgagtggtggagagaggacccagtgctgccctgcccaaccctcacgttcccaccgccacacagcatccaccaaccccggggatctgtacggttgctgtgggctcgatttggggaggaggaaatgacagccaactgtcgccagcccgaaattccacatggaccacccaatggtggcttagttgcccccaccaatgcctgcaaggcgcatgcccctgcgcggggaccgacgctggggccgtccttgcccatcggttcggcccacttcccgctctccctgcaggtatatcctggtgtacccacaaggctgtga

SEQ ID NO: 4286 - DNA, 1518 bp, Chlorella protothecoides
  modified_base (1307)..(1316): a, c, t, g, unknown or other
atgtgggcggctgtcagggtgggtgagttatgtctgtggaggtggggtggggcccagcggtgctgcgggcatgctggcacaagggcccactccagggttgcatgggccatggcctgggaggcacttccacccccccttcccctctcccaccccctttacaccacaccaagatctcacacctccccacccccaaacatgaaatcccaacacataccagggtggagccactttgcacagtttacgattgcggtggtgaaccgtgaccccaaggccagcaagtactctgatacgctgcaccgcttctgcaagaaggagcacgactgggggtggaagaaattcatggagctgggcaaggtgggcgagggcttcaccgtccaggactcgctggtgatcaaggcccaggttcagatcctgcgcgaccgcccgcaccgccccttccgctgcctggacgcgcagtaccggcgcgagctggtccgtgtctacctgagcaacgtggagggcatcgcgcggcgctttgtggaggagcgtcgtgcctggctggcgcgcctgctggcgccgccggcgagcgccggcgcgggcgagggcttccgcggcttctgggcaggcctggccccgcccgcgcgcttcgagctgtcctgcgacgcagcggggccgctgctgaaggccgcggtcaagcgcttcttcaatgagaaggaggtgacctccacgctggtcatggatgggctggtggcggggtgcaaggcgctggaggccgcagggcgcgcgttcttggccggcgggcggtacgagacgccctccggagtgctcatcgacgccgtgcgcggcgttttcttcttcgccggcgacgtcgtggcggtactggaggcgctgctgggcgacgcgctgccccccgccccggcgcccgaccgtgccgcgggcgacgccgcggcgggcacgcgcgcggcgggtgagccggacgatgtcagccgcgactcggtggagcgtgacgagcgtcgcctggcggacctggggcgctggatcatggagacctttgccgctgcggagatcgcgcgcttgcgtctcgagggtctgggctctctatcgcgtgtgcaccaaggggtgggtgggttgggcagaggagcaagacagcacaagaggctggctggagacgctgtcggggccgctgaacgcttgatggctggcggcaggcgggcctggggccgcctggatcgaggcggagaccatcaagcgccaggacgcgctgatcagagaggaggagctgctgagccaggaggagcagctgaaggccgccctgcgctcagagggcnnnnnnnnnnggaggtgggtgcgggagggggtgcggggggggtttctgtgtcagaagtggcgctgggtgtgagcgccagggcttcgctgcgttgggatactgactggcgcatggcgtttttgtctggggacgtagattgcaggggttttggaggattgccaggcacggggcacggggttgtgcacggtgcagtcttggcgctcctccgttaa

SEQ ID NO: 4287 - DNA, 1032 bp, Chlorella protothecoides
atgcctcttctcggtgtcctgccgggcgatgcccgcttccttgcagcgcccgctgcccgtggcgtcaccctgttcacctcgcaggacccggccccgctggagggcttcctggcggagtgggagccgttgctgccccctcccctgctgcagcacgtgctgacgcacctggtgctgcccgcgctggagcgcgcgctggcggcctgggacccgctgcgcgacacggtggccccgcacacttggctgcacccctggctgccttccctgggcccggcgctggaggggcagtggcccggcgtgcggcaccgcctggcctccgcgctggccggctggcacccgtcggacggctcggcgctggcgctgctggcgccttgggcgcgcgcctggggcgccggcgagtgggaggccttcctggcgcgcgcggtgctgccgcgcctggccgccgcgctgggcgccatgcccgtcgacccgggggcccaggacctggcgccctgggactgggccatggcctggcacggcgccgcgccgccggacgcgctggcgcgcgtgctggacgtcgccttctggccgcgctggcacgcgctgctggcgctgccgcgcgtgcgcgcgcacatggcctcggccctggacgccatgaacgccgcggccgacggccggcgcccggggccgacggctggggccggggccgcggcggcgggggcgggatccgccccacccggttcacggagtagcgccgcccccgcgccgccgccgcctgcccgaccaccaccacgcggaaggcagccctccgagctgagcctgcgcgagctgctggctgcacacgcggaggaggtgggcgtcgccttcctgccgcggcccgggcgccggcacctgggcctgcaggtgtacctttacggcgccatcagctgcgcggtggacgcggtgggcggcctcatccatgcgcacatgggcgagcggggctgggtccccatctccatgcagggcctggacgaggagaacgagcggcgcctggccgcgcgcgccgcgaagaagtga

SEQ ID NO: 4288 - DNA, 2769 bp, Chlorella protothecoides
atgctgggatcccgacgtcgcctccctcgctttgcacaatgtgtacaatatgatgcgtatatacacttcttgcagcgcagggcagcaggtgatgttgcatcacgtaagcttcgcccgtcaaacaccctatcaggagaccggcccagctctgctcaccgcagtctactccacatgctggcagtgggaaatgatgaggagcagcacagcaatgtcacgacgcaaacctcacgtctcttgagatcatccagccaactgccagaggaagctgcgtcatggggtacatgtgcccggtgctcgggaccccttacaggggcattgtggacctccggtctgttgtgtgtgctgctcagcggcatactcttcagcgcatcgagcgttctggtgaaggccatcggccggcatgtgcccgtcatgcaaatcatattcgtgcggtccagcctctcaatggccgctggcttcacggccgggaggctgcgtaatgtcaaacccctgtttggcgagaggaggagctgggcgctcctgagcctgaggggggccctgggatccggaagattgagccttggtcatgtcatacccggcagcctgccgaccccccctcctccccacgctaccccgcagcatgttgtgtcggtacgcggcgctgaccctgctccccatggccgacagcgtgagcatcgtgttcatctccccaaccatcactgccatcctggccatactggtgctgagcgagcccgcaggcctgcacacgctggcgggctgcgtgctgagcctgctgggcgtggctgtcgtcgcccaaccgcccatgctcctcggcggctgggcgggggagggcgtgccctggacgcgcgcgcggggcctaggcgtggcctttgcgctggccggcgcggcgatggggtcggcgtcccaggtcaccatccggcgcatcggactgcgcgagcggcccctcaccgtctccatgtggttccacgccaccagcctggcgtcggccgtggcgccgctagcggtcgccttccccgcgggacccgtcctgcccagcctcctggaggcggccgcgatggcgggggtggcggccacctccttcctcggccagatcctgatgggcaggggcatccagctgatgcatgtgggcaaagcggcttccctcagcctcctccagtggctagacctgtcccattgtccctacaatttccagagtatcagcaggcacgctctcgttcctcacaaactacccaatggcgcccactccaggtggtgtacgccaatgtggctggagcggtgctcttcggcgagcccaccactgctctcaagctgagtggtggcgtgctgattgggctgggcatcctggagagaagggatttggggtcgagctggggaagcgtcatgggccccctcgcagctgacttgctcgggagggaagctgccactgacatcagaaagaaacctggttgtgttacaaatagccaacccgattaccttacccctacctcgtccaccgtgaccgttcccgaccccttcgaaaacgtgacgctctctcaaaccctcccaccccgaggggccgggtgggaggtcgcccggcgatgcatggcgtttcctagacgagagggtcaatgctcctccattcttgacagccggatgaggcgtggaaactttgatgatgctctgggctcaataggtccttgcattgcctcttcaagaccctcaattgtgctcccatgcattctctactggcagattgctgtgggacactggcatgtcatgtgtggtctgctcgggcttgtgcttcagcgtctcttccgctctcctcaagagccccgcccctgtttggacggcgggagcagtatggcatcctgctcatacgaggcatcctgggagcaactaggtgagagttgctgtggcacagatgctcattgggctgggtcacgggtaccaatggtttttgaggaatactttggaggagtcctcagggccctgcttcctaccaattgctggagccagctcagcttcagccccgcatcatcctgcatgcaccatcccttacaaagttcaccgtccactttccgaccctcagcctcctcccttcccacccaacactgcaatcgccagtcaaatagcggtgtacctggcggtgctggccctgccactagcggacagcaccagcatcctcttcctggccccggccctgaccgcagcgctggcgtggctggtgctgggagagcccgcgggccggcacaccctggtgggctgcaccacctgcctgctgggtgtgttcatcgtggcgcagccgcccttcctggtcggcatgctgaccgggcggcccgtgccctggacgcgagagcggctgctgggcgtgggggccgcgctggcaggggccttcctgacggcgggggcctatgtcgtgattcgccatgtcggcaaacaaaccgtcccgctcacaatgtcggcctggttcttttctgtcagcttcttcaccatcctgccggctgttgccctgtcgtttcccggcccactcttgctgccctccccgctccaagctttgaccctggtgggcatcgccttgacctccttcctggcccagctgctgatgggccggggcctgcagctcatgcctgcagcaaagtgtgccaatgtcaacctcatgcaggtatgtgccagtgctggttctgggggtgggacagggcattggcgtggaattgctgggacaccggcagtgtctcggtggcgcttgtggttcttagtttggtttacaaagagaaacggcagtgggagtga

SEQ ID NO: 4289 - DNA, 1101 bp, Chlorella protothecoides
atgtacaccgacccgtccgtagtggctgcgcccggcaccgcgcagccgtcggcagccgcgccagcaccctttgctgcgccccagcatgctgcacatccagcctcagcatacggagctccacccgccactggcccggctcccgcgtacggagccccccctcctaccgggagtgcttctgcctatggggcccccccatcggctggtgccgcccccgcctacggggctccacccgccagcgctgccccagcctacggggctccccccgccagcgctgccccagcctacggggcgcctccgcagcatgcgggcaccccgtacggcgtgccagcccctgtgccgagcgcctacggagcgccgcctcagggcacagggcccgcagctgcagcctcatatgcagtcccgccctctgcagggcagcaaggcccctacggggcgccccagagcgccggcgcctatggtgttccgcccgcagccacagggccgtatggcggccactccggcgctgcacagtatggagctgccgttggaggtggtccaaaggcagcatatggggcgtcagcctaccagcagcagggacccaaggcggaacctgctaacccgtatggcggcggcgggggagggatacctgctgcttacccccccaccaccaaggcatacggcaatccttcagggccccctcagtaccggggtcagggggctgtggcacgtgatgctggccccgccagcatcatgcccatcaactccctaaactcctaccagaaccgctggaccatcaaggcccgcgtaacccacaagagcgacatccggaggtacaccaatgccaggggggagggccggttcttctcctttgacctcttggatgcgcagggcggggagatcagggccgtcggctggaatgatcagtgtgacaagtggtacgaggccgtggagacgggcaaggtctacctcgtctccaaggccagcctgcgcaacaagcgtggggtgcgttgcaaagcatgggaggagggtttcgtaggctcggagcctttaggaggaggtgacggacatgctctcattggatcgcgttctcattgtgtgttccttttgagcagcgtggtttga

SEQ ID NO: 4290 - DNA, 1335 bp, Chlorella protothecoides
atggcccagccagctgacgaggccgactttctggagctcctcattgcctctgaacgggtggaggagtggctcgaggtagtgcaaaatgctacattgagtgatacgagactcatcagggcgctcaaggacatgctggaggccgtgatcgctaaggaggcatatgtcgaggaggtgggtactctcaaggcagtgctggagcctgcatgcaggccgagtttcgcagctcccatccgacgggcccctcattcgctgggcttgtaccaacttcttttgagttccagcccttgttgctcgactcctctgcaggcacgccactccagggtggcgtcgcgcctcactgccatgctcaagcggatcggtccagatcaggaggaggcggcagacctggccgccgacatcattgctgcctgcagcggcagcgcggctgccagtggaggggtacgcggcgggcctgaggaagtcatgcccctttcctattggttggctgagcatggtgaccacatcctacatcacccaatcagggcaggcctggaccttgcggcccgatacgccggcggggtgtccatcaccctgatggagggggcactcggggacggcgttggcgccaggctctgggtggcggcacacatcctgaacaggagcctatggacttctccatggccgatccctcctttgggtcggtctggaatctgcgcccttcccattcgcccccgcactgcattttctgccggcacgctgccccctccccccccgacctccgccccacgcaatcccatgcacaggttgctggcggcacaccccgacatggtggctgggcgcagcgtgctggagctgggcgccggctgcggcgcgtgcggcctggcggcggcgcggctgggcgccgcgcgtgtggtgctgaccgactacctggacgccgtgctgctgtgcctggtgaccagcatgcatctgaccctgggcgagggtccgggggaaggggctccacagaagcgacgagcgctgacggccgctgaggccgcgacggagggctgggaggcggggtgcgcggccgtgcgcttcctggactggaatgcagcgcgagggccagtgagggcagcgtcttcggaaccccccccgccctccgtggcaccgcccatgggccccgccgacgagcgcttcgaggtcatcctggggacagacatcctgtacgagggctggatggcagccagcgtggcggccgtgctggaggagcggctggcggagggcggcggcgccctcatctgctgcgccgtccgggagcaggtgggcgctgatgggggttcacgggagcagtgccttgcctcgcggcatgctggatga

SEQ ID NO: 4291 - DNA, 675 bp, Chlorella protothecoides
atgtcgacccctccccccgcgaggccggtgtttgatttggatttgacccggacccgagctttgacagggcctgggctcgaagcccgcgccgcagctccagagatgcctgatgccaaagcccgcgatgcatctgatgccgggcaacggctagtccaccgcaaccatgccagccagcgagggggcgcccagccagccccggctggagctgccacccagcctgcggcccaacgaggagatgtgcctgatcatggccagggagggcggggtgatcggcactgccgctgcgactgcgggacacaccgggtccccgatgggccggggtggccggaatggagtgtcgggatgccctcacaccgctccccaacgacactccggctgcatgccagccctgcatgcggggtggggctggggtaccatttgtcggtgcggggaagcctggccggcgatgtgatcttgccactggacccaccctccctcagggactacacgcggcagataaccgcccacaggcagcgtgagtggagctgcagatactcccgagtctcggggctgacgtatgaggaggcggtgaccagcgagtatggcgtgcagtccctcatcgaccaggtgtgtattggagtgtttgtgggcacgagcgtggggctgccagggagctcactgcctgccgctgcttaa

SEQ ID NO: 4292 - DNA, 327 bp, Chlorella protothecoides
atgcagctctcgcgcggcgctattgcgggcatcctatcagatgggcccccgcaggtctacacggtccagtgcgccggtgagcggggggaaaccatggggcatcggaaaggccacgacagtgtcaagaaagtcatgaatcccaatgggcagccccggtaccgactcatgctctccgatggcgagttccagtatgtctgcatgctggccagccagctgtccgacctcgtcgtcaaccagctgcaggaagggtgtatcctccagatcacagagtacatctgtcagtttgtgcagaccaagaagtacgttcagcagattgtagtagtgtga

SEQ ID NO: 4293 - DNA, 765 bp, Chlorella protothecoides
atgtctcctcccgcatcgttcagtccctccccccgccctccatgtcccctccacagtctgcacgacggcctcagccgggcggccaaggtgttccgctcccttgacgtcccgcccacgggcgagatctccctggaccagctgcgggcgggtgccaggaggctgggttatgcagtggatgacgacgtgctggagtcggccttcgtgtcggccgacctggaccgctcctccaccattaacgtggacgaatttgtggtgatcctggccatcctgcacctgctcaaagggccccgggacgaggaggacgtggatgccgccacgctcaaggcctttgagctggccacccaggccttcctgtcctttgacagcagccgccacggcttcatcagccgggtgggtgtacgagtgcgctggaatgagggagggcaaggagtggccagaaatgcagggccacaggactggaccaggaacgcgcatcatgccctggcccgtctggcagggttagggtcacacccacgcgctgctcacctgcccatcccctgccgcacgtgccaggatgagctcgagtccgccctgctggagccgcacctggagaacatgccgcacagcccgcatgcctctgctaccaacaccatcgttccgctggtgcaacagcgcttcctggagctggaccgggacggcaatggccgcatcaccttccccgacttcctggcctgcatcacgcattgggtggacgaggcgggcgaggaggaggctgagcctgcatga

SEQ ID NO: 4294 - DNA, 375 bp, Chlorella protothecoides
atgttgggtcaggcttcctgtggagtgcatgcacaccttcaaccatatctagtctcgacagcgttcaggtcgaacgctcgggctcccaaactgcgccggacgctgtgcagagggctggtgtcggcccctcgagcagagcttggagaaggagcgacggtgaaggtcactgctcccatcacggtattccattccccaaagtataaggacggcctgctggtgcaagactacacgggcaccatcgttgccgacgtgtctcagttccagggcaaaaccttgagtgccaacaagccctggaaggtgtctttagacgccaaggaccccgagggcaagccgctgaagctcatcatccatcttgtgagtgagggagggggatga

SEQ ID NO: 4295 - DNA, 567 bp, Chlorella protothecoides
atgcctgcattcccggtgatctcaacccccttccaccccacccctcaacccccagaatcccaccccaccgctcaccatcttcacctcctcctcgttgtagccgttgtcggtcataggggagttgtgggagaagacattgaaggcatactggaaggggaagatgttctgggtgacaggcttgccgtccagcacctcccgcgtctgcagctccagctcctccatggcggcctgacccgcgccgctggccgcctggtaggtggacaccaccatgcgcttgaccccggccagccggtgcaggggggccaccgccaccagggcgatgatggtggagcagttggggttggcaatgatgccgccgccgcccgcgcggtagccggccatggcctccgggttgacctcggggatgaccagcgggacgccctccgtcatgcggaaggcgctggagttgtccaccactgtcgcgccggcggcggaggccacggcggcgtacttcttgctgatggagccgccggcggagaagagggcgatgtccacgcccttgaagctggaatttgggaggggcgatga

SEQ ID NO: 4296 - DNA, 2178 bp, Chlorella protothecoides
  modified_base (1739)..(1748): a, c, t, g, unknown or other
atgccgacgccgacgggcacgactttgctgaccgggcgcccgaccagggcgccgtcgccgtgctggcccaggcggggcgggaggtgccggagtgcagcgtgcccgtgctgcgggtcgccgaccccgcggccagcctgggccgcctggcggccgcgttttacggtgcgtgcgagggagtttttcgttgatgggggaggtccttgctgcgctagcaggagagggtgttggaaggcgactcagctgggtgcaatcggacccggctggagtggccaatctcctgcagggtttccagtccctgaccctttgtccctcacatatggcggctgttcgtgccatgtttggcagccaggaccagccatcctggggggctgcacatgcgtgcgggtcgccggcctcggcccaggcccagacagggccctcgctcaccgagcctggcatccccccgtgtgcgcagggaaccccagccgcagcctgaagaccgtggcattcgtggggacgcacggcaagacgaccgctgcctggctgacgcggggcctgctggaggaaacgggggcgctgacgggcatgataggtgtgtgcggccagggtgtgccagaggcgtgtgctcacatcgcccgtcgtcacgtccttccctgggcgcctgcaacccagggcccgaagcagctgtgtctctgtcccgcccagccagcacggctcagtcgcctcttactcccccctccaccgtcgccagggacgatagagtacgcgatcgcagaggatcggctggacgaggagggggcgctgtgggcgcccgaggaggacgacccctctgcggacagggagtcgtcctcccccttccacatcctgccctacgagggcaagtacgggttttggggcggcaaagcacatctcgtgcaatccctgggacgtgtcgtggacaggccaaagcggtttgcattgtttgcagctggaccaccacccctcttcacatctcatgcaatccctgggacgtgtcgtggacaggccaaaacggtttgcattgtgtgcagctggaccactaccccccttgtgcatttgcatgtgcacctcagtgatgctccgccaccctggaacctgaggactcctccctccgtggtgcatgcgcaggtgccccgagaccacaccggaccccctacacctccagaaagtgctggctggggtcaaggaccggggcgccacccacgccgtggtggagctgtcgctccagagcctcatacgggacgagtgggtgcagggacgggaagggagggtggggatcatggagggggcattgctggacgctggccatctgtgactccacaaacagattcgtttcagctcacaatcctcaacccggtgccggagatcgcccccgacgtgctggtcttcacttgcctcctggacgacgacctgcccgtgggtctgaccccggcagcctgctgccaagcgatccagcaggcttttgcgcggctggcgcccggcagcacggccgtgatcaacgtggctggtaagggtggcggactcgcccgtgatctccggggaggggtatgcgtttttctttgccggcatgcgcccggggcggacgcggcgagggtcctctgcgccctgaatccccagacaaactcatgtttggttcataccatccactcccgtggtggcacaattcatcgactcccgcctccacatgtttcccctttgaatcatccccctgtccaagtcatcacgcagacgcctttggagcnnnnnnnnnnctccacattatttccctttgaatcacccccctttccaagtcatcacgcagacgcctttggagctgagctggcggcgtcggtcgcggcggcgggccgcgcgcgtgtcctgcgcatgtccaccgcccccaccccccccggctccccgcccgccgacgtgtttgcggagcggaccaagcacagcatctgggagagcgaggtggtggtcaccacccccgccggccgcctgcaggtcatcctgccactgctgggcgcggcgcacgtgggcaacgcgctggcggcagtggccgccggctgtgcgctggccatcccgctgccggcggtggtggcggggatggagggcgtggacgtcatccccggccgctccgaggttatcgacgagggccaaggcttcagcgtggcagtggacgcggcgcggagccccgccggcgtc

SEQ ID NO: 4297 - DNA, 330 bp, Chlorella protothecoides
atgtccccacctctgcttcacactggtggggtccgggcctccgggccactcggccctggcgccctccccaggcacggcaccggcctctccccggccctgcgcacccctcccgcgaccagcacctccagagactcgagatctggggcatcaagggcaggggcagcacctgggtccgacccgtccctgctggtggtgggcccgggtgtgctaggccagcaccttgccaagctgtggatggacgctcatggccccggcacggtggctggcctgacgcagacggactccaaccatgcccggtgtgtgtacacccttgtccatgcaagggtgtga

SEQ ID NO: 4298 - DNA, 720 bp, Chlorella protothecoides
atggtgcaggaggcgtcgcatgccacggtggtcccggccctgctgggcctgatgggcgacttccagaacccgcgcgtgcaggcccacgcctgcaacgccatcgtcaacttcacggagacctgcgaccaggacgtcatctcgccctacctcgacgagctggccacacgcctcatggccctgctccagggctcggggcgaaacgtgcaggaggcggcgctcaccgcgctggccagcctggccgactgcgcgcaggagtactttatcaagtactatgactcctgcatgcccctccttctccacatcctcacccatgccaacgaccgcagccaccacctcctccgcgccaagagcctggagtgcatctccctggtgggcatggcggtgggccgcgagcgcttccgcgcccacgcccacgaggtcatgaagtacatgcaggacgcccaggccgcgggactggaggccgacgaccccctggcctcctacatgacccaggcgggggctcgcatctgcaagaccctgggccaggagttcatcccctacctccaggtcgtcatgcccgccctgattgcttcggtggagctgaaaccggatgtcacggtggctgccggcgacgactccgacgtggaggacgaagacgaggacgtgagttgggtgctgaaggggcgcaggggcttggacgctatcggacaggtgccgagcctcctgcctggtgcttgttga

SEQ ID NO: 4299 - DNA, 333 bp, Chlorella protothecoides
atgcccaacctggcgcgctctcggaagtgcttcctccctggggcagggaatcagagcacgctgtattcctctatggatcctgcagcctttgcggcattgctgcaaggcctgctgtcctcggagaacgaagtccgatcccaggcggagcaagccttcacagagctgaagaagtaccccgacacatgcgtgccggggcttgtgcaagggctgaggtcgaatcctgacccagcatctcgctcgctgtgtgccgtgctgttgcgcaaggtgggggtggtgtcgacggtggtcgccgtcacggctgcaggctgctgtggatgtgcatcgcccagctag

SEQ ID NO: 4300 - DNA, 399 bp, Chlorella protothecoides
atgcaggatgtgcccgagtggcacacggcagaggacgagaaggaggagaacgcgggcgagggggagctgttcgagtttggccaggagtgcctggaccgcatcagcttcgcgctgggcggcaagaccctggtgcccgtggcggggaccacgctgacggcctacatggccgacacgggcagctgggagaagcgtcacgccgcgctcatctgcctggcccagatcgcggagggctgtgtcaaggtcatggtggacgaggtggagaagctggtggcgctgtgcctgctgggcgctcgggacggcacccccaaagtgcgctgggccgcgtgccaggccctgggccagctctgcaccgacctgggacccgacctccaggtatggcgagggggtgaagaggggtga

SEQ ID NO: 4301 - DNA, 297 bp, Chlorella protothecoides
atggagtcggcgctgagcatgtttgcgcagctggccagccacatcatgagcgtgctactgcagtacctgggcacgctgcacggcatcctggctgccgcgctggcccatgcctccactgacgtgcgcctggcggccatgaaggcgacctgcgctttcatccaggagctggagagccccgcggagcgcgagaagttccaggccctggtccccgccctggtgcagaccatcggccacgccatccaggcgggggacgagcccgcggcacaggtcggtctgcggaggcgcgcatggtgttga

SEQ ID NO: 4302 - DNA, 1356 bp, Chlorella protothecoides
atgactcggctaggcgtcaatcattacaactctcggaccctgctccaccgcccctcaatgcacctcaggctggccatcgcgcatgccgtgcgaggggcccgctgggaggtggcgggccccctcctgctgcgattcgcggcctcctgcgacgccgcaggggcaagcagcagccaggccaaggcctacctgggggcggtggtggtctggctctccgccgcccgccccaaggaggcctgggccgtgtaccaggacgccctggccgtcagcgccttttgcaccagcaacgaggcctttgccgcagaggccctgttcgacgcctaccgcaccgcgttccccgccgcagtggcggctgcggtcagcggcaaccaggccttcctgcacctcgacaaccaggtgtgcggcgtctctggtggcactgtggctgcagtcggcttgtcctggctgagggatcacggtttgcactgcccttccaacatgatccctgcgcattccgtccctggacccctccgtcatcattcacagctggcccggctggctaagaagctgggggaagggccggtggctgagatcgaggccgcgctgccagggagtgcagtagatatctgcagtctccctgcatccgctgttgccgtgctctaccaggctgctcgttgtgactcagctcagaggcctttgaaaagtgacagcctgccaagggttcagagcattgcgtgcattccgtggcaagagtgctgtgcgaccctgccagtgcccgccaggacgactcccaagcaggcaaaaaggcgcgcactcgcgacgcagctgcctcacagctcctccacgccgtcgtcggtccagtccatggccgcctcagctttgccgtcaggcctgagcgcctcgccaggcccagcatcgccatcgtcctcgtcgctcccactgtccaaggagccgtcgcttgatgcgggggacaggctgccaaagaactctcgatccaggtcgttcagaccctccaggtccggcggcggcgtggcagaggcctgccttgcccgcttccttgggcgcccaggtttgaacctcgggccagcgggcttggagttcgaggcgggtgccggaccggtctcgcaggccgtcgtcccggcatcggggctggaagctgcaggtgctggccgggagagcccctggtcacgaggagctgcagcaggttggggctgcagcgctgcgcatgcggggtcacatgcccgaggccccaccccagcgagggcagtgttgatggaggccccatccagcgactcctcagtggccagcgacggcccggtcagctccgacagcagctcctcctccaggctgtgcagcagctcgtctgcatccttgtcgtag

SEQ ID NO: 4303 - DNA, 816 bp, Chlorella protothecoides
atgtccaaatctgggggcctggcggaggctgacaggcttttctcggagggcacgaaactgatcaacccctcggtgttggctctccgcttcaaggcgcagtggtccactgcaacgcctctatttgagagggctggtcttctatacaggcaacatggggagctggcccaggctcgcacggcattcgagagggccgccaaaggtcaagagcgccagaattccggctggcatgccgccaagaattgggagaaggcaggtgcgagggagttggagggaggggggagaagaggccttgcggccgcggtcctcactgagatccatcattcaccacctcacacatgcttgcgcagccgacatagctcgggcgcagtcagatgcagcaggtatcgagtcttgcagcctggctgctgccgaacagtactgtggggagggccgcctgccagcagcagcagacgcagcagtcaagggtgccagggccctcgagacgcttgcaccagaggtatgagtgtcacattgcctgtgacgtggcatcgcctggctggctgcatgtcttggtcctcttgtggagttggagtggattcatgtccagggagtcgtggagtatctggagtggtgattcttgccgcgctagagcaaggtgaacgccccactcaggccataaacgcaacgcagatgcaattgagtggctggaagattctgggaaggatggcacatcaggagacacgtacaggtgggactagggccagagtcactgtcctgcaggatgcttgtccagttgcagtgcagagcgtgcacgcccacacaggcacccttgcatag

SEQ ID NO: 4304 - DNA, 2103 bp, Chlorella protothecoides
atgggcaagcagctgcccaggatctggggttcatgtggagctggcttaagcttacgttctagagttctctcagatcctgataagaccaagcaccactgcgcgcaaggtgcgcatgcgcgacctgagcggcatcccacccaacacgctccgaaacggaaatcacaggaagcttcataccgccaggggcatctgtgtcgttgttttgcgcgagtttgggccatacgtgcaccagctcaacgcctctgcacccaccatccggaccgattccgggaacttgagcgagcatcaggaacagtgcgtattgtggttgctcgccgtaggttgacgcgctctgtacatgtcagccaacatgtcttcgacaccctccacgaccacccctcccgccgcctttcctctatacacggagctcatgctgttccaccaagtttagcattccactcctcctacacacgacctattcaggcgttcaacgcatcgtggctgttctatgaggcacagatcagcgggccaaaacccccctggagcaggatcaagtatcgcggggatgcacacctggacgacgcagtgccgggtggatggtacgacgccggcgaccacctgaagctcaacttccccctgggccaggcagtgtccttcctggcctgggctgctctggacttccccgaggcctttgccgcggccagccctgccaacaacccggtggagaacatccggctcgcagcgcagtacctcatggactgccacgtgggtaagcacgagtatgtgggccagatcggggaccccgacatcgaccacgattactggggccggccggaggagcagcgcggtagtcgccccactttccggtggacactcgccacgcccgccagcgacctcctgggctcggtggctgcggccctcgccgccagccacctgctcctcaagggacgggatgagaagatggctgctgagctcctgcgccatgcagaggagctgtacgcctgggccaaggaggtgcaaggtgagcgggggaggaggggagggctcggactgggtggagtttgtgccaggaggatggaggttgaacagcgcttgggcgtggaagcgtgcaggctgacggcatgtcatgcgagtcacccagcacaagcacagccactgcggcatcctgctgcacccattgaaaccagcggctgcccggttgcccccatgcaggcaagtacaacgcggcccacaagggcgcaacacacgtctaccagtccagccgcttcctggacaagctcatgtatgcggcggcctggctattcagggcgaccgggcaaggacggtacgctgatgatgcgctggcccactggcgagccgccggcggcagcggcgacgtcgtcacgagctgggactcgctctccgtcccagccctcaacctgctgctgggcctggcggcgcagggaaaggcggtgcctggaaaggacgaatatgaagcctggttccagaacaattttctgtccgcctggtttgaccccagaagcggtgagttgggttggtggggggggagaaaggggggatgacggagactggcttctggagacacaatgcagtggatcagtaccttcatcacagggcgccacgagagaaagccactgggacatgaagaagtcgccaaaggggctcattgtccccggatttgctgactttgggaacctgcgctatgcctgcaacaccgccttcatgatggcgctgcgcgcctcctactcgccgagcgaagaaagcaaggccctggcctggtgccgccagcagctggactatgtgctgtggtccaccggccgcagcttcgtggtgggggttgggagcgggtacccgctgcggccgcaccaccgagccgcctccatcccagcggcagccgcggggcaggggcgcgtctggcagtaccacaacagcccggaccccaacccgcacgtcctgacgggggcgctggtgggagggccggtgaggggcgacgatgggtacgaggatgcgcgccccaacttccgggccaatgaggtcgcggtggacttcaacgccgggtacactggggcgctggcgggcgtcctggccatggaatcgcgcagcctgcagatttccaccaactga

SEQ ID NO: 4305 - DNA, 186 bp, Chlorella protothecoides
agactcgactctgaccccacacctgactcgagtcgcaccttccccacacaggacgtccactgggcgacggtggtggtggacgaggcgcacaggatgaagtccagtggctcagccacgcgggcggttctggaggccctcccgcgccactggctcctcctgctcacgggtgaggggggaggcgcatga

SEQ ID NO: 4306 - DNA, 261 bp, Chlorella protothecoides
atgacttggccgaagagacggagactgggactccaggaatggggattaccgactgccatcatcgcggcgtttgcactcaagggcatgcacatgatgtacccttggcagtctgccgcattggaggagggatggcatggggacaacctggtgtacagcgcgcccacctcgggcgggaagtccctggtcgcggacctgctgctcatcaaagcccttggccagctgcgtttggtgagatcttctcgacgtttacgtgcgatgtga

SEQ ID NO: 4307 - DNA, 315 bp, Chlorella protothecoides
atgccagcaaggggcctggtcatcctgccctacctctccatcgtgcaagagaaggcagaccatctgagtttcatcctgggggcccttggctgttctgtcaagggatacacggggggcctggacgagcacacgcccctgggtgtcggtcctcgtcggcctcatcgccgtgccgttgctgaccacaggggcgaaagggtggccatttgctccatggagaaagcccacgtggtgctcgaccgactgaccctggagtgcaggctgggtatgtcggacggagtcggcagctgcaagccagcgccattgtctgggccatga

SEQ ID NO: 4308 - DNA, 318 bp, Chlorella protothecoides
atggcctggaacccggatcagacctaccccatcacacttggagatagtattctggggttggaagcccccgagcactggactctgcgctacgacttcaagcctgcctctgcagccgaatccgggcaaggcaggctatcagtagaccacgcaacacaacgggcttcgttccaacggccaagctccgtcgaggggtgtccaagcctccaattccacggcaagtatgagccatccaaggatgggatggactgtgtggccatctatgatggccagggcttccgcctggagttggtgcaggcagccgtaaagaatctgaggtga

SEQ ID NO: 4309 - DNA, 1119 bp, Chlorella protothecoides
  modified_base (51)..(60): a, c, t, g, unknown or other
atggttgccatcacattgtggagcagcatacgacttcatgctgtcctccgnnnnnnnnnnctgatgtcatggggcaacaggacttctgtcaggaagctggagaggtgcatggctgatcccaggcgcaatgcgtctgggttgcccatggagggaatgctcatctcagctttgatcactcctcctcaacgtgataaagagcagcatacgacttcatgctgtcctccggacctccagatcaacatgaactctcgcgatcccccgcccgctcgcgatttcccttggcgtttagctgactcaggcgtgagatgtcactcaataacggatcctgccgcggctcggcctccggtgtttgggttcggggacgggttcctgcggtcaaagactcatgtagacccgaatgacggtgcgaaagatttagagggcgcgtattacctcgcaccgaccttcagcaatcagtgccgaggacatctgcgtccatattcctcgatgggtgagccggacgaggatcactttgaggctgcggccgagcaattgacgctggccatcgccgccggcaacagcattcccgatgacgagctcttggcactgtatggcctgtacaagcaggggagcgtggggccatgcaccacctgtaaacctggatttctcgatataaaggggcgcaaaaaatggggagcctggcatgcgctgagcgagcttgacaccgccacagcgcgagaccggtatgtgatcaaggtccgcgaattgctgggaggccctgcggaaggcgagcaggccgccacgtacatagacgcctcgccgtccgtgagtgtccccaccaacgaggtgcagctgcccgaagacgacgagcaatggacactccggaatacactgcctcacatgcaggaggggggaccgctgcacactgccttgtgcgaggcagactctgtcgtgctgcagcgcctgcttgaggctggcgagcactgcatcaacgcccgtgatggacaagggtgcacaccactccacctagctgctgacgcgggctccctccaggtgctgtgctgggcgtggccatggcagtcgaatgcctgttgcacctgtgcacgcgttggaggcagcctccacgattgcaggtggtaa

SEQ ID NO: 4310 - DNA, 1839 bp, Chlorella protothecoides
  modified_base (1193)..(1202): a, c, t, g, unknown or other
atgcgcttgagtccatctggcttgcagttctccgcagggcataggctcgcggtcacgacgctggtgaaaccgttcagacctcgccgcgccatcaccacgaccaccatgtcgggatcagatgctcctcagaagctggataaatccactccggacagcgtttggaagcaggtcctgtctccgacacagtatcgtatcctaaggcagaagggcacagagccacccggcagcggagagtacaactccataacacctggtggcatcttccactgtgcagcttgcgatgctcctctatactcgagtgagaccaagttttcgagtgggtgtggctggccggccttctatgacgagctcccagggactgtggagaggcacgaagatgtctccatgggaatgcggcgagtggagatcacctgcaaaaactgcggtgggcatttaggccacgtcttcgaaaaggagcccacgagacgtgctcatccccaaaatactcggtatgccagggtttcaaaacgcccacggacgagaggcattgcgtcaactctgtctcactcaagttccggccaagctaaggagcctctggttgctggaggcgtgccttggggcggggcctgctgcgtactcactcgccaccgacgacgcgatacgactcggatggtgaaactcacgctcatagctcgcgtgagggatggccagctgctggctgagggccttgatggagagaaggaggagggcatgtacgcgtacaagacacaagccaaggtgcgatcgatggccagggagcatgatctcgcgctgccgcccgctatgcttcgatgtggatcctgcacgacggtcagggtgtggtccaaccccgcggcgaccaacccccccttgcagagcctcttcaagcagttcagcacgagcaagccgcccccacggcagtcggtcgcctcgggcgacatggttttccacaccctgatcgacgagtatggcgtctgctacctcaccctcacagacaaggcctaccccaagaagctagcgtaccagtacctggaggagctgcagagcgagttttcgcggatgcacggaccgcaggtcgatacggtcaaccgcccgtatgccttcattaagtttggtgaggagccatgcgctggattgcctgcagaaacatcgatggctcttgacgacaagctctgtgtggtgccagggtcgatggnnnnnnnnnntagccatgcgctgtcttgcctgcagaaacatttatggctcttgacaacaagctctgtgtggtgccagggtcgatggacgggaccttgtgtcctgacgcatggcagactcagcatggccattctgcctcgttacacagacacattcatccagaagacaaagaagttgtacttggacaccaggacccaacgaaacatagccaagctgaatcaggacattgccgaggtccaccaaatcatgacgcgaaacatcaatgacgtcctagcgcaaggagagcgcctcgacagtgagttgcgctggggtgtcttgtttgcagctgggctttgttgggcttgggcactttgcttcactttatactctccgaagagtgcacatgcatactgcggattgcttgttggcaggcaggaagagcgcccttccccccttcccaccccgcccctcaagccactcaacccacccccatgtcactgcctcacagagatgcaggaaatgtccaccctgctgtccaatgatgcccggcagtttgcggtcaaggcgaaagacctgtaccaccaggccttgctccgaaaatacctgccgtggttcgtgacaggtggcatcgtgctcctcgtcctggtgctcagactctggctgtactga

SEQ ID NO: 4311 - DNA, 1053 bp, Chlorella protothecoides
  modified_base (355)..(364): a, c, t, g, unknown or other
atgcatgccgtcctgcgcattgcgaaccgcgtcattgatgcattctctcgtttggtcatggccgaggcaatggctactgtacattgttcaccattcccagtcgacaatggcgacctctcaatcttagagatagacagcaaattcaagcatggccagcacctctggagaccgctttcgccttcgatctcttcaggccggcgacttccggaagggtggggtccagagagtggcgcactggccaatggtcatgtcgaggtgctggcgcagctgagccaggttgggaatgtcgacgaggcagcctggcaagagcgcttccaggtcctatccagtcaacaagatgtgtacaagatcatgnnnnnnnnnnctccttggagatgcatcgccctcgagtattctcacatacatcccattgcggtggcagagcgcttccaggtcctgtccagtcaacaagatgtgtacaagatcatggtcattgagggtgagctgagatccagggccctgcatcttgcccgcatcagatcctgtacaaacataaccaacaggacggtgaccaagggtgttgactttgtgtcacatcctctgcccgcatgtgcagacacaaccaccgaaagaatagtggccaccgcaacactcctcatcgagctaaagttcctgcggagcagcggcaagtgcggtcacatcgaggacgtagtggttgacaacagctgccgtggatatgggctgggcctgagggtaaccgaggatgctgttggttggaacaattggcaacactgtcaactcagtggactggccttgcacctgctgcaggttgatacagcggctgggagatctggcagaggaggcaggctgctacaaggtcatcctggactgtgcagaaagcaatgctgcgttctatgccaaggctggccttgctcgcaaggaggtgcagatggtgagtgggagggctgggaatgcgctagtgttatgacgcttatgcagtggttgaacttgaaagagctccgaaacgcagagctaataacgttctcatgcccgacgcaggccaagtacttttga

SEQ ID NO: 4312 - DNA, 1056 bp, Chlorella protothecoides
atgctggatgcgagctcctcctgcatggccgcgaatccggcctgctccagggggctgaggcgcggcaagggggggatgcgggcgatgccgccgggccccagctccaccggcgacgcgaagaagggcgaggatgtcaagttagaggccacgtacgcgcactccacgaccccccgctccccggccttggctcgcaggcacgacgtggcaaactcggcggcagcatacgccatggagagcgtggcgctgcccgcgccagcctgcgattttgtaacgggaggaggaggagggggatggcattggaatctttgccaccaggccgctgtgatgagaccacccttcggtatcccgaccccagcgaccccagcgaaccctgtgcccagacaccagacatgccttggccttgacgacctctgtgccggcgtcctggatgcgtgccgtcagcgcctttgcttcggcctccgacagcctgggctggggcacggcggcggagaggaggggcaggatggtgaccccggcatgccccccaatcacgggcacggtgacggcctccggcgcggcgcccgtggcctcggcgacaaaggcctgggcgcggacgacgtccagcgtggtcacgccgaagaggcgggcggggtcgtagaccccggcggccttcagcacctcggccgcgatgggcacggtggagttcacggggttggagatgatggccagccaggcggcggggcagtaccgcgccacgcccgccaccagcgtcctcacgatgccggcgttgatgttgaacaggtcgtcgcgcgtcatgccgggcttgcgcggcacgccggcggggaccaccaccaggtccgcgccgaacagcgccgtgcccagcgcctcggcgccggagtgcgcggtcacacgggcgccggtggcgatgtgggacaggtccgcggccacgccggctgtgttggcaacgtcgtacagcctcagctccttgatgtaggcggacctggagggttgaggggggtggaacgaagggagactgatttggggatgaagtcaaagacgtccaagtcgacatgctga

SEQ ID NO: 4313 - DNA, 387 bp, Chlorella protothecoides
atgctgggcgacgcctggctccgtcgccttgctttagctaccattagccaccacagcagcaaaaggcgggtcggtcggatcagaacctcccctgctcctgctgcgcgcgctgtgtaccgacagcaacagctttcgttcgaggtcttcaaattcggatgtgcggctgactttggtcatcttcccaaatcgcggtcactcacgcacacccccgacccaacagcctccacaatggcaccatccgcgatcgaggtcaatgccgttctccggccactcctcctcaaggacctccgtaaccagtgccgggctcggggcctcacccctgccggcagccgcgagtccttgatggaccgcctacaggagcacatgttgtccacaggcgacatgtga

SEQ ID NO: 4314 - DNA, 480 bp, Chlorella protothecoides
atgtacgtgcgtgtcaagcgccagaagaccaccgtgttcctgcaggtcaaccccactgacaccgtggccaccctcaagtctgctattggcgatctcatacagcaggtaggcgacccctgcacaccaggtaggcgacctgcacaccaggggctggaagcgcacccacatcctcgacttacttccgctctgtacgatgcgcaggaaccatccacccagcagctgtaccgagggagcacggccctgacagacacccagaccctggccgagctgggcgtgcatgacgacgacgagctgggactggcgctgaagaaagaaggtatgtgtggagggattgtgcgctgtggccgacccctccatgccactgcactgactggcacctggagtcatgtcaccctccccattttcctggccccagatggcacatgggaggcactggagatcatgcggcacgaggcgccgtccgacggtgtcgcggaatga

SEQ ID NO: 4315 - DNA, 558 bp, Chlorella protothecoides
atggcagtgcgcctgcagcaagtccttcgacgcagcctacgactgacgagtctccaagggacagggccttgcctgggtgggtgcattccctctccgcttcacatagagcagctgctgagcgcccgaccacttcaacaccctgcagccacccccgagcccctgcccactcacacggcacggttcctggacgggcgggcggcagcagccgactggcacgcggagctggcgcgggagtctgcgcacatcctgaaggtggcggggcggcgccccggcctcggcgtggtcctggtgggcgaccgccccgactccaagctgtacgtcacccgaaaacgggaagcctgtgaaaaggtgggcatctcggagcgcctggttcagcttccagatgactgcagcatcggcgacgtgcagcgcgtggtgggcgagctctgtgccgaccccggtatcgacggcgtgctggtgcagttacccctgccgcccgacatctccgaggagcgggtcatggagagcttcgatcccagcaaggacatcgacggcttccacccgctcaatatggggtga

SEQ ID NO: 4316 - DNA, 696 bp, Chlorella protothecoides
atgcggggtcgcagcacaggcttcgtccccgccacggcgctgggcacgctgcgcctgctggccgcgggcggcgtggagctgcgcggcgcttcggtggtggtggtgggcgacagcaacacggtgggcacccccctggcggcactcatgcgggacgcgggcgcggcctcggtcaccgtggtgcaccgcacctcctactcagcgctgttcgcggacgcgttgtcaccgcgcttggccgcggcgcgcgtggcagcggcggcctgtgcgccgcgcgtgccgccagggccttcccaggccgcgcgcgctgccgacgtgcgggaggaggcgctggagcacctggcgggcctgccgggcattacgcgcaccgccgatgtgctggtggtggcggtcggctacccgcgcctggtgcgcgcctcctgggtcaagccgggggccgcggtggtggacgtcggcatcaacgtggagggcggccgcgtggtgggcgacgtggacgaggcgggggtggcgggggtggcgggcgtgatgacccccgtccccgggggggtggggcccatgaccatcgcggccacgctgcacaacgttgtggcctccgcgcgggacaggctgctgggtccacgggaggtgccccaggtggagcccctggggggcctgctgcggcggggggacctgcactatgccttcccagattcgcgcacgtga

SEQ ID NO: 4317 - DNA, 870 bp, Chlorella protothecoides
atgcgatggctggaagaggcaccagatgccgagagtctggtaacagaacacgttggtctgatgggagtattcttcaacggagcatttgtggcggcgttcctcggcttcttctttgcccaggccgccaagatgttcacgcactactactctgagcggaagtgggagctggaacggctctggggctcaggcggcatgccctcctcgcacacctcctgtgtacgtgtggagtgttcctggacatggtgcatgcctgtgcggtgcctgcgctttgcccagggcttctgggtaccgcaatgcatgggcctcgaatggctgcctcctggcgttgccgccgccctctgctgggggcaatcacagaaccccatgactcatcccctttcatcgttcggaccccaggtcatgggccttacgtcggccgtgggcgtcctacaaggcacatccagctcgtactttgcgatgtgcgtcgtcttctccctcgtggggaagggagtcatgggctggcatcgctgtgtcactgggcgggccagccatggtctggggcccttgcagggcctggcctcgcatgctgtggtggaatgcaagcagccttcctccaccatcgcacaccctgctcaattcactctccccaccccgagtccctcctcttcctcttccctccaggtcatgtacgatgcgacgggggtgcgactgcacgccggcaagcaggccagcgtgctcaacatgatcatcatggagctgccgcctgaccaccccgtggccagcaacgtggagcagctgaaggaccagctgggccacacgccgctgcaggttgcggtgggcgcggtggtcggcgtggtcaccggctacatcacgggcatcctctatcgatga

SEQ ID NO: 4318 - DNA, 264 bp, Chlorella protothecoides
atgtggacttttgagcaggcccagacgtttgcggggttccgcacctccacaaacatcaggatgactgtgatcaagctgctgtctggcgtgctctgggttcatgcgcccattgcacccaccgccgagtgcatccggctgatgagggagttgggcttcccagtgggatacatcgtgctgacgacatacgcctatgagcacaaggtttttgtgggccctttcagcaggaagttccctcgggccaaggtgtacgtcccgcccaggtga

SEQ ID NO: 4319 - DNA, 681 bp, Chlorella protothecoides
atggaggaggaattcgggagcacctcacctctgagacggggagcaggcttgcgtggaatttgcatccaccaacgcttccgcttccgccgactccattccagaacaactgccccctcccctccccctcacccaaaactaataaaaacaccccgccccgccaccaccaggggcatcgacgtggtgcgcaccaagatcaagaactttgcgcagcagcgcgtgagcctgccccccggccgccacaagatcgtggtgctggacgaggccgactcgatgacgggcggcgcgcagcaggccctgcgccgcaccatggaggtgcacagcgccaccacgcgcttcgcgctggcttgcaacacctcctccaagatcatcgagcccatccagtctcggtgtgcggtggtgcgctacgcgcgcctggccgacgccgaggtcctggcccgcctgctccacgtggctgcggcagagggggtggcccacactcccgacggcctggaggcggtggtgttcgtcgccgacggcgacatgcgcggcgcgctcaacgcgctgcaggccaccgcgcgggggccgggcctggtggaccaggccggcgtcttcagggtgggagggaggagggagggggagggcgggggaggtgaaaggctgctggggcctggcagggctgcgtgcgacgaggccgtgttctga

SEQ ID NO: 4320 - DNA, 549 bp, Chlorella protothecoides
  modified_base (370)..(379): a, c, t, g, unknown or other
gaggccgcgcgcgccgcggcggggcgcgccgaggaccgcgctgcgctctctgaggccgaggtggcgcgcctcacagccgcactggaggagcggcggcgagacgctgcgcgcgccgagcgccgcgtcgcgctcctcctgcgcgagcgctcgggcctgcaggccgtgctgtcctcctacgacgaggagtacctggggggtgcgcgcggcgaggcggggatcgccccgcagcaggcgcgcctggcggagctggaggccaccgtggagggcctgcacgcccacgtcgccgacctggaggcggagctggagcggcgcggggctggtggcggtggtgacgtgggtggaaaggatgacgtaagccatgcggcctcannnnnnnnnnggaggcggagctggagcggcgcggggctggaggcggtggtgacgcgggtggaaaggatgacgcaagccacgcggcctcggcgcggcagctggccgaggcgcaggcgcgcgccgacgcggccgaggcgctggcggagcggttgcgcgccgagggcgaggcgctggctgcgc

SEQ ID NO: 4321 - DNA, 1074 bp, Chlorella protothecoides
atgctggccctcccagggccccagcatgtttttcaatacacgggagacttcacatgcaatggagttcccatcgtcctccgccaagagggcggcatgggccgaggcacaggatgggccgtctgggatgcatccgtcaccctggcgcactggctgcagcacatttcagtggagcagaggctccagctcctgcctcctgggaaagccttcctggagctggggtccggcacagggattgcaggcctgtctgctgcagcgtgcctagaccagggctacgcccacctgtcagacttgccttcgggggcagagggagagagagctggatgggttgagggcaaagaggcccctcacccaacccacaatcatgggggcgtggttacatgtcctccatggagagctgtttcctgccacacccgctccggcacccaggtctcctcccgtgtttcagtggtgccctgtgactgggagtctgtggggcgtgaagctctgcctgcggcgccttatgcgcttgtcatcgcagctgactgcgtctggctggaggcactggtgcagcccttcatcaacgccctcctcaccgccaccggccccaagagcaaggtgcgccctgggatggtcctgctggctcaccagtgccgatcacagcgtgtagatgatgccttcttccccaggcttgcagcggcattcaaggtcgagtccgtctctcagcgacctggtgagcccgaacggggcgccatcgacctgtacatctgggcttcagtgcagcagcacttcacggtgattgccttagcgtcattcaagagaagccgttcagtggcgctcacctcacctgccctccctgttgggcttgcagatggcgaggcccgcctccgcacccccccgactgcagacccctctcttgagcaggggccggagcgtggcattgagcagggcatgcaccccgctgtcgatggggtgcacgatgtaggggatggtggccagccccaccgcggtgggcagcgacttggtcagcaggggcagcagcgcctcctcgggcgtgttcagcgccgaggcgagcagcgctgtcaggctgtggcctag

SEQ ID NO: 4322 - DNA, 741 bp, Chlorella protothecoides
atgccgtacccgcccacggcggcggccgcgccggcgcccgccgccgccgcgcccggcaatgagtactgcgcgctgttcgtggcgctgatcggggagggcgaggcgccgcagggcgtgctgagcacgggcgaggggcgtgtggtgcgcgccttccaccgcttcacgctggtggaccagaccgggcgcggcggcgacgtgtccaagggccggcgccgggaccagggcgcggtcaagatctcctgttcccgcgccgacccccaggcccgcaactgccacggctaccgcaagttcgtcaagcgcagcgtgctggaggacccggggcgcggcctgctggtgggcgacaccatcgtcatccgctaccacatccagctggtggtgtccacgggcggcgcgctggcacgcgcgggcgcggcgccgcgccgcggcgtggtcgtccccccgccctcgctggggccggagctggcctgcctgctggacagcggggagggcgccgacgtcagctttgaggtggagggccagaccatggccgcgcacaagatcctgctccaggcgcggtccccggtgttcaaggcgttgctgacggggccgatgctggaggggcaggggctgaggccgcgcgtggatgttcagggcgtgaagctccccgtcttcaaagtccttctgcactttgtgtacgccgacgacctgccagaggagctgcagggtgcgcgccggggtcggggcgggggtgtgcagtcgtga

SEQ ID NO: 4323 - DNA, 552 bp, Chlorella protothecoides
atgctggcactcttgccggcaccagtacatcgtcccccatcctgtcgcagggctgtgggacgatgccgcagcacacagggtggcgacaatgggaggcccaccctacctcataccccaccacctcgggcccccccgagcagcagtgggccggagaagcgaggcgacggcatagacatcgacttgtttgagcctgctggaacggaggaggacacgaccgggcgccgggacccctccatccccacgcccaacctccaccccctggcccggctgctggagagtgtggactggtcggagcccggcacctttgacggcatccccaagaccgagtacgacccgctccgggacgggcccctgcgctacctgggatatgccaacgaggtcggggaggcctttggcgcctggctcttctccggcggcgtgcccttgtcctatgccatcgccatctcctacgtcctcttcgacaccgtggacaagtggcaagcgacctacagggacgcccgggccaagctgagcggggagagtgtccccagcagcgtggacgtgccactgtga

SEQ ID NO: 4324 - DNA, 264 bp, Chlorella protothecoides
atggcccagcacctgctggtggccgccgaccgcttccagctcatccgcttgcgcggaatctgcgagcagcgcctctgcgtcagcatcgaggaggagacggtggccaccactctggccctggccgagcagaacaacgcgctggagctgaagcgggtgtgcctggagtacgtcgccctgcacctgaaaaaggtactgcactcggtgtttagtggggtcgcggtgggcttgctcgtcggcggtgatggaagcgccccagggatttag

SEQ ID NO: 4325 - DNA, 876 bp, Chlorella protothecoides
atgctcgccgcaacgcgtggcttgcttaatggtagggtcgcgccgtgtcccatgtcatgtgtgttttgccattcccatgacggcatcctgcttccgattcgtacctcgaatcgcagctgcccgcgcccccccccccccttcccgggaagaaggggacggctacgtcgggtgaggcggtcaacggacacgccgggttgcgcatcccttcacgttgtgtcccatctggtccccatggacacattcctcgcgagattcgtcccgctccctggagccgcgaatatccagtcttgggaacagacggccagtgcggttttcattgcagggcgttggggttgcctgggatctttatatttcgaatcccctccgccctgcccctgcccatgcaaatgccgactgagaccgcgggcgcctgccctgcccggcgccctggccacagagaggggttcatggggtacagggtgggcaaggtggggtgagcacaggggaccacagggaggggttcatggggtacagggtgggcagggtggggtgaggacaggggtcgggcacgctcctgcgccgcgtttgaaaaaagaagaaagaaagaatgccgccaccggggtcaggccccgcgcgcgcgttcccgccgccgcctctcgcgctccctccaccccgcgggcccgtcctcggccgccgcctcccccggcctgccaccgccctggccgtggctggcccgcgcgtgggcgcgcaggtagcgcggcacctcccccgccggcacgctctcctccgcacggcacagccggcagcgcacgtgcaccgcgttgtccgcgccgtagctgctgccgtgcagcacgagcagggtggggatgccgcgcgccgccgcgtactcgtactgcg

SEQ ID NO: 4326 - DNA, 1800 bp, Chlorella protothecoides
  modified_base (77)..(115): a, c, t, g, unknown or other
atgcgacgacggcgagtgcgggggacgccgacgccgcggcggccggcgacgacagcggcggcggcggcggcggcggnnnnnnnnnnnnnnnnnnnnnnnnnnnnnnnnnnnnnnnccgctgcgatcgtgggcatcgcggtgccgctgggcatcatcttcatcatcgccaagacggggtgcatgtactactgcttcatctggctgaagaagcaccgcgcggcgcaggccgcggcccagaagatggacggcgactgggagattgacgagaagcggatcgagatcgtgcaccgccctgacggcgagccctggcagctgggcgagggctcctacggcaaggtgttcaaggcggtgaaggacggggtgcaggtggtggcggtgaagacgctgcgctgcgaggaggaccctctgcgcgaccagttcgtgcgcgagatcgcgatgatgcgcttcgtctcccgcgacgccaacatcacccagttctacggcgcggtggtgggggccaagagcctcatgctggtggcggagtacatggagggcggggacctgcgcaaggccatcaccgccgacgtgcgcaagcgcctggtgtggggcgcggggggcaagggcgtggcgctggacatcacgcgcggcctgcacttcctgcacacctcccgcgtcagccaccgcgacatcaagtccagcaacgtcctgctcacgcgcgacggccgtgccaagctgggcgacgtgggactggcccgcatcctagaggaccagcaccagagcgacggcttcgtgggcaccttcgcctgggccgccccggagctgctcatggggcagcgctgcgacgagcgcgtggacatatggtccctgggcaccgtgctgtgggagatcgtgacgcaggagatgcccatgcgcggcatgctgcgcccgccgctggtccccgaggagtgcccgcaggaggtggtggccatcatccacgcctgcatgcagcacgaccccaaggaccgcccctccgcgcgcgcggtgtacaacatgctgctggccgcgccgccgctggccgggttcgaggacgccgcctccatcaccgagtcctcccctacctcccagtcccccgccgactccatgcgcagctcctccccagattcacgccccacatcccccgtggccgtcgtgcccggcaccgccggcgagcgctcgggggcgatgtcctggcccgcccaggccttcgactcggcggtgctcggcgcgcagggcgccatgcgcgccgtcagccccaagctccactccgtggtggcccagatccagaagcggctgcggcaccacgaggccgtggccgcgggcggaacagatcggtccagcccgggcgacagtggggccgagggctcggtggcgcaggagggcgagcggcaggacaagtcgcccaggtcgcccttcgagaagcaggacctggcggggcacggcatggtgcggggcggcggggcgctgtggcagggacatgctcgcggcgaggaggccgtccccgcacacacaaccccgccgcagccgcctgcctacctcccttcgccgcgcctccggtaccataaagtcgccgtcaacacccccttcgtcgccgtcatcaaccccttcgccgcagacgccgctgcaggccgcccggcgcaacagaaccccctcccaaccccgaaccccagcgctgccctccgacccccctttcatgtctcatcccacgcacctcccatgcatccaccagggcagtggcgtgccccaaactggcgctctagtgctgcctcaggcgcaatagctgctggtccctggcccgccctttga

SEQ ID NO: 4327 - DNA, 1149 bp, Chlorella protothecoides
atgagagcgactccgcatgttcgacggtcaggctggcaccctcctccccgacttccggtggaaacagcaacttgcgccaatgcgagccattcctggcccctttttgtttccgctggagcatcttgtattgcaccggaacccttgtgcacaaagttctacttgctccctgcttccccattccctgctatttccccttcccatggcaacgagggagtacactttgctagtcacgtactgggcgccttacttgggctatgcgatgcaatgactgaggatatgggccgctctcggcaggcaggggatgtgggtggggaggatggccatgagaatccattcgagcgcgcgccaagggatgtggtggggagtatggccatgagaatccattcgagcgcgccccaagccatttcgcaatgcacggcattactcgtaggctggcctgagcaccctctcacagcaccgtatggcatactgaatatctggagcagctcgacatcccgcattgcctgctttcgcagtcctctgagtaaatcgcacatgtcttccatttcaataccatgcacctgcattcgtggcggagttcgaagtggagagaggagaggagtgtcggccactgtgcaggcgtccgccgacccagccctgggagcacccccaactgttggcagcggcggggcctcccgatctatgaagactgtgggtgtgcttggtggtggacagctcggcatgatgatggctgaggcaggggtgagtcggtggcatgatcttgagggaggcgctgaggttggtgggtggcgacaccagtacgtgagaacactttcctggcaccacatcggtctgaggctctctacttggcagatgtacttgtcattgaatgcagcagtcttcgtgaatcgcattccccaccactcactcctctcccaggcgaccattgacctggcactcaaggtcctggaccccaccccgtcctgccccgcctcctccgtggcagagcaggtcctcggcagcttcaccgaccccgccgccatcaaggagtttgccaagtcggtcgacctgctgaccgtggagatcgagcacgtggatgccaacgcgctggaggtgcgcgcggggtatgggtctggctgcattgcatcacgtggcaaggggcccagctga

SEQ ID NO: 4328 - DNA, 306 bp, Chlorella protothecoides
acgctgcgcgccgcagcgccctcgctcaccgcgcagtacgagtacgcggcggcgcgcggcatccccaccctgctcgtgctgcacggcagcagctacggcgcggacaacgcggtgcacgtgcgctgccggctgtgccgtgcggaggagagcgtgccggcgggggaggtgccgcgctacctgcgcgcccacgcgcgggccagccacggccagggcggtggcaggccgggggaggcggcggccgaggacgggcccgcggggtggagggagcgcgagaggcggcggcgggaacgcgcgcgcggggcctga

SEQ ID NO: 4329 - DNA, 315 bp, Chlorella protothecoides
atgacggagccggagccgagcgggcggggcgtgcggttgtgcctggaacgtggcctggcggccgcaggtgtggcccctgaggaggtgacctacgtgaacgcgcatggcacctccacccccgccggcgacgtggctgagttccgggccatccgtgcggtgctagggcacgacggcctacgcatcaactcgtccaagggtgccatcgggcacctgctgggcgcggcgggggcggtggaggcggtggccaccatccaggcgctgcgcaccggctggctgcaccccaacctgaacctggacgagccggacgagggcgtg

SEQ ID NO: 4330 - DNA, 960 bp, Chlorella protothecoides
atgatcatggaatcgtccttctgctgggatgccctgaccccacaggcggacggtacgcccaacaatggagcatgggaatcaccggctcgagcggcccccggattgcccatccagcccacccccgcctcccaaggacatgaaaacagccgaatcggcagtaaaccggccacatgctcttccatgtccctggagaggtacctggagcactacagtctcctcactcatgacactgggagagtcaagatcctgaaccccctcgagcagtccatgctgagaatgcaggacctgaagcaggtcctgagcatcaatgggatctcccaaggcaacaaaccgacacgccgggagatcctggaccggctgcccggatcggccctggtcatgccgggcaagggccaaggtgatgccgcttcccccctttcctccagcatgctcgccctggacgcaggcgtcgtggcggcgctgccgtgggttggcacgcccacccccgcactcctcgccgccttgagttcaggagcgtgtagctgctgccccctgccgctccagcgcatcacggtgcggctgcccgcagagactgttggccagacaccggggggttccggtgacatccccgccagcgtcaaatgcacagcagacccaccagtgtcggcggctggagctgggtcgccacctgccagagctgctgcgtcccttgcagcagcaggtctctgggcgcaggtcactggcaatccaccatccacctcgccttgcgcgcctcagaccgccccccaggcccatgccccgctccccgccacccaccgcccccgcctgtggctggagcgggggcttgcggagctggcgcgccactcctgcatcagcgcccatgcatgtgatggcgcgctgctgggccgcaaggtgggtgggcagcgttcgagaagcccggaacgcgctcgcctgccatcctgtgaatctcccaccatctag

SEQ ID NO: 4331 - DNA, 990 bp, Chlorella protothecoides
atgactccgcaccgccacctcggtctttcatatcgatcaggcacgtaccagcgcagcctgaaccgatcgttctgcaaggctgcagtggaggcccgccacgcattcctcatcatggacgcgccaaacctgcggctggcagacttccgggaggcctggtcaggggcgcaggctgcggggtacgaggtgtgggtcgccagcctgccgcagcgcagtccacaggtgccgggggccggtgtcaggcagggcccggatgctggcatgccgcggggtgcgcaggctgcacccatcgtcatgctcaggcggtgcgcccatcgtgggacaaggcgacggctgtcctggcagcttcacagcccgtgcttccgtcaacctgtcgccccggaccccacccctgcatctcttgcacaggtgtgcgccaagcacagcacccatgggcgcagcctggaggagttggagcagctggcggcggggtgggaggagctgccgcccggcttccagcccatctcgctccagcgcttcatgtttggcggcggggaggtcgctgaggtggagatggagagcgacgaagggccagaccatgccgcggcccggggtgatgccggggcgggggctcgttggacgcgtggcggcggcgaggccggacagatgcgcgaatccgtggagggcgcggctgggggaacggtagcttcgcctgaggccggcgtaggtctggagccggcagcccaaaaggccgccccacctggcatcctgaaaaaggcaggggcgttgccgcggaggaatcgccatgtggtctgggcggatcatgcggcgtccctactggacgaggactctgggtttcagatgcccgggtcgagaccgcaggtgggggtgaagcggcggtggttgtccggaagttgcaggcggaactggggaggggagttctacgctgatggcttgccattgcacagggctgcatgccatccgaggaagttcttgctgcagatcacgctctga

SEQ ID NO: 4332 - DNA, 414 bp, Chlorella protothecoides
atgagggaccgtgctgcacggcccgggaggtgtgctttgatcctccggggcctgcccgggtcagggaagagtgccgtggcccgtttgatccgcgaggcggagaaggccgcggggaccgaccccccgcgcatactgtccctggatgactacttcctgacggtgggtctgggggctgacaaacccaggggacgcctcccatgggcaagggtggtggagacagggacagcggacgattgcatctctagcagcgcaggggcaaggcatgtgtgcggcaggttgacctcagagtgtgtattgcatggccgccgttgccgtctgccccagtcccaggccggtttgatcgaatttgtcctcgccaggaggtcgaggaggaggtggcgggcggcaaggggcgcaagaggcgcagggaggtga

SEQ ID NO: 4333 - DNA, 645 bp, Chlorella protothecoides
atgactcgcgcacgtgtgtgtgtctccaagcaagtgaatcgacccgctggcccccgctcagatggccgcaaagtactccttgctcttggtggggttcatggtcttctcgcccggcttccagccggcggggcagacctcgtcggggttgtcctggacgtactgcagggcctgcagcacacgcagtgcctcgtccacattccggccaaaggccaggttgttgatggtggagtgctggatgatgccctcccggtcgatgatgaagaggccgcgcagagccacgccgtcggcggacagcacgccgaacttggtggagatctcgcgcttgaggtcggagaccagggggtacttgaggtcgcccacgccgccctccttgcgctctgttggattggcggtagtggggaggaaggtgggaatggggttgggcctcagagtccgtgctcgtcgctcctcatccctgggcgccggtatccagcaggcaagccatgcagcgggtggcagagcccccggcgcatgctcaacactgtcaatcgcaacaaaaccacggcgcacccgtctggatccaggccaggtgggagaactgggagtccacagacacacccaggatctaaagaagcgagggatttaagggggtcagtgggtcggtag

SEQ ID NO: 4334 - DNA, 2205 bp, Chlorella protothecoides
atggtgcatcttgtgagactgcaagcttctttgtcctggcatgttcctgttggcaacctctccatggcaccctgtgcagatcgtcctggagattcccgacagcgacgccatcacaagggcagatgcccagtcgatccaggccctggagcctttgttagagtctcgcagcgagcttgtggccattgcactctggctgatgcaccaggaggacagctgcagcacacctccacgcatctctggcctggtgcctttgatgtctatgatctgccatggccctgggcaggacagctgcagcacacctccacacatctctggcctggtgcctttgatggtactgagaacacaacagatgtaagctcgtctgctcacttcagctgggttgcatgctcatcccctaactcccaggcatcggctgtggagatgctggccaggccgggcgagggacgagccagcagccccctgctctggtcgcaggagcgactggatgagctcttgcagggctcgccggtgagagacatggtcgtggagaggaagcaggccctgatcgctgagtgggcagacatctcaaagttgatcagtgagcatgatccagcggcctttcctccaggtgggccctggtcaggtgtacgcaagggttttgtagccatgatggtggccactgcatcactcggtccgctgagcatgtggcgagaccaagttcatcgaagccatggcggcgacgctgcgcagtgtcttctacctccagagcgcagagtgctttgcgctgctgccacagcttcgcgactgggaccggtctggggagaagggggcggtcgtggactacgactccctttcctcgtcggtaatagtacgggccgacaccggcatcaagtgaggcgcctggcacctgtagaacgggtggcgaggttcgctagtatgaacagaaaggggatggcattgcgccatgtgtacaccctccgcacctccctgaccacaccatcacaggaggggtcaggacctggtcctgagggacgagcgaccctcttgcgagctcatgtttgcgctgggcgggggcaccgccgggcaggatgtcgacttcctcgaggtgccggcctcgctggtcatcacagaccgcctgtatggcttgaagaaggagatcctggactccgtggggctgggcgcagtctgccagtcataaggctccgtggaggcccaccctcaaggagctgctgcaccatggatcccatactccgcaggagacaccgcgcagtttgccaaggtgaggagtttcagcgactcttggaaacatcgcatgaggggatggcgggaacaacctgctgcagaggatgccagagaggacatcagcaccagaccaagacatgccttgtaaattttgagcgcgacgtgatcatatctgtggagaatgagtatgagatcctgcagcttctcatgtccgacctgagagccagggttcaagggtacagtggaggaatcgaggaggacatcagcatccttcagcggggcgatgcagcgcccgaggagaaggcggcagccaagcaacgcatcgccgagcgcaagattctgcttaccaatatggatggcgttcgacagcgcctcgcccccatcagaggcatcccgacaaaggtgggattggggcagtgcagggaggcagggtgggtacatgaagcgatacaatatatcactcccctgcagtctagtggtagacgaatgcatgcccaatgctggatcgccacacccctcgagcacttgcaggcgggaatgcaggatcccaactctgacatcaaggagatttttgatgccatggagtccattcccgccctgcctagcaagctgttcaacaggctgagggactgggcaacggggaaggatgatcccacatggaagaaaatattgaagcatctgtaccattcagggacaacacaggaaagctctattcagggtatcccagggaggagttcaggtataggtgcactgattttggaatggaaagcgcagcaccgacgcaggggctgggttcacgctgagtatcaaggtgttgaagtctccacttctctgaagggtaaacatgcatgcagtgtctctagtatgggttgggctctcaatactttcgtcactctcagctgccagatccacccaacacgttttgcccagcttggcatgccttcgaaggaggaagctgctgcctctcagtcatcctcgggttga

SEQ ID NO: 4335 - DNA, 1032 bp, Chlorella protothecoides
atgtggcaaacaactggcgaccttgcacaccgtcactgctcaacaaacaaaccctcccccccccctctgtcccctctcttaaatccctgcagatgcccgggtcgcagggctgggacgaccagtgggtggcttgcaacgtcagcctgggacgagagcgggagggcgagggcatgggcggcgcggcttggtggcgcttcgactgtgggctggtggacgcggggggcgcgccctttgcggagcacgacgcccaccactgctccaagtccttcctgggtccccagtgcgttttacagagggagggggaagggacgtgcaagtaggggaaggaaagagcaatggcagcttgcagctgccggggtctgtgcgggaacatgtttcagtggtgtacccctttccgcacgcaaattccaaacatcatgctcccccacatcatcctgcaggctggtgtcggtcctggatcgtgtgcagggcgggttcatcggacagaccctctccaaattcggcattgcagggctgtacaccgtgagtcggcctcgacctagaatgttgctaccttcaagcgttcctgcacgggcactcgaagatcatgcgtcgcagccaggcttcctcttgacaccccggcccatgccccttttcacaccctccacctacacacacacgcacacacaacaattttccctcgcgcaggtgttcgtgtacggcatcgggcgcttcctgcgcctgtccatgaccaacatccgcatgcgaataccgtacgaggacctgcccaacacccggcgcctcgttgccctctgccaggtcagcgcggcggctggcactggatgcgcagcgacaggcggtccgcgcccacaggggttgatccctgcatccttcaacctgaacctggtgttgtgccccactgtcctcactgtcccgccaccttccatgtccacaggacatctacattgcaagggcggagggggagctcggcctggaggaggaactgtactgggcgctcatcaacatctaccgcctgccgtcagtgatgtttga

SEQ ID NO: 4336 - DNA, 1383 bp, Chlorella protothecoides
  modified_base (1327)..(1336): a, c, t, g, unknown or other
atggaggtgattggcatccatgccagctctgtggcctgcatccccctcttcgttgtgtacctggtcaccctgatgcacagctacacactgaccacacgccatgggctcagtccctccatcctcggcggccccgtggatggacgtgggagtgtcggcgccacagaacaagccccacctccacccgtctgcgtggtgtctcgcgcggagggcaaggctccacacacttccacggacctggaggccggcggcacagcgggcgcaaggggcgagatccctgcgcaggcccccgacacctccaccccaggccaatcgccctctgcctggggccgcctgaggctggcggctacgtccgcggcggcctgcctggccgagttcgcgctgcaggcctgcacagtgtgcgagcgcccgccgcaccacgtcatcgtgcagctgcgcgtgccacgcgcgctgcgcgtgggccgggaggaaagcgagagcgcggatgacgcggcgggggaggcggcgtgcgccttcttgcagtcggtgctggacgcgcggcgcgcggaggaggtgtgcgggtccgcggccgggcggtccgtgccggctgccgccggcagcgggaccccgcgactgcgcctcgcgcacgtgaacgaggaggagcagccggcggaggtgcctgccgacgccccgctcctggcagcgatggggcccctgtctttctgcgccgtgaccaagtccctgaccaaatgccctcaccactgtcgcggtactctacacagtcggcacccctccccccctcaaaacacctcctttacacaaccacaggtatgtggctgtgctcaacatgccggccggcacgccaccggaccagctggcggtgctgatggaggtcgtgccccagcacagtacgcacagcgcgggcgggaggacgtggcccctgcgtgcactgtccccgggcgccgccgtgacggccgtgctggcccgggaggcggagcgcggctctggcaggggggccgtggcggaggagaccccggtcgttctggccgccgagcaccacagccggcagtcgcgggattggtacgccatcacggccgccatcgatttcgtggccttcatctacgtggccctcttctacaacaaggtcgtggcctccgcccgcagcctctcaggtacgggatggaggtgaggggaggccagggcccacttggaaatgcacttgcaagaacatcgccgtctgccgtgtgccttcgtttccctgcggatctgcacgacccagttctccgatggaggaggctccgcgctgccagctcacccccatgcacacctctgcgccgcgcagagatcacgnnnnnnnnnnacatcgccgtctgccgtgtgccttcgtttctctgcggatctgcatga

SEQ ID NO: 4337 - DNA, 1518 bp, Chlorella protothecoides
  modified_base (641)..(650): a, c, t, g, unknown or other
atggtcgtggtagcagaggaggaaaaacgtcaccagcagacgctgagtgatgaggaggctgcctggaagctgcgccaggcggccgccgccgtggaggctagccgccagcgcgccgcacgagcgcagagggtggcgcgactcaaggcacggcgaaaggaggttgacctgaggtcctggtcatggaacacttgctgttcaggtctcagatggcacctgcttggcagcaacgccccacgcactacagtaagcacttctcctgccaaggagggcgttggctcgagttttgccagctttggtgtcggagtgtcccctacctccctcgattttgccttcctggagggagagacgcaggaggaggaagtcaaggaagacgaggaggaggaaggggaggcttggccaccggcagaggaaccggtggaggagacgacggctggcgaccaagtggctgctgaacccacagaagatcgtgtggagggtgcagcgtcgccaccaaccagcgtcgccgctggggccgccaggcgcgcggactctgccctgaccatacccgactcggactacgtcagcgctggcagcagcggcgaggagggtgtgccggccggccgggcatccggagggggggagggtgtccgggcggcggtggnnnnnnnnnngtcagcgctggcagcagcggcgaggaggccggcctctgccagcgaggaggagagcacggcgaggaggggctcagaggcacgcgattccccacctcccgctgcctcgccgccacagcaactgcccggcccggccctgggcagtcgccccgcccacaccccggccaccgactacgagcgcgagctgtcggcggtggaggaggaggaggccagggcgtgtgggatggctgtcgatcgccggggttctcccggcgcgggccaggggacggcgtcggagtcggcgtcgggcacggcagccgcagcctcgcagcctgtaagtctgctgcaccgggcactgcagcacttgcggcaccgcctgcgccgcctggaccgggagtcggtggtcgcctacctcgcgtacgtggccgtcttcgtggccgactactccctcctggccctcttcttcccgctctccatgtttgtctacgcgctctgctccgtcaagcccacgccgcgctactggagggtgagccttcctcctttctttctttttgggggaggtgtgtgtgtgtgtgaggaggcaggcaggacagcgggccaggtgctgtggcaaagtaagtgccacatgccagccgccatcctttgctctgaagacaacatctggaagaaaagaccccacaaccccactccctgcgcaggtgacactggtgtacagcgagctcctcatcatcgtgcagtatgcctaccagattcccacccgcctgggctgctcctttgtgaccccgcagctccagttcacgtgagcctggctgggagtgcaagtggcccgtgtgcggctgtttgcgcgaggattgcttgccgctggtgggcagggaagtccctggaggtatga

SEQ ID NO: 4338 - DNA, 468 bp, Chlorella protothecoides
atgggtgttgagcatgcgccgggggctctgccacccgctgcatggcttgcctgctggataccggcgcccagggatgaggagcgacgagcacggactctgaggcccaaccccattcccaccttcctccccactaccgccaatccaacagagcgcaaggagggcggcgtgggcgacctcaagtaccccctggtctccgacctcaagcgcgagatctccaccaagttcggcgtgctgtccgccgacggcgtggctctgcgcggcctcttcatcatcgaccgggagggcatcatccagcactccaccatcaacaacctggcctttggccggaatgtggacgaggcactgcgtgtgctgcaggccctgcagtacgtccaggacaaccccgacgaggtctgccccgccggctggaagccgggcgagaagaccatgaaccccaccaagagcaaggagtactttgcggccatctga

SEQ ID NO: 4339 - DNA, 351 bp, Chlorella protothecoides
atggcgcgagagggagcagcatctcgtgacgtgccgcccctctccgaccacggcggccccctctgcgtgggctccacctccgtgaccctggcggagtcgtcgcggcaaggactcctggccctcctacgggacggcccgagcgaccccgttccgctgctgcgcagcaacgaccccggcgcaggggagggtcccggcgccagcgccgcgctctacccccgcttctggcacatgcggggcgacgtctgctccagccagcccctggcctccaacgtcgacggggtgggtgcaagctggtgtgctttgtgtggagtggatgggggaatgagatgggagggcgaaggcggcggttga

SEQ ID NO: 4340 - DNA, 732 bp, Chlorella protothecoides
atgggccggcacacctttgtcttcatgcggcggatcaacatctacagctccgccgccttccaggtctttgtcgccttgccctttgtgtatgagctcaggcaactgctggactggtcctgcacccccaccaccctcaccacagcgtgtggctctgctgatgacaatggccccgctctggctcacgtctccctgccctccgcacactgcacctctgtcagtttcatggactggctgaagctggaggacatcaacatgagcctgtactttgtgacggtgctccgccgctcccgggctgcaaaaccgcccgggcagcgccagccccgctactccaagttcttccagggcacgctgctcttcgtcggcctgctgctcctgctctgggtgccgctgctggtcttctcctcgggcaacccgacctaccaggtccccgccgtcgtgggctttggcgtcaacgtgactctggtcggcaagcccgtgccgggggcgaatgcgaagcaccgcaccagcacccgcagcttccctctcttcgccgcgggcgaccggcgagtggctggggagtggggtggcgaccaggccatgctagggccgggcatgaccgactacgaggcctcccagttccagctcctctgcgcctcgccggtgggtgcacgcgagttcctgggtttgccggtgatgtctgcatgttggcatgaccccggtggggcagtggtgacacgcaggtggcccctgtag

SEQ ID NO: 4341 - DNA, 1671 bp, Chlorella protothecoides
atgccgcctcccagctcttgctccctcgactcactcactgaccaactggaacagggcctgattgacctgcacagcctgcgggcctgggtggcctggctgggcctggaggctggggaccccagccaacacgacaccggccacctgcagcgcctgctcacctggaaggtgctggtgctggtgaccgtcgctgccaagcggcgctccctcaagtatgcgggcgctggaagagactggtgccggggaggcagagatctgatgcacttgtctggctgcttggcgaggcttgagatatcagcatccttgacccgaattcttgggtcgttcctccggtggaagagccagctgcctgcagcagtgaggagctcgagggtggccggcgcggcctgcccgctcttctggccccccacgcccgaggacagcctgcgcccaggcctggacccgcgcgaggcgccgcgcctcagccgccgcgcggcgggcctgctctcgccccgcgccttcctggcggagggcaccgcggtgtcctccctggcgggcagcgcgcgcgcggccgctgcagaggcgcgcgcgacgctgcgccgctgggcgcgctccgcgctggacgcgctggactggccgcgcccggccccgctcgaggcgagcgcaggtcccgccgtgcctcggcgccatacaatcgcagggacccccacgcgcggccgctccgtcgacgcacggccctttgcgcccctcacctcgacccggggctcctcgcctcccggcccgagcgcgaccgggctgagctcccccgccccgcccccaccgctgcccgtcgcagggcagtggcgtgccttccgcttcgcgctccaggactggctggagagctcctggcagcgctggaacatggacctgtgcctcctcctcctcctcctcaccgccttccaggccaccacggccctggccctggtccacgtcgccctgctggggttggtcatggccctggcgcccgcccgccgcacgcaggcctgccgctgggtcctggtcccggccctgggcgtcatgctcgccggccagtactctgtcctggtgggcctgccaccgccgctgcctgtcctaaagggcgccaatgacgcgcggcacgacctcctggtgggtcaggcatgttcgcattcgtgctttctcccggggttcgaggtggtttgcagtggtgggaggagagcgttgtcttccaggcgcagttttggtgaggaccgccatccatcgcgaggatgtgcgtcccgacatgaggctgctcgacattgccgtcagcatgggattctctccccccacgcacgcgccatcactcaccaccgctacaacacacaggtctggcttggcctgaaggacgtgagccgcagcgccctgtggctcctcttcctggcctacagcacggcggtgctgcagatgcggtacgccgagtggctcgcgctggcagaccggagctcgacgcagcgcgcgcagcgtgaggggcgggcggcggcggccgcccaggccgcggaagcctcctggctgctgatgggaaaccctggtgatgtgcaacaggatgctctgccggggtccctgctctggcagcccctcaccctcgccgcgcaacccgcgtggcggtgggccgactgggcgcgcttctggatgtacaggtgcgagcctcggctgtggtga

SEQ ID NO: 4342 - DNA, 1617 bp, Chlorella protothecoides
  modified_base (6)..(15): a, c, t, g, unknown or other
  modified_base (227)..(236): a, c, t, g, unknown or other
  modified_base (370)..(379): a, c, t, g, unknown or other
  modified_base (916)..(925): a, c, t, g, unknown or other
  modified_base (1157)..(1166): a, c, t, g, unknown or other
  modified_base (1585)..(1594): a, c, t, g, unknown or other
atgaannnnnnnnnntgtcgttgcggaggcccgaaaagcattagattctggctttgcagtcgtaatcgggctacaggtgtgtgctggggggctggtggaaggcagggaacaggaactgggcagagaggaggacccactctcgcagacgcaaagtatgcacgccatcccacccacttgatcgggactgcagtccacgggcgaggccgcggcagatgcgctggggattnnnnnnnnnntgtcgttgcggaggcccgaaaagcattagactctggctttgcagtcgtaattgggctacaggtgtgtgctggggggccggtggaaggcagggaacagggactgggcagagaagaggacccactctcgcagacannnnnnnnnnctacctggtggaggcccagacaggactgccgtgatgagatgctggcatctggcccagacaggtgtgtgtgtgggttgagggtggtgagcttgggaatggaggagggaatgcctgattcaagcgtggactgcagtgataagatgctggcatctggcatgtcttcaaccactcacatgttgctccatgcaatagctctgagcaccagggcagctcattcatcccacaccatatacattgtgcccgcgacaggagaggaggtcgcccgccacccggacatgccgagtccgagtcttgtccccggctctgccaagctgggcgctggagatgaggagccagagagttccaggacccgggccaggctgcaacaggcctgggactcggcagacctcccgcccaacttcttggaccagctcatcgatgagctgggaggggctgccggcgtggccgagatgacaggtgggtgttggcaaggggcatgttgggctgggtgtactggagtccaaagctatggagggcgggtggagggtggcactgctnnnnnnnnnnatgttgggctgggtgtactggagtccaaaggtatggagggcgggtggagggtggcactgcgatggcggatcttagctccaggctttggacagtctgctggggagtccccagtactcagccccaagcggggctacaagttacccgagacatgttgcagccagcatgctccaggtggagccaagacgcaaggcacgtgtggtgcgggacgcaaggggcacgctgacctacactnnnnnnnnnnaggacgcaaggcacgtgtggtgcgggacgcgaggggcacactgacctactccctgcgcgccaagcccgacagtgccgagctggactccctgaacatccgcgagaaggctgccttcatggagcgacatctcaacagacattctccccaggctccaccaaacagatcatcgtgcaccctcgcctgcacagggctccaagctggtggccatcgtgtcggatgccgcctccaccggcatctccctgcacgcctcggcggccgtgaagaaccggcggcgccgcgcgcacctgaccatcgagctgccctggtccgccgacaaggccatccagcagctgggcaggagccaccgcgccaaccaggtggggcgcagagctgggcaggtcggtctgaggagggtcctcggccaagctcgaatggctccnnnnnnnnnnccaggtggggcgcagagctgggc

SEQ ID NO: 4343 - DNA, 1023 bp, Chlorella protothecoides
  modified_base (259)..(268): a, c, t, g, unknown or other
atgcgatcatgggacttgtcgagtgatgccctgcgcacgagtggcaacaagcagcagggagccctgccgtgcacagtcacattcttatttgcaaatctcgagataatttgtgccgagaagcctcgatgcaggcggccctcgatcgagaagattgtggaggtgtctgatcgcgagggccagttctgccgggtgagccctgctgcggcggtgcgacatggagggctccatggagcctctgccctcctccatctcgctccgnnnnnnnnnntaatttgtgccgagaagcctcgatgcaggcagccctggatcgagaaggatgtggaggtgtctgatcgagagggccagttctgccggcccgaagatgcagagtgggatgacggcgggggcgaggccctctcctccacagtcttccaggcatatcagtgctgcagtgtggctgagggccagccccacccaggggatattgcggagccagcctccctggctgccatcccactaccccccaatgactaccccctggatgcgctgccagcggaactcatcagttctggaaaactgagtagcctgcagctggagggcatgcgctacgcctctggagggcatgcgctacgcctgcgcgcgccacctcaactggctgtcttcgggggaacgtgcgtagggactggaaggggtagggatagagtgggtatgggtgatcgcatgcctaacatgagtggtgtgccgacacctagaccgatcacacacccctcccacacatgcatgccaccaggccaaggcttcttcctcggggatggcgccggcgtgggcaagggcaggcagatcagtgccatcatactggacaactatgctcggggccgggggaagcatgtctggctctccacatcgacagatctgtatcaagacgctgtgagagacttgaaggacctgggatgccacatccctgtcatccagaatgtgcaggtggagtgtaggagagggtttggggtttcaagttcattattttactatgtcggagtgctctaa

SEQ ID NO: 4344 - DNA, 330 bp, Chlorella protothecoides
atgtcacatgccacaggggcctacgctctgatcgaccagggagagcttgactggaaggtcatcgtcatctcacaggccgatcccctggccgagagactgaatgacatcgaggacgtggagagggagctcccgggggaactggagaggattcgtgtttggttcagggactccaagctcctcgatggaaagcctgccaacacctttgggttcgatgaccagcccgtggaccgtgcacagacgctgggggtgatcaaccagacgcatggtttttggctggacctggtcagtggggcacgtgagaacacagagagcaagtctgtgtttggatga

SEQ ID NO: 4345 - DNA, 423 bp, Chlorella protothecoides
atgatcccagggccccccctctctctgcagggcgacaacgacccagtggacgtggtggagatcgggtcggcgagcgccgaaaccggcggcgtgtacaaggtgaaggtcctgggtgtctatgccatgatcgacgacggtgagctggactggaaggtgatcgccatccgcgcggacgaccccaaggccgacagcgtcaatgacatcgaggacgtcgagcgcgagttccccggcgagctgcaaaaggtgtacgagtggttccgggactacaagatcccggacggcaaacccgccaatgcctttggcttcgacaacaaggcccagaaccgggcctttgccctggatgtgatcgaggagacgcaccgcttctggctcgacctggtcagcgggaagcgggaaaacaccgaggacctgtccctgttctga

SEQ ID NO: 4346 - DNA, 555 bp, Chlorella protothecoides
atggctgccctgacaacatccgtgtttgcaggtgtaggaaaggcggcgattgcccagccccgggcgccgacctccgtgcgggtatgctggcgcagggggtggctggagccaggagtgtgctgcggcgatgtagagtatcaaaccacagccatctatcatgcgcaggctctgggtcggtcttttgggttgaggtgccaggtccgggcgccgcggctgtatgccacctgcgtccgctcgagcctggagaccgagaagaaggtgggtgcgcgtctggagagtacgttggatcacgaagctcaagcactgctttttggtgtcgttctgatgccggaaatgccgggcgaccccaccaccccggattaccgggtgttcttcaaccacaagtccaccaccgtgtccccatggcacaacatccccctccatgccggggatggcctgtacaactttgtagcagagatccccaagcagacctcggccaagttcgaggtcgccacggtgcgcgatgatccaggggggttgtggtgtgcggattatatcgtggtgtgcctcccctga

SEQ ID NO: 4347 - DNA, 1077 bp, Chlorella protothecoides
atggccggcaacctggtgtctgccgtgcgctcgctgctgcccggctcccgcccgcccgcacccgcgctgtcctccgcgcgcccggccgcccgcctggcggcgctggagaaggccgacgccgcacggcgggcgcaggaggctcgagacgccgagcgcgagcgccggcggctggagctggagagggcgcgggcggagcgcctggctgcgaagcaggccgcggatgcggaggaggcgcgggagcgcgcggaggccgcgctgcggaagcagcaggaggcggccgcgcgccggaagcagcagctggaggcggggaagggcggcgccggccccaagaggaaggaggtggccctggcatttggcgcggccctgccgcccgcgaccgccgacgccgtgccgagacatgcctcgcaggcagcggctcagcaggccaggccggcgctgcacaaacccgacagggtgcgagggggttgcaggggagtgggtgattgtttgcgatgggtcctcctggcggtgggacgctgggaccgtgtgcgaggcccctgccctgcctgggtgggccggcctttcccccgagggtgggtgattgtttgcgagggggcctcctggcggtgggacgctgggaccgtgcacgagccccctgccctgcctggccgggccggccattcccccgtgcatcacagcgtcccgtctcttaagctgcacacatgtacccgctcaactgcgcaggagaacgagggccccaatcccagcacgacggcgctaccaggcgcagcaccgactgccggcgccgcggcggtgcctggcgccgcgaaacccctgaagaagatcctgtacaacgggcagcaggtacacggcgaggcgggccccgccaagctgaggctggccccagccgcactgcctcagggtgcgcagccgcatggtgtggggctgacggccggggccaaccttcagtcgcagggtctggcccctgcagcttccagacccctgctccaggtatggcggagggtggggtctgatgaacccaaccaggagtgcatgccgggttgccgaccaggcttgggccaggttttagtctcatga

SEQ ID NO: 4348 - DNA, 366 bp, Chlorella protothecoides
atggagatgaagggccagggcctgtatctctccaggggcctgtccttcagggaggcagagtttgcggagctggcctgccccctgaccccagcccagatcgcgcagtacgacgccgcagtcgccctgtggcaggatacccgcgccgccctggtggaagccctggcggcgaccgggagcacgcgggatgtctggaaaccctactacggcgccgtgcagaggttcttcaagatcctcctggtgtccatgaaggtggacgggggagaggaccaaacagatgggagaggacggtgccaggctgcactgggatccagcggggccggtctgcttgttgagttcattcagacacatgcagctgcatctgtttaa

SEQ ID NO: 4349 - DNA, 690 bp, Chlorella protothecoides
atgcgcaacgccatcacctgtccgacggaccggcttgacaccccttccctgcgcgtgcatctaattgagtgcccaggaatacagctgcaatcgccttggcaagcctcacgtgatacggatcggcggcgccggtgtccgaaaacccttgccgcacccaggactctcgtcccccaggccgggaggccacgcgctcccgatgagggcgctgtgcgccgccctgcttgtaatgggaatgtgggatctggcagagccaacaaagtgcggagcggacctgccgctggtagccaacacatgggccttcaccgctgccacggaatcggcctgggaggcaatgacagccgaggacgccaagcaccccgccatggatgccatcgaaatggtgcggaaatggggagttgggctggcgtctgggtgggcgaggttgccgcacggcctgcgaccctggccgaggagctgcgcggacttgctctgtcgaccccccgtggtcgtgcatgcggacggactggtggtcgtgcgccgcaaccctcgccttacaaatgccccattacaccacagggagccacccaatgcgaggatgatcagtgcgatggcaccgtgggatacgggggcagccccgacgaggctggggagaccaccctggacgccatgatcatggacggcgacaccatggacatgggagccgtggggtga

SEQ ID NO: 4350 - DNA, 1329 bp, Chlorella protothecoides
  modified_base (152)..(161): a, c, t, g, unknown or other
  modified_base (842)..(851): a, c, t, g, unknown or other
atgcatgtatcgcgcgggcaccgtggccatgaagttccctcgtcgctaggtctgccgacgtccgggcagggttgtccggagtttgcagggctctgccctggggcacatgcagggagcagccatcatcttatccaagcccatgtgctacacgnnnnnnnnnnctctgccctggggcacatgcagggagcagcaagcatcttctccaagcctatgtgctacacatataatgtatcggcggaatgcccagctcattggactcggagtacggtgcgtgccctcgcccaggccgggccagggccggatgtttcgcggcccttcgtgcgcccttcccccgcatctggggcctgccctcgacggcacaacccccgctgcagtgtcgtgaaccggtcgctggggggtggtctgggcggcaggacgcccaggccccccctgggtggcaagggctggcgcggctccaggcagcctctccctagtccctcctccacgggccagggcgacgcgcccgccgctccgcccgggaccacgcgggaggacgtggtcctgcttgacgtggacggcatgcactgcgccggctgcgtctcccgggtccggaagctgctggaggaccagccggcggtccgcggcgcctccgtctcgctggcgacggagacggcgctcgcgcgcgtacgcctcgctacacccagccacagttccactggcagcaaggctgacgagcttgagaagagcgggggcgaagctctgaatggcggcggcggcgcgctggaggccctgggcgccagcctggcacaggtagggttttcgcttgcctgtgtgagcgggttcatcgtgttgcctgggccctnnnnnnnnnnccctgggcgccagcctggcacaggtagggtctcgcttgtctgtgtgagcggtttcatcgtgttgtctgggccccgcgctgcgaggaatgcaggaggagtgagcttgggggcacttgttgggatggccctggcgctctgtgggttctgcgctgggtgcaaggaggttctgcctcgtcctgcgtctatgactggccaggtggactggcatcctgcctcaaagcaagccggtcccctgccctccttcctgggcctacgcccaggccctcgctgccatgcaccatgttcaaacaaagtagtgtccccctctgccagcttcctgccctctggctcctctgtcaccaaccccaacccaccaaccccatcatcagatcctgacggcggcgggataccgcgcgacgccgcgcgaggcgcgatcccccggcggccgcgcgccccggggcgccacggcgcgcgcgctggagtcgaagcgcgcggagcg

SEQ ID NO: 4351 - DNA, 2322 bp, Chlorella protothecoides
  modified_base (1220)..(1229): a, c, t, g, unknown or other
  modified_base (1596)..(1605): a, c, t, g, unknown or other
  modified_base (2272)..(2281): a, c, t, g, unknown or other
atgcgcggcatgagaacgaggaggcatcaaaacccaaaacccaaacttgcgttcctccccttccttccaacagggtctcggagctccccactcacactggctgccgcccagcatccccgggtccagctggtgtcggggatggatgagcgcagcctggccttctgggcactgggtcacgggcggtcaggggcagcgccagcaggtgggcaagcctttgaggattttggagggagtgggttgaggatgtgcagccgtgaaggctggctcttgagagtgcatagtagagctgtccagccttcgatcctgacgcccggacacctgtctgacaccttcatctcctctcaccccaccccaacctccctctcctttatacctcccagtcatcctaacgacgtctgggacggcggtggcaaacctgctcccggccgcggtcgagggctggcagtccggcaccccgctgatcatcctcacggcagacaggccggcggaggtgcggggctccggggccaaccagaccatccaccagcccggcatcttctcctcctacgtctgctggcaggcggacctggcgccccccagctcggccatgccgccgcagcacctgctggggttgctggatcgggcggttgctgcggcgggggcgggcccagtgcacctcaatgtccagttgcgcgagccactgggcccggtgcccgaaccctgggaaagcacggcgtggctggaggtgagttgtgttggtactttggcatgggactgggggtgactgtaagcgtgcaatatctgcagggacgtgggccgctggagggcctgggggactgggcgacctcctcccggccgtggagcgtgcagctggaggccgccgcctgcgcctcgcgcctcccgcactccctcctcgccgccctttccaccgcgacccgcggcctgctagtagccggggagctgcgcgcgcccgaggaccgcgcggccgccctggccgtctcgcgagcgctgcgctggcccctgctggccgacgtgctgtcgggcctgagagtgggggccactggagtgccggaagggctgatcgcctgcggcgacaacattctggctgcgcaggatccgggcatgtgcaccgctctccgccccgacgtggtgttgcaactgggtggccggctgacgtccaagcggatctcagccttcctggccgccagcagcgcgcgggggagcagcgccggtaatgacannnnnnnnnngggtggccggctgacgtccaagcggatctcggccttcctggccgccagcagcgggcgggggagcagcgccggtaacgacggtgcagcgtggtgggtggtggatgccagcccgcactcctttgatgagcatggctgccttgcagggcgggtgcggctgccgctgggcgccctggagcgcctgctgcgtgaagcaggggtgctggtcgagggagccgcggcagccccattcaccagtccgtacttggagctctggcggacgatggaccgcgaggtggggttcctggtgaggcagcgcttgaacagcgcgccgtacggcgaggcccacatcgccgtgtgcttggcctcctgcctgcccagaggtgggcgnnnnnnnnnngcgcgccgtacggcgaggcccacatcgccgcgtgcctggcctccagcctgcccagaggtgggcactggtgggggaagtcccggggggaagttgggaggaggaacggtcttggagttgcagaccaggaacagttcccattcccgacatattgccagggtcgatgcaagcgcagacgcacccggtccccaaccccgatcaccccacccaggccacgcgttatacattgggaacagcatgcccatccgtgacatggacatgtttgccgacggcctggcatcgagcggcctcatccaccggacacccccccctcctgccttcccttcccccatcagtgcccagcctggggtgcccggtgggcgccaaccgcggcgccagcggcatcgacggcgtgctgtcctcggcggcggggtttgccagtggactgggcatgcccaccaccctggtcgtgggcgacctttcttttctgcacgacaccaacggcctcatgctgctgcgatcaggcaaggagacctgggacagggcttgatggacatgtcatggagtcgccctactttggggtgcatgctggatccatctgccacacagacccagccacgagttgagcacaaggttttggcagtgaaaacccaccctcgtccacgagccacacttgctcaccgacaaatgnnnnnnnnnntgctgctgcgatcaggcaaggagacctgggccagggcttga

SEQ ID NO: 4352 - DNA, 3018 bp, Chlorella protothecoides
  modified_base (1656)..(1665): a, c, t, g, unknown or other
  modified_base (2804)..(2813): a, c, t, g, unknown or other
atgcaagagcttcggagcctgcgtggtggagctggctggtcgagccccggaccagcggggttcagcccggcccgaggcctgcagccaggccacacacgcctggctgagggtccagacgctcacctgctgcaccacaatgctcggaggtgccggcgtagccatcgctcagcccagtacagggctccttgcagacccatcacaagccaggcgagccctgcttcctccagcctgtacgaagccgtggccccacacccctcccgagggccgccgagctcggaccccgccgaggcaccccagccgatgccagcacccagccccccgcccccgccggtgcacgtccactgccagacgctgcccccctgcaaggaccttgccgcaggcaaggagcaggtggagaaggcgctcgacgcggcggtggcggccagggccgggctccccgccgccctcatacgctgtgaggcccaggtccctcgaacccattcggcgctggcctggctgcaggcgcagcgcgccgggacttcgggggccgctgcaccgagccggccggcccccacgctctacttctcgccgcgcctgtcccccggccccgattccgcgggcgcggcggccgccgcctgcgaggagggcgcgggcgcggtggctggggtgggggcggcggccctctggcgcggggcgccgggggaggccctggacgccgccaggctgcacggcatgcagcgcttcacctccgccgccgcgccccgggtccgagggaggggcggcctcctgtcgttctgctttgtgaaaccggggtgtctctggtatttctggcatctgggtgggtggggggccgggcgtgacccagtgccagcaccttccgtcgaccccgccgcgccttcctcgcgcagcgtggaggtgacggacgtcggcggcgcgctcctcctggcctgcacggcgtgctgggactccaaggcagcgccgggcgcgggccccagcgcgacggacgccggcgcggcgctggcgaccgcgctgaccacgctgcgtgacgtgcgcagcgcggcggcgccgccctccctggccgcctttgccggcgggcgcggcgccgtgtcgcactccccccgccgcgccgagtgggaggcggcggtcaccctggcccaggagctactggacgaggaaagcgcagagggggaggcggcgccctgcacgccctccctgctcgaccccggcacggccctggagaactacatcgcgggggggcagcaggggctggacgatcttctagaggcgctggagggtactcctgcactcggcgctcccgcgacgggaggggactgcggcacccgagaccccgactgcggggccgctgcactttccaaggtcgtgctggcgcggcgctccgagctgcgcctgtccggcggcgccgacccgctggccctgctagcctccctgcaggcccgcaacccacgggcctacgccctgttcctagaactggaaggcggggaggccttcctgtcttgcacgcccgagcggctgtacagccgcagcggccgcagcgtggcctcggaggccgtggccggcacgagggcgcgtggcgggggtgagctggacctggctgggtggtctggggcaggggagggtgacagcctttgcaggccgcaccccttcagatgccagggnnnnnnnnnnggcctcggaggccgtggccggcacgagggcccgtggcggggattccaggtaacagccttggcatgtcgcactctgttgccaggtgtggcaagcccccgctgcatcacacctctcctctcagccctcccgtcatcacctcctccagggagtgtggagaacgatttctggctggccctggacctcctgcagtccaagaaggagcacgccgagttcaccatcgtccgggattgggtgtacgaagtgggtccagtgtgttttgggggagggagggggggggattgggcctcaaccgccaggggagtccgcaacaccctgggtcgaaatgccatcaatcgaatccccacacacggcattgcaggccttgcgcggcatctgcgccactgtgcgtgtggacgtgaggaagacggtgctgaagcaggagtcgctgcagcacctgtacggccagctgtcgggcaccctgctgccggctgccacggatgcagacttgctcgccgccctccaccccaccccagccgtgtgtggaaggtgggtggcttgctgcaagcttgcagggagagagcactgccatggctcacctttttatcattgaagcagcaggttgctttgcggttctgtactataggccgccttgttcacagcccacacagctgttccagtatggatgcccccctcccccctcccatgcgcagacccagggaggcgtccagggacatgctctcctcgctggagccctttgatcgaggattctactctggcccgtttggctggctggggggacagggcgccgagtttgcggtggccatccgctccgccctctttgtccccgaggttcaagcgccagaatttcctggcgtgcaggccctgggcccgacagcgatgcgggtggcgctgtatgccggcgtgggcatcgtccctggctccaaggcgtccctggagtgggccgaacttgatctcaaagtggcggccctggaccggctgctgacccccgttccggcacttcagcaggcaaggaaacgggggagccaatgggggataaggacttcagaatctgctccaacgcctccctgtccatacctgctcgcctcaacttcttctctcctcctccggcatacctcaggcgcccaacctgaatgcggccnnnnnnnnnngcaggcaaggaaacgggggagccaatggggagtaaggacttctgaatctgctccaacgcccccctgtccatacctgctcgccctaacttcttctctcctcctccgacaaacctcaggcgcccaacctgaatgcggcatacgccaggatcttggtggaggagctctgcaggctgggatgctccacattctgtatcgctccgggtag

SEQ ID NO: 4353 - DNA, 2337 bp, Chlorella protothecoides
  modified_base (234)..(243): a, c, t, g, unknown or other
  modified_base (567)..(576): a, c, t, g, unknown or other
  modified_base (1725)..(1734): a, c, t, g, unknown or other
  modified_base (1817)..(1826): a, c, t, g, unknown or other
  modified_base (1926)..(1935): a, c, t, g, unknown or other
  modified_base (2029)..(2038): a, c, t, g, unknown or other
atgggacgtggtgcagggggtcgttggtgcagaaaattgaacaatgaacagcagagcaagctgactgcgagaaggggggtccaagcctgctcgcagacttcccaacattcggccaccggcaaactcagcacatcgccatctacctctccagacatgttattcttgaacacctacgcgggacgaggttgcaaaggtggggaggtgagcgcacataactggcgggtgtggccttgnnnnnnnnnncccttctcgcagttccaaatggccgctttggaggaggacaccatcactctcttccgcaagcgtgtatacgacatggcaggcgttctgggcaagaccgtcaaggtgtgtgtggttgaagcccaggccgtagtgcttgaggcaggcatgggtgggaacaggcatgcgaagggacaagcagacccatcccagacgcttgaccatcccagtcgatgtagggctgacacgaatcctacgtttcctgcaggtgtcttacaatggcaagatgctgcctgtcagggacttctccgcctacgtggacatggtgcgctttgggcgtacatgctnnnnnnnnnnggcgttctgggcaagaccgtcaaggtgtgtttggttgaagcccagtccgcagtgcttgaggcaggcatgagtgggaacaggcatgcgaagggacaagcagacccattccagacgcttaaccatcccaggtgctctttgggcatatatgcctgtcgggcatatgcaaacagtactccagtgattgcccacatattcctggccccaccctgtccctggtccggtcgcctgcaggaggagggtccaccacggttctacgagcgcatcaacaaccgctgggaggtggtaatcgcgcagtcggatggccagttccagcaggtgtcctttgtcaactccatctgcaccaccaagggcggcacccatgtgaacgccgtggaggcacaggtcaccaagcacctgctggagcttatggccaagaagcacaaacaggccacagtaaaggggcacatggtgaagagctacctgtgggtcttcgtcaattgcctcattgaaaacccggcctttgactcgcaggccacagtaaaagggcacatggtgaagagctacctgtgggtgttcgtcaactgcctcatcgaaaacccggcctttgactcgcagcacattcacatccccctttcctctgcgcaggccaaggagaccatgaccctcctagccagcggctttggttcctcctgccacctgtcggatgggatcctgaagaaggtcgccacgagcggcgtcgttgaccagatcctgcgtctggcatccttcaaggcggacaaggagctgaagaagggggatggagccaagcgctcccgtctcacagggagcagaggtcttgaagatccgatgtcttcaaacgtctggatcagaccacaatttattggctgctggggaggatggcatgacatcacgactgctcagcagggaagaggttcccacagattgacatccacatttccggcaccaggcattcccaagctggacgacgccaacgacgctggtgggcgcaattcggcggcgtgcaccctcatcctgaccgagggagattcggccaaaaccctggccatctcggggctcagtgttgtcggcagagacaagtatggcgtcttccccctcaggggcaagctgctaaacgtgagggatgcggggactgcacagatcaccgggaannnnnnnnnnggacgctcaaaatgtacagctgatctgcaggttttttggccctaccctcttctcacaatcaatgggaaagtgtccggtcactnnnnnnnnnngatgtcttcaaacgtctggatcagaccacagtttattggctgctggggaggacgggatgacatcacaactgctcagcagggaagaggttcccacacatcnnnnnnnnnntgcagagatccaaaacatcaagcagatcctggggctgcagcacggaaaggtatgtacagcaagtggcggaggggggtgggatgggtgaactgtnnnnnnnnnnaaggagtagaaccgaatcaatctgttgggagggaccaacctctgctcagtctccagcgtttctcgagtttaccaggatgccatccacagataacttcacatcccaaccttccctgtgatgctacagacctgcttgtagcgccgcttgcgagcaccatcgcatgtctccacgatgaactctttagagaaaatgttggccagcttggcgccatatccattgcggccacccgtcacctgaatgatggcaacgagggtggatggtttggggtattggctggcagcgaatggaggcacccttga

SEQ ID NO: 4354 - DNA, 873 bp, Chlorella protothecoides
atgggtggcccggaggcgaccttcaagctggcccgcaccgccgcgcgcctcggcctccaggtcgcgctttcctcgtgcatggagacgagggaggggctggccctcctccgcgagctggcccgggcggtggatgtgcaggtgttccctgacatgttgggactgcatggtctgggcaccgacgactacgtgggcgaggccctcgcagagcctggaagccgaccaggtggggatcttccttcgtctgccaggtctccagagggcgatcggcgaccgcgtgcgacagggtcagacctgcaggggtgtgcaggcctcgccatccactgcccgcgcgtcctgcggcatggctgcgagtcagagggcggggcagccggtaccctggtcctgctgcacggcttcctgggggcggctgaggactggacccccgtggcagcctcgctgggaaccaggcgcgccgtgcttgccccagacctgccggggcacggcagtgctggcctgctcacgggcccggtgccgccgtccctggagcaggcagcagcagatgtggcagggtggtgcgccacgctgcagcagccggtgacgctggtcggttactccctgggggcgcgcctggccttgaccctggcgctgcgccacccgggcgcctgctcccgcctggtccttgtgtctggctcccccggcatccaaggccaggagcatgcgcaggacggatggaaagggatgacctggttgaaacagcgcaacaggatggcaaaccctctgcacgctcaaagacgcgaccgacccccgcaatgcccgcgcagatgccctggctcgcgcacagcgtgcaagccaggatgctgccctggcggcgacgatgaggcaggcgcccattga

SEQ ID NO: 4355 - DNA, 1440 bp, Chlorella protothecoides
atgacctctgtcctgcatgctcacgctgcttcgagggcctcatgtccattggtgaacggacgcaccagcaccgcgcccggccagtgcaaggggcccaggcggcatgggcagacctcctggcgcctggatgccgtaaagtatccttttgcgcccctcatacaacagctgaagggcaccaaggagtcgcagtccgtgcaggacgagcactacccggaaaccacaggcaggccccagcctgactgccccatcatcagctgctgcggcggcggcatcttcttcttctgtgagccagcacgggggctgggcaaagggtgcatctgcatgcactgtggcggcactggatataggaaacaggctgctcccttgtgcattgttggaggccatcgctgctgttccggacatcggtgcttactagcgatccaatttcgcacgcctcggcccctcggggagctgggtgtcctcctctacctccagaagcaattcgacctgggcggtgtgcaggtgcgcggcgcctccgctggcgccctgctttccaccctggtggcctgcgacgtggacctggagaaggcgctggcctccgccacggtgcgcatccggcgcgtggaggccatggagcgcaagctgggcctggtgggcctggccgggcagctcgtgggcgactggctggccgacctgctgccggaggatgccgcacagcgcgcccaccgccgcggcctgcacatcgtcgtgaccgaggttccctctttccgcctcacgaccgtcaagcgctttgactccaagcaggacctggtgcaggccaatcgtacgtgggctggctggcttgctggatggacggtgggggggtttatgacgccagggccagggcttcgatgcagcaatggggctgctgctgcacccaaaggtgcccgcgccaagatatggggatgtgatcgcccaccgcacacatgcgcccaacctccttccacccctgcccacctgcctacagtggcatccacccacatccccttcttcacggacggcgccccatcctatgactacaagggccagccgtgcatcgacggctcactctgggactttgtgtttgccgacaactcggactacctgaaggcggagggtcgagcggtcctggttgactatgtgctggactccgctgtgcagtccccttttctgttttctggccaccaagaatcactgaaaccctccccaccctccacggcgctccagttcaaggatgaccagctatcaaccaaccgccttgactttatccggctggccagccctgacgagatcctgtccctggtcgggttcggttaccgctacgccagccgagcggacgaggcgggcgagttcgagctggcactgggcaggctgcggcgtagccccctgtcccgcctggtcagcggcggcttcctgccaggcttcctgtttgggagcgggtga

SEQ ID NO: 4356 - DNA, 1020 bp, Chlorella protothecoides
atggaggccggctactccgagaacacgtcgctgaatgtcagcagcgcagcgggaccctccaaggcgacggccaccagcaaggccagcaagaagaagaccatcgagcagacgtaccagaagctgacacagctagagcatgtgctgctgcgcccggacacctacatcggcagcactcagcgccagcagcagcagctgtgggtgcacgatggggagaggctggtaaaccgtgcaatccaggtgtcccccgggctgtacaagatctttgacgagatcctggtgaacgccgcggacaacaagatccgcgacccgaccatgagcaccctgcgagtggacgtggatgagggtcaagagttgccatgccgatccgggcagtgcagagaccctgctctgctggtgactgctctgcgccaccgcccagctggaagtcacctctggcacctgcctccaccctgtcagctgaacggcagcatcaaggtgtacaatgatggcgcgggcgtgcctgtggaggtgcacaaggagcacggcgtgcatgtccccgagctcatcttcgggcacctgctgacctcttccaactacgatgacaaggagaagaaggtgacgggtggccgcaatggatatggcgccaagctggccaacattttctctaaagagttcatcgtggagacatgcgatggtgctcgcaagcggcgctacaagcagaccccaacgcctcagcagtctgctcccctcactccgatcccgagcatgccactacctgagggggaagacgccatacttgtctctgccgacaacactgagccccgagatggccagggttttggccgaatctccctcggtcaggatgagggtgcacgccgccgaattgcgcccaccagcgtcgttggcgtcgtccagcttgggaatgcctggtgccggaaatgtggatgtcaatctgtgggaacctcttccctgctgagcagtcgtgatgtcatgccatcctccccagcagccaataaattgtggtctgatccagacgtttga

SEQ ID NO: 4357 - DNA, 396 bp, Chlorella protothecoides
atgtggggaacgctgcgccggcaccccaggcaatccggtatcgttgcaaggcgggcgtccgcgcagagcgaccatgcagccctcgcggatgtgctggaggcctggtcccccggccgggcgtcccacgcctgggatgagctgcctgccctctcgcggcgcgtgcccattctcctgatcactggagaagaggacgagaagttcgtgggcctacagcaggccatgctgcagcggtgccagcccgccggaacgagcggcatcggcgtgcaggctgccacgatcctgagcgctgggcatgctgtgcatctcgagcgcccgcttgagctggccggcgccattgaggcctggctgaagggtctggagtgcacccagcaaaccctgagaccgctggagggatga

SEQ ID NO: 4358 - DNA, 669 bp, Chlorella protothecoides
gtgttgaggcagtgcaccttctgccgctcctccacaaatgcatagtactgggtgatgcccttcagcgtcagctcctccatcagattgatgatgtagggcttgcgcaggaagcggtccttgaaggccttgaccgtgacggggaaggtggcggagtagaggcagacctggcgctgggggggcatgaaacccagcagcgactcgatcacgggctggaactccggggagagcagcttgtcagcctcgtccatgaccaccacgcccgcggcgcccagtcgcgccacgcccttgctggccaggtccaggatgcggccgggggtggccaccaccacgtgcaccgtggcgcccaggcgcatgatgtcctcgcgcaggttggtaccgcccgtggccaccatgacctccacacccatgtgccgccccagctccttgcacacctggctggtctgcagggccagctcacgcgtgggtaccagcagcagggcctggatctcgttgcgcgatgtgtcgatccgctccagcaccgggatgcagaaggccgcagtcttacccgtgccgttcttggcgcgggccaggatgtcgcgccccgccagcgccacgggaatggactcctcctggatgggggagggggcctcgaaacccttctcatagatgcccatcaacagctccctgggg

SEQ ID NO: 4359 - DNA, 636 bp, Chlorella protothecoides
atgggcatctatgagaagggtttcgaggccccctcccccatccaggaggagtccattcccgtggcgctggcggggcgcgacatcctggcccgcgccaagaacggcacgggtaagactgcggccttctgcatcccggtgctggagcggatcgacacatcgcgcaacgagatccaggccctgctgctggtacccacgcgtgagctggccctgcagaccagccaggtgtgcaaggagctggggcggcacatgggtgtggaggtcatggtggccacgggcggtaccaacctgcgcgaggacatcatgcgcctgggcgccacggtgcacgtggtggtggccacccccggccgcatcctggacctggccagcaagggcgtggcgcgactgggcgccgcgggcgtggtggtcatggacgaggctgacaagctgctctccccggagttccagcccgtgatcgagtcgctgctgggtttcatgcccccccagcgccaggtctgcctctactccgccaccttccccgtcacggtcaaggccttcaaggaccgcttcctgcgcaagccctacatcatcaatctgatggaggagctgacgctgaagggcatcacccagtactatgcatttgtggaggagcggcagaag

SEQ ID NO: 4360 - DNA, 1680 bp, Chlorella protothecoides
  modified_base (1049)..(1096): a, c, t, g, unknown or other
cgcgcccgcgcgccgcgcgcgcgggctcctccaggcgcttcaggccgcggtgtggcgcggcgacgccccgagcgccggcggcgacgacgcggccagcaacggcgcgggcccaccctccctcccggcgctggccgatctgctggatgtgctgggcggcggcgacgtggacagcagcaccaggggcggcgcgccctccgccctgcgcccctcctgccgcgagcgggaggtgacgggagggcactcgccgctgggcctgttcgtgcgcgtggagcccagccccgccgcgcgcagcctgaccgtgcacgtgcgcgcgcagaaccgcacgttggacgagctgcgtggggtggaggtagagctggcgctgggcggtcccctggggggaggggcgctactggccttccccctcaagccgctggcgccgggggggaagaccgcctggtctgccacgcgcaccgtgtctgggttcggctggccggtggtcgccgcctccatcaagctgcccctcaaggtgagcctggggtcgcccgtcatcaggtgctgcccgctgtccatctccccgctggtcctcctgaacccgcccacccacgcggtgtcccccgtccagttctaccagcgctggcagcccccaccggcccgacgcaccccctcgcaggctctgccgtatgggctcagcgtccagggatcgctgcagaccccggggcccgctgggttgagcgccctcttcgcggcgtttgcagcctccggcacgctggagtgcgtcatcaaggtgcgtgcaggggtttgctgtcgtggccagggagagcacactggggaactgcgaacctcgcggcccgggccaaggcgacagatgagggctgtgcacggctgtggacagtcaccgcacagcgtgacaggtcgcgtggtttggccgtcgcaccgtttcggcggtctgcgggccccgtcccagccgcctgtgcgagggaccctgcacgatcgccgccttccccttcccggaccgcacgttgccccatgcatgccagggactcgccctggtcgtgcctctgcctcannnnnnnnnnnnnnnnnnnnnnnnnnnnnnnnnnnnnnnnnnnnnnnnccccccccccccccccccccccccaacacaaaaccccaaaacagtctgtgacgcccgggcacggcgtgcacgccgccttccacggcacctcctgggacggcgacgtcgttgcctgcctgctgacggggctgggcgcggggattgagtgctcccccgccggcgcccccatcctgcgcttcaccatccgcagcgagtcccaggcggtcatggaccagctggcagggcaggagggggagctgctggaggtgctcagcggcggcctggcagtgcccgtggcagacgacctggccctggcgggtgccagcgtggcgccgcccgcgatcgtcaagaccgctgccccggccaccacgccggcggccgcccccacccagccggagtccagcacctactccttcctgcgcggtgtcaccgcgcgcacctttgccgtcgaggagagcgagccggcccaggccgtggacggcgcggcggcgctggaccttgaaccggcggcggccctggccctggcccgccggctggacgacgcagccgtggcggcctggaggaggctgcgcgagacgcggcgcttgcaggccgcgaaggcgtga

SEQ ID NO: 4361 - DNA, 291 bp, Chlorella protothecoides
atggagcgggcatggctttactatgcttgcccactcatacccctgccatgcaggacggaagccagggagcagctgcggcgccaggtgggcaccctgcgattcgatgtgcgcgcggtggccgagtccctgcccaaggccgagaagaaggaggcgtttgccgccggcaagcagttcctcaagcagaccgaggcgctcgatctggccctgcggaagaaggacgagaccaaggccctgggactgctggactccaccaagtctgctctggacaccgtgcttgccaagctgggttga

SEQ ID NO: 4362 - DNA, 432 bp, Chlorella protothecoides
atgtacgcaggtgccggcccggccaaggtggtcagacccgctgccctggagggcaggcgtgccgtgctgggctccctgctggccggggtcgcggctctgagcctggctggcaccccccgcgcccaggccgtggagctggaggactaccgcaaggcgcgcgagaccgggttcgacctgatctatgaggcccgcgacctgaacctgacccaggccgagcgcgatgggcttacccaggcccgcaccgacctgggcgccacgcgcaagcgcctgcagcagtctgagaagagcatcgacaaggacctggagcagtggatccgcaagaactactggtgcgtagtccattggaagtgggagggccctgtggtctgtgttgtgggtgtggtgaggtggaaggggtttggggccgcaatgtggcagcgtccacactggtga

SEQ ID NO: 4363 - DNA, 591 bp, Chlorella protothecoides
atgacaagtactgcacctttccaggtgggaggggcagggaatgggcctggaaacgagcaactcatcaaccagccatcagagcgtctgcccacagcctttgctcctcaggccacctcaaagacagaatccgatccacaccctccagggatcatcaacggcggcatcatctccaccctattcgactgtcatgggaactggacggctgcgatagcgctgatggacctccacgccacccccaaaccacccctgacgcttacctacgagctcctggtgagcggggagggtggggatggggtgggaatacacgcttctgacgtgctcatgttgtgggtaggaggatatcggcagatcctccaccggcgtgtcaccgcatggtgtgagattgccgtcgcatggtgcctccctgctggtcaaaacctgcttcagtcacaccaggtcacattcaaggagccgaccccgcccggcgtcccactggtggtcaagagccacgtgaccagggttcaggatgtccaggaagccggccagaaagccggtgtacaggtgtgtagatgggggcatgggatgtccgctgtgcgccaggcgtgggcgtga

SEQ ID NO: 4364 - DNA, 120 bp, Chlorella protothecoides
atgcctagtaagcgcaagtcatcagcttgcgttgattacgtccctgccctttgtacacaccgcccgtcgctcctaccgattgagtgtgctggtgaagtgttcggattggcagctcgatcg

SEQ ID NO: 4365 - DNA, 1059 bp, Chlorella protothecoides
atgatcagaatatggaatgctgagccaatgcttgcatcaatgcaggacatgttggggagccgctcgttccctgtcggtccgacacgtcactttctttttcagccctgtcgagggaatcccgggaaattcatgaccccaacctgcctaggggccgatgcccttccgcacccctggcagaccaacgcggtccatgtccgtcactgccgttgctgcagccggtacggccgtggccctttggctgtacaaacgtcgccagacggagctggaatgggaggagagggagtatgccacgcacacgggcgcccatcaggcgccccagaccttcatggaggacctatactactttgccgagggcctcaggtccgtggctggtcgcagggtggacaggggagggcggcccctggcacggccacgcacggcatgaaggatgccctgaagccgggttggttgatgctcatgcccatgccacatgagccaggcgatttactcttcacatgttgccaccctggtgggcaaccccttcacctgttccaggcctactcactctgcatcgcagcatcctcctcgccggaacccccaacacatcccaaccctcgacgccccctctcaatcagatacacctactctgagacgctggggcggtggggcacggccgacctactcatcggcctgacgtacctgtgccgcaagaacccgcccgagcacgtcaccaccgacatcgcgcgggcggggcaaccctacggtcgcggcgccgacacggcggccgcggcggcctcgctgcgcgagctgcgcgagatccggcgcgtgtttcagtattgcgtgggcatgcgcgagcggcgccccgggccccagcgcgagtactttgccacggcgctgggcattgggcccgaggccatcctggcccaggagacgcgggcgggcgtgctgaagcccagcttcatcctggcacgggacgatcacctgcgcgccatcgtgctcatcatccgcggcacccactccttcaaggacatgttcacgagcctgacaggtgctgtcactggggtgtgggtgggtgggtga

SEQ ID NO: 4366 - DNA, 1230 bp, Chlorella protothecoides
atggggtggccaaggagggtgaagcagggcccgccacatgcaaggacaccgatgagaaggtgtgcgaggattcaccacctccactgcccgcctgctggccaaggagggccccagcctgaggtcggagtggagcagcgtgctggtcctagtggtcctgtacgccctccagggggtccccctcggcctcagcatggggagcatgtgcgtgcgacggaggggatgtgtgtgggtggtgaggaggaagtgacgcattgcccccattcttactcagtggccccataccgcccctcccattcccccctctcactatctcccccccaaacacacacacacacatgcacgcaggccgttcctgatgcaagcgcgcatgagctacactgccatcggcattttctccttcgcggcctacccctactccttcaagctgctgtggagcccggtggtggacgccagcgccctgcccggcctgggccgccgcaagtcctggatcgtccccctccagctcctcagcggtgcagtcatgctgctgggcggcgcacacgcccaggcccggctggacgccggggacgcgctgggcgtgaccctggccttcttcgcgctggtcctgctggccgccacgcaggacgtggcggtggacggctgggcgctggagctgctgtcgccgcgcaacgtgggctgggcctccacctgccagacggtgggcatgaacgtgggctacttcctctccttcaccgtgttcctggcgctcagcgacccggacttttgcaatgcgcgcctcagggcccccgacaaggcctcggatgggggcatcgtgacgctggcaggaaggaaggcggcaggccccggcccgccccggccgtggacgatgagatcttcggcgagggggccgcgctctgcttgaaccacgccgagcccgacggccatgccgcgctgcatgcggtgccgctggcggccgagtgtggggcggcggctcggcatgacgtcgaggccgagcactcggcggcagcgcccaccgtctcgcaggcgtactggcagctgctgcgcgtgatcaatctgccggcggtcaagcgcctggccgtcgtgctcatcgtgtgccgcctgggcatgctgcctgctgaggcggcagccgccctgaagctgctggagaagggggtcagcaaggaggcattagctgccctggtgggggggggggcagcgaagaggtgctgccagtgggaaggttgtgtgtag

SEQ ID NO: 4367 - DNA, 861 bp, Chlorella protothecoides
  modified_base (81)..(90): a, c, t, g, unknown or other
atgctgcagctctcagtcgcgagcgtgccaccctgtgcccctgtcccaccaacaaagcagaggcgacatcagtccgggacnnnnnnnnnntcagtcgcgagcgtgccaccctgtgccccttttcccaccaacaaagcagaggcgacatcagaccgggatgactcccaggtgccaagctatgcacagaacgtgccggcgagctacacagtcgtggatattggaggtcaccagatgattgtggagaagggccggtggtatgaagtcaaccgattggaggattggacttgggggctggcgagtgggcctgtccaaagacctgtgctgcagtattgtgttgtgcatgcgtcgtatcgtctgggtgagctgctgaccctgtgttttaccggtttattgcttgcatatggaggattggacttgggggctggaaaacatgtgtcatcaggtgtcactcctcattcccattccaccacccaggccgcccccgggtcgacaattcgtctgggaagggtgctggcccacaaggccaacggcgacattcgcttcgggacgccctatttggaggatgtggctgtgcacgccaaggcaaggtggaggcgagcgggcgtgcacccctggttgctcgcgtcgcaagtctctgattgtcccaatgtgtcgctctcagccctgctacacgcttcctcgcgtgcgcagatcacggtgttcaagtacaagcccaagaagcattaccgccggaccaacgggcatcgccagcagctgacgaggttcatggtgaccgaggtgctggagggccaggaggcaggcgaggcccctgtggctgtcgtggatgagaaccccgcagcggcgacggaggaggcggcctga

SEQ ID NO: 4368 - DNA, 4332 bp, Chlorella protothecoides
  modified_base (325)..(334): a, c, t, g, unknown or other
  modified_base (704)..(713): a, c, t, g, unknown or other
  modified_base (3508)..(3517): a, c, t, g, unknown or other
atgcatcttcctcatctcatatctcccccgtcacccctcaccctcccaccagagcatgcctctgcccccttttcccctgatcggcaaggccgagaggctggccaccaacaagggaccccaggacgcatggctgaaagggtgactcatgggtaccctgtcggaattgatgtcaggcactggggaggaggcgcccctgagtgcccgccaagccatcctgaggacacgcagcaaccccagctgcgcacgacgacgcgtcctgctctcagactttgcggaactccagttcaaaagcgatgcagggggagaagcactcttgctagagaannnnnnnnnncagacttcatccaggctttaatttatcgaagtgactttccaccccctacaccttgcagattgatgctctacgtgaagacaagtgcaacgtcccacccttcgtgcattgtaagctcaactgcaagcttgatgcaaatgattgtggggagacatttgcagttgcgcctcagtgatgctatacgtgaagacaagcgcaacgtcacacccttcgtgcgttgtaagctcaactgtaagcttgatgcaaatgattgtgggaagacatttgcaggtgcatgcaagtgccgcccacacattggccaggcttcctctgtggatcagacacatctacgccatgagggtcatggcggctcttctagcggtcatgctgatgnnnnnnnnnnggatagcctcccactgagcgagggcgcagtcttgttcggaggggaccgccacgtgctgccaactcctccccatgaagctgtcccgccttgccacaaacctccgtgccaaccttccacccggctgcgccgcaacatcctcctcgacttgattccgctaaaaaccgcatggctccggcgacacatctacgtcatgagggttatggcggctcttctagcggtcatgctgatggcagccgcaccagtctttgcacagccccccggctccaacgctggactcccaccctcggccacagccacgggcctggcggcccagaagcttactgccgagatcgggagtgccttgatggcggagatgaagtacacggatgtggatctcctgtccttcctggtcaacaccgagtgcttggaggcggagtttaactcctttgccgcatttggcgtgggcatgcaccccaagctgttcgggctcgactccccatcgcccatgggcggaaagaaggccaacctctcctgggacatccagctctggtccgaggaggtggcacgtgacgagattggtcacgttcgcatcctccacgaggctctgggagctgacgcacccttctgcccccagttggacattgatggtggtttccagcaggtgagggagacggggtgggtagggttcaggcaggattgcatggtactcaatggactaccattgattgcatggtacacaatggactatcatcctttgcaccacgcagacagcagccagcaaaaatttcacacaccttacacaaaattacccacttcctgccacccacagctgttcaacgatgccctcggcaccaccaacgtggagtgggacccctacaaggacgatgttcacttcgtgctcagcacctttgccctggaggagattggggctaccggggataaaggcgtgaccgggcttgtcgccatcaacggcaatggcaccgtggtcgacctcgtgggtgggcttgcccagtctgcaggctaccaggccgctgccgaccgctacatcctgtggacccaccgcaacgacaccctgcctgagtttggcaagaccgtcaatgaggtcatggaggagctgacgagctaccgccaggccctcaccggggatgtccagattgatcagggtctgacctaccgcggtggcatcaatgtcgtgcccacggacggcaacggtgtgactctctcccgcacgccccagcaggtcctgcacatcctaactctaggatccagcaacggcattggaggcttcttccctgatggagtgaatgggcgtatcaacacccccgaccccctgagccctccctcctccatcccaagcgagcttattgccatggcaaacgctccctacaccattgtctccagctacaaagatgtggaggatcccttcgcgcccagcccccccgggaatgagggtgccaaccgacattcgggacgtgtgtgtaccctaaggtctcgctccccgaggcagcccctgtcgccaggcgtggctcccccgccaggcccgaccccacgcccgctgcgtactgctgtccctgcaccgcatgctgggcgtgcgctggctggagctgctgcgtcggccttggaaactgctgctgctgctgcgcggcctgctgctgctgctgcgcgctcgccagccactggaggtagccgggcggcagctgccccgggccgggcgcggggcgggccagctgggcacggtgcagcgccgccagccgagcctgctgtgcctgctgtgcctgctgcgcctgcatgtgggccagcagcatgcccagctgctggggggacaggctggacagggccggcgggcgcacgcccgggagggtctggggcgtggggaagccctgcaggctggcctggggcggggcaccgcccagtgggtaatgatgggccggaggccccccctgcagcagatgccctgcattgggatgcatgggggaggccgggtgcggccctggctgcggggcggccagcggccgagggcggggccccggctgcgggcccgaggatcgggcccattgttggggcggccgcccatcgggcagcacaggccaggtgcccggatgtgaggcgcccgggcgaccgccagcgccggcctgtccaccctccggcgccgcggcacctccccactgcctggggctgcccggcccggcgtgccaggggctgcacgcccggccgcgacgcggcgggcgcagggcccgacctcggcgcagtgtgcgctccaggaggctgcgccagggccgggcccaccgagggcgcaggaatggtggcagcagcgacagctgcagcgacaccggcgcgcagcgaagtccgggctgaggggcccagcagccgcctgggcgacccccgcacgcggggaggccaccccccggctgagctccgaggacggccgggagaaggcgtgctccagggcctccctggcagcgcggcacccctccatacgggctgcggggtgggtgggggaggccgtggcacgatgagtggggtggtgggggtggaggagggatgcattggaggaggaagagagcctggtgatgcagggacagcccgcggtcggagggcgtcaagagcatggacaggtgaacttcagacgaatgtgtcccaaagcagcttgcatgtaggactgcttgctcgcacctcaacccaggctgggcctcaaggctgccacaagcatggtcccgaccggctcccatcagaacgtcacttgccccacaccccactctgcaaagcgctgcattctcccggcatgcaaacgccagtgcccaaccccacctcagccnnnnnnnnnngatgcattggaggaggacgagagcctggggatgcagggacagcccgcggtcggagggcgtcgagagcatggacaggtgaactccagacgaatgtgtcccaaagcagcttgaatgtaggactgcttgctcgcacctcaaccccggctgggcctcaaggctggcacaagcatggtcccgacaggctcccatcagaacgtcatttgccccacaccccactctgcaaagcgcggcattctcccggcatacaaacgccagtgcccaaccccacctcagccaatcacccacaaaacccacccgtctcgacgaccagcggcacccgccccgcgatgactcgtgcagcccccgacccgcaccgctgcctcacggccgccagcacgctctccacctggcctggctctgggaagtctgccgtttcggcaccgccgttcccggcgccctccgtcttgacggccgggctgacctgctgccccgcaatgacaccggacaggaggcccgccagggcgccgcccaccgcggtcagaccccgcgcatccgacgcgcgctgtcggtctcgggcggccaagagcgcgacgaccaccgcggcggcggcggcctgcgacgggccgacggtcctcgctggcgtgtcgctgcctgccgccgcgccatcgccggggaaaagaccgtcgcccctcgggatgggcccgccgggcccgcggccgcccccgcgctttcttcgcgcccgtgcccagtcgagagcaggtgctggagggccaggcacagcaccaggaggggaagtgattgatgcaggagcaggacccatttcccccgcaacctga

SEQ ID NO: 4369 - DNA, 219 bp, Chlorella protothecoides
atgacctggcaccggctgctccgcccgcagacccccttcctcctcaagggcacgctgcgggagtaccagcacatcggcctggactggctggtcaccctgtatcagaaacgactcaatggttcccagatggtgtgtcagtggtggggtgacgcccctggggccagaaacagcagggatgtgcccctgggggtgcgactcacaagcagtggcgcgcgttga

SEQ ID NO: 4370 - DNA, 240 bp, Chlorella protothecoides
atggaggccgcagaggaggaaagggaggcggagattgacgaggatgaggagcagaccctggtcgcggactgggacacgggcatggccactgaggcctatcgggcgcaggtggaggcagcccaggccgaggcacgagagcgggaagaggccgaggcggcctggatacaggtggaggagtttggaaaggggggaggggggtatacaacatctgggacggccatggtggtgctacgctggtga

SEQ ID NO: 4371 - DNA, 288 bp, Chlorella protothecoides
atggatgcccaggctcaggacaggtgccaccgcatcggacagacccgcgagggagaagcatccttggtgctatcaacagtgcaactccaagcccatgaggaggagcctgcaatgaacaattctgtagccctggaccggccaaagagcttttgtctaaaccctccttccggcatccaccctgcgtgcagccagcacaccatcgaagagaacatcctgaagaagtctgaccaaaaacgccagctcgacttcttggccatccaggtaggttgccggatcttgggcagataa

SEQ ID NO: 4372 - DNA, 414 bp, Chlorella protothecoides
atgaaccgcgccattgtggagaggctgcacgccgtcctccgccccttcctcctgcgccgcctgaagagggatgtggagaagcagctgcccgccaagcacgagcacgtggtgtactgcaggctgtccaagcgccagcgccagctgtacgaggagtacatggcctccagcgggacgcgggcgacgctggccaccggcaacttcctgggcatcatcaactgcctcatgcagctgcgcaaggtgggtggatgtgttggatggtgtggccaagccgcgcctggcctggggttcatgtatacctctgcatccagagcccctgcagcttcctgctgtagctcatggcacgtagaatgccgccctccacaccctcctcccgccccaccctgcccaggtgtgcaatcacccagacctgtttga

SEQ ID NO: 4373 - DNA, 2667 bp, Chlorella protothecoides
  modified_base (2212)..(2221): a, c, t, g, unknown or other
atgctcggcgtcggcttgggaaccagtgtgcaaccgcacggcggtcggacatgtttggtccgctcggcacgtccatgcgctcgcccgacacctcgcgtgttggccgcaaaatgtatcgtcgctgaacacaggaccaaggaaactggactgggacaccgcgtcgctggcatggtcagtacggactatgtgtgctggtgtgagagtgcacggcagagttccgcaatgacgctcgatacgacagggactctgtcgaccatgcccattgtagcagccggagctgccttgtctcttgtggccagcccggtttgcctgccggccgcagcttcggaggccgacctggtgggcgatggaacgcccacagagtacatcatcgacgatgccaaagtactcaatcgcaccacgcgcagcgagctggggtctcggctgaagagccttgaggggactgatcatgaagtatcccgctcacaggaagcaacgggatacaggctggaggtggcaaccgtgaggaagctggaggtggagccagatgcatttgcgctgggtgacaagcttcttggcaagtggtatgggcagccggacaagcagggcatcctgctcattgtcaccaccggaaaggacggcgcgctcaccggcggccctgcctttgtcaagcgtagtgcccctgaccctcacccaccacctttgcaggccgtcggagaggaccttgtggactctgtggtgggcgagaacattcccatcctgactgagcaggagaagtacaatgcgactgtgctgtcctccgtggagcgcattgctgctcggctggaggggaaggaggtgcctgccgccccccagcgtgccgacaccgagcggcgtaggacgtacaagaccaaggcggagaccgagcagaagaagccggtgacatccaccatagtgctcaccctcctcgccatctcattcgtgatgctgttgcatcccattcaaagatgcttgagctcacatgcctactgcgtgtgtgttgctaaggatcgcagcagaggcgcaaccctcgaaacacgggaagtgcgcagctggccagggcgcggggctggggagagcaccggcaagggcacccctcaacaccgaggagcaggccacaacagcaacacattcgtcaccgagcagatatattataacttcgcgtatcttctttcgctctcaccatccgtcagcaacgcggagactcaaggatacccaatttctagcttgagagccgtcgggcctcacgcagcgtgtgtgaacgccttggctagacggaacgatggcggtggagacgcgtgcacacaggagtcttcaatggtggacaaggcatgttgctggactatgcatggaatgaagacatacacctgtggcgcgtgcgctcgcaggaggaggtcgaccggccccttgcccagtaccacctttgaacaaaatggcgaggccgagacccccagccccagcgagatgatcgcccgcttccaggcaatcctcgcggaggaaaaggccaggagagagcgtaacgtgatcacccgtgcctacagccgggtgaagcgcgtgtatgagcacatgatcttcggcctgggcatctacatgctggagccctgggagatggcgatggtctggatcagcctcctggtcatgttctgcctggtctgctcggccattctgcacatcctccagaacctcggggcggtgaccctcgataccccggcgccctggaccctcctgaagagggcgctccacctcgtgcccgtcaccagccactctcacaagggtcgatgcattctctggtgcggtgggcgcggcactgaaggggtgagggtcattgtcaggcctcggccgcaaggcatcacagcgtgccgtgtcaccagtacgccaggtatcagccgtttgggtgctctcgggcaggtccccatcacgggccctgcgccaggctggcaagcacctcgtccacgtggtcgaggttccaggcctcacccgctgcctggaactccagcctcgcagcctccagactcgcacgcaccctgcggccgggagaaggtgcgctgtggactccgggcgcaaagtcagacggcacgacctttgggaccaagctggcacagggagttgatcgcagtgacgtggaccccacggtctgacaggaagagtggacgccgagccaaacgccgcctgcacgcgactgaggcccccactaccctctctgcatcccaagtannnnnnnnnnagagtggacgccgagccaaacgccgcctgcgcgcgactgtggcccccgctaccctctctgcatcccgagtggaatggcgcacctggcgcgggcctcggtggccagatccatgccgtcctcggctgcaagccagcactcggcctgcgtcaagtgcgcctctccaaccagggctcgggactccgccgcgaggaccaccggcagcgcggcgtccagctggcgctgcgctgcacgcgcttcgcccaggtggcacaggatccgggcctgtgaagagtgggggtgggggggtggtaggtccccacgtggtgcctttgctgtcggatcttcttgagtcaggcagaggtcagaggacggctggtagtgcccgccgccacagcctcacagctggcacaatcgcgacgagtcggcccggtgaccaaggagcctgccttccggtcgcccctgggtaa

SEQ ID NO: 4374 - DNA, 279 bp, Chlorella protothecoides
atggagtctgaaccaacgaagcggcagcggcccgtgcagggacgagtcggagccaagtcgaaacaggcacttgccgagattattgctctgcgcaagtctggggctcgacgtgtggatacttttgaggtcaaggaggaagagcctgtctacgacgtcgtcgacgaggaccagtatgctcagatcgtgaagaagcggcgggatgagggaggtgcgcccccagagggtaaaacccgagtgctgcggtcggtgcgcctgcctggaggtgacagcgtcaattaa

SEQ ID NO: 4375 - DNA, 252 bp, Chlorella protothecoides
atgagcattgagagggagcggctggaggcggcggccgccgaggaggcggagggcgagggcgacgcgccggcggtgaagaagtcgggaaaggggccgcagtacgccggcggcctggtgctggagccgcgggtcgggctgtacgaccgctacgtcctggtcctggatttcaactcgctgtacccctccatcatccaggagtacaacatctgcttcaccaccgttgtgcggcccaaggtaggggcagtggcttga

SEQ ID NO: 4376 - DNA, 810 bp, Chlorella protothecoides
atggtgatgaagcccgtactgcggcggtacgcttttgagaaccgcggcgtgcgccccgggcgccagtgggtgctcaaggtgcgctaccccgccacctgccccgcgctgccgcccggcctgaccggggccgcctttgccgccgtgtttggcgccaaccagggcctgctggaggccctgacgctgaagcggcgcctgatggggcccgggtggctggccctggccgcgccgcgcgccgtcgcgcccagcgcccagctctcctggtgtgcgctggaggtggaggtggcggggcacaaggccgtggcggcggccccggccggcgtgcgccccgcgccgcccctcaccctggccagcctgcacgtgcagacggcgctggtgacggggggggcggccgccgagatcgtggccgcctccgtggtgtatctgccggaggtggacgtggaggcggcgcagcaggatgggtggaggtccgcgcgcgacctgcgccacttctctgccgtctgtcgcctgggcggcgcccctttccctgtcggcttcgaggcgcaggtcaaggcggtgaacgcgtccgaggtgggccggcgcaatggcggcgccgtgctttcctgccaggcctcggagcgctccctgctggccatgctggtggcccgcctgcgtgcgttggacgtagacgtgctgatggggcacaacattgcgggcttcgccctgccaatcctcctgcaccgcctccagcaccacaaggattacggtacctgggtcgaggtctggaaaggaggggcgtggcctcggtgcacgaacgcaattgcgaggggatga

SEQ ID NO: 4377 - DNA, 876 bp, Chlorella protothecoides
atgcaggccccaggcatgctcgaggcactcgagcgacggcgccgtcccggcgctgcccccgccctccgaggagctggcggtgctgcccaaggtactgcagaccctggtgcagcgccggcgcacggtcaaggacctgctgaagtcggagcgggacgcggtgagtcctgccggggtcatagggggagtgggaggggggtaccaatctggggccatcgtgggcggtggaaccgccgggcaaacgtcagacttgtgcggggctggcgctcggtcggggcacatgagaggccgtatgccaccagcactgtcactgtaccacacccctgccaacatcatccctgccaacatcgtccctgcccccccaatccctacttcctccaggtgcgccgcgcacagctggacatccggcagcaggcgctgaagctgacggccaacagcatgtatggctgcctggggttcacccactcccgcttctatgcccgcccattggcggagctggtgaccgcccaggggcgtgaggttctgcagagcaccgtggatctggtccagggtgccctgggcgcggaggtcatctatggcgacaccgactccatcatgatccacaccgccagcaccgacctggaggcggtcacgcgtatgggccacgccatcaagaaggaggtgaacaagcggtaccgcttgctggagatcgacgtggatggcgtgtacaagcgcatgctcctgctgaagaagaaaaagtacgccgccatcaaggtcgagcaggcgcgcggcgaccaggctcccacagaggacgcctgctgcaatctgtccgacatgcttttcctcgttgcaagtcacgcagagcgtggagcaaaaggggctggacatcgttcggcgtga

SEQ ID NO: 4378 - DNA, 2535 bp, Chlorella protothecoides
atgaccagcggcggcaccgagtccatcctcacggcggtcaaggccagccgcgactacatggcggccacgcgcggcatcacctcgcccgagatgatcgtggcggtctccgcccacgccgccttcatcaaggctgccgagtactttggcatccgcctcattagggtgtgtggggttgagggaagagtggggggagttgtggtcatggtgcgtggccaccgtgggtggcttcagaaacgcgaggggcgcgatggtaccagtcccttcacaccctggcacacaccccagataggattcgattcaactcagtcccccccaacacacaccccaacacacacacagctgccggttggaaaggactaccgtctgggcggccgggcggtgcgtcgtgccatctcgcgcaacacagtgctggtggtggcctccgcgccaggcttccctcatggcgtgatggaccacgtgacggagatcgcggcggcggcggcagcgcgcggcgtgccctgccacgtcgactgctgcctgggcgggtttgtgctgccattcgccgcgcgccttggccgccgggtgccgccctttgacttctccgtcccgggggtcacctccatctccgccgacacccacaagtttgggcaggggcacaagggcacctccgtcgtcctctaccgctccaaggacatcaggtgcgggtggtttggggggggggtggattggtggggtagaggggtgcctggtggcaagtcgtgcaaaggaggtactgggagcgctggcatagctgcgcctgcaagggtcccctgtcctgccaggcacagggacaccctacagcttgggctccgagccgacctcacacggccctgcccactcagcagcacccctgctgctcacatcccccaactgctccccgttttttcacagaaagtaccagtacacctccatcaccgactggacggggggcctgtatatctcgcctgggtttgcggggtctcgctccggagccctcatcgccacggcctgggcctccctggtgcacctgggggaggacggcttcctggaagctacctccgccatcctcgcggccgccgacgagttccaggcgggggtccgcgccatccctgggatggaggtcctggacagcccggaaggcagtgtggtggcggtgcgcagcaccaacaggtggacagggagggcgaaggtgtccctgatttcgatggcagtaagatatctggcaaggactctgaaaggccccggccagaagcccacaccgtcgcaggtgaacgacctgatgacgcggcgcggctggcacctcagcccgctgcagagccccccagcggtgcacatctgcttcaccgccgcgcacaccgggccagacaccgtgcggcggctggtggacgacctggcggagtgcacggccgaggtggcggccgcgccggggacaaaggccgaaggcgggacggcgcccatgtatggcgcggcggcggccatgccggatcgcagcgtggtcgggcgcttcctggtcgcgtatcaggacctcctgctggactcctgctgaggccgggggggggcctgggagcagagcttacgccctgcaggtgtgggcactccaagcaagcggtcgaggctggccgagccaggcacggctcctgcgccgccgctgcacgacctatgaccgattgtgttctcctgatcaacacatcgcttacaggcatactggtagggttgcaaggcaaacgtgtcatgagacaagggccgcttagatgccacagggatgagttctgtgaggggcgactggggaaaatgaggggcgtggtgggcgctggctgccagcctggctgcagcaccctccatctcgattgccatggaggaggacaaccgaggagcgcccatgagcgacgaaatggccttgcgggcatcaggcaaaggggatacgggcagtatagaaggggaggggagtccagggcacctggcacacagcatcgtcaccgtatgtatggtgactgcagaaggttgcaagctttctgcagagcgacggagcagcacctgagctgcagggctggcagttttgtaaatactgactcctcagtcgcaggagtagaaggagtagtggcttctgaaggggaccaggacctccttgccaggctccgtgcagctggcagggggaacgccgccctccgtcctgctccgcacaatgtactgcaggtacggcacatcccctgcagcaagcagcggaaagtggtgcgattgatgtcacctctttggtctcttttggcatacgtcttgcggaaatcgcgggaattcacgttcacacatcctctatccaatcctgacaccaggatactcagggtaaagatctcaagtgtgatgtttataagacacccttgtgattccctcatggtacagaggataatctctcttgaatcgcaccctcaggggcacccacacactcccttgcctgcaactatgtatatgggagttctggcccaggagaggttctctgagccatcgggagatgggtacaccgttcctcgacctgtgtcgacataa

SEQ ID NO: 4379 - DNA, 1011 bp, Chlorella protothecoides
atgggaggtaagggggtaacgacctgtgcacgcacagtctgctgcagggccaaagatgccagcacgcacgccacccacaccaccattaaaacgagtatggcggtgaaatcggctgcgtgcacggaaaattacaactgcaaagacataacgagctggttcggggtcttatcgacgtccgttcgcgtgtctactgctgggaaaacacagatcataggctctgtgggaggaacgattgtgagactgggcgcatggtctggagtgcaaaaaaactctgctggcacagagattaggcttcgtgtagagccctgggtgggcaaacacacatcctttgggggtgcaaccacagcgggcctcaagggcagtcaaagcaagcggcgaggcgagtcaccaggagaaaggaagtgtggagctcgaaagccggttgagacatgctgttgggttcatcatgcgatcactgctggtcaggaacgccctataacctgggtgacctccggagctgcctctgaaccacagtcaccggggaggaggcaacttgccgcgcggctgcaggagccccatctgcttacgtatctgattcagtcttttggcggaccagagggtcgtggatcccagcatgacggcccgcttggcgaaagacactcgcctccacatgagggacaccgctgcggtgcctaccagcctcgccgaccgccgcaggatccacttgccaatccccatggtgacaggatggccatggtgctaagcgcggattccgcgcgacttccacatttgaatgtctgctcctcctgcttccacagactctcgtcaacttcttacacggatctttcaaattgtaccgtttgttcaggtctcagccatgtagctgttccccaccgtgaacgagtcgatgatggtgttgagtttatcctgcatcttgttccatcgtcgctcattggagccggtgaccagcgtgtaaaagttccctgcacacgattgttcaggtgggggagcaggttcagcgacaacaaatga

SEQ ID NO: 4380 - DNA, 1581 bp, Chlorella protothecoides
atgcgtccagcccagggcatgggccagggtggaaacctgagtcgacaaggatgctcagctgaacgaccccaggaggagcatctggcgatcagagcatggtgcggtcgtccctcggcgccggactggacctggatgtctaaagtccagatgttgggccctcaccattcaccagtgatcgacgccgcgcaggaggctggcgagctgtctgtgcgaggtttgcggaacctgcacaacacatgctacctgaatgctgtcctccagtgcgcccagcgtgatgattgggtggcaccttttccctgctggtacacttcctctcgcatggagccaggagaccccgactcaccacccttgccccaaccccggcagtcgctggcgagctgcccaggcctgtgttcctggatcgtgcacatcatccagcgcctgcacctccctgactcatccatctcggctctggtggcggcgctcgtctcccagctggcacctgccccgccgcatggcggccgcccgcgccccgccgacccctcgcccctcctcgccacgctcagggccaccccctctgcgaccgcctccttcccctctggcaccgagagcgacgcgggcgaggcgtggtctgcgctcatgagcctgctggagagcggggcgcggcaggcctgggcggctgcgccccagaggcccctcctgcacctgctgggtgggggccccgacgccggcctggtgcccacatgggcattacccgcctatatgaaggactgggcgctggcgagccggccgccgtgccgcggcgtgctgacctggacgtcgcgctgcctgcgctgcggccatgcctgggcggccccgcaccagcccttccacctcctcctcctccccgtgccgcgcctcccgggcaccggcctggatggcaacgcgcgctgccggaccagcctgcgtgagtgctttgcccagctggccgacgtggcgcctggggcacgctgcggcgcgtgcgacgcccgagaccgagggtccgaggggggcgctccgggcagcgccacgcacgatcccgtccgccgccccgcgcccggcgcggtgcgcagaccgtgcctggtcagcgccccgaccaccctctgcctccagctgcagcgcacgctgtggactcaccgcggcgcggtgaagatcgcggggcacgtcgcattccctcgtctgtttgacctccaggctgacacgggcattggcacatggggccacggaccggaagcatcgccggagtgccttcgccaaactgcgctgaaggaggagagcaggtcttggagtggaccccagccggcggtggtgtatgatgaaggcgctgctggcgacacgacaccaacaaagagggagtccacctgctcgccgggcccgcctgcttaccgcctcgtggccgtggcctgccactcggggtttgctcgctcaggacactggacggccttccgccgcctgcccggcggcggcgccagcggtgtctgggtggccgcgggcgacgagcgggtcctgcgagccgatctgcagcgggaggtgctccccgccgaggctaccctcctgttctacgagcagctcatcggcgcatga

SEQ ID NO: 4381 - DNA, 2211 bp, Chlorella protothecoides
  modified_base (1674)..(1722): a, c, t, g, unknown or other
atgagcaagctcacactctcttgccaggctgcctgccaggttcacgctctccgctggctcctcctctggttctgccactgtaattttcgtgcatgtggacagcagtcaaacaggcttgctgcctcttatgcctcaggatcgagattcggggcttgtcctccctccctcaccgggagcggcacctcacctgactttaacacaggtgttttcgtctctgtctttgctctcttgatggctggtgaatcgtcgagtttctttggcggccgcgttttcgctggagagcgattgcctcggatcgcggcgatcgacaggtctatgctcgtagggagggccctcgatccccacggagctgcatgccaggaacagtgtgtgcttggccgcgcaggcgcagtgttggctcaccgggttgcctcaggtccgtgcagggcagggctggtggattgggggggaggcgcagggccctcgccccccccctttactccccctgcacgcttctcccccacctcagatcaggtcattgatgttgctgggcagctcctcaatcacggtgttgtagaacttctggatgtcctgcagcaggcgctcgtcgtccttagacacgaagttgatagccacgcccttgcgcccgaagcgcccgctgcgcccgatcctgtgcaggtagttctcggggttgttgggcagatcgaagttgatgaccagggagatctgctgcacgtcgatgccgcgggccagcaggtcggtggtgatgagcacgcgggaggagccggagcggaactcgcgcatgatgacatcgcgcgtgttctgatccatgtctccgtgggtggcggagacggtgtggtcacgctccctcatcttgtcggtcagccagtccaccttgcggcgcgtgttggcgaagatgaccgactgggtgatggccagggtctcgtacaggtcgcacagcgtgtccagcttgtagtcctccatgcccacgtccacgtagaactgcttgatgccctccagcgtcagctcgtcgcgcttgaccaggatgcgcaccggcttgttcatgaacttgcgcgtcagctccagtgcctcggggggcagggtggcggagaacacgcccacctggatcttgggcggcaggagctggaagatgtcgtagatctggtccttgaagccgcgggacagcatctcgtccgcctcgtccagcacgaacatgcggatggcgtcggcgcgcagcgcgcggcgccgcagcatgtcgtacacgcggccgggggtgcccacgatgacgtgcacgccgccctgcaggatgcgggtgtcttcgcgcaccgaggtcccgccaacgcaggcatggcacttgaccccgaggtagtcgcccagcgcgcgcatgaccttctcgatctgctgtgccagctcgcgcgtgggggccagcaccagggcctggcactccaccagcgcgtagtccaggttctgcaggatgcccgcgcagaaggtggcggtcttccccgttccagactgggcctgctggatcacgtccaggcccttgccgaagggcacgatgcccttctgctggatggcggagggcttctcgaacccgtacgcgaagatgccgcgcagcaggttctcgtgcagccccatctcgtcgaaggtgtcgaaggactcggtccactccgtgtagaactcggagttgccggtcannnnnnnnnnnnnnnnnnnnnnnnnnnnnnnnnnnnnnnnnnnnnnnnngggggggggggggggggggggggatgcaaaggacatcagggaaacaccgatgacggcgctggggaggtgtggagacccactgccgaattcgaagcaaccagaccaccgccggctcagcaccccggccccgtccccactcacacttcggccatcttctcgtcgaaggccttggcatcacgccctgcgccggtcacgcgcgccgacggcctgggccagggcccagccacgcacctttggggggggggcgagacgaacgggagagcgagagatggttggcacgcggtagagcaccgtgccaaagagacagagcaggccgggggggggcaggtttcaagccggcacctggctctccagcacatgcagggcggggaccctgggacgaactctgactggaattccgtcccgctttcttccaagtatgttcatgcgccctggcctgcggacctgggcgagcgcgactgcctggttgccatgtgtgcagttgattag

SEQ ID NO: 4382 - DNA, 915 bp, Chlorella protothecoides
atggctgatctgcggtgcgtccctgattatcgtcgtggcgctcgcgctggtcagcctgaccctgtttccctacagcctggctgctgcaggagtccttttgctggatctctgcatacccctctgttccccaccctgggggactgggcacctattccccataccaggcccggccggggggccattagaaatcctctcgcccagcctgccccacccgcctcgcagggggtctccgcgacgctgcgcgacttccccgtcccccgcgtggccctcatgttcctcgtccgcggccccatgccccacgagggcgtttgggccgacttcctgcgccccgccacggtaaccagcagccccgctgccgtcaccgacctgccctggcgccacttcttctcgctgtacacccacccctcccccaactggacctaccccgccaccagcctgtttgcgggaaccgaggtgcccggccgcgagcaggtggcctggggccagcactcactcatcgttgccgagcggcggctgctggcggccgcgcttggggacccgcgcaacgcacgcttcctgctggcctccgagtcatgcgtccccctctggccccgggagtcgctgtacctggcggcaatggggcatgagcgctccttcatcaacgcctgccgcaacctgcgcagcgcgaagcaggccaggcagcagatggtggatcggtaccagcctggcatggccattgccaacgttactgaggccgactggaggaagtccgcgcaggtgggagctggggtggggacggtgtgcagttcgagtggatgcggggggccaccgagggcaccaccaaatcaaatctgtgcgactcgccatcaatcaccacactcccaatccgcagtggttcatgctgacgaggcgccacgccttcatcaccgtgactga

SEQ ID NO: 4383 - DNA, 426 bp, Chlorella protothecoides
ccgatcgagatcgaggcgctgctgcaggaggactccaccgtggtgaagcgccgctcggcggcgcagaccgccgccaaagagctggagctggctcaggacgaggtgcggcgcgcgcaggagcggcgcgcgacgggcacctcgccgcgcgtggagaaggcggcggtgtcggcgcgcgcgctgctgctggcgggggccttccccctggtgccggccaacctggtgccgcgcgggacaaaccccgccaagctctacggcgagcacacgcccatggctctttcgccaggtgggacgctggtcatgtttgagagacgctgggagggcaggaggggctgggtggttgattgtggaggaggctggcatgtgagtggggttgaaggggctccaaacgcatccgcgacaacaggggatggaacaggttgtgcatgt

SEQ ID NO: 4384 - DNA, 831 bp, Chlorella protothecoides
atgccgcccccctcctccaccgcagacaaaggggcctttgttcccctcaaggacacccaggacggctactccctgctctacccctttggctggcaggaggtgacggtgcgcggccaggaccaggtgttcaaggacgtcatcgagcccctggaaagcgtggcggtggctgtggtgcccacagacaagcagacggtgagcgactttggcagccccgccgaggtggccgtcaccctggccgaccgagtgctgagcgcccctggccaggaggtgcgcctgatcaaggccgagaaggtgggcggagcgggggtcagggtggcggggaacaggggggggggggtccctgggatggggagtggatggggacctgtgcggagccgtgttccatgcggcgtattggccaggggatctccggaggcaccctacaggaccaccgtactcgccaatggaaccgcaatggcatgccacacatgtgcaatggactcgagctgtgcatcagagcaaggtgttcaattccccgggtctgccccaccagtgcacacccagagactggacacctactggaaaaggacgccatggaatctgtccatgaacatccaaccaactccctcaccgcagtccacgcgggatgagcgggagtactacaggttcgagttcgtggccaagggaaagacgttccagcgacatgcgctggtggcggttgccgtcgggaatgggaacttttacacgctggtcaccggctccaatgagcgacgatggaacaagatgcaggataaactcaacaccatcatcgactcgttcacggtggggaacagctacatggctgagacctga

SEQ ID NO: 4385 - DNA, 795 bp, Chlorella protothecoides
atgaatacgacccactcgggtgcggagtccctgctggccgttttcgatgttctggccagcagcgacgtttcagatgtgctcctggccatgcaagcgcgtgacccgatcccagtggtcgctgcaaagcttcacggccatgctggatggctggtggggtcgcaggctccggtgcttcgatgccgtgcagggcgacgagggcagccgggaggcgctcaccgacgccctgctcgtcctcattctgtcccgggcgccacagatcacggccgtcatgtgaggagggacctccgctacctcggctgccaaactctcgatccccgcgtaccgcgcacgtgcgtgcctccttctccggagcggccctccaacaccctctcaccccgcaccccacgtgcccgatgcaggatgcaccactgccatcacatcagcgatgcttccctgggggccctggcactcatggccccgcccctgcacgtcctggacctgggctggagcgcccgggtgacggcctggggcctgaagcaggtgatcgaccgctgcggcggcacgctgaccacgctgtgcgtcagcagcaccagcaacaccctgtccctcctgaatgtggatgacggtgttgcccaccagctgtgcatgctctgccccctcctgaccaccctacaaatggtgagtggcggggctgggggtgttggggactgggggtggggggagtgggggctgcggcgtggtgcatgcgcactgcaggatgctgaagcagagagggggccacctctcttagaaacggcggtgtccgtcgacgcttga

SEQ ID NO: 4386 - DNA, 1110 bp, Chlorella protothecoides
atggggctgcacgagaacctgctgcgcggcatcttcgcgtacgggttcgagaagccctccgccatccagcagaagggcatcgtgcccttcggcaagggcctggacgtgatccagcaggcccagtctggaacggggaagaccgccaccttctgcgcgggcatcctgcagaacctggactacgcgctggtggagtgccaggccctggtgctggcccccacgcgcgagctggcacagcagatcgagaaggtcatgcgcgcgctgggcgactacctcggggtcaagtgccatgcctgcgttggcgggacctcggtgcgcgaagacacccgcatcctgcagggcggcgtgcacgtcatcgtgggcacccccggccgcgtgtacgacatgctgcggcgccgcgcgctgcgcgccgacgccatccgcatgttcgtgctggacgaggcggacgagatgctgtcccgcggcttcaaggaccagatctacgacatcttccagctcctgccgcccaagatccaggtgggcgtgttctccgccaccctgccccccgaggcactggagctgacgcgcaagttcatgaacaagccggtgcgcatcctggtcaagcgcgacgagctgacgctggagggcatcaagcagttctacgtggacgtgggcatggaggactacaagctggacacgctgtgcgacctgtacgagaccctggccatcacccagtcggtcatcttcgccaacacgcgccgcaaggtggactggctgaccgacaagatgagggagcgtgaccacaccgtctccgccacccacggagacatggatcagaacacgcgcgatgtcatcatgcgcgagttccgctccggctcctcccgcgtgctcatcaccaccgacctgctggcccgcggcatcgacgtgcagcagatctccctggtcatcaacttcgatctgcccaacaaccccgagaactacctgcacaggatcgggcgcagcgggcgcttcgggcgcaagggcgtggctatcaacttcgtgtctaaggacgacgagcgcctgctgcaggacatccagaagttctacaacaccgtgattgaggagctgcccagcaacatcaatgacctgatctga

SEQ ID NO: 4387 - DNA, 963 bp, Chlorella protothecoides
atgtcgtcctcctcatcccagaacgtgccggtgcaggaggccagccgcgtcccgggaaagtcccgttaccaggtctggcgcaccaccttcgagatcgatgaatcctatgttcccatcaaggcggtgggaaagggcgcgtacggcgtcgtgtgctccgccaagcacacccccaccggggagaaggtggccatcaagaagatcaccaacgccttcgagaacctggtggacgcccggcgcaccctgcgcgagatgaagctcctccgctacctcaggcatgctcggtggcgttggggccttgcgagggcgtggctgtcaggggcttgcactcttgaggcgggggcagtgctgtggagggcccccttcaacgacgtctacatcgtgtacgagctgatggacaccgacctgcaccagatcatccgctcctcccagcccctcaccgacgagcacttccagtacttcatgtaccagacgctgcggggcctcaagtacgtgcactccgcgggggtgctacaccgcgacctgaagcccagcaacctgctgctgaatgccagctgcgacctgaagatcgcggactttgggctggcaaggaccagcaccgagagcaacgccttcatgacagagtatgtggtcacgcgctggtaccgcgcgcccgagctcctcctctcctgcgatagctactccgcgggcatcgatgtctggtcgggagtcggatcgccatccgaggagctcagacgagccgcgggcgagagcaccgcggcggcgttgagtcgaggatgcgtgggctgcatcctggccgagctgctggcgcgcaagcctctcttccccggcaaggactacatcgaccagctgaagctgatcatcaggaccctgggcacccccagcgatgaggagctgggcttcatcaccgcgcccaaggcgcgcacctacatccgtggcctggccgccgtgcaggtgggcgattga

SEQ ID NO: 4388 - DNA, 648 bp, Chlorella protothecoides
atgtccctctgtacccagtgcgccattgtcactgacacccccctccctcctctctcccccctttctcgcctgctcaccccgcagaacgacacgagcatcggcaacctgggactcgctgccatctccatcaagatgccacacctgcagtgcctgggcctggacggcagccacgcctgggacgaacagggcatggcctgcctggccgttgggtgccagggcctgatcagcttctcggcagccgccagcaggctcgctgacatggacctctgccgcctcctggcctcctgccgcgcagtggaggcagtgcgggtgtccaactgctcggccatcacgctcaagggcattcaggagtgcgccgatgtggccagtgacagcctgctcctcctggagttccagggcgtcggcggggcggccagccccaccgcgcgtgccaccttctcttcctgggcccggtcgtcccgctgggagctgagccccaagggagacgccctcgccagccctggagcgtcgcccagctgggtctactttggcgacctgggccgcaagagtcgggtgctggacgaggcctgctcccgccactccagcgacgtctgctcctccgtcggctctccgcccccctcgctcgcgccagctgcgacgggagattga

SEQ ID NO: 4389 - DNA, 318 bp, Chlorella protothecoides
atgcaagttgcccagcagatctgttcctcgcgaggtcgagggaggagtcagggaatcgaagaccagggcgctagacaggaggatattgtactggagtacacgacccgcctgctgggccgggcggtggacagcgctgcggcacgggggagggtcaagcccgggtcaaagagcagcgttcctgtggccatcggacccgaggatattctcttcctcgtcaggaaggacagcaagaagtttgccagggtgcgggagcttctagtgatgcaggaggagatcaagaaggccaagtcggtgagttggatggaccaggggccatga

SEQ ID NO: 4390 - DNA, 1716 bp, Chlorella protothecoides
  modified_base (375)..(384): a, c, t, g, unknown or other
  modified_base (967)..(976): a, c, t, g, unknown or other
  modified_base (1103)..(1112): a, c, t, g, unknown or other
  modified_base (1509)..(1518): a, c, t, g, unknown or other
atggcaggaggcccagctgcagaacgtagactcctggccggtgccagggctgggccaggtccccctggaccaaaccatgacccccggggacgagttcgtgcctgcgtccccggtatgtcgcattggcgcgagggtgttgagtgggcatgggtattcaggctgctgcacccccacctttgggttatggggagggggcctggtgccctccagcctgcacacccgagcttcgcccccacccccgccaccggccccgagagcgccgggtggaatctgggtaagcgcggtcggtcccgccgccactccgacgcctcctccagcagctccagcagcagctcctcggattcgtccctgggcgatgacgaggacgtggccatnnnnnnnnnngagatgctgctggagccctacttcatgcagctagacaacacttacaacaagctgcagacgctgtatgagtacatcgacgacacggaggtgagaccttgggatcatggggggggttggggcgtggtcagcgatgcctcggctggacccttgcccggcacgtcggtgctgtgtcactgctcggcctgccatgaatgcgatgctcatagcacaccctgcgtcgcccatcattcattgctggtcgcttgcactcccaccttgccaggatttcatcaacctggaactggactccaaacgcaatcagatcatcagggtgaggcatggcaaggggcttggtgcgaatgcccctggagggtggagcggaccatgcatcatggcggccacacggcgtcgaggaatggcactctgcaggcatgtgctgccgccgtccactcacaacccccccgcccccccccagctgatccccccacccttggacacatgcagatgcaactcgtgctgacgtctttcaatgcctcggttgccctggtgaccgccttcacctcgctcttcgccatgaacttggaaatgaagcccgccgacgagnnnnnnnnnncgagtggccggggcaggtgcggcggggtgcggggaccctgcgtgtgtgtttggcgggtctgtgcgggcgctgggccccgggccacgccccgcgcgggactgtcctgtgccgaagcggcgcgcccctnnnnnnnnnnaggtgcggcggggtgcggggaccctacgtgtgtgtttggcggctctgtgcgggcgctgggcaccgggccacctcccgcgcgggactgtcctgtgccgaagcagcgcgccccattcatgcgcatccgtcgtgggtctggggacccgcctgcctccaacctgacccgggcatgcacgctctggcagcaccaaccccagactctcatcccccccacccaaaaaacaacaacaacagggtccttacggctggttcctcagcatctcgctggcctccggcctgggcgccatcttctgcttcgtcggcgtcctggtgtacgcgcggtacaagaagatcctgtgagccaggtcgcgcttggttggggcccctcccctcccgtcgcgcttgcacccgtctttctnnnnnnnnnngtgagccaggtcgcgcttggttggggccccctcccctcccgtcgcgcctgcacccgtctttccggctggcaacagcatgtgacgcaggcatgggatcaagggggcgaggacggcagggcgcgtgcccgcgcctctgcctgggggagtgagaagagcaagccaggggaaggggtcaggcaccgactcaggaccgggtga

SEQ ID NO: 4391 - DNA, 768 bp, Chlorella protothecoides
  modified_base (191)..(200): a, c, t, g, unknown or other
  modified_base (597)..(606): a, c, t, g, unknown or other
atgatgctgggaccttgcaaaacgattggcgctgtagaggacccctcctggccgccggtggcagatcccgcggcgctgccttgcactgtgtggtcccggcgcctgatgcacactcgctctggggatcggcgtgctgcattgctcccatcatgctttacacacaaacacacaaacctgctctcgctctcttnnnnnnnnnnatcccgcggcgctgccttgcactgtgtggtgccgccgcctgatgcacactcgctctggggattggcgtgctgcattgctcctatcatgctttacacacaagcacacaaacctgctctcgctctctcacgcacacaggagctgctggacaagtgcaacccgctgggcgtcttcgatgccatcgccaccctggccgtcgcccagaacatgcgggacctgtaccgcctcgtcctggtggacacccccctggcgccctacttctccggtgcgcttgatgaaggggtggggtacttggcgggaagctgtggggtgcacgccaggcggctgactcaaaaggtttccagcaagaccctcatggcaccctcggcgctggatgcctccatccccacaggatacgtnnnnnnnnnnacccccctggcgccctacttctccggtgcggttgatgaaggggtggggtggttggcgggaagctgtgggtcgcacgccaggcggctgactcgaaaggtttccagcaagcccctcatggcaccctcggcgctggatgccgccatccccacagaatacgcctga

SEQ ID NO: 4392 - DNA, 498 bp, Chlorella protothecoides
atggaagcacggcatcacatcagagctcagcaactgtgttgcaccaatctcgttcgttgtcgatctgctcttacgggcaggcctcgcgacgccttcccatcccctgactttccctggccccagccagccagcccctaccacgtcctcctcgtaacccttggcagttctctcctggccagtctctgcgaatcgtgggatcgacgaaaggatcctaacttgaggcgcaccgttaaaacttaccgggcgcggctgccctcactgtattgccaaagacgaagcaatccgtccagttacctttcgtcagcgcgacatggtgccttcacgcactgctccttaccccttgcagagggcgtcgtccgagggtacaagctgggcttgctcaccgctgccgactacaacaacctgtcccagtgcgaaaatcttgaagatatcaagctgtatctggtgagtcgatcgtggctgcagcgggtttgccgtgaagaggacactgctatgtaa

SEQ ID NO: 4393 - DNA, 978 bp, Chlorella protothecoides
atgaagcacttgaccttgtccagcagactcttcacatcctccttggtagcacgttcgactgagcacaacgaaaggagatggtttgtccttcctcagagccgttgccgtgctgcaaagagcaagcgttccccagggcatctgcaggtcatgcacaccctacccccgccacccaccattgttcacaggagagctcctgcacgccgactcctgctgcagatgactgatcgaagcacaaggatcggtggaaagaacagtcttacggcaaaatggcgagcaaccatggtgttgtcgcggtgtgagtttcgtggtgggtggtgccccggatccacaatcctcaatccacagcagaggttgccagcacggcccctgggagcgggtccagagaaaggagccgattcggcgctttcacaccgtcctgagcagcactcgagcatcactgcctggagggatggcggaagaggccgatgccacggtgaaggagcctctggacctgatcaagctcagcttggacgagcgagtatacgtgaaactgaagggggacagagagctgcgcggcaagctgcacgtacgtttgatggttggggtctcaaggactgccactctgagtttcatgttcctgcaacagcaacctcctgctcggtccaccacgcttcccaggcgtatgatcagcacctcaatatgatcctcggggatgtggaagaggtggtgaccagcgtggatatcgatgaggagacctttgaggagatagtcaggcgcagtctcagaaatgcacccctctcccaacgccttgcagacgaacaaacgaatgctgccctacctcttcctcagaggggatggcgtcatcttggtgtcaccgccgctcagatcataggcagtgagggcattcgggcgccaatgccgcctcaccttatgctgtcatgtgcagaccagctctctaggcttgctgtgatgcccgcagcacttctgtggggacaatga

SEQ ID NO: 4394 - DNA, 1119 bp, Chlorella protothecoides
  modified_base (471)..(480): a, c, t, g, unknown or other
  modified_base (945)..(954): a, c, t, g, unknown or other
atgcttgctctcatgacgttgggttcttcatctattgacacaactctggatgtgatttaccacctcaaaggcgtgatctggaggggcgattcggtcatttccggcatccctgagaccctggaccatctccgcagcttggtgagggctggaagaggcggcaagcaactctactttgtgaccaacaacagcaccaagtcgagggcaggctacctctcgaagttcacctccttgggcctcaacatctcagctgatgagatttactcctccagctacgctgccgcatcctacctggagtccatcaacttccccaaggacaaaaaaatctatgttatcgggcaggagggcatcctggtgaggagacggcaacacactaagcctgtgtgcgcacagactgtgcgccacgctcaaagaggaatgtccttgcttgcagcttggggcttgaagagaggagctggaactcaagggcttcannnnnnnnnnacgaagaggaatgaccttgcttgcagcttggggcttgaagagtcgtgggtggaggagctggaactcaagggcttcaaatatctcggtggccccgctgacgcagaccacagggttgagctgaagcctggcttccggctggatcaggaccctgatgtggtcattggccttgcccaagttccatcggcccctgccagaaacccgcctgctcaaagtccaaactggctgctcactctcccttcgactcctcctcttttgcccccggcccaggtgggcgcggtggtggtcggctttgaccgcttcgtcaactactataagatccagattgcgacgctgtgcctgcgagagaacccagggtgcctgttcatagccaccaaccttgacgcggtaactcacctcaccgacgcccaggagtgggcaggggctgggagcatggtgggcgccctcagagtggctggggataggggnnnnnnnnnntcctgcatcaagccaagcgcagacatggcaagtgcaaggtcctgtgcactctcgcaccacccatgctgccttcaaaagtcttctagcaagactcttgatcacatgctgcaacagactcttcactcacagcttttgaaccatacttcgtctacttcaaagctttga

SEQ ID NO: 4395 - DNA, 1335 bp, Chlorella protothecoides
atgtcgaacctgaacactcctggcatgaatgccgccaccaatctgacaccgcaccgatgcgcatgcatcttcccgcatccagtatacggcagcaaggtcaacttgcctgtcatggcggccgatcgaggcagtcgtcagcactcgcatgcgggacgacgatcagggccacgcactccgacagcagtagcgtcgccggaacgtgcggcacttcaaccccacatggctgggcacaccgacctcatcaatggtctgggctatgttggaagtgttcccaccagcctcatgccctggttgctgcgcctcagccacatccgcagcagcatctcgggctctgatacagccgatgccctccaggacgcagcctgcggtctgctcatctggcaggtaagctgcacggacctgctggtggcatgggcatttggagatataatgaattacagtagaaaaaactcaatgcacccttcctttcccacacctttcaaagcacaccacatcacacaggcggcactacaagagggtcttgtgcccgacgacgagacgttgatggccatggctgagaaccctgggtttgttggcggcgacaggaagctggaggacctgaggtggcctgatgaaccccttcgagctgccctcctgagtgagccgctagggattggagagatgccagtgggttcatccatggtttacatagcatcagggattaggctgtgcttcataggtgcacatgcgtgtctcagggagtgtggccggctcatggtttcttccccaagttcgagccttcaacagaccggctcgtggttctcaccactccatgctcacaccacagggggagtcaccgtgcttggagttgggcggtttgccaaaaagtaccctgctgtgctgcaggccttgctcaagagcctggtgcaagtggtgtgtcagtaccagaagacgggcaaacatgatgctggcaccccatcctacacatccctcaaccccctcgcattcccagtctctgggctgattgaggaggaagggcgtgcacgagatgccagcggaaatgtgtacaagaccatcgccgagctgcaggcagaggaggcggcccgacgagcagagggagggaagcagggcatccgcaaccccaacgttgtggcggctgatgggaagccggggtcgccagtcccgggccagcctcagccgggcaacagcgaagtcgaggaggaggagcccgactccacagagccgaagacaaaggaggaggaagctgcccagaagcttgtggctgccctggtgaagatgtggagggagccactcaccaccctgtctcgcgctggacgcgcttttgaggtgtgttga

SEQ ID NO: 4396 - DNA, 1152 bp, Chlorella protothecoides
atgccgccaatgaagcgaagagcggacacacaagatgaggacgagtgcccgtcgaccagtgcacccaagacaattggacagatggtcgagcacattggcaacaagcaggtccggtccaccaggtttcgcgagctgaagcggaaggaggaccgacggaagaaggcagagaggaaaaagcggcaagcagcagccgagaaggcagagaaagcgggtgcagaacccgtaccaaagccggtccccaagacaatcgagaacacacgagaactggatgagactattgtcgcgccggatgacgaggaggtagctgcagaggagacacaggatgagtttgcaggtgagaaagggagaattctcaggcgtggcaaagggagagggcgatggcgcctgaacaggggtgccctggttcttgggagagtttttggttggagagtgcagttgagacacaccttgaaccatgatggcaccctctccaggttgagatacaccttgaaccatgatggcaccctgtccggcctccccccttccacccgctcaccattccggggacgtgttctcgcagatcactttaagagggtgcgcccgccacatgtgctcatcaccacctgcttcaagccatctgggatcatgtacaagttcatagccgagcttctggaggtgatgatgagcgcgtactcgatgcatcttcatggggtgcaatggcagcatgaggggggcgttgcactcatatcaccgcagggaaggctgcgggatgctgacagtcccccggtaatcagggtctcatcgcctcccacccctttattccatacaggttttccccaatgccacatactacaagcgccagggtttcccgctgaaaaagatcgtgcagtttgcgaagaaccgcgacttctcagacgtggtggtcatcaacgaggacaggaagatgatcaacggcatgctggtgacccacctgccagagggccccaccgcccagttcaggctatcaaatctgaagctgtcgacggagatctcggtatgtggtgcggggcgctcacggggatgaagcaggcatgctttgcatggacgcaagacatgcacagggcatggctgaggccatggatgccttgcacgcatatcccagacactgcctggttgcatgcagatactgtgtga

SEQ ID NO: 4397 - DNA, 318 bp, Chlorella protothecoides
atgaacatcgaggtgctccgcaacacgctgtacaaggcctacctggacgactttgcggggctgtgcgggcgcctgggcggcgccacgcaccaagtcatgggagaccttctggccttcgaggccgatcgccgcgcgctgaacatcacgctcaactccatcggcacggagctgacgcgcgacgaccggcgccggctctacgccaactttgggctcctctaccccaatgggaaggggaggagggtgttcctgcgtgttggggcgaggcgcaaccaatgcgtctccggcggcactgttgctggagtttcattggttggttga

SEQ ID NO: 4398 - DNA, 648 bp, Chlorella protothecoides
atgcgtgggcctcgggaaacggtggcaaaggcgctggcgctggagtgtatgagggcagccaaggcgcaagacagggcctgctatgtgtttgcgtttgcaggcctccaggaggtccgagagcttgagctgaacatggatatgaagagcatccataacctcctggactttttggagaagacgttcaatggcggctctgacttcaacagccccatcaagctgtgcctgagcaggctgacagatgccaaatgggccaactctgacatcttgctggtttctgatggggagctgcgccaaccaggggtagagattatgaggaaactggcgggtgccaaggacaagctgtcgctcagagtgttggtgcatgagttcgcggactgggccagcgtgaagaaggacaggtcgctcacctttgactgggatgatgccctgggcaatgcggcccgacgggaggcggggctgcggctggagaagatgagaaacgccgagatgaagcggcggcggctggcagagcgtcaaaagggtggctcgggcctcaagggtgaggccaccaagatcctgcgcatgccaagcaaggatgcatccagctttgacgagaaggggcccaagggaaagagcaaccagcgcaaagccatcacctttgaccgctga

SEQ ID NO: 4399 - DNA, 372 bp, Chlorella protothecoides
atggagaagtgcccgccgtaccaggccatcttcagcaaggtgtgcgggtgccagtggctgcgagggcaggggggtagcgaggcaagagagggacctcgtgctggtcaggaaggaggagacgaggcctgtcttgcccaggttgatacccgcaccactctcacattcaataacaccctacaacacttcatgccctgcctgacacctgcttctcatgccttcccaacccctgcacagctgggcgcgggcgagtcggtgatgctggacaaggtgctatatgaggaggaggccaagcgcgccatgcagacgtttgagcagcagttccactacggcgtgttttactcctacatgcgcctgaggtgcgtggtgtgttga

SEQ ID NO: 4400 - DNA, 297 bp, Chlorella protothecoides
atgtgctccattaatgtactgcaccatgcaggcggcctgcagttcgaccccgagacggtgaccatctccaagggcgactccgtcacctggcagaacaacgccggcttcccccacaacatcgtcttcgacgaggatggggtgccgtctggcgtgaacgtgtcgagcctgaaccatgaggactacctcaacgcccccggccagtctgtgacctccaagtttgatgtggctggcgagtacaactactactgcgagccccaccaaggtgccggcatgcagggcaaggtcatcgtcaactag

SEQ ID NO: 4401 - DNA, 357 bp, Chlorella protothecoides
atggcattcccgatagtctcgaactctgatcccaactcccacagaggtggcggctggggtccactgcgccgcgccccaacgcaatacctggatgacaggggtcggcccggcctcctgcgtacggtgctggaggcgcaggagaccagggggttgaccaggggggatgacctctcgcgcatgctgccctcagaggtgagggactggggatcgatttgccaatgcagatgtgccggccaacttccctgcaacctccggcacgtaggcggccctgcttgcaaggggcaggacggtgcgccaggcgcgcctgctcttctttgccaagctggcagagcaggcgctgcagtgctacgagcgtga

SEQ ID NO: 4402 - DNA, 705 bp, Chlorella protothecoides
atggaggccgaggcagcccccctgatccaggccctgggtttggtgcaggacacaccccgcgtcatcccagagcccgccccctgcgtctccttctctggctcccacgccggcgcccacgtgcacgtggtcgtgaacggcaagtgtggaaagcacggcgtggacaatgtgggcaccgtccccgccgcgctgaccgcctacctggcgcttcaggcctttgaccccgacctcgtcatctccacgggcacggccggcgggtttggcgcccagggcgccgccatcggcgacgtcttcctctccaccgccaccgtcaaccacgaccgccgcatcccgatcccggggcatgagagctctctgcgggtgtccgaagatactgaaacgtcgccggcgtgcgcagcgctgcgctggcaagggattcctgtctccgcccagggcaccgcagagccagttctaacccgcatgcttgtgcgcctgggtgtgctcctagggggcttcgaccagtatgggctgggtctgcacgcggccctgcccacgccgcagctccaggcagcactgggactgaaggcggggctggtgtcctctggaaattccctggactacgtcgagcgggacatggagatcatgcgggagcatgacacctccgtcaaagtgggaggggagaaagggaggctgggcggggtaggaggtggagccaaacgggtgtgctga

SEQ ID NO: 4403 - DNA, 1566 bp, Chlorella protothecoides
atgcaggtcagctcaactgccctgtcgcatagacaagcccccttcggggccgccgcggggaaggccaaagtgcagttccgcctgcccaagcgagtgagcttcggccaaaccatctccatcgttacatccagatcaggatgggagccgatcccagatctgcacatggactggtccgaaggggacgagtggaaagtgtctgccgaagtcgcgcccgggctcgggagtaacgattcactcacaccacatctccttgcatcttatctgtacagggatgagcttgagtacaagtacgttgtgttgggcccaagtggcattgtggagtggcagacagggagcaatcggcgactggcagtcgatgtcccgggcggagctgccgtgaccgtggtggatgaatggcatggaccgacacagcaggtgtcagtggaacttccagaggctcttcaaggtgggagacgagcatgggcgcatgggcattcctgtgcatgcttgcatggaaatataagagggttaccctacagctgtgccagcacagatgcaggcgggaggaccacagcagccaccagcccctcttatgacgcggcgccagagtccaagcgtgcacccattggcttcttcggcaagcaccgtctgcccgccagcctgcagcgcagctttgctggcacacaggctgcgaaggcagagtcagcgagcaaggacctgtccaagaagcagctcaagtctctgctggaggtgggttcctttgggggcaaagggagctctgcagggtgtactggtcaattcccccctacacagcacactctgatgtgctgctgttgcctctgctctccttccacagaagaagggactgtccaccgaaggccggaagatcgacttgctggagcggctgcgcagcgctgcctgaccagtgcaaaccctgatgctgcacggacccctctttgcaggcagacatcatgcccctgcccaagcaagattgcccaacagtatgccgccacagtacggccctcaaatgtttgcgaaacacccttcagcgccgtcccctgccatgatttcagggtgccctgcccgagaccacaggccagtgcacaggcctgggtcccgtcaaatctcatcggccagaatttgttggcgcaggtccgacatcagggtgcacatgaaatggatgttgtggatggtcaagagtgtgctcatcagcggctcatttgccttcttgagatggtgcaggtaggcgagtctgagggggagagggtggacagggaatatggagagagatctgcatgccggacgaggggacgtggcgcgacaccttgcactacatcacgaggaggcagggtccatgatggcaggcatgctgatgtggaggaggagatcaagggccattattccacacagcctcctgctgggcccatgcggcgccccagcgctggtgcgtcggcccttcatccccatacatcacaaaatccggcgccagggtccaagctgccgcgccagactctggccccactcaccactcgcacattccccatcggggtcagcatggtcccgtgccggcccgcccgtgtggggtag

SEQ ID NO: 4404 - DNA, 1485 bp, Chlorella protothecoides
  modified_base (517)..(526): a, c, t, g, unknown or other
atgctcaagcacacccggccccaggcgttcgcaggcactcggagagacacagacacactccagctgcacgtgcatgggattcaatgtgatattgtgaggggtgacgaaacggctttggccttggaagacgatggtaacctgctcagatgctggggcctgcccagcactctcgtggaccggtttgatgccaggcaagctcgctcagaattctctgggagaggggatgcaaccgacatccttcgattctctgaatctattgatgcgaataccatgtggctgcttttagactcgcctctcggcgactcggcacctgtacacgagcgcaccctctcagacattgagctggatggtgagcggtacgcagacaccttggccgcacgagcagattttgcatcgtccagcgatacatccccgtcgccaggtcagcgggcacttgggtatgggacagccagtggaagcacgaatgtcccaagcataccacagcctggcaggcatgctcagccatgcttgcacagtnnnnnnnnnnacagccagtggaagcacgaatgtcccaagcgtaccactgcctggcaagcatgctcagccatgcttgcacagcaatgctgtggaacgagcagatgctggtccgttttgagaatcgccgtactccacaactgctctgcagacctgatggccccgtgccagcaccccatctccactggagctgcagttccctttgagtatggggccacactcagtgacagcagtcgagtggaggaaccccaagctcccagcgcgcccgagcccggcaatgatgaccctgctttccagcccaccggcagagtccctgggaacctgcgactggctggtgtggcgcccaccaccctgcgtcacctcaaggtgtgtcctgcgcggtgtagaatgatgggcaaagggagtgcccaggtgtactcttcagttatgacactgcctctcgcccttcccaccgtgcgcctcctgcttgatgtgccggccagaccttgtgaccctgggccctcgattcaggtgatgctgcaggctgcgcgcgccgtgcggggcgggggtccacagctggagatcctgatgagagtgcgccatgcccgccagcccctcttcggcttcctgcagccggaggacgcccgccacgcattcttcaagtggctgaccggcctgccagaggaggacacaggggtcgaggccttgcatgtggcacaggatctcagcccaggccctgacacggcatcgagcttgttgagagtcatgcagcgcctggctgcttctgtgcaggtgagtggacgcacagacgctgtgtttgtgcaccccttcacgggggtggagatgcgcataatgaggagcatctgggtatgcgtttggtatgcctgttccgatgggtggcagaggtcgcgttggtgcaggcattgctgtacactttgctcctgggagtggaagccacctttctcatacgaatcccaaatccctgacccttga

SEQ ID NO: 4405 - DNA, 321 bp, Chlorella protothecoides
atgctgctcacccccgagtcgtcggtggaggcgcagaaggcctttggcgcggacatcatcctccccctggacgagctgccgccctaccacatcgccgacgccgacctggaggccagcctggggcgcagccaccgctggatggcgcggtcactgcgcacccacctggccgatccgcggcgccaggccatgtatggcatcgtgcacggcggcatgtccatcgacctgcgccggcggtccgtcgagtacctctccgccctcccctttgacgggtttgccgtcggggggagcatgggcaaggacaggtgcaacggtagattgtga

SEQ ID NO: 4406 - DNA, 573 bp, Chlorella protothecoides
atgagatcagcccagagcaccaccctggccgagttccggagggaccaggttgcctccatggtggggcagcagcaggccaagcaggatggggcccccccggccatcaacagggtccactccgccccgcgcctgtcccaaggggaggacgtcctgcccaagatcgtggtcggcatctgcgccatggacaagaaggccaggtccaagcagatggccaacataatgaagcgcctgtcccgctacggcgagtttgaggtcgtggtcttcggggacgacaccatcctgaacgcgccggtggaggactggcccgtggtggggtgcctcctggcgtggcactcagagggcttccccctcaagaaggtcgcatggcgagacgatgggcgaggcatgcgtgacgagactcggccaagtgctggtatgcagcggcctgccgggagccgaccccgccaccgtacctcgcattccacaggcccagcagtatgtggtcctgcgccggccctacctcgtgaacgacgtgtttgcccaggacctgctgctcgaccgccgactggtctatcgcaagctggtggtgggtag

SEQ ID NO: 4407 - DNA, 624 bp, Chlorella protothecoides
atgccagggactcagcaccgccgcactcacggcgcctggccctgcgagccgcacgctgtggctctggcatcaccccctcgcgacccagcccctgccccctcggcccaacccccgcccaggtccaagaagtctgcagcgcgggtgggcaggatccacacaccccacggcgtcatcgacacgcccggtttcgtggccgtgggcacgaacgccgcgctgaaggccgtggacggcgcttgggccgatgcagaggggctgcagctcatgttctgcaacacctaccacctcctgctgcaccccggccccgaggtggtggccggcgccggcggcctgcatgccttcatgggccgtcgggaccggccgctcatcaccgacagcggcgggttccaggtcttctcactggcctacggcacggtgcacgaagaggtcaacgagctgaagcgcagtcaggggccctccaagcacaagacggggaacctgatgaagggcgtgacggaggagggcgtccgcttctgcagctacaggtgggagggtgggaggaaggggggggtctggggtcggctcctggagccccattgcttggtgtacctggatcggaactgcagcctagcatctaccctgccatga

SEQ ID NO: 4408 - DNA, 639 bp, Chlorella protothecoides
atgcccacccacacccgcatcatcgtcggctatggcggcgccacgctctgcctggccaccatcctgctggtcactctggcccctggcaacgacgcgtcgctggccggcaccctggccgccacgggggtgtgcagcatctttgatgccgtgtcccaccccgccatgtacgccgaggcggcgctgcgcccaccccagtacacacgcgtcctggtcctgggcgcgtccctggcgggcgtggtgaacaacatcctgcgcatcatcaccatggccgccttcgacagcgaggccgacggcctggccaacggcgcccgcatcttcctggccctggccgcgctgtggacgggggcctgcaccgtactgtacccgctcctgcgccgccgcgggctgctggtggaggcgggccccggtgcgcgcctggaggcgggggagggcgagcaggaccccgacgccgagcccgtggagaaggaggggcaggaggggccaaagcctgggaaggaggaccacgccgccctggccgtcgcgccgggggaggcgctgcagggccgggcggccgtgctgcaggtcatctgcgacacctggcgcctctgcgtcgcgctgatcctcatttacatgtgcgtggggcaaagctgggagtgctga

SEQ ID NO: 4409 - DNA, 2214 bp, Chlorella protothecoides
atgagacaagccatcgacgggaagtcatgcatgggtgactggcgctcagatcatgcgcagatgagctgcagtgcaatccgtggagtagggcatagatttgaggctgggctggtggccccgcaggaggagaccagcactgcctcagcccagcagccgacagaaaaggtgctcgccctcttccggcgccagctggccgttcctcatgctcactccggcgccaccctcgcggagtgggagcatgccggcggcgccgaggatccgcgccgcaaggaggtgcttgccgcccatgaggcggcgatgcgttcggctggggagcgagagcctttcgaggcggccatcggcgaggagggggccgctgcagatacccagctcctgggcagctacatgtcgtacctggagtttgagaagaagaagggcgaccttgcgcgctgccagggactgtctcagtggatgacttcagtaagaccatgtgttgcctggagggcatgtgggcctcgggcttcagaacaagaggcatgcaggagcctgtttgatgctgtccttttccctgtttctcatccgccagacagctcgccccctcttccttacatcactgcaatgctgccccggccgcagtgtctctacgagcgggtgctggccgtgttccccgtgacccacttcctctggctccagtactgctcgtttctggagagcaggctcctgcgtcagcaggacgtcaaccggctcatcaccagtgcctacgctcgcgccacccgaaactgcccctgggtcggccagttgtgggagcggcgcatccgggccctgcaccgggcgggggcagcagagggcgagcttgctgcggtgtacagcgaggccctggcggctcatgttccggtgtgctacttgggaccgcgggagggttgggagggggttatgggtcacaggaattgggatggagatcgtgcgggaggacgtcgtgcgggtggtgctggcctacgcccactatttgaagtgcaagaaggagctcagccagctccagtcgctgctcaccgaggccgagaagcacctggagacgagatttcagggcgagctggaccacagcttagcgtaggctgcagctggtctgggggggagggtgagaggaggaaaacaattgccgatcctctgccggcaggcaacttgactccagaaacgttcacgccttggcctgagcttggcaaactgaaagcagtgcgctatgtgtttctcatcacagggggtcctgacgtcagcgttggcttctcaggggtcctcttgcgagccctgcgtgactatgctcggctgtctcaccccatacctactgggaggagcactccggcacaacaccggggtggcaggtgtgggaggcagtgctgcgatcgccactggggtggcggcgccgggcctgggccgccgcaatctccttcgagctgcgacatggcgggccggagaaagcccgcaagctgtaccagcggtgccacaggcgtaagctcgaggacgggggccaggccaggctcctccaggactggctggtcttcgagggcctttttggcgaggcattcagggcatgacttgaagcgcctccgtgtccactctgccctagccacgctggtcgaccaccctggctctcactaccatacaagcagtgcacagtcatatgcggaggcgtgcacccaggcagacccaatcctgtcggagctcgcatccgctgcggcagcgcgcgcccaagccgatgccgaggctgctcatgcgtcaggggccgcagcgccaaggtcggccaggactgccaagccagccgcaggcaaggcgccaccaattctggatcccgaggagcagaaggcgcggcgccaggccgctgaccccaatttcaagccgcgggagaagcgggccccgagtgaggctgccgccggtgacgagacaaagccgccccaccccaagcggccgcgccaggcagagcagggcaacgcggaagggggcattgccgtggacgtggcgtccgccaaagaggacatccagttcgattcgaggactgctggcaaggaggcaccgcttgccgagaaggccaccgagcccgcgccgaccttcaccgcctttgtgaagcacctggcaccagtcgtgggtcgggaacagctagaggaactcttctccggctgcggcgggatcgccgagatccggttcggcatcaacccctccacgaaaaagagcaaggtggtgtag

SEQ ID NO: 4410 - DNA, 894 bp, Chlorella protothecoides
atgggcttctgcacacaactcgacacttcgtggtgttcagacgttccctgcctcgcccttgatgctacgacaccgttccgtctgcgcgccctcaggatctggatcgcttggtgctccacaggcagagcaaagcagcggggagctcctgataatcaattgccaaccagactatcaagaaaatgtgctgtaagcagtgccatgcccaacgacgagccgatggcggaggcgtcctcgtcgcagtccgattcggaggagagcgatggaggagagatcgacatatccgagcaggatgcctctgccatcatgacggcagaagctgccctggagtcaaatccgtacgactacgagggacacgccaatgtgagtacctgcttggctgtgctgaaatgggggctgaagaagggaatgcagaatgagcatcggacgcggtttgtcgcatcatgcactccatgcagcccctctctgcgttcccctctctgcgttattaacacagctctcaccttaacactcacgtctacgcccctgctgctccagtacatatcccatgtgcgtcgctgtgggctccaagcaaagctcaaggatgcccgcgaggccatgcactccctcttcccgcttggtgaaggcatctggctggagtggctgaaggatgaggtggcagcttttgaatctggctcggccacccgtgaggatgtcacacgactgcatgagcttgccgtgcaggactacctgtccgtcaacatatggctggcgtatctggcattcatatcctctggcgtgcagagcggggacagcgccgcaatcagtgaggttcgagatctcttcgagagagccctcaccgccacgagcttgcacttcagccagggcgctagagtctgggcagcataccgacagtga

SEQ ID NO: 4411 - DNA, 762 bp, Chlorella protothecoides
  modified_base (244)..(253): a, c, t, g, unknown or other
atgtcgctgagcaacgagcaactggaggcctttgagcgggatgggtacctggtcattcccgacttcacatcccgcgaggaggtggctgcgatgcgttcccgggctctagagctggtggctggcttccagccccccaaggccgtctctgtgttcgacaccaaggaccaggtgccggaggagctggggggaaccagttgggactcagccagagggatgccatccacaccgccaacctccactaccnnnnnnnnnnatctgtgttcgacaccaaggaccaggtgcctgaggagctggggggaaccagttgggactcggccagaggaatgccatccacaccgccaacctccactacccccccgccagaccagcaaggtggaccagtactttttggacagcgccggtgccatcagcttcttcttcgaggcgggggcctttgattcccagggcgcccaggtcaagcccaaggagctggccatcaacaagatcgggcacgccctgcacgacctggacccgatcttccaggcctggtcctactcgccccgagtctgcgccctggcgcagagcctgggcctgcgccgcccgctgcccatgcagtccatgtacatcttcaagcagcccgggatcgggggggaggtggtgccccaccaggacagcaccttcctcttcaccgacccgccctcagtggtgggcttgtggctggccctggaggacgccacactccagaacggctgcctctgggccatcccggggtcacacaagtga

SEQ ID NO: 4412 - DNA, 576 bp, Chlorella protothecoides
atgatgaccctgttcaacctgggcgatctggcggggaagggcggccccaccctcgtgccggcgctgcgctggagcaggcagggcggcatcctgggggcggtgtgcctgcgcgccctcttcattcccgccttccacctcgcaggcgagcggcattggcctggggatcgacttgtttctcagcgttcctcggagaggggatcaagcaggggggacagtgcccccctcggggctgtggggatggaaggtggagctcatcgagcggaagggcaaggaatgctcatcccagcgtcgtgtgctctccccccgagggagccggctgatgcctcctggtccccgctctcacatccgctcccaccgttggccccacccaacttcgcagtgtctgcaccagccgggctggcgctgtgcacgctgggcctgggtttcacaaacggcgtcctgacgagcagtgctatggccacagccccggctcacatcgccccaagccaggccggcctggcgggcagcatcatggtcctctccctggacgtcggactggtcctgggcgccgcgctcagcttcctctggctgctgtga

SEQ ID NO: 4413 - DNA, 1080 bp, Chlorella protothecoides
atgaagacagccaccggtccagacacgtggggcactttcctgacctacacaggcctgggttccggcaccctggccgcctggaacagcttcatcctgggggcagactactttgagtcgcgattcccggcaagtggttgtgtggcggggtgtgcgctcgatctggattcttcgtgcacgagggagcagctctggtggaggatggctgcgttattcacaggggagtcgcaggccctgcacacccagcatgcaccaccgctcccacatcactcacgtttccctccgaaacacacacgcacacgtcatgcacagggccagcacgccaaccgcctgttcacagtcttctatctccccgtcaacctgagcgtggtggcgggcctgacgtactggcacaccctgctctccacccgcacccgcatccggataggcctggccggctccgccctcggcctggccctggtgcccctgctgggcgcgctgcctcctagtggcctcaccctggcggccacgctgggcctgctgtgctgcgtgggcgtgacggacggcctgacccagcccgcgctgtttgccgaggccgcccagggcccgcccctgctcacgcacgcgctggtcacgggcaccgcgctggcggggctggcggcctgcgcgctgcgcgtcgccaccaaggccctgctcccacccacgccgcgcggcctggccgccagcgccgccgctttcttctgggtggccactgcctgggtcgcgggctgcctcgccctgtacctcacgcgcgcgcagcgtcctcgggagggtgtcgaggaaaccacgcccggcgcgcggacccccaccccagcgtcacccccgccccgggtcgagctgtccccctccgtccacggcgcgagcgaggaggacgccgaggcgagcttgctgccgaggggccccgccccggaggctgtcctgcgctcgccgtacctcgtgccactgggtactgcgaaggccggcgtgggggaggtgagagccacgctgcgcacgatatggcggctcagcttggccacgtgcctcatttacacgtgcgaattctggagagacagcgaggctttctga

SEQ ID NO: 4414 - DNA, 183 bp, Chlorella protothecoides
atggcggtcctcacattcctgctgggattctcaaacggcctgttcacctcgcacgcaatggcggcggggccctcccacgtccaccccaccctttcggacatggcggggagtgtcatggtgctggccctgatcgtggggctgaacattggggcgggcctcagcttcctgtggctcctggagtga

SEQ ID NO: 4415 - DNA, 249 bp, Chlorella protothecoides
atgcccagtcacaagatgtgtggtcgtcccactccacactccacccaggggtttgcatatgtcgagttcaagacagaagccggcctgaaggcggcgtgcgccctggacaggaccgacttccacggcaagcacatcttcatcgccccctcaaacaagcccaagcccagcgcaggacacgatgttcccgacaaggcccccccaggtgattggggtgacttgagagggtcggtgcgctatacaggcctttga

SEQ ID NO: 4416 - DNA, 819 bp, Chlorella protothecoides
atggccagtcgtggaagggctccaggaggagtcggccacaccctgttccctgaaatgctcccctcctcctcgtcctccccaggagctgctgaggagctgctgaggtttgttggggatggcgagtaccgccgcctgaagctgggcagcgaggagttggactggcaggcgctggaggcccacttccggcgctcccagaacgcgctgcgcaagaagtactggatgctgagcaaggcgcccatgccggggacgatggaggccacgcccaagcagcgcgccgagcgcaagaactggacggaggaggagaccgcggagctgaagcggctggtagccgcgcagtcgggcgcggatggggagtccgtggactgggagaagctggcggcgcactttggcaccagcgtgcagacggtgaagcgcaagcaccggcacgcccaggagcacctgagcctggcctcgggcaccccggcatccacggagaagggtgcgtggcggttgtgccgtgctttcttacttggggaacccgtgtggtggagggggcccgaggggacgggcgtgcggatgaggtcatgcgtgcctgggcgctgctttgatggtggggaggcgtgcctgcctggcgctcacgtggtggaccagccccctccgctgaggggagcggttgtgctctgccgccagcctcccatgtccgtcctggcagtgtttggagcactgcaaccatgcctcaccctccgccatcctggaccctccccagccctccctcaaaacccacccctgcagcaggcaagcgccagcaccaccgcaagaatgtgccgtaccgatggatga

SEQ ID NO: 4417 - DNA, 210 bp, Chlorella protothecoides
atggagctgctgaaggtgggcaaggacaagcgcgccctcaagctctgcaagcgcaaggtgagcaggacgacggacgggagtgccagggagggtggagggtcactcgtgcctcacacttccccctccacccccctgcagctcggcacccacctgcgtgccaagcggaagagggaggagatgtccaccctgctgcgcaaggtcaagaagtga

SEQ ID NO: 4418 - DNA, 948 bp, Chlorella protothecoides
  modified_base (350)..(359): a, c, t, g, unknown or other
atgtgccgagggggagcttgtaaatttgtccgcataaggagttttcagcatctacaagagtgctcaggggctctgtcatctctgtgcacaaatttgggagacaaggactttcatatcttggccaagggactttcatatcttggccaagggtgtgtggggcacgatgccctcgcacgtgcggacacctctttggagcacgttgctccttctgctgagctctggcgtgctctcaatggtaggtccgatgggcgctctctgttgtcgttcgccttcctcagaaagggggggggacgcgcaacacttgccatgtccggcgatctgttgtgggggcgggttagaccctacagcgnnnnnnnnnntcgatgggcgctctctgttttcgttcgcctacctcagaaaggggggggacgcgcaacactcgccatgtccggcgatcgactcacgcgcgcattccccctctcagggtgcctgcatgacgaagttcttcgcccttccgtctgtcacgtgagtcgaggccggcttcttatggctccttattgtcgcctcttcgtccggaaggcgcgtaatgtgtggagattgggcatggcttcggaatgcacatcgacacccgtaaattgcccgtattcgctggccaccactccagccctgccccctgccaaccaccacagatttatggggtacagcaagtcgggttacatcaaagaaactagtcttgacatccttggtctttccgtcagcgccatcagcatggaaccctttgagatcaacaaggatcgatcgaccaggatccttttggcagtagaatgcctgaaggctggccagaaggcttgccccgccgacaaggacgggaatattggcaccggaaacaagggaaagaacaacttcggtgattacaacgttggtgactggaacattggtgagcaggaaatggggagacggtgggggtga

SEQ ID NO: 4419 - DNA, 315 bp, Chlorella protothecoides
atggcggatatcacggcggtggatgagactatcaagcgcctcgcgtcctataaaggggtgcggggcatcttggtggccaccgccgacggcgtaccggtgcggacaacgctcgagcaggatgccgctcagcagtatgcagccctggccaccacactcgccagtaaagctcggagtatggttcgtgagatagcgagcgacgacgagctgcaattcctgcgggtgcgaagccggcgaggagagatcatgatcgcgcctggcgccgacaaggagagacagtactgcttggttgtggtgcagaaccctgtctcggaataa

SEQ ID NO: 4420 - DNA, 918 bp, Chlorella protothecoides
atgcgcggcacccgcagcctggccttggttgccccaacctccatcctccaagctcttcacattactctcgcttccgtgcacacacaaaccccttatcccccgataccccacctcccatcccaattcctggcgacacaggtggacgaggatgcggcccgagtgaccgtcgctgcgggcgtgccgcagcgcatgctgctggactatctgtccaagtacacggcgtacaagcagcccgcgggctggacgctgcccgccttctcctggttcatcgaccagaccattggcggcgcggtggccaccggcacccacggctcctccatgacctggggctccctctcttcccagactcacgctctgaagctggtggtggccaacggcacagaggtgacgctgacgcgagagtcgcacccccacctctggcgcgcggcgggcgtctccgtgggccgtctgggcgtgatcacggagctgacgctggccatcgtgccgcagcaggcggtgacgcgcagcctggagaccacccagtttgccaacttcaccgcccagatgctggaggtgcaggaggactacgtcgcggcgcgggagtcgggcaacgaggacgccatcaaggccgcgctgttcgcggtggacgagacgcagctcttctggttcctgcccaaccgcgtgatctggcgcaccgactactcctactcagacaaggagcccagcgacgtcatccccaacatcgaccccgccgacgccgccacgcccgaggtgtccgcacagtcggggccctccgacgacatcgtctttgaccaggcctacaccgaccccgtgagacccaacgccgccatccgctacggcaccgacggctggacgcggttctacaccatcgccacccagaactacgtgcggccggggaccttcgagcgccgcaagtga

SEQ ID NO: 4421 - DNA, 537 bp, Chlorella protothecoides
atgcacacgacacggacctgtaatgtggattacattccgggcatccgctgtccgtcgcaagtgctggctcctgatccggcaaacgacgatgcgtgtgctgcccccccctccccctctgtcctgatgaggaagtttccccagatgcctcaagaacccatcaacccctccctccctcctcaggcaaacttccagggtttcttccagtgcgatgattccaccaaggtgggacgccccgccgacatcgacgagctcaagcagctggtccagtcctacgagcacatcaaggccgtgggcgtgggccactcctggaacaaggaacagttctgcgccaacacatcggccgactcctccctgaacctggtcatgaccgagctactgaccaccgtcaacttcatcgagaacccctccgaccccacggagtggggcgccaacggcccgcccccaaacttccccatccaggcaagccaaggggttggtttcagaggttttccgtggagactcgtgttgggttcttgcacgtgtgtgggtcctggctga

SEQ ID NO: 4422 - DNA, 2118 bp, Chlorella protothecoides
atgcccctcacccactccttccgacacacacatgccccaacccaccacccccaccaccccactccctgcacagaggtgctggcccacgcttcgcgcgacacgctggccgtcatggtgggcgcggtcttctcgcgcctgggcagcctgcccgccgacctgggcagccagctgagcagcccttttgccgcggcggcccacgctgccgccggcggtcaccacctggtggtcgaggatgaggtcgagctgcagggcgcgggggccgggaatgcggagagcgatgctgcgctgacggccggtggcaatcgcaccgaagccggcgacgcaggcagcgccccggcggaggcggtggagccggcgcagcacagcatcgtgtcgctgctgccgcctccgtcagcgggcggcgcggtcgcgccggtcacgaaccctgtcccgaccgacgccgggtccatgccgaccatcagcacgacgccacgcggtgcgtcgcaggacggcggcgccagcccctcaaccgccggccggcggcccggggtcgtgggctacggccccgactgcgtgcgcgagatcctggccttcgtgatcggcctgatccgggccaagggcggcggcggccccgccgccgcgcccggcgcctccgcccccgctgcctccgcctcccaggacctccccctgcagggcctgcgcctgctgctggtggtgctggacgcggcgggccccgcgctgacccggcacgccgacctggcggcgctgctggcggccgacctgccgcgcgccatgttcgaggcgggggccgatgcgccgcccacccgcctcgccgcgctgtgctgcgccacgctggcgctgcacgcgcggctgggcgcgcgtgccattgtccaggtggaggccctggtgcgcctgctgctgctgccgctggccgaggggcgcggcggcgcgggacctgagcgccagcgcgtggcgctggagggcctgctggacctatgccgccagccgggcttcgcggccgagctgtacctggctgccgactgccgcgtggagcgcgccgacctgctccaggacatctgcgccctgctgtccaaaaccgcgcagccgggcggcgggggcggcggcgaggcctgggcggggggcgacagcgcccagaccctggcgctggaaggactgctggccctcctggcctccctggacgacgtcgcggagggtgggggcgcttcggacatcgaccctggggtgcccagactgctcgactcgcccgggcactacgtggacgtgtggaccccgctggccgcgggcctggccccgccgaccgaccagttcctggactggggcggggtggggagcgtggggcccgaggaagggggcgagggtcgcggggagggggacagcgacgagagtcgggacggaggcgtccggacgggcgtcgccatcgaggggggcgccggccccgccagagccgccacgccgaccaccccccggccccgcgccacctcgcccgcggaccgcgcgcgtgccgagaagcggctcaagtcgctgctggcctcggccgcggagcactacaatcgcgaccccaagaagggcctgcagtacgcgcaggcggcgcgcctgctgccgcccaccctggacccggccacgctggcccgcttcctgcgctgctgcccgggcctgaacgaggcggcggtgggcgaggcgctgggcgagcgcgacgacttctccgccggcgtgcgcgcggcgtacctgcagaccttcgacctggcggggctggactttgacgtcgcgctgcgcctcttcctggacgccttccgcctgccgggcgagggccagcgcatcgaccgcatcatggaggcctttggcggcgcctaccacgccgcctgccccgggtcgggcctggcctcccccgacgccgcctacgtcctggccttctccgtcatcatgctgaacaccgacctgcacaagcagcgcaccgaccgccagccgcgcatgacgctggagggcttccgccgcatgaacgacgcgaccaacgacggtgagcccatgcccgccgcgctcctccagcacctcttctccgtcatctccgccgaccccctggccatcaccgccgacgcggcggccgccgaccagctgcccagc

SEQ ID NO: 4423 - DNA, 912 bp, Chlorella protothecoides
  modified_base (382)..(391): a, c, t, g, unknown or other
atgctgagcaggttccggagcagtgggcaccgcgcacccaccatcgatcagaatactcggctgggactcagcttggcatggggtgacattggtggctgtagcagtgacgatggaggtcggcgacctggccctcctgctgaacaacgaggtggccacagtcctcgctgccctgcgaggatgggccgctgcgtccacgcgatacacggtatgcaccaggcgatcatgactcccaccctgatctctgcatccctggctgttcctctgcgtcgccagggggcgatccgggcgcccaacctcgcccctccctgcccccgtaggacgacgagatgcccgagagcctgccttctcgtattgcggatggccacacgcacttcaccgtccnnnnnnnnnngggggactccctctgtgttgtgcctcgcccctggctcctcctctgcacctgctgtagtgggtgctggcctgggcgatgtggagcccttgcacctgctgcaccccttcttcgaggtcatccgcacgcctgagaccagcggccccgtgaccggcgcggcgctgggctccctgcgccgcctgatccaggccggcttcctggccgcattccccgccggggtgggggaggccgtggcggcgctggcggacgccgtcacctcatgcaagtttgaggccacggtgccggggtcggacgagtgcgtgctcttccgcattctggaggtgctggccgcgctggtggcctcgccctggggcgccgcgctgccccacgacacgctgctcaacgcgctgcaggccgcctaccgcatcgggcactaccagaccgagaaggggcgggccacgtcgggtgagagggctttggtaagctggggaagccgcctcgctccctctgcctggagcgtgagcacgtccccaccccgcctgtag

SEQ ID NO: 4424 - DNA, 984 bp, Chlorella protothecoides
atggagggccgcgaccccaccgtccgcatcgcggtggtaggggaccctggcgtgggcaagacaagcctcattaccgccgctgcgacggagaccttccctgatcacccccctcccgtgctcccccccgccatcctccccgccgaaaccgtgccggagtgcgtgccggtggtcatcaccgacacctcctcccgccccgaggatgcagcagccctggagctggcggtgcaggaggcctccgtggtcgtcctgtgctttgccatggacaggccgaacaccctggccagggtatccaggcactggatcccggagctgcgccggatggcggggggcgcccacgtccctgtgctgctggtcgggtgcaaggccgatgcccggcccgccgaccacaccctgcaagcggccgtcgtgcccatcctgcagaacaaccccgccgtggagacgtgcatggagtgctccgccaagaagctgcagtacgtgggggaggtgttttacctcgcgctccgggcggtggtgcaccccaccgcccccctcttcgacgcccaggcccagaccctgaggcccctctgctctcgcgccctcaagcgcatatttatgctctgcgacaaggacaaggtggggctgcacggggcaggggtgcatgctgaagcaggtgccagcggccagaacgggggcggtgtgggttgctggaatgccaggctgtgttcatcgatgagccctgaagagtgcagggcgccgtctgcaccagcactcgcgcctcaacccttctgccgcccaatcctgcaggatgggattctcaacgaggcggagctgaacgccttccagatccactgcttcaatgcccctctccagaccgaggagttgataggcgtgaagcaagtcgtcgcggagcgagttcccgaggtacttctgggtgcagaagtcatagctctgtgctgtaggaagacgcagtcattttgggggaagattgagggaaaaccggtgtga

SEQ ID NO: 4425 - DNA, 195 bp, Chlorella protothecoides
atgccagctgtgacacagctggcgttcccactcctcgtgactcttatcccatggtccacccccgcctacgatggcgtgctggtggagacgagcaagcgcggcctgctgtccctgcgcggcttcctggccaagtgggcgtacaccaccgcgaccgagccggaggtcaccctcgcctacgccctctacttcgggtga

SEQ ID NO: 4426 - DNA, 1059 bp, Chlorella protothecoides
atgcccccatggtgccccccgaggtgctcaaggagctggccccctacgtcggcctggcccaggtgggtcggtgtggcacgaggtgatgccctgccccactcccgaatgtgggacgtgcgatgccggcgcagcgtgatcatgggcggggtgaggtgccgatgtctttggtgtccagcttcgcgcctccagatgccttgggcgtgtgcttggcaagggcctgcatgctcattcccacactctggactggccatccggcccctgtttgcagagcctgggccatgctgccgtgcagctggtggacgaccacgggttctccgaggtgcacatcacgtaccacaggtgagcatgatggggggtgcccagcagtaccactgcgcagaggatcagggtggtgtgagggacgacgcagtggtcatgtggagaactggcgacaatgccctagtcacctcacctgattgtgaacccatgtggggtttgaaatttgcctcgcagcccccgcggagatctgctggactctcggctcctccgggccaacgtcgtgcgtgggatcctgcagcaaatcaccacttcccagcgtcctctgatccagggacccgcatgatgcttgggtggtcacccgccgcccaggcgcctggtcgggataatgacacatggaatgtcgagcactcctgtcttcatccccctttgctccctcacatgagaccctgtcgtgcagtcccaccatcccctcctcgactcgaatgcacatccgcccaacccctcgcacaggtcaacatcgtgaacgccgacctgctcgccaagaagcgcggggtgcgcatcgtcgagactgtggtgccctccgagggcgcagcggtgctgaacagcctggaggtggccatcgtctcccgcgcctcccgcttctcctccgccgtcaacggccggggccagatcagcgtgtcgggggcagtgaagagcggcaagcccttcctcacgcagatcggcgactttgatgtcgacttggccactgaggtgggctctcctggggtggaaagggggaacagggcgttgtccttgagatga

SEQ ID NO: 4427 - DNA, 399 bp, Chlorella protothecoides
atgaaaaggcaccgggcctcgtccccaggcaccgccgcacgaccagcatgccgtgtgactggccagtgtggtccttgctgcgacgctgccgtgcctgaggactgccccactcatgccagccctgctgacactccctcctcgtcaatctcactgcacacccagggcgaggtactgctggtgcgccagaacgatcagcctggaatcatcgccactgtcgcctctgagctggccaagaaggagatcaacatctccttcatgtccgtggggcgcactggccgcggcgctgacgccatcatggccatcggcatcgacggctcccccgacaaggagctgctgggggccatcagctccgtgcgtggcgtgcaagagaccgcagctctgagcaacctccgtgcgtga

SEQ ID NO: 4428 - DNA, 1452 bp, Chlorella protothecoides
  modified_base (693)..(702): a, c, t, g, unknown or other
  modified_base (788)..(797): a, c, t, g, unknown or other
atgggacgagctgtaggccagcgcatttgtgtaatgagtatatgcacacacagagccgcccctgtgaaatttgaaatgatgttgctgcggggtgcccctgtccccgctggcttccactccccatcccgtaccaagtacgcatctgttcccaatgcggtggcatacagcatgccccgcagcagttgctgtcggaaaccggtcaccgaactcaccggttactccacatccttcggtccctaccatacggacccgaagcggagtcatggacggaaacgagtccttttgggacttctgcaccagggtgaatcagcagtcgatgtcgtggccagccttggccaaagactcggacatcctagtgacgaggtcccgaaaggactcgttctcgtccattaccaggtttcagctccgcatggtggaaccaaagggtgtgggataaccggtatgatcggtgaccggtttccgacagcaattgctgcggggtcgggtgtgccttccaggcaaggagacgttattctccctggagctgctaccaagtggttggggacttcaggtggaatcctgagcagtgcacgcagaagagagggacctcctctccgtcagcaggaacagtcaaatatcgatctcgtgtcgatctccgaaagaaatgcggcttcgccacatgattacgcaaacaaaaccttcaccactttccgnnnnnnnnnngggcggagacaggggaaccccgcaacagatggtcaggatgacatgggactccagaggatgagcatcgcctttgggattgttacaannnnnnnnnnccaggaacagtcaaatctcgatctcgtataccgcccgtccccacaaggacgatgcggtaaagctcacgagataatcagggagatggggggtcctggggcccagtccagccagttcatcgctgatgtcccttccggagcctggcccaccacacccctggtggtacgaagacccgggcgaggaggtcagccccctccccaacctccacttcgtccccaggtgctgatgggctgggtgggggccagtgaccgagcccttggcaagtacgcccgcgtgctggcggactggggctaccccagcgtgcgctcggtggtccccacagcctacgttctctgcggccaggcaggcgcgtgcaatgcatgggcccagagcatgctggatttcatgcatgaccagggactggtccagggccgcccgctggtgctgtacgccttcagcaacggcggtgccgccatcgtcgcatccatggcgcgcatctgcagatccgaggataggtgtgcaaaccatgtttgtggtgtgccgtctgcccctgccgtgaaggaagggatgcttggcctctggaaaccttcagcgagtgttgcgcccttgatggatgctcagcatggacacacgccatcccccgcatcaggtacaaatcgctgtggccccgggtggtag

SEQ ID NO: 4429 - DNA, 2487 bp, Chlorella protothecoides
  modified_base (112)..(121): a, c, t, g, unknown or other
  modified_base (458)..(467): a, c, t, g, unknown or other
  modified_base (531)..(540): a, c, t, g, unknown or other
  modified_base (743)..(752): a, c, t, g, unknown or other
  modified_base (806)..(815): a, c, t, g, unknown or other
  modified_base (2397)..(2406): a, c, t, g, unknown or other
atgttctggggcgcatcgtcccagcgatacttgttgatgagcgagacgtcgaagccgcccgcagaggcgatgcaggcctcgatgccaatgcaatacaccgtggcggcggctnnnnnnnnnnagagtgggagggacctggggagttgtgtttcagaggaggttgagtgccatgagttatggccagggaggacagaaagttgcttgcagggcccgcccctcgcgcctgcgctgcgccccacctgcgagtacagctttcttcaccccctgctctccctcatcccaaacccatccaggcctgttgggcgacggcgtgcagtaccttctagacatggcgagaaagagggtgatgcagcccggcgcgatcacggtccccgccgccgccacggtgtactgcattggcatcgaggcctgcattgcctctgcgggcggcttcgatgtctcgctcatcaacaagtacnnnnnnnnnngacacgcagttggcagccactgtctgcaatcggaaagggtgaagatagtcagggtgggtacttnnnnnnnnnntcgacggcgagaagaggggccgtgtcaggtacgcacacgcttttaggggcctttttgagaaggggggttcccaagctggagatgaggaattcaggaggtgcagctccttcagagagcctctcgaggacatgcagtaggattgaaattcgccaactgcgtataattcaacacgtgcgtcccacccgctttgaccaactgcgtannnnnnnnnnccggaattgccccatcggtgtgccatgcctctcacatgatacgtccctctaccnnnnnnnnnntcgacggcgagaagaggggccgtgtcaggaggtgcagctccttcagagagcctctcgaggatatgcaggaggattgaaattcgccaactgcctactattcaacacggacacgatgttgaagcttgaggtcgtcgcccctgggaacatgaatgccatcgtctactggtttgatcttcacctggatgatgtggagactctctcgaacggtgtgtttgtggtgctttgccatggtactttgtgggtccccacacctgggaaagagcacctggtgtgcacacgactcaacacaaccttgccctcaccctcctcttttacagcgcctcctggtgtacttgataaggcaggttcagagtcggtccagcccacagagccgcgatcaggagaggaccagcctccttcggactttgagcctgcgccgaccttccaaggacgtcgcccaggctggatctatggcactgccaaaatgggaacgggctactatcgcgagcgggattctgttgccacaacagaggagcgggatgatggaggtgcagcaagcagctcccaggctgctgcccccgccgagtcccgggcctgcgccgaggcggcgccaaaggacgcagccgctgaccctgaggcctcggccgccgagccccctcactactggggccaggccatgcagaccctggacttttgcgtggccgtgaggcccggcaagaccgtgagcgtggtggtcaggcgcgagcccagcaggctcaactttgcgctgaggcagggcgtgggggaggaggtcgcgcggccgccctggaaggagcagtgggggggcggcgcgtccgtggagaacccgcacgtccagcgtgtgcactactgcgaactcctgtggcttgacagagattcctgccgtactcgagcttgccactctggccatctgctggtgcggagggttgccttttctgacctccactccgcccttgggaggtgtggtgttgctctactttgtgattgcccaaccctaccaccatgccccccccctccccccctcccccccaacaaggtgcgcgacttcctgatgcgcgtcaagtcgcgccgcttccctcccatcgaggaagacatgcgcatggtgctggcgcattgtgggtccctgattctggacaccgcagccctgcagcaggtgcccgggggaatgggtgacgaggggaatgggagggcaacctgccgggacaagggtcggagatgccgtcaaacagcagaactaaaattacatggagtcacaggtttaccacgagctcgtggtgctggagaagatcaaccagaccccagagttctcgccgggggccactctggaggccatcacgaggcctgccctggagttgggctgagcgcgcctgtaagtaaatgggcgcactgtttacagccagacatcgcagcgatatggtacacaacactttcggcgcgcacaaggattcgacgctcgacttccaggccgaactcattcgggcatgcctgctcacacgctcagctggtgggcgtggcacagagtcccctggcagccatgagcatcacgagcttgtctgcagccaggcacgccgagcgcagggcggcnnnnnnnnnnctcgccgggggccactctggaggccatcaccaggcctgccctggagttgggctgaggtgggcatatttgaagcgctcctga

SEQ ID NO: 4430 - DNA, 621 bp, Chlorella protothecoides
  modified_base (555)..(564): a, c, t, g, unknown or other
atgcgcttcgacgtggaggacgcggcgtacgcggcgaccgcgcggcgcgacgccgccttccccccgcgccacctggctatgctggcagacgggggtaagtacgaggcgtacgcccgcgcgctgcgccgcgcggcggcgcgcctggctgcaagggacggcgaggtgcatgcgctggacgcggggacaggggcgggcgcgctcgcgatcctggcggcgaaggtgggggccacctccgtggtggcggtggacctgcacgagcccctggcggacctggcacgccaggcatggcacaccgatggggcaattccggggggtatggctgggctcattcaatctcctcctggtggggtgtgcgcagcctgcgcatccgcaccgagcacccaccctgaccatcttcacgctttccaattgcagacagtggctgccaactgcgtgtcggaccgggtgtcggtggtgcagcgcgacatcgcctgcctgcaacgagggcgggacgtgcgggcgctgggggtcaacctggtggtcgccgacctcttcgatgccggtgggcaggggggnnnnnnnnnnacgagggcgggacgtgcgggcgctgggggtgaacctggtggtcgccgacctctttga

SEQ ID NO: 4431 - DNA, 2010 bp, Chlorella protothecoides
  modified_base (476)..(485): a, c, t, g, unknown or other
  modified_base (1350)..(1359): a, c, t, g, unknown or other
atgggagtgcaaataccctccaacatgccccatcccgagcacagccgtgatgttgctgtcaaggctgagtcgggctgggccggtgatggcgagcccacttttgaaaacgaggagcaggaattgtcaaccccggtcacaccatcttcgacatgctccccgccccaggtacgccgggcgatccttgctgcccaagctcaggctgctgcggatccgctgatcatgtcattgaagctgcaggatatcaattctcgagctgctgcggcgcgcaaagctggagaaaccccacgcgccctggggatctggctggcactctttgccaaggcccgtgccggcaacctgacccacccagagatgcacacggtgcatgggaatgcatcgggtgctgcactagatctggagctctgggacctggccctggagcacgccaggcgtggtaggagtctggccgaggcctcccttcgcaggtttggttggtnnnnnnnnnngttctggagagcggggtcaagccagcgcactaacgctgacatctcgcagcccagggcccccggctcaccgcccgagcatcacgatttctcggccaagagacgcgcactggagccccccagataccttcgccccacgccttgcaggaatggaaaggcgtccgacgcctacatcaggtcctttgctcgggaggggcgagcactgctgggtctgggacggagcagggaagcggtgacggccttcgaggccggcctgagggctgaccccctcgacccagggctgagggccggcctgcagagcgcccagcagcgcctggcagaggaggccctggctggtgtgtgcgctgggggttgtgcgggacctggcttgcacgttttgaggttgggccctttgtatttctcgggtgggtatccggatctgatcagggtctgcaatgctccagagcatcttcacatttgggggtctgcaatgcccctgagcacctccacatttggggtacctctgcgttcccagggccacagtcgagttctacaagacataccagccaccaatctgcctcgcgctcatccaacccaaaccctcaccgcaggcgggggccaggttctcaaagccctgacctacccagagcccaagcagcgcatcgcctaccacccggcctccgcgccgctgcaccgcatcaagacggacgacatgctccctctgcgcctgctcacccccttccaggccgagaacgaccacgccatcaaggacaccgtcaactacgtgacagtccaggtggaaagggtgaaagaggggcttgcgtggggaagacccacagcgtcctgcactggtgaagcttcatgcaggggtgctcatcacgcgaccccnnnnnnnnnnggtgtgtcgccgggtggcccccctcacgccggtctggtgggggcaaggcgtggcgctggcacctcctccgagaaccacagcgttctgcactggtggagcttcatgcaggggtgctcatcacgcaaccctcccatgcatgcaccacagacagacatccgcatgccgaggaggcacatcaagctgctggaggactcgtactgcctgtcccgcctccaggccggcgtccggtcggcggtggaggccatctccgccggcggcgagcgcgacgtccgcgtgattgacctggcggcgggcgccggggtcctggcggccaccgccctcgccgccggcgcccgccacgtgacggccgtggagcgatggctctacctggcgctcaccgccaaggagatcctggacgccaatggggtgagtcgaggttttgggggggcgccccacctacaaaacggtgcacctgccagtctcgcacagcctgggctcctccccccgcatgcgtcgatgtgcatgtggccgtcccagccatcccaccgcacggcgcctgcagttccacgaggaccgagtgagagtggtgtacaagcggccgacggacctgcagctggtcaaggatgtgcccgtctgcgcaaacctgatcctggcccccctcctgctggatga

SEQ ID NO: 4432 - DNA, 1251 bp, Chlorella protothecoides
  modified_base (981)..(990): a, c, t, g, unknown or other
atggtgggctggaaagcgcggagcaacacgctgttcagcaggtgtgtgagggcgtgtgtggtggcgtggtgcttgggctggggcgggcgaggaggcgaactcaagatcgatggtccccctttccctgcacgcagggggcactggggcgtggggccacggcgcagcctcatgccggccctggcagcgctggcagggaacaagactgacctggagactctgggcgtggcagtggacgtgggggacacaaagttcgtggcgacatccggcaaccagtttcagtgggtggacgcctggtgcaacaacaagtatctcctgcacacggcgggcttcagctactctgcaggtggggagccggcgggtgtgagtttggttgtggagggcgcggtgcgcaggggagtacactcgccacaccgccactcggctgtctcccatgtcacaccctgcatcctgcaccatgcgagtgagcctgggccatgtcgagccccctcctcttcccttctgatcctctctcaccctgaatcccaagccccaacacgccatcccccgtttccccccgtgccagcgctaaagtaccggctggcgtgtgaatcgctggtgttcaaggtgcagtccaagtgggtggagttttacgagccgggactgctgccgggggtccactacgtggccctgcccccctacgagcacgagggcggcgacgcggaaaagtacatcaaggagatggggattgatccagaagctccaggcactaaactgcacagtgcaaggcatgaccaagctccagccgtgggcgctgcaagacatcgaaaggcagtgcaggagagtgaaggcaaggcagaagctcctgcagtcgcaaaggcggggaaagaatggatcctcaagaatctgcaagaggaggtgtgggggtggtgtccggatggcatgcgtcgcaggggtgtgggtcatgttgcacatggagggaccaagattttgacatccaccaannnnnnnnnncctcaagaatctgcaagaggaggtgtggggttggtgtccgggtggcgtgcgtcgcaggggtgtgggtcatgttgcacttggagggaccaagattttgacatccaccagggcttgagagattgtcagcttctcagcgccagtctgtatcatcatttcgtcgagcaactgcctgctctcccacatcgcagggcctctcatgttactggttccaggccatcaagcgatactcggagttatactttcacgagttccctgacatag

SEQ ID NO: 4433 - DNA, 369 bp, Chlorella protothecoides
atgccttcactcggcgtggcgcgagcgagctcaggcggcctggcgacgcgcaaacccctgctctgcagcccggcacatgggccgatgcggccaggcttccttgccccgcccgcccggcgaccacgactccttgcacctccaccccctgcagcgctcaagtaccgcctggcctgcggggcgctggtcttcaaggtgccctccaaatgggtggagttctacgagccggggctggaggccggggtgcactacgtggagctgccgccctacgagcatgagggcggggatgcaaagcgctatgtgcaggaagcgggtggggcggagagcgggtggggagatgagggtgtgcatgtagtggcatggggccattga

SEQ ID NO: 4434 - DNA, 240 bp, Chlorella protothecoides
atgccgctcctgtacctgtatagtgccgacgaccccctgaccgacgccaccaagctggacgcgctgctggcgcagaagcgggcgctgggccacgacgtgaccgccaggcgctgggcctcctccccccatgtcatgcatttcaaaaatcatccggaggagtacctagcacggctgtcggccttcctgcaaagagtggcgccggcccgcggaggcaccgtacgcatcgtcgcccgcctttga

SEQ ID NO: 4435 - DNA, 1005 bp, Chlorella protothecoides
atgaacaacttcccgaccctgaccctccctcccaaaccccacagcgccctggaccggctgcagccgcgcgcagtgagccacgaggagcagatcactgccctgcgggagcagctggcgctggtgtacgagcgacgcgagctttggtcccaggccgcccaggccctggctggcatcgacctggacagcggcgtgcgcctgctggacggcgagtaccggctggagaagaatgtgaggatagcgcggctgtatctagaggacgacgacccagtggcggcggagacctacatcaaaaaggcctcatccctcgtggcggccatcaaggtgagacgatggggggtgcgggtgtgggggcgtgggcatgctggtcggagttcatactcgtcacagtccctgctgggctccatacgtcggacccctcctgatcccacctccatacagaacgaggcgctggagctgcagtaccgcacctgctacgcccgcatcctggactccaagcgccgcttcctggaggccggcacccgctactacgagctgtcgctggcgggcgggggcggcccctcgcgaccccggaatgaggctctggagctgcagtaccgcacctgctatgcccgcatcctggactccaagcgtcgcttcctggaggccggcacccgctactatgagctgtcgctggcgggagcgggcggcccctcgcgaccccgggtcagcgaagaggacctgggccaggccctgtccgccgccatcacctgcgccatcctggcagcggcgggcagccagcgcagccgcctgctggccacgctgatcaaggacgagcgcaccgtgccctcacccctgcgccccatcttggagaaggtctacatggagcggatcctgggcgccgaggaggtagtgtatatcttgaggggagagtggatgagtgggtggagctgggtgtgtttcagcgcggcgaggggcgagtctaatctgcctgctgaggacacctacatgcagggtagggctacttga

SEQ ID NO: 4436 - DNA, 2505 bp, Chlorella protothecoides
  modified_base (928)..(937): a, c, t, g, unknown or other
  modified_base (1480)..(1489): a, c, t, g, unknown or other
  modified_base (1853)..(1862): a, c, t, g, unknown or other
  modified_base (2154)..(2163): a, c, t, g, unknown or other
atgatggtggggacggtgggagggggaaagagtctgtgcctgcgaggtgctggggtcgcctggacacgcagcgcccatccagaggcgtcacatccgcgtcatccaccccccctcgcagggacgctgacgcccatcgtgtccaaccccgaagcggcgaccatgtcggagtcgacccgtggcgtcgtgcggcggctggctgagctgttcccctctgccatcgtgtcggggcgcagccgactgaaggtccagtcctttgtccagctggcagagctcttctacgctggcagccacggcatggacatcacaggacccgcgccaggggccacggcgggggcggcgacctgggaggaccaggtcgccttccagcccgccgccgcttttcagcccgtcatggccacgctctgcgaagagctggaggagggtgagttcaaggggaaaagggggcaggagcaggccaggaggaggcgacaccatgaaatgggtgcaggcagggcagctccccccgtgccgcgcagccgtgagaccctttcccggggctgtggtggagaacaacaccttctgcctcagcgtgcacttccgcaactgcgatgcccactcctttccgccaatcctgggcctggtggaggcggcggtggcctcccgctccgaccagctgcgcatgacccggggccgcaaggtcctcgaaatcaggccaaaggtgggggcaccggtggcgaggcacggggtgggtgggcgtctttggccctttcaagtcgggaggggcatggctcttcatccctggggcctgcccgtatcagcatcccatgcccagccagtgcccaccccggatcgacagcagcggtctgtgccttactacacacattcatgtgtgtgcaccttgactccaccaccgcacacccattgctcatgcagttggagtgggacaagnnnnnnnnnnccaccggtggcgaggcacagagtgcgtgggcgtctttggccctccaaagttgggaggggcatggcccttcatccctggggcccgcccatatcagcatcccatgcccagccagtgcccaccccgcatcgacagcagcggtgggtgccttcctacacacatccatgtatgtgccccttgaatccaccgccgcacatccattgctcatgcagttggagtgggacaagggcacggcgctgattcacctccttggatgcatggaccttgccgatgcggagcaggtctttgccctgtacatcggcgacgaccgcaccgacgaggacgcgttcaagggtaagctcgcatgggagggggaggaagggggcccctggacattgcgggagccgaccttcaaccgtgggccgcccctcagagtgccatttgggcaccaggtcttggctccagctgccacactcatgaggacgagctggcacagcaccggaaccccttgcccgcctgggcagaaacctgtggttgcgactcccagcctgcaggacgcgcagcttnnnnnnnnnntcgcaccgacgaggacgcgttcaagggtgagctggcatgggaggggggggaaggggggccctggacattgcgggagccaaccctcacccgtgggccgcccctcggagtgccatttgggcatcaggtccctgccccagctgccacactcatgtggacgagctggcacagcaccggaacccttgcctgcctgggcagaaacctgcggtcgcgactcccagcctgcaggacgcgcagcttcctttgatcccgcctcaaactcccaccccctcctgcgcagtgctcgcggagcgcggcctgggctgcggcatcctgctggtgacgtgggggcggagcggcgccaacgcgtggcagtccaagcgctccnnnnnnnnnnctcggatgtggtggccttcctcgagaagctggtgacgtgggggcggagtggcgccaacgcgtggcagtccaagcgctcctgcaagggatggcacatcgccgcccggcccactgccgccgccgccacgcctggcctcccaccccgcacgcccacggcaccgacgcccgtggcgcggacgcccacgcaggggcatgcagcgctcaggagccctgctgctgtgttgggctgctgcctgcttgagcttgggcgagttggctttcgggatcctgcagcgccgcctcatgccgcctcnnnnnnnnnncggacatctctcctcccttcctctcatcatgctccagctctgtgtgctctaacagcagagcggtacgtccccatgttctcatctatacctgcagtcccctctgcagacctctctccctggcatgcagcgctcaggagccctgcggctgtgttgggctgctgcctggttgagcttgggcgagttggctttctggatcctgcagcgccgcctcatgccgcctcctctatgctgtccaaccgactgcgttgcgtgcaaggggccgggggagtggtggggctggagcatgtcccccaggcactcatgccctgcatgaatcctttgccgggagggccagtggcctga

SEQ ID NO: 4437 - DNA, 759 bp, Chlorella protothecoides
  modified_base (40)..(49): a, c, t, g, unknown or other
  modified_base (163)..(172): a, c, t, g, unknown or other
atgcccaccccaaacccacccataacccacccacacgcgnnnnnnnnnnctctcgatcctggcaggggggagggcaggaggcgtgggccaaaacatgcggacacgaggcaggggcctcccgcttcacaagcgccggtgcaggtcgacctcgatgtgagcacannnnnnnnnnattgggtggggcgaggctcgcagacctctcgaccagcggttgtgtcgtggttctgtggtctgggcgcagtggttggctccggccgcccacgtcgctctggccacgtgcagaccagcaggcaggcgctgaccaggacagcggggtggagccgtgaaatccggcgcgccattcatacccccgccctatccccacccatgccccacccataccccatccacacgcacagggacttgtggctggagtgtgcgcgccgcgctttctcggggctggacaccgacaaggatgggcgcgtggacgccgatgcgctgctgagcgtgctgcgctccaagctgccggcggccgaggtggactacgccgtggagcacgcgatggtggaggccgggcacgctggtgcgtgcgctcgctttgggcgtggagttgaggaagacgggttgagctgcggaagcatgtggcggggcctgcgcgcaggcgctctcgatcctggcaggggggagggcaggaagcgtgggccaaaacatgcggacacaaggcaggggcctcctgcgtcaccagcgccggtgcaggtcgacctcgatgcgagcacgtga

SEQ ID NO: 4438 - DNA, 1131 bp, Chlorella protothecoides
  modified_base (160)..(169): a, c, t, g, unknown or other
  modified_base (556)..(565): a, c, t, g, unknown or other
atgccgacaccagtttatgcatcaacaagtgctcctaaagagaagggtaatgttttctaccacccggaacctacatgtgggttttgcgcgctctacatcatgggccttcatgctgtacattgggcacacagccgtctgccgggatccattgcgcctccgnnnnnnnnnntgcgcgccacatcatgggccttcatgctgtacatcgggcacatagccgtctgccgggatccattgcgcctccgacacctgcatgaaggaggcatagccgccgagaggacagctgtgatgacagtgggtgtgcatgggtatcacaccaccttccaagatccacatggggtgcgtcgggacttctcgcgagcccccagaccctcatgcagaccatcttgtcgcacatggaagcctcgggtgtatgcccttgcgaaagggaaggcggacagctcgaagaaggcgagtatttgcccggcatcattacgaaggtcaactgcgagcgggcacttgacgggctctggatcttcatgcctccacggcacatgcagtccgcttagcagctccctgnnnnnnnnnntgggatctggatcgtcatgcctccatggcacatgcagtccgcttagcagctccctgctgaacgcgcaggaggatgaacgcggtgcgcctcacgacaagccacatcagggtggcctgactgccagcctgctgttcaatgttcccattcaccaacgcacaggccgcctcctggagggctcagcggggccagactcattgcatcacatgtcagggaaagggccaggtgcaatgcccccagtgcaaggtatggtgcaatgggtggggctgggagtcaccctgcaatggggcatgtgtctggatgccacggagcacgtcctcatccagcaccacctcagcgttccgcctttccctgtgcagggcacgggggtgggacctcgttcacggcaacccaccaaccccattcagcatgctgccaacaagatctccagcctggtgtccggaggcaaggccgatgacgtggagtggcgcaccagcaaccgctgctcgcgctgtcagggtaggggcgtgtgccgatgcgaagagtgtggcgggacggggcgaagagggccctcagaggaagaatcctga

SEQ ID NO: 4439 - DNA, 423 bp, Chlorella protothecoides
atgtgtgtgcaggagatcatttcgtcacagcaatggcatcgggccgtagcggggtacgctcggcatggataccactccaaccctgtccagttaccccttgcaggctcgcagcacggcaagaccaaggcgctggagtacctgcacacccacccccgctccgaggaggagattggcgagcagcgcaaggcggcccgtctcgcgctggacacctcgacccacggcggcagcgactacgaccgcctgctgcggcggctggaggaggagagcaagcggcctgacaaggtgggctcagagtgtgggagtgagtgggaaaacagcttccctgcagagtgccagcctcgtcgcatccttgaacaacagggtagggaagggcaagcggcagtttttgacagcgctcgctcgcgacgcaagggcgcgtcctag

SEQ ID NO: 4440 - DNA, 300 bp, Chlorella protothecoides
atgagggtcgatatctgggacgtcaaacccaaagaggacctcgaggccctcgacgctgggctcccaaagaactttgattccctgtttgaactcggggcgacccttggaaaagggggattcggcctcgtgaggtactggggcggctgggggcctgccctgctcctcctccacccgctctcacccctggcgtcgagcgcgacacccccacaacagcaaccgatgcctggcgatgatgcagggtggccaccgagaaggcaactggtcaggagtatgcttgcaagagcgtgtgcaagcggttga

SEQ ID NO: 4441 - DNA, 888 bp, Chlorella protothecoides
atgcgtggctcgcgcagcaccagcagcctggcctcgctgcacaagcaggagaggaaggagcgccagaagcggcccgcccccaccgacccgccggccgcggcagggcctgggagccctgcggggcggcggggcgcgcccggggtgccggtgtggccgggcagcgcgggggcgtccctgccggcctccatcccggaggagccggagtccgagcagggcgggcggcggcgtgggggctctgcggccctggccgctctgggtaggcccagcccccccgcccgcccgcagggcgggggcgaggaggatgtgggccacgcccggcgcgtgaccttcaatgcggagctgcccagctaccacgcgggcggcgaggccgggccgggggcgggcgaccgccgtgcggggtcctcggagtccgacgcggcgccggctccggagtctggtgcagcggcccctggccccgctgcgagcgcaagccccgtttcatcgtggccggcgggcacgcagagcccaggcgctgcgccgccagcctcggtggacccgggcgcggtgacggtgaccacgccggcggagctgtcgcgcctgatgcgtaagatgcggttccgccctggcgaggcgctgtcggcggaggcgctgtgcgaggcgctgcaccgcctgggctacgacctggagccctcagaggtgagcatgcttctgcgcgagctggaccgcgacgccgacggcgccatccacccctccgagttcgtggcaagtcagctggactggggcgccatgcagcaatccaacaggtatgggggactttgttccttttggggggggagcgcggtgcacattgggtggggcgaggctcgcagacctctcaaccagcgggtgtgtggtggtcctgtggtgtga

SEQ ID NO: 4442 - DNA, 738 bp, Chlorella protothecoides
atgaagagccatgcccctcccgacttgaaagggccaaagacgcccacccaccccgtgcctcgccaccggtgcccccacctttggcctgatttcgaggaccttgcggccccgggtcatgcgcagctggtcggagcgggaggccaccgccgcctccaccaggcccaggattggcggaaaggagtgggcatcgcagttgcggaagtgcacgctgaggcagaaggtgttgttctccaccacagccccgggaaagggtctcacggctgcgcggcacggggggagctgggtgacgaggacgccaagcgcagccctccatcccttcccggcgagacctgccctgcctgcacccatttcatggtgtcgcctcctcctggcctgctcctgcccccttttccccttgaactcaccctcctccagctcttcgcagagcgtggccatgacgggctgaaaagcggcggcgggctggaaggcgacctggtcctcccaggtcgccgcccccgccgtggcccctggcgcgggtcctgtgatgtccatgccgtggctgccagcgtagaagagctctgccagctggacaaaggactggaccttcagtcggctgcgccccgacacgatggcagaggggaacagctcagccagccgccgcacgacgccacgggtcgactccgacatggtcgccgcttcggggttggacacgatgggcgtcagcgtccctgcgagggggggtggatgacgcggatgtga

SEQ ID NO: 4443 - DNA, 2610 bp, Chlorella protothecoides
atgggagctgcatgcatccgccaatctggcaaagacaccgtgaacatggctgctcgaatcttctggagacgggagggatctacctgccacacagacctggaacagcccgcacgcccttcccccagccatcgttgtttctcctccgacataatgacatggactggaggcgagaatgaggcctggcgaagtgcatgtgcctttgtcttgggcactgggtgggacgacgtcgaccccttggagcacatcagtaataagacacacttgggaatatcctccattccctcccgggcttgcaccggctgcacagcttattccagagagatatcgctgacgcaatcggttgccccaatggcaaaccgttgcgaagggagggggggagaaggaggaatatgcaggggcaggggctcaccaaaggctgttggacgagcctttgttcgtgcaccgcttcgtgtcccacaactctgtccgctcctccacgtcgttgcagacctgcttgtgctggtggtcatgcaagatagtgtgacagccgcagcacagtttggaagtccagtacttttcaaccaccaccaccctgcacacccgccacaggcgccgcaaaaatcgtatccagggccccggcgggccccccgcatgatgccccccgaagaccatgagtacccacttccagacagtctgagtgggcatagaattgggatcgtcgtggccagaaaactcggaagtagagaaaggtgtgaccaccactttatcgcacaggacaggactcgattggaccactgcgctcggtcaattcattggcggtgtttcggaattttcgctcatcctttctaccgagtgcacagacacatgatctccctcatactcacttggtttctctcatacagcgggcagaacaaattcgctctgaggtcattgctggggcgggaagcgcaaaaattgagaataatcatgtcccagtttagcttgatggacaatgcaatgtcgtcacaagagagctcccctgcccgggagaggcagcgacctctggcctccccatctaggtccagctattcggccgccctcaggcaaaaatcatgctcagaacgcattataatgccttcaatacttgtggtgttgatatttggggtcgtggcgcttatgttcggccccgttgtgggcacgctgcgaaccgggaggtatcagccagcagcatcggcacccctgacaggtacagcgctcgccagcgcagagcctgctgatgccatcgagacgcgggagtttcatgccccatcgcacagtgacagaattgaaggagtacctgctgtcgttgaccgtttggtatctaattcacctgagtgcagatgccttgggctgtctctcgcaagcatcctctcaaccatctcctccatttggcacaatagggatttggtggagccgctggcggacgacgggcacatagcagtaacttttgcaaatcacaatcaccttgatttcgccacaaattgggcgtatcacatcaggaagactgggtgcacctcgtacattgtgggggccatggacgagaagattctgaaggagctcgtcaagctgaacatccctacattctacatggcttccaacctcaccaccaatgattttggtagattcaccaaggagtttatagaaatggtgggtagtgaggagggcctctggcttgggcgtgcagggtttatgccgtggcctgtggtagccatggctgtcccagcctgttttacccaagcttgggcctgccgacagccctggcggtctttccctggtcaggcatctgcaatctgtgtgaataaaccgcctggtgaattctgcagtaactcacgcatgctgctcaggttgtacaaaggcggttctagcgtgtccttcagccatcgactccattaccccatatccctcagggtcgcaagaaagcagccatggtgcagagttttttggacctcggcttcagcacactcgtatctgacgtggatgcggtgtggttgcgcaaccctttccctttcttcagaaaggtgcgaggtgaccagcaggttcacggatgcagacatgcttgtctccagcgacctcatccagaccactagcatcgctgaggggctagaggatctctcgggagctcgtcatggcctcaacattggtgtgatgttcctccgtcccagggcactctctttggtccaggtaagggaagagtgggtgcttggagagcaagccgtcgcctggagtaaacgccttgtgaattcctggaacactcctcacaatgtgcctcacccataccaccaggaatggattgcaaacatgaggagcgatcccaaggggtgggatcaggcggagctcactcacctattccgcagcaacctcaccgtggcgcccaaccgctcggatggtctgctgagtatctacaatgggaagctgctgggcggtgccctgcccacctccctcttctgctctggccagagctacaaggagggaacgagctgggagggggggctgcgcccatactccttccatgcatctgggattgcctccgcgaccagtggaaaacggtcccgcctgcgagagtggggattctggcatgtgagtgcttggttgaagggtgaatatgcagggtga

SEQ ID NO: 4444 - DNA, 684 bp, Chlorella protothecoides
atggtggagccgctggcggacagtggcaacattgcggtaacattcgtgaactacaaccacctggattttgctaagaactgggcgtatcacatggagaagacaggttgtaccgcttacatcatgggggccatggatgaggaaacactcaaggagctcgtcaagctgaacattcctacattctacatggcttccaacctcaccacgaatgactttggcagattcacaaaggactttctggatatgggtcgcaagaaagcagcaatggtggagagcttcctcgcccttggcttcgacaccctggtatctgatgtcgatgcgggccgcagggtcttccactgcgcccctgtcatgtgtcgccaacagtgtcaggagccccttcctccccacgtgccttgcagtatcttcaatgggaaactcgtgggcggggtcttgcccaactccctcttctgcaacggcaacagctacatggaggagacgagctgggatggaggcctgcgcccgtactccattcatgccagtgggattcactctgcaaccagcggaaagcgctcccgcctgcgagagtggggattctggcacgacgagcctgagcgcttcacgcatccagtcgggttcctgagctacgacaatcatgtgcccctggagctgctcaaggaagttcgagacgtaagttggcagggatga

SEQ ID NO: 4445 - DNA, 423 bp, Chlorella protothecoides
atgaacgcccttcgtctccacacgcctccacagttcaataaccgctcctggaccgtgccgggggtgctcccccacttcaagctcgtcaacgcgcagctgtctcagctccgtgtggccctcgtggccgccaaggaactgggaggggcggcggctgtgctgccgcacctgtggtttggcaaagagttcaatgcctggccaggttttgggtacttgcacgagccaagactcaagaagccttttgccgcccctgcagactataccatggacctcgtaaggatggaccatgagatccccaacgagtatcgggagttctcattcctgggtaagcctgaggcgacatccctgctggctgcgagggttgtcgtcacgatctgccaggtggggtacatgtggggacaggacagatggccgatgcgggcatag

SEQ ID NO: 4446 - DNA, 780 bp, Chlorella protothecoides
atgcacccagagacaccccccctgcccccgaaatctcccctgcccccctctcccccctacacacacacgctcgcaatcagggcgtcgctggagcagctggtgctgacgcccagcaagcagctggactgggaacgactggagaacctggtggagaacggtagccgggccgcggagtttgaccccggccaggtctggctgctggccgattgggtctgctcgcccgccggcacggggctgcgcgccagcctgaccgcggaggtcacagccctgctggacgcggtggcggcacgcgcagcgcgcgccgacttggcggcccgcctgcgcaatccgggtctggcggcccgtctcgtgccagagggcaggggggaggccgccagcgccgcgcgcgctgagctgctgtggcgcctggcccgggagacctcgcacgccaccacctcccccctggctggcgtgtttggcacgctcgccgacctgcagggtgagaggcacgcgccctggcgcagcgctgaggcagctgcaggagctgctgctcaacgccccgcccgagctcaaggacggctttctgcgtcccgaggttcaagagatggtggcaggcgtgcagctggggctgatgcagcgggccgctgctcgggcggtgcaggtgctggcgtcgccctggggcaacaacgtcccggcaacgggcgagggcaggggggctcagcgcggattcttatagccgagtggtgccccagaccgtggcacctttgtgcctcgtctgggacactgaaagtcctgtgctga

SEQ ID NO: 4447 - DNA, 1944 bp, Chlorella protothecoides
  modified_base (125)..(134): a, c, t, g, unknown or other
  modified_base (667)..(676): a, c, t, g, unknown or other
  modified_base (1174)..(1183): a, c, t, g, unknown or other
  modified_base (1780)..(1789): a, c, t, g, unknown or other
atgttgcccctcatgcgctgcagagcagcaaaagcttgtggtgacgagcagcctggacaagtccctccgcctctggtccagcaatggaaacaccgactccctgtgctccggaggcttcaccaagnnnnnnnnnngagtctccactgcccacgagctcctccgctgtacgtctctcagggaaacactgactccctgtgctccggaggcttcaccaaggcagccgacctcaacccagagggtggcccaatcttcagcctgattgaggatgagcgctcattcgacggcctgaccaatcagatcttcctcggcaagcaggctcgccagatcgtggcctgggtgccgccgcgtctgagcctagacgacaaggtgtgcgggtccagtgttggggctcgtggatgtaatctggtgtgcttcagcgtcagagtcgagggaaagttcccaccgcaatcgaaatgttgccggcgtggcaccctgggcatggtctggagttcaatccacccgtctgcctcagtaggctgtgtgggcttttcccattgtgtgcttgctgccaattcccaggggccatgtgtgcactggttgtcgtgctgcgtcacgctcaacttcaccaaacctccgcaattcccccctttccaggtggtgcttggggaccacaagggctgggtgaggnnnnnnnnnnaactgattgtcgtgctgcgtcaccctcaacttcaccaaccctccacaattcccccctttccaggtagtgcttggggaccacaagggctgggtgagggcgctggccacctccaggacgcgctggctcttctccggctcctgcacccagctgcgggtgtgggacctgggccgcgccgtcccccgctgcgtggccaccgccagcgtcgaccgcggcgacatcgtgtgcctcgctgccaacggcgacgcggtgtatgccggcaccgccgacggctcaatttggtggggcacgaggaggtgtcactctttctgcaggggggagtggagggggacagagcacagcgaaggtgttctggcgtgtgggatgttttggtgtcattctctgaatgcagtggatcccacttgcaccactgcgaggtggaagtgggttcgacacacttccacaatccgacccccacacatccctcgactggcaggatgtggagcgtgggcaagaagggcnnnnnnnnnngatctggtggggcacgagggggtgtcaccctttctgcaggggggagtggagggggacagcgcacagcaaaggtgttttggcgtgtgggatgttttggtgtcattctctgggtgcagtggatcccacttgcaccagtgcgaggtggaggtgggttcgacacgcttccacaacccgacccccacacctccctcgaccggcaggatgtggagcgtgggcaagaagggcgagctcaagtgcctgaagacctggcgcggcgcgcacgccgatcgggtgactgccctcgtgctgcgaggggagacgctctactccgccagctacgacggcagcatcaaggcctggtctgcagagggcctggacctgctcatccccctggaggccgcgcactgcggccagcgcatcaactgcatgacggctgggccggacggcctcctgtacagcggcggcgacgacaaggtgtgcttgctcgtggggctgcggggaggggggggagcaccgtgtctggatgcgcgggtgcagcagaggggtgggcgagcagccccatgaggaaagccgggcgaggcgatcgactgcagaggggccacccaccttgtgtcaggnnnnnnnnnntttgctcgtggggctgcggggagtgggggaggaccgtgtctggatgcgcaggtccagcagaggggtgggcaagcagcccaatgtggaaagccaggcgaggagattggctgcagaggggccacccaccttgtgtcaggtccttggccaggctgtaa

SEQ ID NO: 4448 - DNA, 3168 bp, Chlorella protothecoides
  modified_base (1281)..(1303): a, c, t, g, unknown or other
  modified_base (1386)..(1395): a, c, t, g, unknown or other
atgccttctttcttcaaagcagagactatagacgtgacaattctacgccagcgcgggtgcggtgtggtttgggaagagcggggccgggggcgtcctgggatgggccagggggcgcctgcgccctcctggccgctggggcccgggctcccccttcggcccctcctccccgagcatgggtgctgctcgctcgtgcgcctcgggcgctcacttctcggcctgggacttgaggtttgcggccatggcgttaagcgcggagccgtgcttgaaccaggtgatctggttgtcgttgaaggtctggttgacggggaactcgtaggtagagccgtcggggcgcgtcccggccacggtcagctgcttgcccggggcaaaggtcttcaggccgcggatggagatcttgtcaaagggccccaccttgtcgtagtcggcagggtcggcaaaggtgaggggcagcaggccctgcttcttcaggttggtctcgtggatccgggcaaaggacttgaccagcaccgcggccgcgcccaggtggcgcggctccagggcggcgtgctcgcgcgacgacccctcgccgtagttctcgtcgcccaccacgacccagcgcacgcccgcggccttgtaggcgcgggccacgtccggcacgccgccgtactcgcccgtcagctggttcttcacgctgttcacctcgccgttctccgcgttcaccgcgccgatcagcatgttgttgctgatgttgtccaggtgcccgcggtacttgagccagggccccgccatggagatgtggtcggtggtgcacttgccgcgcgccttgatcagcaccaacgcgccctccacgtcctccccgtcccaggccttgaagggctccagcagctgcaggcggctggactgcgggtcaaccaccacctccacgttggacccggcgggggcctggtacgtctcctcccccgggtcgtagccgcgggggggcaggtcgtcgcccgtgggcggctccagcaggatctcctccccgttcttgcccaccaacgtgtccttctccgggttgaaggtcaggtcgcccgcgatggtgaaggcagtcacaatctcgggagacatgacaaaggcatgggtggcggggttgccgtcgttccgcgccgcaaagttgcggttgtaggaggtgacgatggtgttggctacgcccttggccacctccgtccgcttccactgcccaatgcaggggccgcaggcgttggcgagaacggtgccacccaccttgatggttttagggggggggggggggggggggggccnnnnnnnnnnnnnnnnnnnnnnnaggagttgatcagtacggaagggaggacagggaagcatgggtggggttcggattcggacccctcctctggagcacccctctannnnnnnnnngggggagaggagttgaccagtacggaagggaggacagggaagcagtggtggggttcgggttcggacccctcctctggagcacccctctacccctcccacacacatccccccccccctccaaaagccaccaacccctcgcaccttctcgaacacctcgatcaggccgtcgcgctcgatggtggcccggatctgctcggaacccggggtgatggtgaagggcaccttggccttcaggcccgccttgatggcctggcgcgcgatggacgcggcgcgctgcatgtcctcgtaggaggagttggtgcaggagccgatcagcccggcgctgatctcggtgggccagcccgcggcgcgcgcggcgtcacccagctcgctgatgccgtgggccaggtccggggtgaagggcccgttgacctgtggctccagcgtggacaggtcgatctcgatcacctgatcatactcggccccggagtcggccttcaggttgtcgcggaaggagtcggccaggtcggcgatctcgcgccggttggtggccaccaggaagtcgtactggcggctgttgaaggggaacatggaggtggtggccccgatctccgcgcccatgttgcagatggtggcctgcccggtgcaggacagcgcctccacgccggggccaaagtactccacgatggcccccgtcccgcccttgacggacaggatgcccgccaccctgcagatgacgtccttggggctggtccaggccgagggcttgccaaccagccgcaccccgatcaccttgggcgccttcagctcccagggcaggcccgccatgacatccaccgcgtcggcgccgcccacgccgatggccgccgcgcccaggccgccgccgttgggcgtgtgggagtcggtgccgatcatgaggcagccggggaaggcgtagttctccagaacgatctggtggatgatgccggagccgggcttccagaagccgatgccgtacttggacccggcggacgccaggaagtcgtacacctccttgttggtgatgttggcgtacttgaggtccgccacgccgccatacttgttctcgcgctcgctctggggagcagtggtcccctcgatcaggtggtcgcagtggatggtggagggcaccgccgtcttgggcaggcccgaggagatgaactggagcaccgccatctgggcggtggcgtcctgcatcgccacgcggtctggcggcaagggggggggggagggggaggtgagtctatgtgcatgatctccggtgcatcagtgtataatgctatgcacggggtgtcctgcgaccacttccctcagtgggcgcaggcgcaggtagctgacgccgcgctcgatctcctggctctcgggctcgtcaaggtgaccgtagaccactttctcggcaaaggtcaggggccggttcaggcggccgcgcacgatctggaggcagggggcgaagcacaagggtcaaaccctgtgggagagactcgcgagaaccctcggaccctcggtgccgcggccgcgagcaaccccaaatatgcagcgccgaggacctttaactcaccccaagcctcttctcgatggcgtcgtaacggtcgttcacgaactcgtcaggctcgacacggctcatgggcgcctgcggcgacggaggcagcaggttggaacgctacatcgaccgcaactatacaatacgaaagagcctatatttcaacgacgcacctttgtggacatgctggcgctcacggagaagcggccatacagcttgccggcccgagcctgtga

SEQ ID NO: 4449 - DNA, 315 bp, Chlorella protothecoides
atggagtccgtcctggtggggatgggcaccgactacgacccccagcgcctgtctgcatccttccgtgataggaggctgggcctcacctcccgatcgattgccgtcttctcaaagctcagcgtatttgcagccaaggtggctctggacgtagcacaaggaaagttcctggagcgggctgatgtcagagcccccgagctgcgcgacctcctcgcgagtctggggccggcgttcatcaaagtcgggcaggctctgtcatgtgaggctggggacctggtcacggaagggcaattgtcgacagactggtctcaggcctag

SEQ ID NO: 4450 - DNA, 603 bp, Chlorella protothecoides
atgccgcagggcgcgcgctatgctgtcatcgcgcacatcgtgcacctggtcaaccgcgactaccgcgccatgacgcgtgactactacgcgctggacttcatcgaccccagcatcgacaccagccccatcgcccccgcgctggccgccttcttcgacgacgtgctgaccgcctcggtgtcaagcctgaacttcaaggcgctggtggacgggctgggggaggtgctcttccgctaccccttccgcgtcccgccctactacgccctcatcctgcgctccctcactgtgctggagggccttgccctgtccagcgacccagactacaagctgctggctcaggcctacccctatgtcgcgcggcggcttttgactgaccctgcgcccgagctcaggtgctttgggggagtcatactggggaaggtgggggtggaggggaagaaaggaggggtagatggtgggaatgcggttctcatgtctgcacgacaggtgggagaatggcaggtgggcagcggtgtgcatgctcagggtgaggcagcggctgctgttcaccagtcaacggttgcgccatgcagtgatcactggccgccactggcatgcctgatgtga

SEQ ID NO: 4451 - DNA, 540 bp, Chlorella protothecoides
atgttcctgagcaaggatctcccctcccccactcgacattacattgttgttgcagcccgtcccgacctgctccccccggagtacctggcggccctggcgacgctgcaggaccggctcccgcccttcccctctgacactgccaggcagctcatagaggccgagctgggccggctcatctcccaggtgtacagcgagctcacgcccgagccagtggcagccgcgagcctcggacaggtgtacaggggtcgactgaggtccacgggcgaggaagtcgccgtgaaggtgcagcggccgggcatcctggagcagatcgcgcaggacatggtgctcctgcgccgcgtcatttcggcagtagacaagcagccctccaaattgtccctgttctcccagcccctgacgccgctggtggacgagtttgcggcccggctgttcggcgagctagattacatgcaggagggccggaatgctgagcgtttccaggccctctatggcaccatgccgcaggtgcccgagacggcgcaggcttgtggacggtcttga

SEQ ID NO: 4452 - DNA, 2043 bp, Chlorella protothecoides
atgcaggacgccaccgcccagatggcggtgctccagttcatctcctcgggcctgcccaagacggcggtgccctccaccatccactgcgaccacctgatcgaggggaccactgctccccagagcgagcgcgagaacaagtatggcggcgtggcggacctcaagtacgccaacatcaccaacaaggaggtgtacgacttcctggcgtccgccgggtccaagtacggcatcggcttctggaagcccggctccggcatcatccaccagatcgttctggagaactacgccttccccggctgcctcatgatcggcaccgactcccacacgcccaacggcggcggcctgggcgcggcggccatcggcgtgggcggcgccgacgcggtggatgtcatggcgggcctgccctgggagctgaaggcgcccaaggtgatcggggtgcggctggttggcaagccctcggcctggaccagccccaaggacgtcatctgcagggtggcgggcatcctgtccgtcaagggcgggacgggggccatcgtggagtactttggccccggcgtggaggcgctgtcctgcaccgggcaggccaccatctgcaacatgggcgcggagatcggggccaccacctccatgttccccttcaacagccgccagtacgacttcctggtggccaccaaccggcgcgagatcgccgacctggccgactccttccgcgacaacctgaaggccgactccggggccgagtatgatcaggtgatcgagatcgacctgtccacgctggagccacaggtcaacgggcccttcaccccggacctggcccacggcatcagcgagctgggtgacgccgcgcgcgccgcgggctggcccaccgagatcagcgccgggctgatcggctcctgcaccaactcctcctacgaggacatgcagcgcgccgcgtccatcgcgcgccaggccatcaaggcgggcctgaaggccaaggtgcccttcaccatcaccccgggttccgagcagatccgggccaccatcgagcgcgacggcctgatcgaggtgttcgagaagtggaagcggacggaggtggccaagggcgtagccaacaccatcgtcacctcctacaaccgcaactttgcggcgcggaacgacggcaaccccgccacccatgcctttgtcatgtctcccgagattgtgactgccttcaccatcgcgggcgacctgaccttcaacccggagaaggacacgttggtgggcaagaacggggaggagatcctgctggagccgcccacgggcgacgacctgcccccccgcggctacgacccgggggaggagacgtaccaggcccccgccgggtccaacgtggaggtggtggttgacccgcagtccagccgcctgcagctgctggagcccttcaaggcctgggacggggaggacgtggagggcgcgttggtgctgatcaaggcgcgcggcaagtgcaccaccgaccacatctccatggcggggccctggctcaagtaccgcgggcacctggacaacatcagcaacaacatgctgatcggcgcggtgaacgcggagaacggcgaggtgaacagcgtgaagaaccagctgacgggcgagtacggcggcgtgccggacgtggcccgcgcctacaaggccgcgggcgtgcgctgggtcgtggtgggcgacgagaactacggcgaggggtcgtcgcgcgagcacgccgccctggagccgcgccacctgggcgcggccgcggtgctggtcaagtcctttgcccggatccacgagaccaacctgaagaagcagggcctgctgcccctcacctttgccgaccctgccgactacgacaaggtggggccctttgacaagatctccatccgcggcctgaagacctttgccccgggcaagcagctgaccgtggccgggacgcgccccgacggctctacctacgagttccccgtcaaccagaccttcaacgacaaccagatcacctggttcaagcacggctccgcgcttaacgccatggccgcaaacctcaagtcccaggccgagaagtga

SEQ ID NO: 4453 - DNA, 861 bp, Chlorella protothecoides
atgcccgcacgcgcctccgccgcgttgccgtgcctgggcggcgagggcgaggcgctggtccgctccgagctgggcgacctggccaccatattcaaggtggcccccgtcaccggcaccgaggaccgcgtgttcaaccagctggcgcgcctgatcaaggcctacccggccctgcccctggtggcgggcggcgcgctgcgcctgcagccggtgtgggtccgcgacgtggcccaggcggtcttcaactcgatgcaggaggagggcgcggcggggaagacctacgcgctggcgggacctgaggtcctcaccctgtcccagctggccgacctgacctaccacaccatccgcgagccacacaatgtgctgcccgtgccggagagtgagtggggggacacatttattgatggacagggggagggcgccccaggtctgctctgcctggcctggtggtgccccggtgcagcagatacagcgggccgaaggcgacctgccatcgtgcactctggcactggtcagcgcgcggccgaccgggccgcaaacctcgagcggggatggccagcggaacagaatctggccgagctggcgtcccgcccgctgggctggctgggcaccaaaacgcccttccgcgccaaccccttcttctcctccgactccgtcgccgagctggcccgcggcgacttcacgctggccgccgccaccgccgaccagcccctgctgaccattgaggacctgggcgtggcgccgcgccgtgtcaccgagggccaccccatcgagttcctgcgctattaccgctccggcggctacgacatgggcgcggtggccgaggtggactctgcccccacgcccgcacgctgggagcggtga

SEQ ID NO: 4454 - DNA, 282 bp, Chlorella protothecoides
atggagtggatcgagggcgtgaagctgacggacaaggctgccatggctcggagtgggctgtcggtggtacagtttgtggacgtcggcatcgagtgctccctgcggcagttgctggagcatggtttcttccatgccgacccccacccaggtgactggctgttcagagggaggagcattgcaaatggttgcctcatctctgggtgtggtgtatgcttgcacgccttgcctcgctgtcatgcagcgcagccagtggtgggaaactgtgctgcgacagggtcttga

SEQ ID NO: 4455 - DNA, 321 bp, Chlorella protothecoides
atggcgagggccccccttcaccccctccccgggtcacacacgccctcctccccctttcctcccctccgcaaaggccacgcggcggcggtgctgggcagcacgtggtacatcgtgggcggcggcaacaacgccgccggctgcgccgacatgtacgcgctggacctgggggggctggggcggggcgagccgctggtgtggacgctggtcggcaacacgccgccttcctccgccatcgccagcgagggcctcaggtggggaggggattggggagggacggggggggaggagggggtgatgaccaggtggagagcgggtgtgtga

SEQ ID NO: 4456 - DNA, 216 bp, Chlorella protothecoides
atggcgggctgcctggtgtcttttggcggctacaacggaaagtaccacaactcggtgcacgtctaccgcccggagggctacgtcctggtgaaggcggcctcggcggaggcgcggggcgcggagcgcggcgcgctgccagcgggggagggtgcgtggctgctcggctgcgcgatgtgcccatggggctgccttgtgacacccgtggggatggcgtga

SEQ ID NO: 4457 - DNA, 312 bp, Chlorella protothecoides
gctgcgcttctttgtgcaattcatggcgcaacagtagaaaatactctatttgaagatggcgacggtgcaaacacatttctaactggtttatggactagtgcttttggtgtagtaggcttagcattaaatttacgtgcatacgatttcgtttcacaagaaattcgtgctgctgaagacccagaatttgaaactttttatacaaaaaatattcttttgaatgaaggtattcgtgcttggatggctgctcaagatcagcctcatgaaaaattagtattcccagaggaggttttaccacgtggaaacgctctttaa

SEQ ID NO: 4458 - DNA, 624 bp, Chlorella protothecoides
gctgggctctccacaccctcccgtccccggcccccgcccccctctcctaccatccgctccgtcatggctgccgccagtgccctcgtctcccctcccatggacggcatggtcactgtcacccagcgcggcttcgtggtcaaggcgggcggggccgccgcgccgcccgccctcaagtccacctcggccggctcgctggcggagccctcgctgctgagcctgggctcctttggccgccgcacggtcagccccctgctcaccccccccgcctccggctccctggagtcggcggcggcgggcggggacgcgggcgagctgcacctggcgcaatgcgccaagctgacccccggagccaagcgcctgatcaagggcgtagtgcgcgggctgagggcctggcaggagccggaggccgcggccgagggctttggcggcacctacttcttcagggacgaggacggcgcgcgctgcggcatcatgaagccctgcgacgaggagccactggcgcccaacaaccccaagggcttcgtcgggcgccagctgggcgacccgggactcaagcccaccgtgcgagtcggcgaggccgcgacacgcgaggggatttgggatgagggaagtgggacccggtga

SEQ ID NO: 4459 - DNA, 1731 bp, Chlorella protothecoides
  modified_base (820)..(829): a, c, t, g, unknown or other
  modified_base (1129)..(1138): a, c, t, g, unknown or other
atgttgcgctccgagcagtgtgcctctgctattgtccctcggttgcagcttctgatctctcccggtccggccgaagaagctgatctcgccatgggatctttgagtcgtcccatagtgtgccaggaacaccagcttcttccttggcgaaactcatcagacgattgtgccaggaacacccagcttcttccttggcgaagctcatcagacgatgtttgcagcacgcgtataggcattacagcacttcacagacacaattgcaggatgcggtgtgcccagatcgtccttcttctttgcgtcgcagccgcgacggtgcccggcggatggggcttcacccaccctgacgagtgtacgtgtggggggatctctgccatgctccgccctccggagtgccattttgaacccctccaaactcctcatgcccgtgtagatcaaagactgggacaagtacaagaccgcaggaccccactgggaggcggccctgtcgtcatggacagtgagtggcggtcgcgtagaggggggttgctgccgtgtgcagcaatgtggatgataatactacagcatcacgcacatctctcctcaccgtgccctcatagtgccccacaccggcgaacaacagcaaggggagcgactgcgatccctgtggagagggctggtgggggtatagcactgccatctcctcctccgcgtaaagaactgggagcacatatcctgtcgcagcaccaacaccctcttcctgatcctgcttggaacatcgataggctcacccaccggcctctcgtcccgttccccccaggggatgaccatgtgcccggggatgggnnnnnnnnnnggggcagtgatcctgcttggaacatcgatatgctcgcccaccgacctctcgtcccattccccccaggggacgaccatgtgcctggggatggttatgtgacgaacgtccacttctccctgactggggtggagggcaccccaccacgggagatctgcgactttgtgcatgtgaaggagtgggacttcaaggtctgcaacctggagggcaacctgcctacctaccttggcgggaacctctcctgcctcccggtgctcgaagagtgggacttttccaggaaccacatgactggggggtcacaannnnnnnnnnaccacatgactggtgcgttggcacggcttgcggcatggggaggagttttcaaggctggcgtagccttcacaaggcctgaccaagggggtcatacggcccatcccggagtccacaggcaccatcccacgcctggttcggctgaagatgcagggcaaccacctgacgggaagcatgccggagtcgatgggggacctcaaggccttggagtggatcaggatctttgttggtccatatgcttggagcctggcaacacagcctcccctatattcccccctccagacaatgagttggagggctcattcccggactcgtacaagaacgtcaatggtcgcatgacgcagctggccattggcggcaacaagtttgagggtgagttggatctgcagcatagacatggcatcgggtgtggaccctggaaagtgtggtgcatccgaggcgcccttgtcattgctgcccactccattagatgctcaagcgatcgtgggatgcgaggacgatctgtatcaccacagacatacgatgtcccaccctgtgtgcatcatggggtttcacgccatgctgtgctgacccactctgtccttctgtgctcttag

SEQ ID NO: 4460 - DNA, 1287 bp, Chlorella protothecoides
  modified_base (115)..(124): a, c, t, g, unknown or other
  modified_base (292)..(301): a, c, t, g, unknown or other
  modified_base (1084)..(1093): a, c, t, g, unknown or other
atgcactccgctgctgtgtcgcgcggcatgcgggtggcgatgcccagtgccgcctccgctctcaagatcgtgctgcttgccgcgctcctaggtgtctcatccgccgcggtggtcnnnnnnnnnngcgcgggccagctatacatgctcgaagcttgtaatgatttccagattaatgcagaattctccactcctcgatcaggtgtctcatccgccgcggtggtcgtcaacacccacaatggggagaccttcgcctacctaaaaccccaccagaccgtgccgccctcggccaagnnnnnnnnnntctgttccgatgcggaccctcgctccgacgataccctgctcgtcacgtacgactgctaccatcaggccctgtacggcaactgcaatgccacattcatgaaggactacctggaggagctcgtgcagaacgatggtgggaggggtgatttgaagacaggcctgcacattggaactgaaatggaggtaggggatggggatgggagaagctactgccagatcagctgtggccgctgcaaatgctgctctgccccctgggatgtcatccagaagacggggagcagccgtttcctacaggtttgcactacgtggatgggcataatgggaggttgcccgatgttccagagggcgcgtaatgcaagtccccaccatgtcatgcactggctgcaccctgcacatctgcgctgtgcatgctcgcagagtcatgaaaggggtgggttgtttcagcaaccctctgcaacccccgggctgctccttgcctttgacaatgcggtggccgcaaccaactcgtcgcttgaagccacgctgaagcgcccaggctacacaggcaccatcctggttcccagcgatgcggcgttcgaggcggcgctggccaagtacccaggcctgctgcaggacccggcggtgctgctgcaggtgctcaagttccacatcctgccccccgaaccgcgcacgcgcggcctgtggaccagccccttcatggcggtgggtggcacgatattctccctctacgacggcaccgccagcatcaagtcggccaagaccgcgctgcccgcgggcctgactnnnnnnnnnnctcttctccctctacgacggcgccgccagcatcaggtcagccaagaccgcgctgcccgcgggcctgactgcgcagggtggcgtgaccgggatcaagctgacggggcccgtcaacggcgcgaccgtggtgcagagcgacctgcgcgcctgcaagaccgtggtcaccacgctcgacagcctgctctggccctttga

SEQ ID NO: 4461 - DNA, 189 bp, Chlorella protothecoides
atgccaggcggggagaaggcctggctggaaggctggcgcgagcaggagggcctgggcctgctcagcctgatgtacgacaccatgcccgcccagtttgtgagcatggtgatcacggaggtgggggccatcccccctacctccgtccccgtcatcctccgcgagcagcgggccgacgggaacatggcgtga

SEQ ID NO: 4462 - DNA, 129 bp, Chlorella protothecoides
atgggactgatgtccgcctggcacgacgcaagccgcctgcagcctgagactgtggaccgataccgcttcccccagctgatcaggggatgggagacggggttctgcagattcctcgcagcgcgcttcgca

SEQ ID NO: 4463 - DNA, 723 bp, Chlorella protothecoides
atggtggtggccaagacaaactaccgcattgagtcatcgctggaagtgttttacaccggaggcccggcggccctgttccccgatggagaccgccttgcttgcgcatgcggcgacgaaaccaaggtgctggggtggcagggggtgtgtgcgtgcaggagcaagacatgcgtagatactcacgatgaatattttcaaccctggcagatcatcgacctggaaactggcgccgtgctccgctccctgcctggggtgggttgcgctttgggccaaggatcagggaccagggagcgcacccatgctctcgctgcgtgcatgctgagcacgctgcattcttcagactctgagcccgtgacagctctggccatcagccccgatggacgcaccatcttctccgccagccgcgccctgctcctccgcgcctggtctgcggagacgggcaaggtggtgcagacatatgtcgggcacaaggcccccgttgccggcatcgccgtggaccccacgggctccctcctggccaccgtctccgccgaccactccacgcggggcgtggttggggctgggttatttggcccagggcggccccccaaaccccaacaaactgcacggcccttaagatccgcctccgtgagcggagtcccagcccctcattcctccctcatgggggatgaaaggtggcggctgggatctgcgcatcactgcaatggagtgccgctcgagtcatag

SEQ ID NO: 4464 - DNA, 369 bp, Chlorella protothecoides
atgctgctcgtcaccgcgagcgatgacacggagatccgggtgtgggacctggtcgccaagtcttgcagaagagggcaacctattcctcgtgcccctcctgtccaccacccctcacgaaccctgctcgcccacaccgccgccgtccacgcagtcctcaaggggcacttctcggcggtgacctgcctgggcctgtctgccgacggctggaccctggtctccggctcccgcgacggcgtctgcatcgcctggaacctgcgctccggcgccaagctttccaccacccccgtgctggaggccgtggaggcgctggccgtgctggaccccgggtcggcgctggccgcgggcgccgcgcccgccgcccccgccgcc

SEQ ID NO: 4465 - DNA, 891 bp, Chlorella protothecoides
  modified_base (27)..(36): a, c, t, g, unknown or other
  modified_base (116)..(125): a, c, t, g, unknown or other
atggggtggagggggcaggtccatgannnnnnnnnnctgcccggctgggagggggacgcagggatgtctggactgggtcaggggaggtgtcccatgccgtgcatgttgggtcgcgnnnnnnnnnngcgatctgccccggcatgctctcatcccccctgccactccatccaacccaggtacaagccagagcccttcaagatcttcaccgagtcggtgatgaacctgaagtttgacgaggagccgatgtacgcggccctgatcagcctgttcgagccgctgctggggtcgccctcggccgcccgccccatccaggtggagaacgcggtgcgcgtggggcagaagcgtgggcgggagcagatggaggagttccgggacgacgcggtgcggcgcaagaaggtgcgcctcggctaccccgccagccagtggatcagcgtgtacaacaagcacgcgccgatgaagcagcggtaccactacaacgtctccaaccaccgcctggatgtgcacgtggccaagggctacgccgacggcctctacatctcctgcgtctgcgccgcgggcgagctgtgggccatcatcatggacgcggggaccgggtttggggaccaggtctaccgcgtggcccccgccgccttcctgcccaaggactggatcatggagcagtgggaccgggggtactacatcaccgccatcgccgggtccagcagcctcagctccctggtggtcatgagcaagggcaccaagttcacgcagcagtcgtacaagatctccgactccttcccctttgagtggatcaagaagaagtggagggaggctttccacgtcaccgccatggccacctccggctcccaggtgggtggctgtgaaggggaggaaagggcgtgtggaaggggg

SEQ ID NO: 4466 - DNA, 840 bp, Chlorella protothecoides
  modified_base (218)..(227): a, c, t, g, unknown or other
atggacctgctgggctctagcctgtgggacgtttggaaccaggaggggcagcagctcagcgcccagtttgtggcctgcgtggctgtggaggccatcaccatcctggaggccctccaccagaaagggcttgagactggaggccagaaccagggcgggcccacaggcaccttgcaggcctggcacccatgccttgaggtgcgccctgccagccgcctccnnnnnnnnnngggttttgaggtgctctggaccgatgagacttggcctgcaggcttgagactggaagccagaaccagagcgggctcacaggcaccttgtccaaagcgcgccgcgctcccgggctccctggagtctctgtatgctgcacttccagccgctcaccagccccaccccaccatcacgcccatgcagctttgtgcacggcgatgtgaagccagagaacttcctgatgggcccgcccggcacacccgagtccaaccggctgtacctagtggactttgggctggcgcagcgctggcgcgaccccaagacgcgcacccacgtcaagtacgaccagcgccccgacgacttccgcggcaccatccggtacgccagcgtgcacgcgcacctgggccgcacgcccagccggcgcgacgacctcgagtccctggcctacaccctgctcttcctgctcaacggccgcctgccctggcaggggttccagggcgagaacaagggcttcctggtggccaagaagaagatggccaccagcgccgaggcgctgtgcaggtgtgcatgtgcgggggggagagcgggagggagtgttcagggcatggtgatggggtggagggggcgggtctatga

SEQ ID NO: 4467 - DNA, 411 bp, Chlorella protothecoides
atgttgagggtgttcgggggaaaggcccccgtacagattgcttgcgctcgcatagcgcgtagcctgtgctcgggcagccggcctgatgccgcccgttgcaggcgaaggggaggagaaggaggagctcgcatgcccgaccagggtgcaagtctccaactcgccggtgtatgttacgggacgacgtctgggcaagggcggattcgggcaggtgttcctggggaatcgggcgaacaaggcccggacagccaaggagacccgacccttggaggcaagctcttgcggcttactggaggttgcttacccgtatgtgtccccctcttccatgcgcaggtggccttgaagttcgagcataagaccagcaaaggatgcgcccccaatggtgccccctttgaatggggtgtctacaagtga

SEQ ID NO: 4468 - DNA, 1338 bp, Chlorella protothecoides
atgacttgggcgcgaggggcacccgggaaagcacggaatacccttgaaccaccccctaccgggcttgcgccggtggctagcagcttattcccgaggacgggatgtcgctggcgcagttggttgcctcaatcggcgaaccagggggcacttggtcagcatcaggatgttcaccgctccattcacgtcgcgattgacaacgttggccttgcaggccgtgttgacacagtgcttcatgccccacagttccgtccacgtctccacgccacagcagacccggttgtgccggtgggcgtgcagggtggcgtgccaggcgcagcacagtttggaagtcctgtgctcgtcaaccaccaccaccctgcacacccgccgcaagaaacggattcagggcctccgcagagtcccccgcatgatgcccccccgggccagcccccgtcgctgatggggaatgatccacgcatcccgcaacaaaggcacctctgtgctgggtgccttatgggtcaggtacctgtggccagggaggttgaggagatgggggttgaacacgcggccctcgccgtgcaggaagtcttacacgcgctccgtaggaatgattgcctgcgccacaggcttattgtagtaggtacagtggactgtggccttggcggccactatgtcggctgtggtgaaggggccctccgagggctatctgcgtgttcgttctctcacaactccataccgaccccccgtcggtaccaccctcgagggtccgaccagcttccggcagatcccgccttgacgcaacctctgcgaaacctgggcatgtcgactgcactccctggcctcgcgctgggtgcgacctgcccccgtcccaccaacaagccccgtcggacagtcccgtcagtcggggcctccagtgccgcagcggggccatgctccacatcggacccgtcgattcagaacaatgtcgtgcccacccaagctccggcacctgccgagcagctcaccgtcatcagcgcgagacgtcgggaactggagtctcaggcccgcgcggctctggatgctgacagcaggtggtggcaagaaggcaaccaccccaacctcatcaccgtcctgacctcagcgcagtacaaggctgccctctcctcggccgcctcaggccagctggtgctcatcaattactttgccccccactgcaacgggtgtcgaaggctgtaccccaaattccagcagatggtgacctgcaaccccggcgtcctgttcatcaaggtgcggcccgcgtttaaatctggcaatctggcgttgggcgggaggttgcaagttgcaaatggcgccctggtcatgcaattacccatcagatag

SEQ ID NO: 4469 - DNA, 594 bp, Chlorella protothecoides
atgctggaggccatcaggtactcccgtggtagcctcgagctccttgagcagcgtgatctgcccaccaccacgcgctacatctctgtgcggggttcagaggacgcatggcgggccatacgggacatgaccgtgcggggcgcgccagccatcgccattgccgccgtgctcagccttgcggttgagctggtggtccagggggagggatcccagttctcaggcgcggcccaggcctcccagtacatccaggatcgcctggagtacctggtgtctaggtgggttgtggtgggtgtgagtggccaccacggtggagggggagtaccagccatggtgggtggagggggagtggcattggctgctgtcgtcaaacgtggttggcgatatccccgagattgccgccccacggcggtgaatctggcggaggccgccgctcggctgggcgccgccgccgcggaggccgccgcggcccccgccgccaccccctcctcggtggtggagacggcggtggcgggggcggaggccatgctgcgcgacgacgtggccgccaaccgcgagctgggcgcgctgggcgccgacgctgtggcgcgcgcggcgggg

SEQ ID NO: 4470 - DNA, 1872 bp, Chlorella protothecoides
atgccggtgagatgtttctggggtctgggacgttgtctttcgcggcctgtcggacagaaggtgggctcgtcgccctgcgccacgatcattcggaccaagctggtggaggaccgcgtgcccggactccggggttccccccgccccctgcccgtcccctcctccactcgtgccttccaccacacaccccagggccctttccaagaagtaacggatgtatcaacactgcagagcagccagtccagttcggaacagtatggcagcggcgaagctcctgccacagtcgtcggcgaggaagcctgccctggtgtcaggccatcccccttctccaccctgtccatgcgcagcctctccgcgtcatacacgagtcctaggctcccctcagccggcgggacccctcgaggtccccagcccagcgactccaagggtctctggcccgtggcacccgcggatgcctcccccggccctggctgcctccggaacggcaccacccacagccaggaggagccttccttggaggagcaggcctcggacgcggacgggccggcgatggacaccgatccgggcgaggatgccgtggagtccggcaacccgacccgacacttctggataggcaacctgagcacacacatttcgagagccgtcctgaagacagtttttgacaagtgtgtgctgcggatgggaggggaaaaggggcccgtgctgggtgttgcttggtgttgcttgggttgggatgggctccgactggcctatgcaggcctcgcggcaccccctccctccctccaaccccccctctcctcatgccatcccgctctccaggtttggggtcgtggacgatgtggtgaccttcccaggcaggatgtatgcgtttgtcaacttcaggaccacggaagaggctgtagcggcgatggacacgctgcaggggctggtggtgaggctggggtggaagaggaggggggcggatccctgtgcgacgcccaggctccaggcgccaagctcttcctgggggtctccactgagccccgtcgcttcctgatggctgctgcttgtaggcccatccaaacaccctccccccgccctccgccatcacagatccccgagctcacgggcgacaggcagctcctgctcaagtaccgccccgtcaacaaggccggggccaagctgagggctctcggcctgggcgaggagggtgtgctcagcgacaacctggacgacaggtgtgtggtgttggggttcactgtggaagggggaagcgggtggttcgtgccaaggggagccaggggtgcaagtccccttggggcccagcagaggtgcccgccgtccagcacgcggatgttcccacgcggggccctcagccctcgcgactgccctgaccttgggctcctgcctggacccccggaggggctcggcaccgcacaacctcggccacgcaccagctgcctggtctgtgaagaccaagccgtccccgcgggcggtgtgtgtgaagcctgccgatggtccggcgccgacaaggccgggtctcaggagcccagcccccgcatctggctgggcaacatcacctccgccaccacctccaaggcgctccaaggcgtgctggcgcgcttcggccccctgctcgacgccgccgtcttccccgcccgcatcgggccgctgggctacgcctttgtcaagtttgagcgcctcgctgacgccgtggcggccttcaacgccttgaacaacacggtgcgtgcatgggagggcccggagggtgcggcatgtcgtggtctcgttctgttgcctgcgatgatgatgactcggcgggcaatgcctcaaaagggcctgggaggcccatcggtcccacgggctgggcagtggcgtgggtgtggaggtgaatga

SEQ ID NO: 4471 - DNA, 891 bp, Chlorella protothecoides
atggtgcaccggcccttcatccgcaaggccatcaactttgtgttttaccggtttgttttcgagaccgagcgtcacaacggcatcgcagccacctgctgcgggcgtccattctccctctctccccagggaccggccgcctcacgctccaaacccccccacccccaccccccacccttagagctgctggagatcctgggcagcatcatcaacggcttcgccctgcccctgaaggaggagcacaagggcttcctcacgcgcgcactcatgccgctgcacaaacccaagagcctgcctcagtaccaccagcagctctcatactgcataacacaggtggggtggaaggatgcggggagcggtcagcgtggggaggggccggaggatcagattggatgccccatccctttgggaaatgggcatgggctaggagaggggtgcagaggagctgcactgccctgcgtgcccacccgctgggtcctcgctgcgaggtgtgcacttcactgcaagggccctccccccaaaatcctggccccctccgcatcctcacagtttgtggagaaggacagccggctggcggtgcctgtgatccaggggctgctcaagttctggcccatcaccaattcgcacaaggaggtcctgttcctcggggagctggaagaagtgctcgagtggacccaggctcctgagtttgcagaggtgatggagcccctgttccgccgcatcgcgcggtgcctgacctccagccacttccaggttgcggagcggtcgctgttcctctggaacaacgacgtcatcgtgtcacaggtcgcgcagcacaaggaggtggtgctgcccctggtgctggcggcgctggaggacaacgctgcgcaccactggaactcgacgggggtttga

SEQ ID NO: 4472 - DNA, 1074 bp, Chlorella protothecoides
atgagctccgggctcctgcgatcaatgaagctgaagctggcggggggaacgcccaagagcgggaagcccgacagcggtgctggggtcggggtcagtgggacagcaccgggacccgtgggcgcctccacagcccccccgccccccggccaggcccctcgacatgctgtgggaccggtggccagcacatcgggccggggaggggtccccgaaacggatcctgggcacgggttccctgccttgactgaggaggaaatgcagcggcggtatgcaggcgagtgcaggccgcccatcggcgcttggatcggggctcaaaactgggaaccgggtgcatggtgtgggaaagctgtctcccagggccggtgggggtgcaggccgatcaggcttagggtcatcggtcctcagtggctccccccttccccctctcctgcagaaccgctgccctcgttccgggatgtctccccaggcgagcgccaggccctgtttgtggccaagctccacctctgctcgttcacctttgacttcagcgaccccgcctcccacgtgcacgagaaggaggtgaaacgcgcgacgctgctggagctggtggaccacgtcaactccggctccggcaagttcaaggacgcgctggcgccggacatcgtgggcatgctggccgcaaacctcttccgcgcgctgccccccgcgcgcgagcacggccctgacgcctttgacgtggaggaggaagaacccaacctggagccggcctggccccacctccagatcgtgtacgagttcttgctgcggtatgtcgtgtcgggcgacaccgacgccaagaccgccaagcgctacatcgaccagcaattcgtcgtcaggctcctggacctcttcgactcgggtgcgcgcgggggtggagcatggagggagggggggaagggggggtgttggctgtgttctcggggcggatacacggcaaccggaggtcccgatgcctgtgcgccacgccgcagcatcgcgaaaggcgaccccgcagcggtacatgggcgtactgcgagtgggcctcccagtgtgcttgccatgcggcggtgtgggtggtga

SEQ ID NO: 4473 - DNA, 825 bp, Chlorella protothecoides
  modified_base (419)..(428): a, c, t, g, unknown or other
atggctctgaggagcctggcccgcttcgcgctgtcccggcgcgtcgccgatgcttgcttccagcaggcgaccaagctccaggtggcagtgcagggtccaccggcgctcacgtccctgctctggcgacgcaccgcatcctccctgctgcaggaagcatctgcttccacctccacccccgccttcggcacagaggccgatctggtcgttcccctgctgaaccagcgcgggcgccaggtgggcacctacaccctaggcggcgacgtgttcaacaccgaggtccgccgagacatcctgcaccgcgtcgtgcgctggcagctcgctgcacggcagcaggtgggggaggggcttgggggcttgggtcggcactgtcgcagcttgcaggtgtctgaacatgccgctgctgtatgtgagccagcggnnnnnnnnnnttgggtcggcactgtcgcagcttgcaggtgcctgaacatgccgctgctgtacgtgagccagcaatcgtcgagggtgcatgcttggacgcagcggtgcaccctcaaacaacactgctctctgaccccgctgtgtcacagggcacacacaagaccaagacgaggacggaggtgcggggcggcgggcggaagccccggccccagaagggcggcggcgtttcccgccagggttcgatccgcgcgccacagtggcgaggcggcggcgtcgcgcatggccctgtcacacgaagtcacgccatcaagctgctcaaacgcatcaggcggctgggcctctgctccgccctgtcggtgcgctgagggcgggggggcgttgcaggcatcattgtcatgtacggcatga

SEQ ID NO: 4474 - DNA, 291 bp, Chlorella protothecoides
atggcgacccctcgcattcccaccaggcatatcgctgagccccttcccctcagccgccttgctcccgggaatttcccgcagggcaacctggcagaggcgcgcaaaatgactgccgacgtgccgcaggcgagcaggccgctgctgctccctgccctccatgccagcctgtggctggaccggctggcagccgtggggcacgatgtgtttgaccccgccctccagatctcgccagtctcgcccctggggtaccagcttcgcctgaagtgggccatgctccggcaccgcttctga

SEQ ID NO: 4475 - DNA, 348 bp, Chlorella protothecoides
atgtcgacgcagcctccggctcgacagagggcctcccccctcaccccacccccccacacacacaccccacacacacagcgcgtgctttcctccacgctggagggcctgctggccggcgcgcctcgccgcagcgtgctcctcagcgatctgagcgcggagggccctgatgggggcgagggtctgcgccgggcctgcgccaacctcccctgggtggacctgctgcccagcatagggttgaatgtctactccatcctgcgcagggactacctggtgctgacgcgccagtcggtagaggcggtgcaggagcggttgaggaagcccatccgcccgcagcggtccaccgcctga

SEQ ID NO: 4476 - DNA, 621 bp, Chlorella protothecoides
atgcccatcaagcgccatgcatatcccattcttggccttcccactgtggcttctgcccgcccactcagggcatgcccaccatgccccctccccgcccctgtcacccagtggtggcagagcgccgtgaacgacctgtacaagggccacgccccagaccaccctgtcatgaccgccctggcggaggtactgcagcaggcgcagctgacgcggtaccgcctgcagcgcatcgtggccagccgggaggaggtgtcggggctgggccagcagccagagagcctggcggagctgctggcgcagctggactccagcctgggccagctgtcccagctgcagctggaggcggcccacgacgcctcccccacctcggcggaagccgcacagaaggtggcgaggggggtgggcctcgccagggtgctgcgaggcacgccccgggatgcctcccggggacgcacaaggctgcccgaggagtccactggccggcacggggtgtccctctccggactggcgcagggcaggccctcgccggaattgtgtgccgtggctgctgagctggcaggggtggccaaggtgggcggggaccggggggaaggactcaggtggagagagtgcagattgaggtag

SEQ ID NO: 4477 - DNA, 645 bp, Chlorella protothecoides
atgccagttgtgcacccttggcggtctgtaatgcgaggaggaggaggtgttcaaatgcacactccccctcttcccttccccacttcccaagaccacccgagcctgggcgcgtggctcctcaccctggtggacacggccgcccgagactccccaggcgagcccatgcaggccggggcgctggtgggcgagctggcgcgtgccgtgcccggtttcagggacgaatgggccgggctcgcggagggcagcgtgtgctctgcccgcttccagcgcaaggcgcaggcgctggtcgccgcgctggccgcgcgtttcggcgccggcgacccgcgcttcgccttccgcggctccgacggcctggccttggactccggccccgacaccatcgcggcgctgctggccgccggagtcctgcgcaccggcgcccccctggctgacgccctgaaggagcgcagggaccttggcggcagccggtgggaggccgcgctgagggcaggggccctggaggccggccgccgcgcgcgggcgctggcagcaggcagcgatggcccagtgcccagcgccgcccgcgtcctggccaaggttctgcgggagcagggggccgcggaggaaggcggccgcctgatcgccgccgagtcggttgcgtactga

SEQ ID NO: 4478 - DNA, 849 bp, Chlorella protothecoides
atgctggcctcggcctccacgcgtgtcctctcgacctctggtccccagcgcttcggctcgatcatatcccggcgcacaggtgtaatggtgtgcgtggctgcccagcccagcgcccctgaggcgctggaggagagccccttccccagactgggccggaacgccgccctgtacaaggaggtgggcggggggaagaagttccggcagcacgtgaaccccctgaagaaggagctggccacccctccccctccccccgactgggcggccgtgtacgccgaccccggcctgcccctgaccgtggacgtgggcgcggggtacggccgattcctgctgggcctggcccagacaggtgcggtgggcggcctgcgcaaccacctgggattcgagatccggggcagcgtggtggccagggcccaggactgggcagcggcgctgggcgtggcgcgcagcgtgcatttcgtgctggccaatgccaccctcagcctgggccccgtcctccgctcctaccccgggcggctggacctggtgaccatccagttcccggacccccagttcaagaggcggcaccgcaagcgcaggatcgtgcagcgggggctggtggacagcgtggcggagctcatgccgcgcggcggccgggtgttcctccagtctgatgtcctggaggtgagggggggaggattgaaaggcggggagcatcttcatgggtttcagtggactgtgccggagcccctgtcgggtagcaggacggtgtgtgggcgccgaccctgtgctccagcagacataccgttgggatggagacagacgatgcatcgggacaacactctgaatgagcaaggagactcatggccctga

SEQ ID NO: 4479 - DNA, 813 bp, Chlorella protothecoides
atggcaccatgccccttcctcatcctccccgccccaaaaacatcgatcacacgaacccggcaggaggaggccgccctggcccccagccctctgtccacgctgcatgcccaccgggcggtgctgggcgtgattggcatcctgcactgcgggcacacacgtgacctggccaaggcctgccgcgctttccagcagcgctgccatgcgttcaagggcgccttcaccgtgcggctcttcggcttcgaccccaccgacgcccaggtgggcggcggcctgctggccctcccgggcctcgacaccttccccccgggtgccaccccagagcacctgcagcaccacgccgaggtggtcatgcacgactacgcggcctgcatgctgggcgagctggagcgctggatgctcagcgcatcgcccgccatgctggacctgggctcgctggtggacgcgccggagttcacgggggccgggcccctggaggcggtgcagacgcggctctacagtgacgaggaggtgaagacaaagaaacggtatggccggctgcagaaggctatgggcgaccactgcctgcttgcggggtcaccgcgggacgcgctggaccacttcaacgtcgccgccgatttgtgccgcgtggtgggggactgggtcttccaggcgggggcgttggagggccaggccagcgccaaggtgaggggattggacgggaggaaggggggggaggggaggatgggatgtgtgtgtttctggcctgtgcgggatgctagctccagagggcagattgccgcttcgcggccaatctgcctcgtgctcattgactga

SEQ ID NO: 4480 - DNA, 291 bp, Chlorella protothecoides
atgcagggtgcgtgctgcggcgtccccgtgacgtcgggggagtattacccccagcagcagtacagtcaggggtatccccctcagaactaccaggccggctacccaccccagggctacccacctcaggggtatggccagcccggctatggccagcctggctatggcggtgagcctgcatggtggtctctccctgccttacgccgtctgcaccggagtgcatgggcggaaggaggctcacagggtcacacggatgccagagctgcctgctcccctcgcaagcgcgacctgtga

SEQ ID NO: 4481 - DNA, 387 bp, Chlorella protothecoides
atggcatgtctgtacctgggaggcaagctggaggacacccccaagagcgcccgcgatgtcatcacagcatgctgcatgcggcgctatgggccagaggtcgcggggctctctctccgcaaccatgactttctcacagcagcaagggaacggctcttcctggccgagagggctgtgctgtatgccctgcgcttcgatgtcgccatagagcacccctttggcacgatgctggccgcgctgaggaggccggcgctgacgcgagtgtggcaggagtggggccaggctcaccccggctccgtcagcttccagcagatgtgcatcaacctgctgaacgacaggtactggtgttgggtcagagttgaggcgtgggcaccgggtggggggttgtga

SEQ ID NO: 4482 - DNA, 405 bp, Chlorella protothecoides
atggccgaggccaaggcggcgttgcggcgcaagggcgtgctgccgctgcaggcggaagccgatttgaagctggcgcgcttcctggccggccttcaccacaaagcatgccggcagctatgcgggcactgggcactcaaaagccccccctcctcctcattgattccccaaccttccatccagggcgaggcggcgcgggccgaggtgtccgacctggtcacaggcgtgctttccttggttgagggcatgcccctgcccgaggaccgtatgctggccttcgtggagggcgcgggggcgctgggactggtgggctcgctgcgcaagcgcatgctcctcctctggcaggcggtggagctgagcaagtacctaggcttccccaatctgcgcagcctggaggtcgccaggtga

SEQ ID NO: 4483 - DNA, 462 bp, Chlorella protothecoides
atgtgtgcgtgggatgggaaggctctgctgagggttgagggaggtttctggtggaatgtagtgtggggagcggtggtcgaacacgtcgcaagatgcgagagcgtcgtcaatgacaggcctcgatgccccccacccaaaccctccctctccatcaaatgctccgccaggaaggcgctggagccgccggatcgacacatggaccctgtgggcctggaggagccctggagcacgccccgctccgccctgcaccgggagagccccagcctgtggccccaggtgcgcgccggctgcctggaggccattctggggctggccatctacgccaagcagcacgccgaggtgtgggaggcggcggccgtgctcctgcgcgaccaccccgccgagctgtcgccgcaccgccagcagagcctgctggagaacatgctggccgccgcggcgcagatggcgcccgccgagcggtga

SEQ ID NO: 4484 - DNA, 1146 bp, Chlorella protothecoides
  modified_base (130)..(139): a, c, t, g, unknown or other
  modified_base (773)..(782): a, c, t, g, unknown or other
atggcgacagaagccgtaccaacggtatttagtggaggcccacaggagacagtgaaactccctctggaggttgcgttgttgcccaagaagcttttagctcctggtttcaagtctcgcaacgcgtcgacgnnnnnnnnnngtgaaactccctctggaggttgcgttgttggccaagaagcttttagctcctggtttgaagtctcgcaacgcgtcgacagtgtgacgacttgtcgagctgtccgaggagtttcgggctcggtatacacagtcagatcttgtacgtatgacatcgtggaacggcattggagaggctttcagacgactaatcttgcgtaccttggggccagagtagtcgctctattcccacgccggtcacggtcctgtggcgccacgcgcccatcgatgggtgatggtcccgagagctttcctgtgcgaagccgctccttgaagattagcatccagtccgagcctgctgatgttttcgtgtcgcgctacaccgaccgcgtgctggtggtgatctcccagctggccagctttgggactgtcctctcgacgcagcgggagcaggtgctgggcaggggcagcaccttcaaggtggacaccctgctgggagaccgagccaatcccatgccggagctgtgcgcacggcagctggcgcagagcgcggccgatgccgggtgtgacctccccctcctcatctgtctgggcctgcgcccctcggctgccaccctggcgggcatgcgagcaagccctgcccctcttcctaccactcnnnnnnnnnngcgggcatgcgtgagctcttggacgctgtcgcccagcacaacatctggtagtcgctttcaacattgccctgcgtcaggagcaagcccggcccctcttcctaccacttctactgccctccacttctactgccctccccggcctcccaccctgccggccagtttgccaaccgccagtaccccccttccgagtgcctccccgtctcacacacatggctgcatgcgcactgcatgggcgggcgtcatcgagaggggggcgtgtcggggcgcaccggggtcgctgcgctgcccagcgcgcagcgcagctggtccatggctgacctggcgctctccttgctgtgggcgccgtactccagcaggcgcgtga

SEQ ID NO: 4485 - DNA, 375 bp, Chlorella protothecoides
atggtccctcctcaccccacctgcctcctcccactgcagggtggcaccaacatcaacgacttccaggccaagacctttgctcggatccagttgtccaagagccaggagtactaccccggcacccaggaccgcaccctgctcatctcaggccgcctgaagcaggtggtcgccgccctggccctcatcctggacaagctggtgggggagggggtggccccccttagcccccgctcccggctgcaccaggagcctgacagggcgccgcgcctgctgctcaagatgctggtcccccaacccctctgcggcatcatcatcgggaaggcaggggccaccatccggtccttctccaacgacacccagacaaccattcggtga

SEQ ID NO: 4486 - DNA, 2211 bp, Chlorella protothecoides
  modified_base (560)..(569): a, c, t, g, unknown or other
catatcttcgcatgtgttgcatatgttgctacagagtgtggatcatcccttggatggttgatttcgaggagatcacagctccccacccctttgacaccatggggagcggaggaaacgccgacattgactcgaactgaggaaaaggtacccttcaggagcccgccctgcgatgctggcggggtgcgacttccctctcgtgcgcgacagattttggagtacgggcgaggacaccgcccccggcaccagctgctcatctgcaccttcctctccactgaaaagtaccgcgataggacgccccggcctgcgagtgctggacctggggactctgcctcgggtggagtccccacccaccgagctccgggcgcgcaaggacaagctcgcctacttcgagcgccagtgctcccccgtgggccacggcctgttcgtgggagcagaatgtgtcgcccggaatcgcgaatcgctgcgagaggcgggcatcacacacgtgatcaattgcgtgggcttcctgtaccccgcctacttctctccggagctggagtaccggacgctctacctccagnnnnnnnnnntgtgatcaactgcgtgggcttcctgtaccccgcctacttttctccagagctggagtaccggacgctctacctccaggacacccccgcggaggacatcacgtgcatcatgtacgacgtcttcgacttcatccaggccgcggtgggacatggcgccgaccccgccggccgcgtgctgctccactgctcacagggcgtgtcacgctcagtgagcctcaccatcgcatacctcatgtggagggagggccggccgtacgaagaggtgtttgcctccgtgaaggctgcacgcggcatcgccaacccaaacatcggcttcgtttgccaggtgcgtgaggtgcaggggatgagtttgacagactgctcccaagaacttcacgcgctgccctccatcccctctgggctgtgcgccgctacacccacgtaccaacactcctccgcctggtcacccccatgccaccgcagctgctgcaatggcagaaaaggcgcaccactggccccggggccgagcgcctgtaccgactggctccccagtcgcccgcagccccgcagtacctggtaccacggtctgcaaagattcttgggtccgccggcctcgacccacggggctcctttgtactgcacaccagcacggcgctgttcctctggctggtgcacccagcagaaggaaacgcaaggatacccatgtccttgcgctcacagctccactcccgtgtgcgcttggcagggcaaggcatgtccagaggggtttgctgcggcggccaccacctttgcagcgcaactggagcggtatgaggctgcaccagcgcccgctttgctgcaaagggatgggaaggagagcgaggagttctggacggcgctcaaagcaatgctctccagctccactggcgaggatgggccagaggcgtccggcagctggagggcagctgccgtgtgtgagatgcccgcgtacgacaaggactatgaggtgggtggctgtggaggtgatcagaccaagatttggttatggggatgtacacgttatttccaccccgctgtgtatggtccggaacaaaccctgtcaccatcccctgcatgcttgaagcactgcctgcaccagcagtcctgtcgcgcatgcccagaaggggatgcatacaaccaagcatcttctttgcgcagcccatggaccgcccacctcttctctcatattccttcctctccacttacctgcatctcctcccgcaagatcctgccacatacttgctttccctcgcacaactccttcccacactgcacacagctttttgctcggtcacagaccgctcggagtagcaccgcagatgacagcgatgccagtccacggtcggctcgcaagacgccccgtgacgagaggtccgaggaagacccctcccccaacgagcggcagaggaagcatgcgcgggggacgccgccgacggtacctcgagacgccgccagcgccgatggccgggcccagagctctgctaacggtgctgtggctgcagcagccagccccaggaggcatgcttccaggctacccccggttcctccgttggacatgacgaggaggggggacccttccgtgaacagtaggagccgtgtgccgcgcataaatctgtcccctgtcgccacagtcgtatctgacgactag

SEQ ID NO: 4487 - DNA, 1344 bp, Chlorella protothecoides
  modified_base (927)..(936): a, c, t, g, unknown or other
atgcaaggcgctcgcgtgctggacgtcggttgcggaacgggcatcctctccatgtttgccgcccgtgcaggagcctctagggtcgtaggtgaggggcctttgagcttgtgtgtcgggggctgttggagctgtggccaggaagggggagctcgtcttgtttcagccagaaacatgcttctcctggcaatgctggggagaagtccaccaaatggggcacctcccacccacccaaatcctcatcagagctctgccagttcctccaaaggaggaggcctgccagtttacatcctaactaaacccccctacacctattcaggagtggatgggagttctcgaattgcagaggaagggggagctcttcttgtttcagccagaaacttgcttcttctggtaatgctggggagaagtccaccacataaggcacctcccactcacccaaatcctcatcaaagccctgccagttcctcaaaaggaggaggcctgccagtctacatcttaagtaaccccccccacacctactcaggagtggatgggagtgctcgaattgcagaggtggcccgccagaatatattggccaacgggctgggcgaccgggtcagcattgtttctggcagggttgaggccgtggaggagctggatgtccccggcagcaaggtcgatgtcctcgtcagcgaatggatggcgaatggatgggtgagggtctaccttggggtggaggcacagtctgggcggggttgggcagcatgcagcttgtttcacactgcgcctggtcgagtgaaacccaggagtggagagccgatgtactttgaccccatgctgggacaaagggtgttgaatccccctggccaatgtttgctgcatgcgcaatcctgccaatggtgttttggcattctgtgcctagagtccgcccaacacccacacctgtcnnnnnnnnnntgtactttgaccccatgctgggacaaagggcgttggatccccctggctaatgtttgctgcacatgcaatcctgccgatggtgtttttgaattctgtgcccagagtccgccccaaacccacacctgtttcacaggctatgccctcctgttcgagtccatgctggactcggtcctggcggcccgcgatcgcttcctcgtccccggcggcgccatcctgcccgaccaggcctcgatctatgtggccgggggcggtccggcggccggagggctttccttctgggacgaagtctatggcttcagcatggccccggtgaaggggacgctgcaggctgcaggtggggtcggatcggaagccggtgggaaagtggcattggggtgctggctcggggacctccctcatggcttgtaa

SEQ ID NO: 4488 - DNA, 834 bp, Chlorella protothecoides
  modified_base (234)..(243): a, c, t, g, unknown or other
  modified_base (592)..(601): a, c, t, g, unknown or other
  modified_base (781)..(811): a, c, t, g, unknown or other
atgagcgtctcagaagcgagtgatgggcctgaggagtggagcgactgggaggagtcggaggagggacctgtgaagagcttgttctcggacacctggctgcccacggtggaggaggtcatcgagcacgactcagaggtccacggattcgacctgagcctcttcaggaagcaggtgcgaggggtgtgtagcgcatttgtaaaggggccagtggctagcacacttgcactctacccnnnnnnnnnncaggtgcgaggggtgtgtagcgcatttgtatgggggccagtggctagcactcttgccctctacctagcacccaggccaccgcgcatgagacgcacacaaagtccgatcttgcaggagaatctggatacgtatggcaccctgcagctcataaactacatcagaagttgtgcgagggagggtgctgaagcagtgcttcccactctggccacacgtccctgggcagacgaagctttcttcctgcccacgctggctggcgatggaatgctgagccatgactgggacgaggcgggtgcctggagctcttcccccgcagaagccagcggctctggcgccaacgcctcccaagcannnnnnnnnnatggaatgctgagccatgactgggacgaggagggtgcctggagcgcttcccctgcagaagccagcggctgcggcgccaacgcctgccaagcccaggaagaaaatgcggtggccatgcgggcggccgtgctggccctgcaggccgcactcctcgacgagccctccacctctgtgccttccnnnnnnnnnnnnnnnnnnnnnnnnnnnnnnnttcgagtcctacagcttctttga

SEQ ID NO: 4489 - DNA, 450 bp, Chlorella protothecoides
atgggccggggcccactcgacgccggaaacccaccgccgcctgggagtcctgggggcgcctccccgctgcgcagcctgaggctcctctacaagaccctgctccagaacatcatgaacgaggcggtggtagcagaacaggctgcccacctgcagtcaccagggcacgactccccgacccaccccccttcaaacctcacacaggttttcacccagcccacggcggcactggctgccctggtcacgcgggtttttgagcagcgcgttcagtccgccgtcgaccaggcgctgagctggcggggagtgcccgatcccccctcagcctccgacctgcgcgcccaccttcgccagctggcggaggcggtgaccatgacccggggcctggccagcgacgcccaggttggcgtggtgtgtgatgaaaagcacggcaatgcggtctggggccaatgctga

SEQ ID NO: 4490 - DNA, 1356 bp, Chlorella protothecoides
atgccttggaaattggcatacacttcccgagttgggggccagatcctaccagggaagtgccgatctgaacattgcacgggggtaatgcgccctgctcaaaaggcgccgcggggagtgctccactcgagtgatctcagggctaggatgtcggaccttgcgtctgcacagaggaatctgcagcagctcgagagcgctgtgcagagcgggagcgtggaccaggccaacaagctgctctcgaaactcaaggcaggaatgcgtagttatcacttgcatcgattgtggtcgcgcgatgccgtgtctcacgctgatatcgccccgttcacctttcccccatcccctctgtcctcgcgtcctgtgactccctgcagctggacctcatctccttacccgccctggcagccaactcccagcccagccccaccacgaccgacgagctccttcttgcacgtgagatctcgcaccgctcctcgccaacttgggcccctccccaccgccgcagggggcgtgtatgagcaggcggtgctgctcgggaccctgcgctccgacttggtcgtcttccagcgcagctggagccagctggcgccgtactacatcccaggcgacctgtccaggagcctgaccccctctccacgccaggccttcctcaccgccctgaacctgctgcgcctgctctcacaggcggcagtggcggagttccacgccgagctggagctcctctcggatgaggtccgtggtgggagggacagtcgggtggacgctgccatggcgcacccaggcatgctgggaaaatcggtgctccttgccgggctactcacagcgagggccgaagcctcagagcgctgtgtgaccccgcacggcgactgtgcctgcacccactccccgccgtcctgcgccgccccagatcaaggcttcccccgaggtgaccaagatcatggaggtggaggcgtggctgatggagggggcctacaaccgggtgctggaggcgcaggacgccctttccacctcgccctacactgccatcttcctccagcgcctcaccgacaccgtcaggttggtgggctggggtggcaagacggggtgtgcagggtcctaaggcggtgggcttatcctctgcatggtttgaaaatgggggagtcaggggcgctcgagactgtgtctttgatgagactcgccttatctgtgattccaaggcactgtctagctctccaccccctcccgcgcgcaccaccgacaaccccccaccctcgacaatcacatcagggaggaggtggcggcttgctgcgagcgctcgtatgcctccctgaactcggccgaggccctcaagctgttcaggctggaaagcgaggcacagcttga

SEQ ID NO: 4491 - DNA, 1863 bp, Chlorella protothecoides
atgccgggatcgcaggcggcctgtcgggggcacgggtcaatttgtaaatccactggtgctcattcccgagggagaggatgtgcacctcatgccaataaccgatccttgaatccatgcactactatcctcacatctgcaacccgggttttgacggagaggagaagcagtatgcccagtgagagggacagcacgccaggtcttcccatcctgaaggacaggggcccaggcttgaaagatactcttgcgcggatgagcactacgaacacgccttcgagcagtgcgcttagcctgggcgcattgcagctggcatgcgagtgggaccggatgcaagcccgcgtgcctctccggtacggacgcggacaaagccgtggagtccatggcatcatgtacgttatgattctgaaaaggaacacagcagcacttgtgtggattctggctgccttgactatctgccagactgcgcatgtaggcggactgcgatcccggggtcgcgctcttcgcacttcctactgtgtagtgagttcacgtgagggggatcatgggatgacgggctcggcagtctcattcaagtgtggcactctgcgcttcatcattatcgtgctccccgctcccaatcgcagttaccgcggcgagatcatgctggtggacaaccataggaagttctcctcctggagtcccagcaacagtggtgcatgccatgaccattttgtccttgtgcacattcctcacaggttgaaagggttcagggatggattttaccagaataatatatatctgacgaaggacatgttccctgacttcaacatccgggttctgaatctaggggatggcgcgacgtgcgatccccgtcagcgtcagtgcgaatttgttcgcttcgttgagtgcgttcccgagggcgcctatcaatgttcggatgacttcacatggattgttggaatgggaacgggcaacgcggggagctggaactttggagacttcaacgtgggggacagtaacataggcaaccgcaacatagggtggaataacgtgggaagcaacaacaccggcgagaacattatttgccacaacctgtcaggcaatgaccgctgtcggctgtcagacctgctaacaggagagacctacttcctcgatgcgcccccctaccctcctccccggccccctcggccttttgatcctccgtctccttcccctcccagccccccactcccgccaccttcacctccgccgccgggacagacctgcgactctggcacaaggttcatcgctctgcccaccatcgagtgcgcggggtggtacaatggggttctgtatctgacgagtccgagcagccccgatgcctactgtcggttgaagggatttgcagggtcagggtcgatgagaattctgcccatcaccctgagcacgcctttcagcaagttcagcatcagcacactggatccagggactctggagatgtgtacaccgacagaggcgacctcctgccagtcgattgcggtgattgaatgcctgccagaagggattcccaaatgcacaccggatgccagtggcaacattggaaacggcaatataggatccaacaacttgggtcacaacaacaatggcaacaacaacgtcggtaagggagcatgcaaccccaatcctcggcctggccttctcaagagcctttcttcgagttttggttgccctcctcactccgcaggcaatcacaatcatgggagcaataccacggggagcgagaactggggcgacaatctcgtttgcaacaacattcaggatggcggccaggacacttgcactgtgacggacctacgcacaaccgacacgattgtgctcaaagttcatgcaccttcccacactccttga

SEQ ID NO: 4492 - DNA, 720 bp, Chlorella protothecoides
atggtgaatgacaaggaaaccgacttctattgccggtacgtgcacgcactgttcgggagggcaggaagctcaatatataccgatatgagtctcacattatttatcattcatctatctactctagtacggatgcgctgctgtgtcgaattgagatgtgcgtccctcgccctgctcaggctcaaaggatacaacggtggaggcatcgtcatgcagtccttggatctgaaaaatgatggacctttcaaggactttaccataggcaccgtcaatccagcctcattcaccacctgcaccccctccgccacggtggtgtgcaaggccatcgccctcgttcagtgcctccccaacggtgtaccggggtgtgtggaggaccaggatcacaacattgggaccgggaacactggcaagaataacataggcgacaacaatgttggagaccgaaaccacggtacgtcccatgccaggagggttgatgctggtggaggtaatgatggcaagtttgtgcgcctgctggaatgtacccccatgtatgaatctgtgaggcgattgcatagacacacatccacaggaaaccacaacattggcagcgataacatcgggactggactgactggccagcgaatgttatgcaactttgccaaaactgatcggtgcccgctgctctggctggccaccaacgagacgatcaaattgttcgctcctccccccccccacccccca

SEQ ID NO: 4493 - DNA, 477 bp, Chlorella protothecoides
atgtccttttctgcaagccggcatggtattcagccgggcccctgcctgacaccgtgtgtgcctcatcgagggggacatggggagagggtccttgcggcgtacaccctcttcatgaccatccctccatgtcttgcctgtgcaggcacgggcaagacgctgctggccaaggccattgcttccaacatagacgccaacttcctgaaggtggtggcatctggggtggtggacaagtacattggcgagtctgcccgtgtcatccgcgagatgtttgggtacgccaaggagcaccagccctgcatcatcttcatggacgagatcgacgccatcggtggcaagcgcttcagcgagggtgggtgggttgggaggtggagggcccccgagtgtcgatgctgcgcccctgacggccgcgagtgtggatttcggcctgggccttcaggcctcccggtcgctggcctcacccacggcccagtcgtgtga

SEQ ID NO: 4494 - DNA, 726 bp, Chlorella protothecoides
atggagctgctgtcccagctggacggcttcgagtcgctgggcaaggtcaagttggtggcagccaccaaccgccccgacgtcctggaccctgcgctgatgcggccggggcggttggaccgcaagattgagatcccgctgcccaacgagcaggcgcgcaccgagatcctgaagatccacgcctccaagatcaccaagcacggcgagatcgactacgagtccgttgtcaagctgggcgacgccttcaacggcgcggacctgcgcaacgtctgcaccgaggccggcatgtttgccatcaggtgcgggaagggggaaggggggggtggagtcgtgggaaaggcagactcggggggaacagggggaggaaagggaagcaatcgcatggtcgtggaggtcgagggcctgacccatgcgcggcacaaccctggccgtcacgagtgcgttgctccgcccagtgccgcgctgcatgctcgggccctggctgcgctgccaccttccccccctcgcatgccgggctcgggccctggctgcgctgccaccttcccccctcgcatgccgggctcgcgctcgacgtgcgcctgcgaccagtgccccacacttcaccgctgcagggacgagagggattacgtggtccaggaggacttcatgaaggcggtgcggaagctggccgaggcaaagaagctggagtcgccctcccccttctcctctgactttggtgacaagaagtag

SEQ ID NO: 4495 - DNA, 1011 bp, Chlorella protothecoides
atggccagccaggtggaggcgctcaagtacatccccggcaccagcctgaacgtggacggcttccgtttcctgcgccccggcgcgcgccacttcttcctcacccacttccatggcgaccacaccacgggcttgaccaagggcttcgacgcggggaccatctactgctcccccgtcactgcccgcctgctcatccgcgacatgggcctgcgcgccggggtcgtgtgccccctgtccccccacgtgaccgtggaggtgggcggggtggcggtgacccctctccccgccaaccactgtcccggcgccgtcatgttcctcttcgtcatccccggggacggcgggggccggccccctcgcaccgtgctgcacacgggcgacatgcgctgggacgacggcgcgatgatggcctaccccgcgctgcgcgcgctgggcactctggacacgctggtcctggacaccacctactgtgcgccacgctggacgtttccaccccaggagcaggtgatccaggctgccgccgagtttgtgaggcgagaggccgccaggtcagcaggccgagtgctggccgtggccaacagctaccacattggcaaggagcggttctactttgggctggcactgcggctggggtccagggtgttctgcacgccgcagaaggcgcgcgtgctctcctggctggacctgcctcccgcctggctgggactgctgactcagcgcccgctggaggccgacgtgcacctgctcgggccgggggaggcgctggcgcccgccgcgctggaggcgcgcctctgcgcccccgccgcgccctgggcctgcgtggtgggctttcgggccacgggctggtcctataagaaagcgccgcgggccgaggcgctgagcgtgtggcgcgagggccgcgcggcggtcgtgggcgcgccttactcggaacacagcagctgggccgacctgcgtgcctgcgtggcttccctgcgcccgcgccgcatcatccccagcgtcaacgccgcaggttggggg

SEQ ID NO: 4496 - DNA, 867 bp, Chlorella protothecoides
  modified_base (373)..(382): a, c, t, g, unknown or other
atggtggggcagtgggagggtggatgcaagcgaaggggctcgacaggtccggacactgccatgccacagcgcgtcctggcaaacaaaagctatggtgagtgccggcatcatccccccctaacgcgcagagcgagagcagctgctggaggacggcttctccaactggaaccgccgcgacttcaacgcgtttgtgcgcgcctgcgaaaagtacggcaggacgcagctgtccgacattgcgcgggaggtggaagggaagaccgaagccgagggggtgtccatgctgccgccgcccgtgcatcacagtgttcacacccgcaaacaaactctgtgctgatccgatttctaccaccagcatccgcatcgctattcctgnnnnnnnnnnaaatggtgagtaggtcttctgaatggactcagggtgatggacatccgcatcgctattcctgccctcccactccctggtcattttgccgtgaccaccatcctctcctcccaaacaatcaaaccccacgaaaaacgcaggtgcgcgagtacgcggcgaccttctggtcccgagtgggcgagctgaacgacgcggaccgcattctgaaaaacattgagcgtggggagcagcgcatccagcgccaggcggacatcatgaccgccatcgctaccaagctggagaagtaccgcaacccttggcaggaggtgcgcatcgcctacggcccggccaagggcaaggcgtacacggaggaggaggaccgcttcctggtctgcaaggtgcacgagctggggtacggcgcctgggacgagctgaaggccgagatccggggaaactggaggttcaggtttgactggttcttcaagtcgcgcacgccgcaggtggggtga

SEQ ID NO: 4497 - DNA, 1458 bp, Chlorella protothecoides
atgcagcctgccactccgactgctgagctgccggccagattgtcgcccccatcgactcccatgcgacttactcccacttcctgccctctccctcctctccaggctgcacgcgggcgcaagcgcctggacttcctgctgcgccaggccgaggtgttccagcactttgcccccgcggcggcggcgggggcgtcggccaccaaagcccgcaagaagaaggggcggcacggcgcggcgctgaccgaggagatggaggacgaggagctgctgcgcgacgaggagagcgcggagcccggcgcggtggggcaccgcctccaggtccagcccagcgtgatcacgggcggcacgatgcgcgagtaccagctgcagggcctgaactggctgatccacctgtacgacaacggcatcaacggcatcctggccgacgagatggggctgggcaagacgctgcagaccatctccctgctgggctacctgcgcgagttccgcggcatcaccgggccgcacatggtcatcgtgcccaagtccacgctgcacaactggctgaacgagttccggcgctggtgccccgccatcaaggccgtcaagttccatggcaaccaggagcagcgcgcggcgcagaaggaggaggcctgccagccggggcgctttgacgtggtggtcacctcctacgagatggtgattaaggagaaaaaccactggaagcgcttccactggcgctacatcatcatcgacgaggcgcaccgcatcaagaacgaaaacagcatcctgtccaaggtcgtgcgcacgctgaccaccaactaccgcatgctgatcacgggcacgccgctgcagaacaacctgcacgagctctgggcgctgctcaacttcctgctgcccgaggtcttctcctccgccgagaagtttgacgagtggttccagattggcgcggggcgcgaggcggaggcggaggtcgtccagcagctgcacaaggtgctgcgccccttcctgctgcgacgcctgaagtcggacgtggagaagagcctgccgcccaagaaggagaccatcctgaagatcgggatgagcgacatgcagcgcaagtattatgccgcgctgctgcagaaggacatggacgcggtgacgggcggcgcggaccgctcgcgcctgctcaacatcgtgatgcagctgcgcaagtgctgcaaccacccctacctgttccagggcgcggaaccggggccgccctacatcacgggcgagcacctggtggagaactcgggcaagatggtgctgctggacaagctgctgcccaagctgcagagccgcgggtcgcgcgtgctcatcttctcccagatgacgcgggtgctggacatcctggaggactactgcctgtatcgcgggtaccagtactgccgcatcgacggcaacaccagcggcgaggaccgcgagagccagatcgacgactataaccgggtgagtatgtag

SEQ ID NO: 4498 - DNA, 1245 bp, Chlorella protothecoides
atggaccgcgcgcacaggatcgggcagaagaaggaggtgcaggtgttccgcttctgcgtggagaacgccattgaggagaaggtgatcgagaaggcgtacaagaagctgcgcctggacgcgctggtcatccagcaggggcggctggtggagggcaccaagggcgtgaacaaggacgacctgctccagatggtgcgctacggcgcggagatggtgttcagctccgaggcggccaacatcaccgaccaggacattgacctcatcatccagaagggcgagtccagcaccaaggagctcaacgacaagctgcagcccccggcatcaagtcggaacacgccatggaccccgcccgacctcaccccgagagctcccaccccccgcaccttcatccatccgcagaacttctcggacgatgccatgaagttcaccatggacggcgggctgtcggcctacgactttgctgacgaggacaaggagccggagaacacggatcagctggaccagctgaagcagctcatgggtgggtctggggcgcgcgggggggggaggcgcgccagaggtgtggcgtgtcaagaagtatgccctccaccagcggctcggcgaccccatctcgacgtctggcacgacaccggatgcgctgcacggacgcagcgcacgcaccgcgcatgttccccgtacacaccgcacgagcacgccccaggctgcattcccactgcttctttaccctcgcgccgccccccccccccaccaccatccgtaccaggtgccaattgggtggaccccccggagcgcaagcgcaagcgtgtggtgtcgtacgcggagaacgagttcttccggcaggcgcagggcaaggaggcgcgcccccgcggcggcggtccccgcctgcccaagatgccggccctccaggacttccagttctttgacaccgctcgcctcaccgagctgtacgacgcggagcagtcctacgagctgcacaagcacgcactggcgcagaaggaggcggcggcgcgggcccagggcgccagcgaggaggtgatcgccaaggagatcgcgcccggcgaggacgacccgcagcccctcaccccggaggagttggcaggtgtgtgggtgactgtgtgtggtgggagtgcgtctgtggcgggagggagacatggtggggcagtgggagggtggatggaagcgaagaggctccacggggccggacactgccatgccacagcgcgtcctggcaagcaacagctatggtga

SEQ ID NO: 4499 - DNA, 174 bp, Chlorella protothecoides
atgggcggcgtggagtcgctgatcgagcagcccaccatcgtgtcctactgggaccaggggcccgaggagcgtgcgcgcctgggcatccgcgacagcctcgtccgcttctcctgtggcgtggaggcagccgaggacatctgggccgacctggcccaggccctggaggccgtgtga

SEQ ID NO: 4500 - DNA, 1017 bp, Chlorella protothecoides
  modified_base (710)..(719): a, c, t, g, unknown or other
  modified_base (866)..(875): a, c, t, g, unknown or other
atgcggcaacccctaaaccccgcgcagcttgacggtcctttcgtctatcccgccgcgccttctgccttctgcctggtctggtactcatttgagatcaggggtgcattgggatatatagcccttgagatatcctccattatgctggctcgacgagcgctgcccgtcgtaaccctgtgtagacttccgcgaggtgagcaccacccggtctgcaaacccacccaacttttcccatcgattcgagtcctagaacaagctccgtgcgctcccccatcaatttattacacgccttgcaattgtgcagcgttcgcgagcctgtccacagaggtcgccacgggtgtgaatatcctaaagaacgggaccgacccagccctcaagtccgacgaggagctccccgcctggctctgggagctggcccagccggagaagcccttgacagagctgcagaggcatgagttcacggagctgcagtcagaggaggtaggtgggggtgtggcatgggttggatttgagaagagttccctgtgtggcggccgcaagtggtccgcgtccactgctgcctggcgtgctcacctttcgcccgctctcccttccccacccagcaacggaggtgggtcaagctggagacgcgcgccgggatcaaggccaacaacgtcctcaagtctgcctgacggagcctggtgcttgctggagtcattttgccctctcatccnnnnnnnnnnccctgccatctgcatgcttcttcttgcaggtgtccatgccctcatcccatgtctgaggatcggcactcgatctcaagggatgaaggggagcgaggcctgtggtccgccgtgccaggcgagcgggaggcaggccagggcgagtgaagnnnnnnnnnncggcactcgatctcaagggatgaaggggagagaggtgtgcgcaccacgcggcatgggtctcggggggggggagcgacggatgaggacacgcaggcctgtggtccgccgtgccagggagcaggaggcaggccagggcgagtga

SEQ ID NO: 4501 - DNA, 678 bp, Chlorella protothecoides
  modified_base (278)..(287): a, c, t, g, unknown or other
gcggcggccgccaacgccggcgccggcgcggccccgggcgccgcgcgcctgtccaaggtggtgcagctgacgggcttcagcgaccccatctacgccgaggcctacgtcaccgtccaccagtacgacatcgtcctggacgtggccgtcatcaaccgcacccaggacaccctccaggtgagggtgatgggtgggaaggaggggggaaaggggggtcagggggaaccccgcgcggccgacccgcgtggcgggcggcgtggcctgccagcctcccacgcctnnnnnnnnnnggggaaggagggggggaaggggggtcaggggaaccccgcgcggccggcccgcgtggcaggcggcgtggcctgccagcctcccacgcctcccaccgccgacccacacccgtgggaacgccctgcactcccggcgacgccatccacattcccctgcacagaacgtgtcgctggagctggccaccatgggcgacctgaagctggtggagcggccggccagccacacgctggggccgggggcgcagcgccgcatccgcgccaacatcaaggtgtccagcaccgagacgggggccatcttcggcaacctggtcttcgagggcacgggttacaacgaccgcaagtgcgtcgggtggcggggggggtgtgggggggtgtggggcagacggcgaaatga

SEQ ID NO: 4502 - DNA, 810 bp, Chlorella protothecoides
ccctgtacccgctggacaccatcaagacgcggctgcaggccatgcgctccggtggcggcctccgcgcgctggtgcaggccggcggcgggcgcgggctgtacgcgggcctggtgggcaatctggtgggggtggcccctgcctcggccatcttcatggcggtgtacgagccggtgaagcagcgcgtgctgaaggccgtcgacgccgaccgcgcgtggctggcgccactggcgggcggcgtggccgcggggctggcctccagcgtcgtgcgcgttcccaccgaggtggtgaagacgcgcatgcagacgggggagttcagcaatgccctgcgcgcgctgcgcaccatcgcagcgcgagaggggcggcgcggcgtctttgccggctactcctccttcctcctccgcgaccttcccttcgacgccatcgagttcctgacctacgagcagctgaagaagggctacgcctccgccgtgctggggggacgccgagagctcaaccctgcggagcactcggtggcgggggccatcgccggggcggtgacggggctggccaccacgcccctggatgtgctcaagacgcgcatgatgatcgacggcgggcgcgggcagtacgccggcgtcgccgactgcgcgcgccagatcctgagggacgaggggcccgccgcgctgctccgcggctggcagccgcgtgtcatctggatcggggtgggcgggtccatcttcttcaccgtcctggaggccgccaagaagctgtacgcccccaaggcggccgcgaccggggtcttggccggcgagccccaccccgcgcccaagt

SEQ ID NO: 4503 - DNA, 1227 bp, Chlorella protothecoides
  modified_base (498)..(507): a, c, t, g, unknown or other
  modified_base (578)..(610): a, c, t, g, unknown or other
atggcctgcggagcggcgcacaccgtggccttcaccatgcaggatgtgatcacctggggcgccaacgaccgcgggcagtgcgggcacggcgagcgggcggagccggactgggtcaagccgcgcagcatcaagatgttgcacgacctcatgatcacgcaggtggtctgcggcgcggcacacacgctgtgcgtcacggggaccagccaggtgtatgcctggggcgccaactcgcgcggccagctgggactgggcgatgtggccgaccggcgcacgcccaccctggtggacggtctctgggccctgcccgtgctccagctgggggcaggtgaggtggagtggcggggggagtgcgtcttcgtcgaagcatgtgtctgggtggtgtggttgcgaggcgctgagcgagagtggggagaacggggcgacggatccaggcgtgtgcccatgcacccgactcaatgcccccccccaaaaaacaaaaactcacaccaggcgacagcnnnnnnnnnngtgaggtggagtggcggggggagtgcgtctgcgttgaaggatgtgtctgggtggtgtggttgcgaggcggnnnnnnnnnnnnnnnnnnnnnnnnnnnnnnnnntgttcacctggggcgccaactgccagggccagctgggcctgcccgcggcggccgaggtggcggcggccgcggccatgcaccgcagcgccagcgagcgccggcgcgtgaaccggcgcgtgaaccagcgcttcctcaccgccatgctggagatggaaatcccgcaggaccgcgccgagctggccctgcacgagactgggaacgtgggcgtggaggtggcggcggagtggctcttctccgtcccggacgacgtgctggagacgcacctggccgccgacccgggcacgcccgtggaggagctgggcgaggcccaccccgaccgcgacgtgctggtgcccaagcgcgtggcgctgagcggcgtgcacggcgtggcctgcggcgcggcgcacaccgtcgcacacaccgccgacgaggtgtacgcctggggcgcgggcggcgcggggcagctgggcctgggtccgcatgtgctgtcgagcacgctgccggtggcggtggcctcgctggcgggggcgggggtgtgctgcgtggccgccggcgcggcgcacacgctcttcgtcaccgccgacggcggcgtgctgggctgcggcgacgccagctacggcgcgctgcccctggcggac

SEQ ID NO: 4504 - DNA, 1527 bp, Chlorella protothecoides
  modified_base (448)..(457): a, c, t, g, unknown or other
  modified_base (772)..(781): a, c, t, g, unknown or other
atggggcctccatcgcggtctcagggagagtccagggccagggatggccgggagggagaggccggtttctccggccgactgcccaaggatgaggtccagtactacgaggagatcgacaagcagctctcccaactggaggatggggaggagcagaggctgctggctgacaacgccttcgagcaggccggcactcagatgatagaggcgacgggagatggcgtggtgagcagagtgcttgagaagctcatgccccacgccagcacccaggccctcatcgacatgctgacggcccttacatccggagagaacctcgttgccgtctgcactgggtgcgtttgggttgatgtggggggcttgagaatgcgacgggtgggtccgccgtgtgacttgcatgcaacgaggatgggcagtcggagggcacccttcccctcccatgtggccgagaagnnnnnnnnnnggaccaattggggttcatggtccgccatctcactgctttcagtgctctgcgtgctgaaagatccatctgaccatgtcttgcggcagggcacccttcccctcccacgggccttgctgattcagatccggcatcagttggacgacgccctgtacagcacgacggagtcagtgtgcggcgacctgcaggcggtcatcacgacgcggcacggctccttcctttcccgccgcctcctcagcgtgctcgtggggcgggacgtgacctccggcccctcagccaaggcagcgccaggtccctcagtagccgggggggggtcannnnnnnnnnatcctgatcctgctacagagccgggctcgcgccggggaagccccagaacagatcgagcagccaaggcatcgccaggtccgtcagtagccgggggtgggtccgacgcggcggcgccagaggtcgaggaggagaagggtgaggaggcggcgcccaagcggcgcaagacggtcgggggcctggcgagcaagctggagagggggagcgacacctcggccgcggcctcggcgggggaggtcgatcacccagaggcgctgcagggcctgctggcctccctgctcaccgacgactttgccgtggaggcggccgccctgtgccgcaacacttttgccgcaccttttctccagtccctgctctgggcctgcaaggacaacgagtgcgtctgcttggggtatgggtttgggcgtgggtgctcgggggtacatatttaccctccccgtgttggcgccatgtgtggaggttgtagggaccggggaacaggcgttgggaccggtgcaccgtcttgcagcaagacaaggacagtcacagagacgaccgctccactcgttgtctttaaagcaaatgcaagccccgcgcctcaagcgacaaaccattccttgtcaacgggccaccctccccccgcccgcctgcctccgcagggaagccaccacgcagctagtcagctgtctgctgggcggcacgatgctcaacgtgaccccagaccagctgcagcagatgatgcaggacaaggtggccagccacgtgattga

SEQ ID NO: 4505 - DNA, 546 bp, Chlorella protothecoides
  modified_base (39)..(48): a, c, t, g, unknown or other
  modified_base (229)..(238): a, c, t, g, unknown or other
  modified_base (337)..(346): a, c, t, g, unknown or other
atgtgctgtgcctgcacccttaccggaggttatgatccnnnnnnnnnnggcatgtacttgggggcctgggtgggtttgacgacagatgttctgtacctattgctaagagtctgctgccttgggtcaaatgctatgcctgcacccttaccggaggttatgatcctccacaggaactcaccgacagactcccattccacagtgtactctgtgaccatctgccggcagcctnnnnnnnnnnatggtgttccagaggtggggccttcctcacgcgctgatccggccgcggaggagcaggatgaagggaatgcttcccttgccgaggagtttgctgtgctgnnnnnnnnnnatctatgcaagcacatcctgtttgtgatgttgagagttctgggtctcaagagttctgatccccttgtgtggcagcgagccctgctcacagatgaggtgaggcttgcgacgctgaaggggaggcgagtgagggatttcaggctggcggaaagtgaggaaattctttgttgtcacagccattacgagtgtcctgacaggtag

SEQ ID NO: 4506 - DNA, 453 bp, Chlorella protothecoides
atgctgagtacgggcgcagcctgggcagacagcgacgttggagggggacccccggtgccccctcccccctttccccctgctgtgacgcagcagcgtccctcgcctgccacccccttagatcaggccactggcctgacacctgagcagccctctgcacctcccttggtggatcccccctctgcatcggggtcaaaggccgagactgcaggcaccagtgcggcggcaccacctgaggctgcgaccccaaccccggcagaggaaaccccaaagcccagcaagaagaggaggcggtcacgcctgggtgagctccaggagatacggcaacagctcgctcagcgggagctcgagctgctctccaaggagagatcgctgtcggcgcgggaccaggacatctccgtcctgcaggaggaggtgagctcgtggaaaacgttcagccagactgcgcctcgctga

SEQ ID NO: 4507 - DNA, 372 bp, Chlorella protothecoides
atggtcactgggcgccgaaccaggagcatgccgcaggcagctctaaaacttgagtccagcctccctggcggcgtcggccagggcctgcaccctcccgtggtacaggaacccgccacggtcgaaggccaccttctcgatgttgcgctggatgcacacctcagccagcttcctgccgaccagcgtggccgcactgacgttgccgccgtgcgagagctctgcgcggatgtccggtgtgagggacgagatggatgccagggtgtgcccctcagagtcgtcgatcacctgcaggacatgcgtgcgggtgtggtgacggacgtggcgggctggaagacatgcagtgcccagaggtccccaccgagttggaggctttga

SEQ ID NO: 4508 - DNA, 495 bp, Chlorella protothecoides
  modified_base (243)..(319): a, c, t, g, unknown or other
atgcagcaggctcagccccgcctggcagggttccagggactggtgtcctgtcggcacatgagcctggcctccgtgcagcccgcagccacattctgctccgcaggtgatggaaggtttatacgttgttttgttcaagtatctgtctccaccgcaaaagatcatcctgaccgttgtcctgtgtcgccttaccccgcagtactccccgcgaggtttgcggtcgaggcaaaggcgaagacgaggcannnnnnnnnnnnnnnnnnnnnnnnnnnnnnnnnnnnnnnnnnnnnnnnnnnnnnnnnnnnnnnnnnnnnnnnnnnnncacaagcccggctgcacgcaggacctcacagtccagttgcacagtatgaccaggtcacgccctggtcccctccccacatgcctgttcaccctattctaatgcaggtagagggcacgactgagaggccgaggctggcggtcttcaggtccttgaatcacatttatgcgcaggtctga

SEQ ID NO: 4509 - DNA, 423 bp, Chlorella protothecoides
atgccgtccgagatcctgcactgtacgcctcccgaggacctttgtagggcccctgagaaggtggcctcgtggcacgcccttcccgtggtgccccgcaacccggtgccaaccctgcaagccctgtttgaggagctccacgcagccttcgaggcagaggccagccagggcatcatcatcgacaactcccagcccgcagcctcattcgctcggctgaacgcgcgggtccaggcactgctaaccaggtacacacaggagggctcctccgactggcgccggtatgctgccttcaacagccaccactacatacgccacctcatcgaggaatctccccactttgagatcctgcccccgcgacctgtatggcatggcccgcctgcactgaaacctggtcttgttgggaatgccgccaactttgcagattga

SEQ ID NO: 4510 - DNA, 768 bp, Chlorella protothecoides
atgtcactctcacccctggattccccttccccccaacaggtcctggctgcctcggtggtggaagacgaggtgagcaaggcccgtggcttggtcatcctcgacaacgaggcgtgccggcgccagcgcgccgcgctgcgcacgcccgccgcccagggcctggcggagcgggtgatggacctcgtggcagcggtgacgcgcggccagggctacaccgccggcacggtgcagctgttgggcgagctgcgcggcaccacgcgccgcctccgtgcgggcctgcacgccgcgctggccggcgccggcgccgacgagctcaactacgtgctcaccgccgtcaacgcgcccgcgctgctggaggtggtggcgccggagacggtcaccgtgctggtgcgggggcgtgtggcggcgctgaccaccgtgtcgcgctccgtcctggtcgacgccttccagaagctgggcctgcgccaccgcacgagccgccaggccgcagtgcgcgacgtgctgctggccacgcgggggctggacctcacccgcctcaaggcctacatcgacgacggcggggactaccactcctgctacaagctcatgtacaacgacctgcaggtggattggtggggtgggaggaggggggtgggtgaacgaagggggctggggaggggagggccagggctgactttctacggattcgggggtctcgcaagcatgcatggtcttgggagttggaaactcgtggacgggcatgcgcttgggcgccatgcagaccgcgcgtag

SEQ ID NO: 4511 - DNA, 369 bp, Chlorella protothecoides
atgcgcacggtgaagggcatactgaacaagctgacgcccgagaagttcgagcgcctgctcggccagttcatcccgctgatcagcaattacgaggtgctgcaggccaccatcatccaggtgtttgagtccgcggtgcaccaacccacctttgtggccatgtacgccgacctctgccgcgagctggacgcggtgctgccggagtttaacgagccggacactgggcgccccaccaacttcaagaagatgctggccaacacctgccaggaggagtatgagagcaccgagtcggcacgcgcgagtcgggtcatggatctcgctgttgagcaccgcgcgcaccgctcctccacccatcaccgccccgggcagtag

SEQ ID NO: 4512 - DNA, 213 bp, Chlorella protothecoides
atggcgctcggcggtgcggaaagtagttgcctcattgacaaggcgccagcaacccgccctcgacgttcactccttgtcagtcgcaccgcgcgccgggtgttctggtacctcctgagctgcgccctgggcctgtggctggtccgttggctgcagacgctggaggggatgagcatgctctgggtcttcctgtctgcggtgaggctgctgtcgtag

SEQ ID NO: 4513 - DNA, 525 bp, Chlorella protothecoides
atgatgaggggttgttttggactcgtcgagcacggcgagcggacgggtaggggcgggaggggatcaacaccccggcccacagcatgcctgactggcggcacgggaaggtgcatcacgggacaacacttgtggtttggttggaagcgcatccttgcagacgcatgcatgctcaggtcgacagcatcccgagaagggccacccactcccctccctctccccgccaccaccccccaaccccatccaccccacgcccccccaaagggcatcacgagactggcggtgcaccccagtgagccgctggtcttcacggcgtgcatggacggcgcggtgcgcgcctgggacgcgcgcagcgggcgctgcaacgcctgcttcaggggccatgaggccccagtgcaggacctggccgtcagccccgacgggaagctggtgctggcgggggcggaggacggcgcggcgcgcgtgttcagcctggaggagggcatcgcgcgcatggtggcggagcaggggcagcggccggagccgtga

SEQ ID NO: 4514 - DNA, 843 bp, Chlorella protothecoides
atgaaagaagaccatcgaccctgcaccccactcctcccccccacttccacaggtggccgccaaggcgagcgggcccgagcgcgaggcggaggagcgcctggccaagcagcggctgctgggcaacatccggctgatcgcggagctgttcaagaagggcatggtgaacgaccgcatcatgctgctcatcctgatggacctgttgggcaccggcgaggccggccccgacccacccgcggagtccatcgaggcggccccgacccacccgcggagtccattgaggcggtgtgcgagctgctgagcacggcgggggcggcgctggaggccggcgccaagagccggccgcggctggacgcggccttcgccacgctgtcaaagctggccaatgcgcggggctacccctcccgcatccgcttcgtcatccgcgacgtgatcgagctgcgcacgcagcactgggtgccgcggcgcgaggcgttcacggccaagaagctggaggacgtgcgcgccgaggcggcggccgagctgggcctggacgtcaacatccctgggctggacgggacgggggcgggcggcgcgctgggcgcactcacctcgctggcgcccaagcgccccgaggagctggagctgttccccgccttccgcagcgacgatgcggggtgggccgccgcggcgcgcggcgcgggaggcgcggcgggcgagggccgcttctccgccttcctgggtgagtacgtcgccgtgcagagcggcggcgccggcgctgaggccaagcccgcagcggcggctgcgggcgcggtgcgtggttgtggtggcggtggttgtctttgtggtggcggtggagggctgtaa

SEQ ID NO: 4515 - DNA, 708 bp, Chlorella protothecoides
atgccaggcagcgcctcgttccggcgctcaccctcccccttctccccttcctcgccatcctccaggacgccgatcgacgtcacccccgagcggcgcgaatcgctggccaagtccatcttcaccgacttcctggccgacggcagctttggcgaggcactggctgcggcccaggacctggcggtgcccggcttcatgcgccggctggcggagatcgggctggcccgcgcctacgacgcgcgcacggaggaggagtggcgcgcggtggtggatctcctggtgcggctgggcgcggcggggcaggtgcccggtgccgacctgggcgccgcggtcgccggcctggccccgcgcctggaggacgacgccatggacttcaggtttgcgccggccgtgctgggcaccctcctgggccgcgctgcggcaggcaagcagctgggtctggacgtcctggccgccgcggcgggggcgctgggcctggacgccctggacgccgcggcgggggcggtggagtcggccgcgccgcggcgcgggctggtggccgccgcgctgtgcgcgctgcgcgacgaggtgggcgccgagcgcctggtgcctgccgtggccgaggccgggctggacctggcagcgctgctggcctccgacccggagtttgacgacgagctgctggagccggccgcgttcctggccgcgcaggggctggacgggctgctctga

SEQ ID NO: 4516 - DNA, 378 bp, Chlorella protothecoides
atgactgatcagaaggtgcagcgagccatcgtcttccgcagagttggagacccatccgtgctcgaagatgttagagactggcctgtacctgttcccagcaaaggccaaatcctcgtggcggtgaaagcggcgggcgtcaaccccgttgacacctacgtccgtggaggcaaggacatcccgaaattcatcatcaagacgccgcaggtgtctggtggtgactttgcggggactgttgcggccatcccagagggcacggtgacagatttaaaggtcggcgacagagtgtacggtctggctgatggttgggcgccctggtcgagagacggcacgtacgcgcagtacaccgttgtcaccgccgccaacgcggcacggattcct

SEQ ID NO: 4517 - DNA, 984 bp, Chlorella protothecoides
gccgggagcggcaagcgcgtcttcatctcgtccggtgccggaggggtgggcacctttgccgtccagctcgctaagcttcggggcctgcatgtcaccacctccgcctcgcctgccaatgccgacttcctcaaggtggggttggggggaaggtgcatggggagtggagcgtgtgccaggggtccccaggttgtttgcaagttgggaaaatcctcactgcaatacagccctccttctcatcacctttctcacaggaactgggagcggatgaggtgtcccaggcaccgtcgcccacgcgcccctgaacgcctcgaccaacggctcccaccacctgcagggaaagagcagtgggagctgcgcagggtgctgaagcgccagggcgctctggtggacatcatgaacaacgggtacctgcgtgactacggccgggcaggccgcctcgtccagggttacagctacctgcgacagtgcgtgggatgcttgtgcaggggtccagaggcggctgtgcgtgtgtgtgtggtggtgaggggaggagaaacctcaaggcgctccatggaagctgaccgcggctgtccgcctgggcccttccatcacgcctttctttgtcaaggcgcatgggcaggacctgacccagctcgtcggcttggtggcggaggggaaggtgagggtcgtcatcgaccgcacgctccctcttggcgaggctgcagcagcccacgactacatgaccaaggggcacgccaagggcaaggttgtgctcctggtggaggaggacaactgaagggagggtcacatacagagtgcacaagaggcacttgcatatgcaagcccgcaagggctctcccacccaacctgtacatccacggctcaatcagtggtgctcaagtgatgattggcatggtcccagtcacgaggattggtgcacagcattcacggattgcatcacgactagattcttccttcccacgaccatctgtatatcatgactga

SEQ ID NO: 4518 - DNA, 3519 bp, Chlorella protothecoides
  modified_base (1409)..(1418): a, c, t, g, unknown or other
  modified_base (2676)..(2685): a, c, t, g, unknown or other
  modified_base (3040)..(3049): a, c, t, g, unknown or other
atgaggttgttactcatacagggtgtggttgagtgttggtgtgggtcgggcgcgagtctcgttcagggcgccccatcatcacggagcctcatccagaaacgttgcacccgtggcacagcatgcactcggattgtgcaggggtgcattgcagcccaaaacttgccatgcatgagggtacatcatctcaatttacctccatccacctgccaaaatggtggcggggctccaagcgatggcctcccggcctcttgcgccgggccgggtgatggtcccgaccaaggccctctgcttccgaccggcacggctcggggcgcaggcacccatgcccttcatcatccgttccacttcccacgtcacgaggcgccctcgcattgccatctgccgcgcggacgcagccgtgggagaggtgaggagggggtgttgtgtacagtctttgctggggtccaggcagcggtccagcgccccatgccccgcaccgtgcgcggtgatgctcgaccgagggtgcccccgcctctcccataccctgtgcagaaccccttcacccagccgcgccccgtccaaggcctgccagccaccctcttcggcctccccgtcgccggagtgtacgccctgggcgccgcgctggccgccgcgctcggcttcggcggctggtccctggccgcccggctcctccctggtgcgttgatgcaagagaggagtacccgggggtcctgtcttgaggctggcaggcgacggtggggtcgctgggatcatgctcctcttttcatacgcacccttggcccgtcgctgcgcagcgtcgggcggctggtggctgcggcaatcggcgccgctctggccgcggccgtcacctcccgcctgctgacgctgcgccgctccgccgccgtggcgcagctgcacaacctgctggtctccctgccccgcgcctccgacctcacgcgcgaccaggtggcggcgctggaggcccaggccggcgcccccctggccgccatcgaccccgaggccgtcaagtcgctgtacggcaccttcatcgaggccaccatccccgcgggcgacgcccccctgcgcggcgacgagcacacccgcatctcggccttcaagcagacgctggggctggatgacgaggcggcgggacccgtgcacgttgacgtcggccgccgcatcctgcgcggccgcctggaggcgggcagccgccgcgaggacgtggaggcacgcaaggtgggctgtgatggggtggagtggcgtcgggaggggtgggtgggcatggcgtggaggatcatggggtgggcccatgggaccaggtggggccgggtcgcccagatgacctcatacagcgttctggcaatcctttcgggtcgctcggctgcctgcagactcgacggcatcgagtcagaggggtcagtgaacgccgnnnnnnnnnnaaaggtgggctgtgatgggtggactggcattgggaggggtgggtgggcatggcgtggaactcgacagcatcgagtcagaggggtcagtgaacgccgcgctacacccctccccctccatccgctgactcccctccctgtggagcacaaccacgcatccattcccacaccaccaatccacccacaccaaaacaaacaggccttccagaaactgatctacgtctcctaccttgtgtttgcggagcggtcctacctcacgccctgggcacgggccttcggcctcaccgacgcccaggtgtacgtcgcgcggcgcgacaacgcgcgcgcgctgttccaggccgccctggcggcacgcggcggcgtgctggtgccgacgcaggaggcgctgacctcgctgcgcgaggtcaaggagtcggtgcgcctggcggacgaggaggcggagggcgtggtgcgcgaagccgcgcgcgccacgctgcagggcttcttcgaccgcgccctgtcggtggtcaagcgccgcgcgcgccagcgcgacctggcggaggcggtggccgagctgcgcggcgcggtggagttcaaccgcgcgctggcgcggctggcgggcgcccccggcgtcgtccccggcgtgggccccacctcggtggcggggtcggagtgggcggcggccgaggggcgtggccgcgacctccgcgacctcttccgcacctttgtggaggaggggctggcgcgtgacggcgcctacggcgcggccgagacccgcgacgccgccgacctgcgctccgcgctgggcctgggccccaaggaggccgcgggcgtggaggaggaggtgaaggagcgcgtgtaccgccgccggctgcgggaggaggtgaccagcggccgcctggacgccgcgccctcccccgccgcggtcctgggcgacctggtggagcgcgtgggcttcgaccccagcgccgccgccgcgctgcacgcggggctgtaccgccagaagctggcggcgctgctggagaagcgcgcgctgtccgacgccgatgcgggggagctggaccgcctgcagcgcctgctctgcgtccccgccgccgaccgcgacgcgctgcacgccgagctggcggggggcatctactcccagaccctggacaaggcgctggccgcgggggccgaggggttcggcctgcgcgagcgcggcgctgtgcgcgaggcgcgccgcgacctgcgcctggacctgtccgtcgcgcggcggctgctggcggcgggccgccgccccccnnnnnnnnnncgcgcgccgcgacctgcgcctggacccgtccatcgcgcggcggctgctggcggcggccgggcgccgccacctgctccagttcatcaccaacgcgcgcaagaccaagagccgcgtggacggggccaaggagctcaagcgcatggtgcttttcagctcggtggtgctggcgccgctggtggacgacctgcgctcgccggaggagcgcaccgcggcgcgcgaggcggaggagcgcgagcgccgcgtgcaggagatggtggccaagatgcagcgcgacaaggcggaggaggccaggcgccaggccgttgctggtgggggggagaagacggcagaggagggcgtcgtggacgtggaggcnnnnnnnnnnccgctgctgggggggagaagaaggcagaggagggcgtcgtggacgtggaggctgccgaggtgaagactcccggtgatgagccagagaaggcagccgatgccggcatggaggaggcggtggcagcggagaaggccgagcccgtcgtggccgaggcaaccgaatccaccgccgacggcgcgcccagctcgctgaagaaggcgcaggcggcggccgactcgcgcaaggcgggggagaaggtgggcgaccagatcgtgtacgcccagaaggacatcaccctggccgacgacctggacctgagggacaggtgcctttatttaggtgtttgtcctgggggagggagcgtaccggatagcacagggccaagggtgtgccggcagacgacccggaactgcttgggtccatgtatcgcaagagtcgtcagccacaccgcccggcctctgatgcgcttcccgacgctggggccgccttga

SEQ ID NO: 4519 - DNA, 1125 bp, Chlorella protothecoides
atggtcatcggtgagtggatcaagtgtggatgcttgttgtccaccagtggtggatactcctgcattcctgcaccgcgccagcgccgctgcgctgtgcgcacctccccacagacggggcgtgcaacccagcgcgacgagagcgagtttgcgcgcctggcgcagctgggcgatgtgctggggctgacgcaggtggaggtcgccaccgtgcactccgacctggcggagcaggccttcaagagccaggtgcagcaggtgatgggcgagggcgccctgaccccggaccggctggcggggctggaggcagtgcgccagcgcatggggctgcccaaggagaccgcggacaaggtgctcaagggcttccagaaccagaagctgatcgccgggatgcaggtgggcagtccgggtgggcgggcggtaggcgggtggcttggggctgccaaggcacagggccagctgaccctgcccttcctgctggagctcaaagaggcgggggtggacgtcgcctccctcacctctgccgacctgcgcctgcagctgtaccgccaggaggccatcgcccgcctgaccgacggcaccggcgagtttgccacggatcgcattgtggaggagctgccggccgccctgggcatcgaggttgggaaagcgcggaagctggtgcaggagctggcccgcgaccggcgacggacgacgctcgtccagcaatatcgggacgatcagcatgcctttgcgatgtggaggaacaggctggcccgagcacctcgtcccctgtcccttctcttccttgctttctcactcacccgacacacacaccatcacaccctcaacccccaggcagtttccttcctgcggcaaaagaagtatgatgacacggtcaaggcgctgaacaacctgctggccgtggagaaggccgcgccctcggacgccccgctgtcctggagccccgcggaggagctggcggacctgtactcgctctacgtctccaaggaaagcgcggaggagaagcgtgccggtgtgcaggcctgcctgggcctggcagacggcgacgccgctgggctgagggccgtggtggaggccggcaacttcaagctgggccaggagaccgagtcggaggcggccttcttctga

SEQ ID NO: 4520 - DNA, 522 bp, Chlorella protothecoides
atgtgggcgctttactacctggagcggggccgcacgcccgaggcgctgttcgcctacgcccacgcctttccccccggcccgcccacctccgagccccaggcgcagctggtggcgctgctggaaagggcggcgcgtgacctgcccaccgtctatgcctccctggtcgtgcgggttgaccccggcgccccgggcccctcgctgcggccgctgagcggcggcgacgacgagcagggcgcaggcgagcgcacggacgtggcgctgggctttgcgctccccacgccggcgctgccgggggccgggcggaggctgctggcaatggggccccgcctccgggactgccccctggtgtgcctgccggagcgggtggcccggggaggggagggggaggaaggcgcgggggaggacaggctgccggtgtggcccgacctcacccaactgtcggccaagctggtgggcgccgggaaggagggcggggggcgggaggacggggggcgggcgcccatgcgcattcccgtgccctag

SEQ ID NO: 4521 - DNA, 462 bp, Chlorella protothecoides
atggcgttgggcatggaccacggtggccctgtgaacgatctagggaaggcatggcccaacctccgcacacctccctttcatctcacaactccaccaggcaaggagctggaggagcggctggctgctgaccgtgaggagaacgggcgcatgccgacgctgctgacggtatcgtggagccgggatgcaccccccgccctggctctcgacggatgggcgcgggtgcccagcgtgcccagcgtgtcgaggtcctgcgccctgcgccgccccgaggccgcggcgatggccgacgacgccgccgccctggtccggcgctgggcatccgtgcagccgccaggtgggatgggagggcgcgagtgtgtgttgggggggtgggatggaggaggcgttgcccggggagatggtgggatgagcagccggaatcggtcaatgtgtggcttgcatgccctagcgctccgtccctga

SEQ ID NO: 4522 - DNA, 363 bp, Chlorella protothecoides
atgctgggtggaaagtacggcgcgagcctgacggacgccctgggcgtgaccacggccggccagctggcggcgctgccgcggagccggctggaggcggtggcgggagaaaaggacgcggcctggctggtggggctgtgccgtggagtggacggggaggaggtggtggaacgccgcctgcccaagtcccagtcctgcggcaagacatttcggggccgacgcagcgcgcttgccgacctgaacgctgtccgtcactggctgggggagctgggtgggttgcggcgtgaggaggggcaagggggggcgggggaatgtggagagctggcgagcaggagacctgtgtggaaggctgatgctggattgtga

SEQ ID NO: 4523 - DNA, 366 bp, Chlorella protothecoides
atgcaggaggtgttgcgcaagaggatggatgctgaggtgcctcgcaaccatctggatcttcgtcacaggctggacgctcagggaaatcggtatggcaaggtcatcgactacaagtacgtcggcggggcctcgctactgcccgtgaggggaattggccatgcctgcctcctacaagaaggaatcagagggttaacagcgcagcaacagctcatcccattcccactgccctctcccaggatcagcgagcttaggagcatcgagctgctggatgatctgtgtgacgacctgaagaaggactatgactacaatagcacatctggtgcctgggagagcacgagcgggaagcctgccagcggcgacgggtga

SEQ ID NO: 4524 - DNA, 357 bp, Chlorella protothecoides
atggagtcctcctttgccatggcagggactcacagagaggacagagacgatgagctccttgcccgcctcaaagtcggccttgatctggaccgccagcttctcagcctcgtcggtgcccttgggcagggtcaggtcgtccttgaggtcgccgttctcctgcatcagcgacacgaagccgtcgtcggtgacatccagcagggtgtagtctgtgcgggtgacgtggggcacgtcgcagttgtgggaggagggggtcaggtcctccatcttcttgccggtgaagatgtcgatgcccacgaacacgcacttagcgtgaccatgcttgccggtcttggaggtggacacatcggcgacctgtga

SEQ ID NO: 4525 - DNA, 543 bp, Chlorella protothecoides
atggaccccgagaagctggtgcggctgcgcccctccttccggcccgagggccccgacgcggcgccaggcacgatcacggccggcaacgcctcgccgctgaccgacggcgcggcggcgctggtgctggcctccggcgcggcggtcgcccgcctgggcctgcgcccgctggcccagctgctgggcagcgccgacgcggcgcgggagccgcgcgagtacaccacggcgccctcggcctcgttgcccaaggcactggcgcgcgccggggtcgccgccgccgacgtggacgcctgggagatcaacgaggccttctccgtggtggacctggtcaaccgccggctgctgggcctggacccggagcgcgtgaacgcgctgggcggcgccgtggccctgggccaccccatcggctgctccggcgcgcgcatcgtggtcacgctgatcaacgcgctgcgcagccgcggcggcaccctgggcgcggccggcatctgcaacggcggcggcgggtccactgccatcgtcctacgcctgatgcctcaggcggagtga

SEQ ID NO: 4526 - DNA, 249 bp, Chlorella protothecoides
atgcagcaatggaggggtctgggtgggggcaagggtaggtgttgtccaccagggcgtggggaggtcgggcgcctgggaagtacacaccttcgccggttgtcatcctgccagagccacccgatggaccatgcctcggcgcccctggtggtaggcctgacaggcggtataggaatgggcaagagcaccgtgagtcgcatgctcgagcagcgcaacgtcccggtcttggatgccgaccaggtgcgggtgtga

SEQ ID NO: 4527 - DNA, 531 bp, Chlorella protothecoides
atggtgcacgagctgtatgccgcaggcgggcttgctgtggagcccatcggtgccgcctttccgactgctgtgacgggcggcgccgtcgaccgcacggcgctgagtgcctgtgtggtcggcaaccccgccgctctgaggcagctggaggacatcgtacatcccctggtaaaggcccagaggagtcttggactaaggcgggccgccgagtggggggcggaagccgtggtcctggacatccccctcctgtttgagacgggggccgaggcggactgcgacctcacagtagccgtcagcgcccctcctcacatccagcgccggcgtgtcctctctcggaagggcatgtcgccagagaaactggcttccctgctggctcggcagctgccagatgcggagcgatgccgcaaggcaaacgttgtcattgatacggggtgcagcctgaaggagacggagaagagcatcgacgaacttgtaagcacctttccctcccgcacccgcaaggcctactcaaaggtctccaccgacgcagggtga

SEQ ID NO: 4528 - DNA, 1107 bp, Chlorella protothecoides
gcgtggacaacaacgacagctatgaggagctggtgcgcttcgtgcacaccgtctccactggctcccccgtcacacacttcattgtgcatgcgcgcaaggcccacctgaagggcctgaacccgcaccagaaccggacgggcctgaatccgcaccagaaccggacggtgccgccgctgcgctaccaatgggtctgggcgctggcccgcgacttcccccacctctccttctccctcaacggcggcgtggcggggttggacggcgtggtcaccgcgctgcgcgccgaccccggccccctcgccggggtcatggtggggcgcggggcctaccacgcgccctgggacgtgctggccgacgccgaccgacgcgtgttcggcgggtccaacgccgcgctttcccggcgcgtggtgctggacacgtacgcggcctacgcggacgccatggtcgggcgctggggctccaagcccgacggctggcgcgcgcccagcctgcgcaccctgttcaagccggtgctgggcatgtttgcgggggagccgcgcgcgcggcagtggcgcgccgccgtggacgccgccttcaagcagggcgcgggcagcgtgcggggcgtgctggacgccacgctgcacgtgctgctgccggagtcgctggacgccgcgccgcgggaagagggggacggaggggtggcgggaccggcgcatgaggcgctgcgcacggtgcagcactgggagccggaactgccgccgacgccggagtggcttgcggtggagcgggagctggggcgaggggccgcggagcgcgaggggggcatgccggcagccgaggagggcaaggcaggcagcgcgagtcaggacagcgccctgaccgccgccgacaagagcgaggcagcaaacttgcgttcaggagcccagccaggtggtacggggtcggagacgtcgacgagcggaaacctggcgcagggccccgcgccggcaggtggagccgccacgcccggggatcaacagcagcagcaggaggaatctggcgctgcctgcaaagatgacggagcgtcgcacgacgagtcgtgggtgctggtggagaagcagacatctgtgccattacagggagcggcatcat

SEQ ID NO: 4529 - DNA, 1068 bp, Chlorella protothecoides
  modified_base (666)..(675): a, c, t, g, unknown or other
  modified_base (882)..(891): a, c, t, g, unknown or other
atggggttctccctggtcatagtaccccatccggggcaggcggcagtgaacaccgtgtccctgcgcctcatcgtcaggcgagtctcgggaccctcgccgcatggggttttgggcgaggtcggcactgaatgcacgggcgccgcttcttgcttgcgcaccgcacctgcctccttccccttcctcgttccatgcccagctgaccgttggcccccattacacactcccagctaccccactgcctaccccgatggagccgtggagctcaggctcaaggacgcccagggcctggagccgcaccacctccaggccctcaccaagacgctgctctccctggctcgcgagcgtgcctctgagggggccatcgcggggttcgacctcatccaggcggcgcaggagatgctgcagggcctgagcaaatccggggtgggcaccggggaagagctggactctgagtccgggcggggcccctcgccaggccctgcgccacccgtgcaggagccgggcttggccgcggcctcggagccggcagcgtcctccccgcagcaccccttcgagctgttcgactgggcggacggcgacctcttctccacctcgctcttcgacgggctctgggagggagcggccgcagcccaggtccccctgcacccaccggcgcccagccccccnnnnnnnnnnccccttcgagctgttcgactgggcggacggggacctcttctccacctcgctcttcgatgggctctgggagggagcggccgcagcccagatccccctgcaaccaccggcgcccagccccctgcgccccgggcgcgaagcccagagccctcaagtgcgaccgtgtgccttgggtgcagcccttacttgtgtccctctgcgccagacctnnnnnnnnnntgggtgcagcccttacttgtgtcgtctgtcctgcttgaatcttgggtcggcagggcgcggggaccgaaggttgggatgtgtgggagaacggttgggacgtgtgcgatgaacagcctctgcgccagaccctgccacagcccttacacccagccagcttcactcataactgcgctctga

SEQ ID NO: 4530 - DNA, 1056 bp, Chlorella protothecoides
atggtcaatctcccagcgttcagtgcaacaacgtacgagcaccgccgtgtagggcagttgatcaaggtcaagcaccccgtttcgtcactagcccagccaccagttactcgcttcagcctgcctctccaggcccttccgtcgcgcaccatggagaccccacggcgggtgcctcgtggtcctttcatcatgccggatggcacatccctggccgccttcatgcgcgccgaggagcctgtgacccggcccaagcgcagcaagccgcaggccccctcccgcgaatgggtgtccgactggctcaccacctccggctcccagcccccctccatccccgagctggacgcgctgcagaggattggtcagagacggcagcggcgctggctgaacaaccgcctgctcctggccctggcggggcggctgaccgcggccgacatcgagggccttttcaagccggtgccctttggcgcgccgcgcccacccacggtctgggagacgctggcggaggagcgatacggggcgttgcgcgagtccctgcgcagcctggaccccgacacccaggcggacctgctagcgtcgctggcagaggcaggcgccgcccgcgacgacggcgaggccggcgagccccggctcagcgtgcagggtgcgggccagcgcgcctggtgcagggtcgcgcggcgcggcagggctgcgctgcgccagcccgtggcggccgccgtggtggccgacatggaggacagcatcggtggcttcctggcccagcccggcgccggggacgagcttgtgtttgaggggctggatagcttcgggcgcctcctctgtcacagcctggcggagttccacggtctcagctccacgagccgggcggacgggctgggggccaaggcggtggtgctacggcgcgagggccgcggagaccaccccgccccctcctgcacagccctcttgctgatgatgcagggggggccgggaggctcggggacccctgacagccagggtttcgcggcaaatgcagaagcaggacgctccttggtgtacaggcctgccgtcctggcggcatga

SEQ ID NO: 4531 - DNA, 891 bp, Chlorella protothecoides
  modified_base (90)..(99): a, c, t, g, unknown or other
  modified_base (151)..(160): a, c, t, g, unknown or other
  modified_base (212)..(221): a, c, t, g, unknown or other
  modified_base (396)..(426): a, c, t, g, unknown or other
atgtcgggagaagaaagtcggagttctccaagggccctcccgatcccgtcatgcaccttccccacccgccgcgcacacatgcgctcaacnnnnnnnnnnggcctgggaatcctaggggcctgtgcacgggtggcagatcgccatcatggannnnnnnnnnagcctgggattcctaggggcttgtgcacgggtggcagatcgccatcatggannnnnnnnnngtgggtccgatatgtcgggagaagaaaggcggagttctcccagggccctcccgatcccgtcatgcacctaccccacccgccgcgcacacatgcgctcaacaccttgagctcgtcctggaggattgacagattcaaattacgcagtggctgcgagtatcaagtgatcagaatctgnnnnnnnnnnnnnnnnnnnnnnnnnnnnnnncttccttgcaggtgtgatcagattctatatcaagtaaaaggaggactccgcggcaaggactttgtgatggtgtgcagcgatacaaatgcggcgcaaagtatagtgaccatgaagtcggatgaggacaagctggtcccgatagactcccacaagctgttcgcgatcagtggcgaggcgggtgaccgtgtcaacttcagcgagttcgtgatcgccaacgtgcgcctgtatgccctcaggaatggcatccctctcagcaccaaggcggtggcgaacttcacgagaggggagctggccacggcgctgcgcaaggtgggtcacccaggaggcgtgcggatcccacccgtgtgcgggagttgctggagcacaggagcatgctgtctcaccaggaccctttgcagacaccatggagtccatcaggggctaccaggagccatggtgcatgcccctgggagccatggtgcctga

SEQ ID NO: 4532 - DNA, 618 bp, Chlorella protothecoides
  modified_base (435)..(444): a, c, t, g, unknown or other
atggagcggctgggcctgccgcgcgacgccatcacctactcggccaccatctcctcgctggccaagggcaagcagtggcatgccgcgctgcaggtgttcaaccacatgcgcgacgcgggggtgcccgccgatgtcgtcacctgctgcagcctgatcaacgcgctggagcgcggcgggcagtggcagctggcggaggccctcttcctgcagatgtgctgtgtggccaaggacgccgaggtgggggtggtggcgcccaggaaggacggcaaggaggagggcaaggcgggggaggtgtcgccttcatccgtcttcgacctcctccgcgtcctgcccccgcccggcgaggacgcgccgggcgggggggaggaggtgcgggacgccggcgcgcccgcgggggagggcgtgccggggggggagccgtccgacgggacggcnnnnnnnnnnggaggtgcgggatgccggcgcgcccgcgggggagggcgcgccggggggggagccgtccgacgggacggcggaccggctgctggccgacggggaggagctggcctcccgcctgcgcagctccctgagcctgggcgacgtcgagcgtgcgacgctgggcgtgccgggggctgggcc

SEQ ID NO: 4533 - DNA, 744 bp, Chlorella protothecoides
atggcgctgaagcgggaggcggaggcgcggcgtttcgcggccatgggcgaggatgccagcgggcgcggcgcgcagaccgtgtaccgcgacgccacggggacacgggtgacgcgggaggagttcgtggagggacagcagaaggcgcggaggaaggcggagtacgaggaggagggcagcctggcctggggcggcggcctgaagcagcggcaggaggcggaggagcgggcgcgggcgatgcgcgaggaggcctccaagccctttgccaggaggtgtgcggctgcgcagcgtgacggcgctggctcacagcaggccagcctcatcgcaccggagaacgactgcctgaggcgccaccgcgccggcgtttcccagtcgtcacgcaccaccccttgccgcccactgtcccgcgacgacgccgagctggacggcgcggcgcgcgccgcgctgcggtggggggaccccatggcgcacctggtcaagcgcggcgccgccgacctggaagcccttgcccccgccctggacgcggcgctgcagggctccggcttcctggtgccccaggaggtgccgccccactcctggctgcgccgcggcctgggcccgccgcccaaccggtacggcatccggcccgggcggcactgggacggcgtggaccgctccaacggctttgaggtggacatgttcaagcgcaggaacgagctgaagagacgcgggcaggaggccttccagtgggcgcaggaggacatgtga

SEQ ID NO: 4534 - DNA, 846 bp, Chlorella protothecoides
atgccggggccgcaggcaagcggagcgccttgttgcagtcggtgcaacagagacgggtctctcctgctcaaccttttggcggggagtgtcccgtggatgtactcgagggagttcacggcagctgccctacccccccaccaagggccacacaacactgcgttcccccaccatgctaggcacaagggcgtgttccaccacaccccagagaacgatgtggggaccttgtcgctgtactatgacctgccgtggctcagcatgcggggcatgctgtaccaccccatcaagactggcgctgtcaaaaagtcggacgtgatgatggtgaggcagggtggggcgttggagtgcagcccgacgtcacagcgcagcggccatacaaggggcgactccttgcacctgatcaacaaggggcatcgtgcggtggcagacctggtcatccacttcctgaggatggaggcggcgcgcgccgcgctgggccggcagcacgtgaccctgggaggggacgacggcgcccttcccgcccccatgctcccgaacttggtggagctgcccgccgagtactgcgcccagggcgagaggttccgacgcgacgtggctcgcaacgccaccggcggcttctggtggaagggcaagggggatgagatgcgggctgtgacgcagaaccccaatgccaccctggacattcacgtggacgcctcagtgacggcgccggggtcaaaccgcacggcggtgctcctcttcacggccaagagccatgacaagattgggaacgcaggtgtgagggttgtgaggggtaggatcgagggcgaggaggggcactgtgtgaagtttgtgggtgggacagattga

SEQ ID NO: 4535 - DNA, 504 bp, Chlorella protothecoides
atgttaattgcccaccccaacacctgcgcgcagagatacgaggcccatgtttggagcgagggtaaacaagtttacctcggaggatatggtttggaagtgcaggtagggcatctctcggatgttgttttctcggcatggcaccccttggggaccctcggattgccagcgggccaagacgcccagaccaactttgatatcttccgatacagcgcggagttggaggatcataccgcgagtcaggaggaggtcgtgcaacacctgcgagcgcagagcaaggccatgaactgcgttgccaaggatactaatctcaccatggaggaatgggagctggagatatcaggtacggtccttatcaccaagtttccgacctgcggcccagcggcgagcagggttcattggtcgccaggccggcgtcccgttgtcctctccccgaggtcccatgcgtgcatggcactcttgcgagcatgcagcgtgtccacttcatcgcattgcatcgacgcatga

SEQ ID NO: 4536 - DNA, 690 bp, Chlorella protothecoides
atggcgtactcacccaggcactattgccaaccgctcagcacccccgtcacccggaagcgcagccgcgagagctccggggaggacgaggccatgcccagtagacgcagcagtctgcatgagctcatgggtatgtcccgatcggcccccgggacgcccatggaggccgtgccggagtacaagggggtcaccctccacgtgcgcactaaacgccatgaggcccacatctgggagggtcagcccgggcggcagttctacctgggcgggttcggcagcgctgccgaggcggcgctggcctacgacattgtggccctgcgcctgggccggcgcgagaccaactaccacctgtcctactacgagccctggctggacctgctggaggcccagcccctggaggatctggtgtccgggctgcggcgccagagcaagggcgccagccagcagacctccttcttccgcggcgtgacgcggcacgccaaggggcgctgggagtcgcgcattggccaggccgcggggcggcgctacctctacctgggcctgcacgacacggaggtgcaggcggcgcgcgcctacgaccgcgccgccatcgcgcagaagggcatcgacgcccagaccaactttgcgctctgcgagtacctggaggagctggggccggaggccgccgcgcgtgccgccgccaggggcctcctgggg

SEQ ID NO: 4537 - DNA, 1809 bp, Chlorella protothecoides
  modified_base (262)..(271): a, c, t, g, unknown or other
  modified_base (1020)..(1029): a, c, t, g, unknown or other
atgggcagtctgtcggccatgtgcattcaggccatgcgtcccgactcggcgagtgcggttggtgcccaggtgaggatgggtccaggaaatgaggatgctttagacctgtggcagcatggaatccggtgcaatggagagatcacattgttggtttcggccgacaatccatgccgatcatgtcaatgctcgggtgcaaccccctcccaccctgcgccatacctgcccacccccctcagggccctccatcaggagggtggcggtnnnnnnnnnncatgccgatcatgtcaatgctcgggtgcaaacccctcccaccctgcgccatgcctgtccgcccccctcagggccctccaccaggagggtggcggcctgggccccctggagcgtgaattggatgccgccatcctcagagaggactacggacaggccgcagtcctcagggataagctgcggccgcagtcctcagggataaactgcggtgagggccatggtggggattgcgaggagttcacccactcgctcgcatgcaggactcctccttgcaaaggggttaagtcgcccgcataccaccctcctcattgcagggagcagcgggaagggaacctgagcggcgtcctgcaagccaacgcagccttctacaaggcgtttggagacgccgacctgccggcgatggaggcggtgtggggcaagtcggagagcgtgcaggtcatccaccccgcggccggctgcatcgcgggcagggaccagggccgctgccaccgacacgtaggctgcgctcgtgggttcctggtgattggttttcgtgcttctcaatgggtgcgcatagaaagttgggcaaggaatgttgctgggctctcgagccacaccttcaaaattctttctgaagtcctcttggccatacctcgccaccccattcccactctccacagcattggctgggtcacctgcctggaggctaccaaggcagggtctcgcacggggcgtgtgctcgccaccaacatcttccagagggaaggcagcggnnnnnnnnnncgtaggctgcgctcgtgggttcctggtgatcggttttcgtgcttctcaatgggtgcgctcaggaagttgggcaagggatcttgtgcaccaccatggcagcattatctgacaagccctggtgaggaacatcgcctggtgcgagcagacgttgccctgctttgtattgagcaggagcagtcactcatcgcagtgttggtgcggacaagccggtgccaacccggcccggcaagctacatgctgcaccatccactggctgtggtgaaagcccctggaattggctcacacatttgcaaaaggcacggggccacgatggcctgctatgccaaagagaccgccatgtggatcatatatcatcctccaagagcaaacacgctagggagacatccctgcccacgagccgatgcacaagccagtgttaaagccctcaacagtggtgggatacagtgtgcattctcatcgttgggtaaatcgcctgcaatccaccatgcaatcccagggattgctgatcacacagctccctcctcccctcccaaccgcggacaggatagagccagcagggacagcctcctggctgcatcctcggacatctcccaggcgcagctgtcgatagcatacttggagctgaggtgccgcgcccacggtgtacctgcgccccctgcgatcggagggagaggtgcatgtgggcatgtgcatcagtcatggtgcagagggggaggtgtgccctgcaagcgactgacagcccctgatgcagagggggaggtgtgccctgcaagcgactga

SEQ ID NO: 4538 - DNA, 915 bp, Chlorella protothecoides
  modified_base (529)..(538): a, c, t, g, unknown or other
  modified_base (874)..(883): a, c, t, g, unknown or other
atggaatgtaaatgcagtgggacagcgcccctggaatcgaggcaggccctggaagacttactgctatgcttgtgtgggagcaagcccacccccgtacatacgctggaaatcaccctgcaaggccccaattcttcgactgtggtgctttctcgcggcatgaatgaagcagctacgagcaaccctcaatggacggcacagctctttgggcttccgctgcggggcaagcaagcggtcggcctggaggctagcgtgcgaagtgtggcgacgtcctcctgccagggccccgaagttccagcattctggacagcgctgggcatggagatcgagtacactgtggagcgtcgaggatgtgcagtcaccctccatgcccccagatctgggctggaggtccaggcccgccgtaatcacaccgtcttgttcccaagcgtgcaggtggtggtctcgcagctgtacagggctggagccgacgaggagggtggtgatgggcacgcgccaatcgtccccaatcatgtgctggtagaggccaggnnnnnnnnnnaggcggtgatgggcaagcgccaattgtccccaatcatgtgctgactgctgctctcgcctccttggcgcatggagccgacaggaacccattcccaccctcctcagatgagattcggcgcctgcttcgtcagtacacgacgctgcaagtcgtgccacagcctccccccggaagaaggaggtgaagatctggagaaagcggggggagcgtggcaggagcagccgtccccacgcgcaaggcggagctggccggtccaaatatgttttaaggaaacctggaaaacagctgaggcgggcgccaggagtgcccgggaccataaccgcacccatcgaggcaggnnnnnnnnnnctgaagatctggagaaaacggggggagcgtga

SEQ ID NO: 4539 - DNA, 2100 bp, Chlorella protothecoides
  modified_base (429)..(438): a, c, t, g, unknown or other
  modified_base (1287)..(1296): a, c, t, g, unknown or other
  modified_base (1384)..(1393): a, c, t, g, unknown or other
atggccactgctttgcccgcctgccaccccctttttgaacccttgctgccaggacccctcctcacaggtggagggcgtgcgctttctctacgagtgcgtggtgtcggggccgccgggtcagcggggcgccatcctggcggacgagatggggctgggcaagaccctgcaggtcctgaccctgctctggaccctgctgcgccagaacccacaggtgcttggtcggggagtcgagtggggtggctgtccctggtccaggcatggggctggctggcaggggcagcaggggcggcagctgcatggctggaaaccctagggcacgggacggcccgcctccgccgctgggtccaccagctgcgctgtgcacccgtggtccctggaccaccgccctcacaccccctctctgccccccactcttgctcctcacaaccnnnnnnnnnnctgcgctgtgcacccgtggtccctggaccatcgccctcacacctcctctctgccacccactcttgctcctcacaaaatactcgcccccttgaccctgcccggtgccctcccctcagccccccgctcctcgactcccccccctcctcagggctccaaacccctggtgaccaaggccatcgtggtggcgcccaccaccctggtgcgcaactgggaggcggaggcccggcgctggctgggccccgagcgcctgcgcccgctctcgctggtggccgggccggcccaggccgagcaggtgctggggttcgtgcacggggcggcgcacgcgctgctcatcaccagctacgagctggcgcggcggcacgcgggcgcgctggcgggtgccgcgcagctgctggtgtgcgacgaggggcaccgcctgaaggcggcggcggggagcaagaccatctccgcgctgggtgcgctgggctgccccgcccgcgtcctgctgacggggacgcccgtgcagaacgcgccgcgcgagttcttcgccatggccgacttcgtgcggccgggggtgctgggggacctccccgccttcgagcgcgtgtttggcgggcccatcgcccgcgcccaggaccgggcggggacggaggaggacaaggcgctgggcagggagagggccaggtgcgtgtgcctggcgggtgggaaggggggcgctgcatggcttgggatcgggcggtctggtgggcagggcaaacagggcaggccaggttggcaggcctgcctgggggagctccaccctccccttctgcaccccatccctcccaccatcagcccctcatgcacgcccccaaacggccacacactcannnnnnnnnnaagagcacgctgcgggcgggtgtaccacccaggagagccccccaaaggctgcaaggatggaggacgcggcacaggtggccgcgggcgnnnnnnnnnnaccccatccctcccaccatcagcccctcatacccacccccaaacggcgccacactcgaccagggagctggtgtcgcgcatctcgggcttcatgctgcgacgcacggcggaggtgaacgcgcgcttcctgcccccgctctccgtctacatcgtgttctgccgccccagcgagctccagctgcgggagtaccgccgcgtgctccagtccgccgcagtccacaccctgctctccaacgggccgggggaccagggattgtggtgaggacccttgcaaaagcgaggatggaggacgcggcacaggccctggcggtgctgtccagcctgcgcaagatctgcaaccacccctacttggcgcccgaccccgacagggacgcaggcccgacccccgacacctcgccccgccccgccgactctggcaagctggcggcgctggacgccatgctggcggcggcgctggcggaccccggggagcgcgcggtggtggtgtcccagtccacggccgcgctcgacctgatcggcgcgctgtgcacgacgcgtggctggccctgccagcgcctggacggcgccaccgaccccgcccgccgcgtggacatggtggacgccttcaaccgccacggcgtcggccgcgtgttcctgctgtccaccacggcgggcggggcggggctgaacctggttggcgctgcgcgcctcttcctgtttgattcccac

SEQ ID NO: 4540 - DNA, 1311 bp, Chlorella protothecoides
  modified_base (622)..(631): a, c, t, g, unknown or other
atggatgtgaggcgtgctgcgcatgctgtgagcacacgaataactgcgggacaggtccgcgatccggcacatgtcatgatgcgcattgtcttccgtgattcgacactcttgggcagcatgtcgatttccaatgaaaatcaggcgctacctgccagcgtgccgactctggggctgaagaggaaggctttcaaagccccccttgcagtccgacccgcagtgagcaacattcctcccgcggcccgcgaggatgcgggccccaagcccgtttctgcgtcagaggagcattattacttcaatgtcacggctgcacatgcgtcatggggaacaatcatgctacaagtgcacccccgcctgccctgccccagactgtacaccaagcacaatcccggcaagcttcgtaaaaacaagagctgggccgatggagtgctggagatgcgagccggtggcaggaccacgctctttgaccccagtgggaagagtgtgacgcagactgtggcgcgtgggtatgacccgcccagcatgggggaggggtcctctgtgctcctcgggggctgggagctggaggtgcagaaccgcatggaggcagccgagttcagggaagctctgccatccctcgtgtgcnnnnnnnnnnaggcagccgagttcagctctgccatccctcgtgtgacgtggtcgccaaacatagttcaagtggcgtgcatggcgtcacaggagcgggacagcattcataggcccatcagctggtgctgtagcaccactgcccaaggcggccagcacaacgacatcctccacgggtctcaagggaagggcggcttttcggccagtggtaccggccggggttgctgcgcagcatgctgcagtgcgcaaggcccctgcatggctgcacgaccccatggcggaaactgccatcgtgctgaacaggtgggacctgaaggtgccttgcggttgagcaacctgtcgcaatgcgtctcgacatgtgtggcacagggcttggttatccacaggagtcgaggatctgcccatgttttcgcttcctacgaggacagcggcctttgcatgcatcccagaagcgccggcctgagctcatcaggtagccagaaccctccctcccggtccctcgtgcccagagagcagtggatgggctcccaggagtctggcgcctcgggcgtacggcctgtggtggtcgacccatacctggcctgccacctccgcccgcaccaggtgctccaaaaggggcatgccactcgagcttgcaggggactgacagagctgacacgttacggacagacgtcgtcggtacatgatagctaa

SEQ ID NO: 4541 - DNA, 432 bp, Chlorella protothecoides
atgtcacccctccccgcggtcctgcatgcggcgggttgcgacctggttcccctcaccctggaggtgggcgactacgtgctcagcgcctcctgctgcgtggagcgcaaggccatccccgacctccgcgcctcgctcgcctccggccgcctctttgcgcaggcggaggccatggcgcggcactacgccacccccgtcctgctgattgagtttgagggcgaccgcgcctttgccctgcaggccgcgggggagcctcatggcgcgcttggtgctgctcacgctgcaccacccgcgcctgcgcctggtctggtcgcgctccctgcatgccaccgccgcgacctttgccgcgctgaaggccaaccaggaggagccagacccggtggccgccgccacggcaggcgtgcccttggaggcgggggagggcgccatggctga

SEQ ID NO: 4542 - DNA, 252 bp, Chlorella protothecoides
atggagggcgcccaggccaaagacggcattgacaccctgatcctgcacctgctcatggatctgggcgcggaggacgaggccgccgccttcgccgccgtgcccaacgcggtcgtgctgcccgaggtggagccgcgcctgctgtcgctgggctgggaggacacgctgggcacgctgtgcgccacgaccggcgaggtgccgcgtgcgctggcggtgtaccagcgcgcggcggcgcggcgcggggccggcgcggag

SEQ ID NO: 4543 - DNA, 1242 bp, Chlorella protothecoides
atgcaggcgatagtggggctgcactacctctcctccgtctcgaggctggtggcactgcaggagggaggctccctcaccctactcgacgccgggagcctccgctcccaacccctgccactcaagggaattgcgctggccacctgcgccaacgaggagccgggccgcgcgcctcgcctggcaatcttccacaggcttcgtgtctcttctggctcctttgtgcgccccgtcgcccaccatgcaatgcctctgatcgtccttcccccgctttgtatcaccgtcggcaggctcaccgtcctgctcctcttcccggccgagagcggcaagctgggccaggtggcggccgagatggagctgcctggcatcgcctccccgacctgcccggcctgggtgggcgcgcaggtggtgtgcgccgccgggatgcgctactgcttcgcagcccctctggcgggggggtccctgcgccagcttttcgacgtgccgccggagctggcatacgtgccgcctcgagcggtggggctgccctccctggcccaagccgtagtattactggggaagggagtggtggccttgggagcccacatgcagtcccttcgacgcagctggcagctgagtcccaagcagcacctcaggctcggggttgcgcatggcctttgcttcttccccaatgaacctcagacgacattggaatcctcgactccagccagcattcacagccaacactccccaacccccccggtccccctgcccacctttccaaacgcccagggcgagacgggcatccgcatcaaccctgcagggcaccctgtgggcgacgcgttgagcctggagggctacggcgcgctgcgcgcgctgagtggcgtggggcggcacctgctggtctggaccccggagcgcctgtgcgtgctggaggccgacaccggcgcctgcgtgcagaccctgggcctggcggccgcggaccccggtggcgcggcggccgggcaggccgtgtcggcctgcaacgatgcgggcgcggtgctggtcgcgccccgcgccgcgcctgggtccacggcggcgcgctcggccggggccaccgtcttcctggcgcagcccgtccccgcctgggaccaggtgcgggatgcgctggcccacggcgaggcggaagccgcgctgcgcctgtcgagccggggcgaggcgcggggcgaggcctgggcccaggccggcctggccttggtcggcctggccctgctcagaggcaagcgctga

SEQ ID NO: 4544 - DNA, 663 bp, Chlorella protothecoides
atggtggcgggggttatgtcggaggacccggccgcccagctggaggccacaacccagttccgcaagctgctgagcatcgagcgcaacccgcccatcgaggaggtgatctcggcgggggtcatcccgcgcttcgtggccttcctccagcgcggcgacgcgccccagctccagttcgaggcggcctgggcgctgaccaacgtggcgtcggggaccagcgaccacacgcgcgtggtgatcgatgcaggggcggtgcccatcttcgtcgcgctgctggcctcgcccgtggacgacgtgcgggagcaggcggtgtgggcgctgggcaacattgcgggcgactccccgcgctgccgcgacctggtgctggcctgcgacgcgctgggcccgctgctcggccagcttcgcgaggacgccaagctgtccatgctgcgcaacgccacctggacgctgagcaacttctgccgcggcaagccgccgccggagttcgaggcggtgcgcgccgcgctgggcgcgctggcccgcctcattcactccccggatgaggaggtgctgaccgacgccagctgggcgctgtcctacctgtccgacggcaccaacgacaagatccagcacgtcattgatacgggagtcgtgcgccgcctggtggagctcctcctgtgggtttga

SEQ ID NO: 4545 - DNA, 507 bp, Chlorella protothecoides
atgtccaacgccagtcagtccggcaaagccgctgcgccggcgcccgaggccgctgctgctgacggcagctccggctctgaagcagccacagccgtgaccaccatctcgccccaggccatcaaggagctccgtgccgagacgggggccggtatcatggcatgcaaggccgcgctgcgtgaagccaacggcgacgcgcaagcggcctcagaggcgctgcgcaagaaagggctggccagcgccgagaagaaggcggggagggcggcggccgagggcgtcattggcgcctacatccactccggcaacaggcccccccgaccttatgtgtcgcagctggtggcatcagggtcggtgcagtacgtctccgtcgccgacattcctgaggaggtcaggcggcgcgaggcggagattgaggccgccaaggaagacctggcctccaagccggaagccatcaggttggtgctgggatgtaagggggagcatcggatgccctctgccaattgtatttga

SEQ ID NO: 4546 - DNA, 1728 bp, Chlorella protothecoides
atgatcgcggagggggccaagcccaagccctcccactcgccacggcgggaccccagcgccggcggcggggccaggcccgggtccgatggcggcgctgccaggggcgcgggcgggcgccaggggtcctcctcgtcgtactccggccggggtccaaccggggccgcccccgggggcagcggcgcggcggccaccgtggcgcgcaagtcttctgcggggcgcgactcgggcgcgcccgccaggcggaagctgaacgtcaaggtgggcgacgttctgatgggcaagatcgccaacgtggccacctttggagcgttcgtggatgtgggcgatggcaccacgggcctcctgcactacagcgagatgaagctgccggagggggtcaccgacgtcacctctgcattcaagcctggccaggaggtggaggtgcgtggcgaaggtgtcccttcatccgacgagctcaacccgaccccttgcctccttgcctccactcaccaggtgctcatcacctcactgaagccggacaagcgcggcaaccgcggatccaagatcgggctgaccatgcggtccaagaccgaggtggagctggaccgcaagctgaagagcggcgggctccggacggagggtgccggcggcgcgcctgaggacgcagaggagtttcacgccatgggccaggcactcaagatggctgggctgaacctctctctttaccccaaggtagggtggggttgtcgtggagagggtgttggacgagttgcaaaagatgagcgggggcatgcttgggaggcccagagcacaacacagcaacgcgcactgccagaagttggccatggcactgcccttatcgctctgcacactctgccgtcccgagacctgcttctgccgctcgcgttctcacactccactcccctccttacatcgcaacaggcatcctctgtgtcggtcggtggggggtccgaggtgcctgccgccgaccagctcgtatctgacgacgtcttgatctccgactctggccctgcagaggagtcgcagagcgcggcatcgagccccgaggcagtgtcctcccccctcgtcgacagcgcccccgttgtcgacgactcccccctgaccaccaaggaggaggaaactgtggaggagctggccactgccgaggtcgatgccccctctgtcgtcgataacctggatacctcctccctcgccacggacgccatcggctccccggccaaagacaagccgctggatgttgcggcagccgagacggcggcgcccgaggaggggcctgccgccgaggaggtgccggacggctcccccgagggcgcgcacgtccccgcagccgtagaggaagaagccgcgccgcctgtctcagaggcggccgccccggaggctgcgtccgtcggcctggccagcgccgacagcctggtggcggacatggctgagcaggccgagagcgccgagcaggtgtcacccctgcgcgccgtgcaggctgccgcacagcccgaggaggcttctgcccccaaggtcgccctctccaccggggcaggacaggagaatgaaggcgccaaccccgctgctaccgaggctgccacgccgggtgcggccagcctggatgccatcaagcgactgcgtggcgagaccggggcggggatcatggactgcaagcaggcgctgcagaagaacggcggcgacgaggagagcgcccgcgaggtagggggtgggagcggtgtctccgggtga

SEQ ID NO: 4547 - DNA, 765 bp, Chlorella protothecoides
atgcgtttgtggctcgccgagcaccgactacctcaccccacgccacgcgcagactccctttgtgctcgtctccaggcctgtcttcttacggcaacggtacgaattccgtcgtcggagcgtggacccagccgaccaccacccttgcctgtacacagggtgatttcgcgatcgacgccaacatggcgtcgttgtcgccccgcagcgaccgcatccttttcggccgaggcgcccaccgagagctcacccgctgatgtcagcggcggtgccgctgcccccacggccgcatcccctgcgacctcctctcccccccagtctgcgcggcgctacaaccagggatacccgtcgcgcgggcccaaggtgcagggaccggccaggaccctggcggtcaccgacctggaggttgggaagacgtacacgggcacagtggtaggtggccggcactggtgttggctcattgtgctggtgggagccgccgttgcatacctggctgctgccagggcgatggccatcatcaagattggggcattcatcaacgtcggcgccaagaccgacggcctgctgcacatctcccagatcagcacagagtatgtctccagcgtgaccgaccgcctgcaagtcgggcaggaggtggaagtgcgggtgctcaccatcgagccggacggcctcaagtttgcacgtgagcgctctttgatgtgctgggtttggatgtggtggctacattttgtgtctgaaggtgactctcggtcccatgcacttgatggctga

SEQ ID NO: 4548 - DNA, 720 bp, Chlorella protothecoides
atgggctcgggtgactccactccaccccccccaccccccaatcaatcgactcgcagacaccaggtgccgtcggtgctggtgccggccctgcgcacagtgggcaacatcgtgaccggggacgactcccagacgcagacggtgatcaactcgggcgcgctgtcctgcctcctggtcctcctcacctctagtcagaagaagtccatcaagaaggaggcatgctggaccatcagcaacatcaccgccggcacgcgcgagcagatccaggcggtcatggatgcgggcatcatccctccgctcatcaacctgctggccaacgctgagttcgacatcaagaaggaggcggcgtgggcggtgagcaatgccacgtctggcggctcgcacgaccagatccgggcgcttgtggcggcgggggccatcaagcccctctgcgacctcctcatctgctccgacgtgcgcatcgtgaccgtggcactcgagggcctggacaacatcctgcgcgtcggcgagggcctgcgggagatggcggggtcgggcggcgtcaacccctttgctacgctggtggacgaggcggagggcgtagaccacatagagcagctgcaaaaccactccaacgaggacgtgtacgagaaggcggtgaacctgctggagacctactttgacgtcgaggacggtgatgtcgaggggctggcccccgcggtggacgcagccgcaggtatgtag

SEQ ID NO: 4549 - DNA, 300 bp, Chlorella protothecoides
atgtcccagcgccgacagaaacctactctgctgtatcacacacagtggctccggaaaaagggtctggcttctgctgagaagaaggcggggcggtctgccacagagggggctatctggtcgttcgtgcacggcagcaagattggcgtgctcctggaggtgaacagcgaaacagactttgtggccaggagcgacgaattcaaggatctggccgctgacttggccatgcaggtgctgggaggaaagggaggcggaggaggggtgggtgtgatggtgcccaccttgctatgcatggtggtttga

SEQ ID NO: 4550 - DNA, 612 bp, Chlorella protothecoides
atgggcgcgcgcgctgccgggccgcaacgctcaggccgccctggagtcggcgctgtgcgagggggtgggcgccacgcccgccctctggccgggccaggaccggctgtcctacgcatggggcgggcgcctggtgctgggcgtgctgcccgtggcccgcttcggctcgcacacggcctcggtccagggcctggcgggcctgatgcacgtgacccaggtgcgctgcaggggtcgtgggcgtgtggcgtggattgtatcgggagggatggtggtgggaggggatgcccgggtgcagtgggggggattgcgggggagtggaggaatggagggtgggaagagaacaggcgcggtctgttagggactcatcagaccaaccactgggtggcggtgcacgccagccaccagtctgacggactggtgggcaagcggcaccgtctgcgggaggccatgctgtgggaggatgcgccggagtactacaccgagccgcgcctcctgtccatggacctcaagccgccgagcgtgcccgagaagctgagcctgggggtcatggacgaggggggccagacggcgctgcagatggcgcacaagcggggccttcagttccagctgcagcag

SEQ ID NO: 4551 - DNA, 858 bp, Chlorella protothecoides
  modified_base (68)..(77): a, c, t, g, unknown or other
  modified_base (692)..(701): a, c, t, g, unknown or other
atgctgtcgtctagcagccagggctcaccctggcctgccccgccctgcctcaagactgttttgtgccnnnnnnnnnncacacatcctcaagctctgcaattcgatcacgatgctgtcgtccagcagccagggctcgccctggcatgccccgccctgcctcaagactgctttgtgccccccccccgtcctcaggctccactgactgaccattcccccccacccaaaaacacatcccccatattcccctgcccagggggaagcaaggcgtgcgaacaggacttccacaacagcaccgcctgccaacggatcgggctggcccgcgccttcctctcctacggcctggacgtgacgctgtccgacgccgactgggcgtttgccgaggacccacgccccttcttctcccgccagccccacgccgacctgctggccgccggcgcggcgctggtcaactccaccgccgacggcgacggcgggctggagctggccgccagcctggcggccggcaccgacgacggcctgctcctgctccgcgccgcgcccgccatgctctccttcctccaggcatgggcgcgcgcgctgccgggccgcaatggtcaggccgccctggagtcggcgctgcgcgagggtgtgggcgccacacctgccctctggccgggccaggaccggctggcctacgcatggggcgggcgctnnnnnnnnnncaggggtcgtgggcgtgtggcgtggattgtgtctggagggatggtggtgggagggggggtgcgggtgccggggggggcaggtgcaggggagtggaggagtggagggtgggaagaggacaggcgcggtctggtagggacccatcagaccaaccagtga

SEQ ID NO: 4552 - DNA, 1707 bp, Chlorella protothecoides
  modified_base (963)..(972): a, c, t, g, unknown or other
atgcaagtacctggagcaacacatgctgcatggccacccctctggacttcccatgctgtcgatgctgtcccaccccactcccaagcttggagctgcccacccccccttccaacccctgcagaccctgatgtcacacgacatcccatttctggccgtgcatctttgggcgtgttccacttcactgctgatcgctccccctccccttcaccccccctttcccaaaagcgtagccctccatacagtcacacacaccgacaccctcttcacctctcctccatcgcaaccgcaggcgactttggctggggctccccctccttcaccaagatgggcaggcagaaggtggacctggcgcacaccttcctgtcctacggcctgaacatcaccctggccgactcggacgcggtgttcgtggcggacccttgcgccttcttcgcgagccacccccgcgccgacgtgctggcgcacaccgacaagctcaactccgggctgcccgtcggcgacgcggggctggaggaggccggcgccatccatgccgtggccaacatcggcctgctggtcttccgtgcacgaccgcagacgctggccttcgtggccgcctggcgcaagggcctgaaccaggaccccaaggcctgggaccagaccctgttcaaccagctgctgcacgttgggcgcatgacgcccgagccggcgccctcccgcctcacccgtgcctgggacgacgcgctgctggtgggcatcctgcccaccgccagctactcctcgggccatgtggcctatgtctcggggctggcggcacagaaaaagctgacccaggtgagtggatgctggtgtggaaaggaaggagcggtggcaggggggcgggaacgcgattggcagcgaggggcgcgccggggcggcggccacctaccatggagcctcccctgcatttcctttcaacgctggacaccgaccatggcccctgtnnnnnnnnnncctgccatggagcctcccctgcatttcctttcatcgctgctggacaccgttcatggcccctgctaccccgctgtgccttgtcgccatctgggtcacatcagcacaactgcacgcccacaaccacaccaagacactcacatgcgcacaagcgcgtgcatacccacacccgcacccacacccactcactcacttgacgccctgtgtcaggtgatggtgcacaccaccttccagtacggcggcacgcccggcaagcgcaaccgcctgcgggagggcatgctgtggtacgacccacccgcctactacgccggcccccgcttcctctccatcgacatgcagtacccagcgatcccgcccggcatccagaccatgggcgaggagggcatgcatgccgtgcagctcgcccacctgcagggcatgctgcagcagatgctgcagatcagggccggtatggccatggctgtggtgctcaaccgcaccttcatcatgcccaaggaaggcggcgggggaggggtgaggggtttcagcaatgagatggggccgagaagcaaggcgcgtggcggaagggtgcacaggggagggcctgctgtcttcctgccctgcagcaaccctcatgccctgtcacccgcataccagggctggaggtcgcaaagcgtgacctccaggccccctgttctgctgacagtgcatgcatgcaatgccagcacccctagagggttcacagcccagtacctgtag

SEQ ID NO: 4553 - DNA, 1305 bp, Chlorella protothecoides
  modified_base (1130)..(1139): a, c, t, g, unknown or other
atgttggaacggatgtacacccgttgggcggagcggcgtggaatgacctggcgcgccctctaccgctcgctgggcgaagaggccggcatcaagtgcgtcgagctggaggtgcgatgggcggtggctaacggcatttttggggtatcccctccttgcatccaaacaggtcacggggccttgggcctttggctggctggccggggagaaggggacccaccgcttggtccggcagtcgcccttcaacgccaaggccgcgcggcagacctcctttgccgccgtggaggtgatgccggtgctggaggacctggcggccagcgtggaggtgccggagacggaggtggaggtgtctaccatgcgtgctggcggggcgggggggcagaatgtgaacaaggtggaaaccgcggtgcggatcgtgcacctgcccaccggcatcgcggtgcgatgccaggtggagcgaacgcaggtgtgcaaggagctccgcaggggggaagaggagacactggccgttcagcattgaatatgtggagtggagcagcgtgtgcatggagaggagcagtgtgggggagccggcaaacacacggttctcccaaatgggtcccacctcggcaacctcattcccacgaactgcaccgtacccaaactcctcctcccccgcgccctgtgcaggcgctgaataaggcgctggccttcaagtggctcaaggccaagctgctggtgctggcccaggagaagcagagggaggcggcggctggcatccgtggcgatcacgtcaaagcaggtgggcgtcggaggcaggcagggtggggacaggggtggggacactcacagggctggtgggacggggctcgactgactctgcacttgaagtcctgggcagggatccctcttgccactcatccggcaccccctggcacccacagagtggggccagcagatccggaactacgtgctacacccataccgcctggtcaaggacgtgcgcacgggaaaagaaagcagtgcggtggacgacatactagggggagacctggacggcttcatggccgcatacctcaactgggcgcagcgggaggccaggcaggcttaggctttgggaagtacgacacccctcgccgattgtgctctggcgnnnnnnnnnngtggggccagcagatccggaactacgtgctgcacccataccgcctggtcaaggatgtgcgcacgggaaaagaaagcagcgcggtggatgacgtgctagggggagacctggacggcttcatggccgcatacctcaactgggcgcagcgggaggccaggcaggcttag

SEQ ID NO: 4554 - DNA, 675 bp, Chlorella protothecoides
  modified_base (282)..(291): a, c, t, g, unknown or other
  modified_base (352)..(361): a, c, t, g, unknown or other
atggcggcgctccaaggcaggattgcagacctagagaaacaggccggggatccggcgctctgggaggacacctccagcgcacagaccctgctgcagcggctgtcggaggccaaggagacagtggcatcccttcaggagctgtccggcatctgtgacgacgttgacttgacggtggacctggccgctctcgagaaggtgggcctggtgttggaatgtggtattgattttgttggtgtgggcatgcagcccctatgtgctgggttgatgcgatgtcccacctcnnnnnnnnnngacgacgttgacttgacggtggacctggccaacctcgagaagtcgttctgtccgggcgggnnnnnnnnnnccatgttctccaacctgctcaagcactggcattgcgtaagaaaccttgccacctttgctccaccatccctggcattggcagactggaagctcactgcagcacgagggtttggaagaggcccagaccctggcttcggatctggaggcccggctggcagcactggagctgcgccagatgctgaacgggccagtggcctagatctgtgcgcgatgcctcgtgtccctgccagtgctcaacaagagtttgagcacacaattaggggggcgagcgcatggctgcaggcctccaccgtcactcagggctgcagtcactga

SEQ ID NO: 4555 - DNA, 2400 bp, Chlorella protothecoides
  modified_base (128)..(137): a, c, t, g, unknown or other
  modified_base (1533)..(1542): a, c, t, g, unknown or other
  modified_base (1709)..(1718): a, c, t, g, unknown or other
  modified_base (1814)..(1823): a, c, t, g, unknown or other
atgggtcgcaccgtgacggtggcgaccacccagatgacgtgctcgtgggatatcgaggagaacttggtacgctttgacaactcaccgcgtcctcgcccgaccttacactcccaggcaaaggcagaaannnnnnnnnngtttggaaatggtgatcgggctgcccgggttttgccttggccccccgtcgtaagcttccaaatggctgaccagctcaccgcgacctcgcccgaccttgcactcccaggcaaaggcagaacagaacgtgcgtgccgccgcggctgcgggcgcgaacattatcctcctgcaggtccggcttggaccttgtttcggaatgcggttcccgacagggtcatccgccgccctgttccatgcaatccactggatgccaaacccaactctcctgcaacaccccaggagctgttcgaggccccatacttttgtcaggagcagcttgccaagcactatgccctggccaaccccgtcgagggcaaccccttgattgagaggtttgcgggactcgcaaaggagctgggtgtggtcctgccaagtgagtccttcaggggtggctgggatgccaatgtttgtgggaatggactgcgcggtctgtgcacacccaccctcgcagtgatgtgcagcctgtcacacacatgccccggaatggcacagcgtcgcatgtggatctgtgcgccgtccagcgtcttgcaagtattgagcccctgtgctcggcggcggggatgcactccagctttcctcgctcgccactggatgtggcactcccaagcaaggacacacaccggcaccaccactgcatgccctgcagtcagcttctttgagagggccgggaatgcctacttcaactcgctggtggtcatagatgcggatgggatgacagtctgtgggctgctggacgctcctgcacacagtcacctcccttctgtggctggtggacgctgcggccccgcagcgctacactcgctctggctgccactgtgtctgggaatcggcagtctcgagttcagaccaagcgattcttaccttctgccaccgcccaggccatgctcaggccccgagcagtcccttccttgcaccctcctcgcacccccctcccctgttctcatccctgcctgtaggtaccaggagaagttctacttttcaccgggggacacggggttcaagccatttgacacctcctttggcagaatcggcgtcctcatctgctgggaccagtggttcccggaagccgcccgctgcctggcgctccagggcgcggagctcctcttctaccccacagcgattggcagcgagccgccccccgccccccccgtcagcagctacctgcactggcagcgtgtgatggcggggcactccggggcgagcatggtccccgtcatcgccgccaaccgcatgggcagggaggtgtttgacgccagtgagatcatgttctacggtgggtccttcatcactgacgagacggggcgggtcgtggctcagtgcaggaggattttaccagtcagctacagacaccatggtctnnnnnnnnnncctcatctgctgggaccagtggttcccggaggccgcccgctgcctggcgctccagggcgccgagctcctcttctaccccactgcgattgggagcgagccgccccccgcccccccggtcagcagctaccttcactggcagcgggtgatggcggggcactccggggctnnnnnnnnnngtggctcagtgcaggaggatgttaccactcagcaacaaacaccatgctcggaactgagcaggagttgaggcataatagcaacccatcacaacacannnnnnnnnnagcaggagttgaggtgtgctgcgggatctgcgggactcctgctgcctcagtttgcctgttttcaacaaagctgccagcaggcataacagcaacccatcacaacacccccccgcttgctccccaggttggaagtggctccctgccccccaatggcggccctgacgcctcaccggccaaggaggaaggctttgtgaccgcgacctttgacctagacgagattcgcacggctcgggctggcccagggttgtgggtctgcccgactctcgtcatgcattatgaccttgggccccctcttccaatggggcaggtggggcatgttcagagacaggcggccggagctgtatggggctatcaggactatggacggattttcccaggcccggtgaatctccgggtatctgtcgtagaagcatacctaacttgcatgctgtgcagcatttcacgaaatgtatccaatgataccgatctgcagtgttccatgggcgctaatccatcacatgccaatctcatgcatattttaggtaaaaagcaagaaggttcacgtcgtaaatgctgcaactcgaccttggacctatag

SEQ ID NO: 4556 - DNA, 1305 bp, Chlorella protothecoides
  modified_base (534)..(543): a, c, t, g, unknown or other
  modified_base (902)..(911): a, c, t, g, unknown or other
atgctgcagccgcctgcgacagggctgctgagggcgagcaccctgctgacgacggcggagtgcctgctccaccccaaccgtaaccccggcctgtcccaggccgagatcgaggcccggctgatggcgttcctgggggtcacccgcgtcatctggctcccgcgcggcctggtcgccgacaccgacaccaacggccacgtggacaacatcgcctgcttcgcgcggccaggcgtggtggtgctggcctggtcagatgatgccgaggacccgcaatacgaacggtcccgcgaggccctggcggtcctggaggccgcggtcgacgcgaggggcaggcggctggaggtcgtgaagctgccccaggggcccgcgatgcattaccgcgaggaggaaacggcgtcgatagagactccagcccccagagcctggtggcagcgggaggcggtgtcagtccaattgagccaggcagggcatcgcccctcatgctcatccccctgcaatgctcagaaagcgggggcgggggagatggatcgagtggcnnnnnnnnnncagtgcctggcgggctccaggggtactgccaaagctgcgatgcaaggggggcaggggggtgtggggcagggcgtcgcccctcatgctcatcccccctgcaatgctcagagagcgggggcgggggagatggatcgagtggcgggcactcggctggcaggggcctacatcaacttttacatctgcaacggcggcgtggtcatgccggggtggggcatcccagatgccgacgcaaggaagagcattgccgctgggatggcaagggtggggggaccgccgccccagcatgtgagaccccttcccgaacaaaccatcgttgcagggccaaggcggtgctccaggaggtgttcccagacagggannnnnnnnnnaccccagcatgtgggaccccctcccaaacaaaccatcgttgtagggccaaggtggtgctccaggaggtgttcccagacagggaggtggtgcaggtgtacacgcgcgagatactgctggggggcgggaatgtgcactgcatcacgcagcagcaacccctgggcaaacctgccgccatgggcggccttgccatcagtgcactgtgagaaatgtaaaacctatagaaagccggaacaccccgactcgcacgtcaccaactcccttgacaactctggcccgtccccgagcgacacatcgttgaacccggagcagttacacgcgctgcacacacctcgagcacgtcatggctcccggacatgccttccgctgggtgaagcccgaagtgtgagtgcctag

SEQ ID NO: 4557 - DNA, 4128 bp, Chlorella protothecoides
  modified_base (455)..(474): a, c, t, g, unknown or other
  modified_base (914)..(923): a, c, t, g, unknown or other
  modified_base (1048)..(1057): a, c, t, g, unknown or other
  modified_base (1587)..(1596): a, c, t, g, unknown or other
  modified_base (1955)..(1964): a, c, t, g, unknown or other
  modified_base (2023)..(2032): a, c, t, g, unknown or other
  modified_base (2211)..(2220): a, c, t, g, unknown or other
  modified_base (2696)..(2705): a, c, t, g, unknown or other
  modified_base (2812)..(2821): a, c, t, g, unknown or other
  modified_base (3131)..(3140): a, c, t, g, unknown or other
  modified_base (3996)..(4005): a, c, t, g, unknown or other
atgaagcagcgaccactgggttttggagtccaagggagcggaggtggggtgggattcgagcgctgggtgtccagtgtgggtcgtgcaaagctgcacaacagatccttgggcagcagagcccaacctgctcagttgctctttgcgggcacaggactgagtttgaagtcgacaacgttctggtggatattcgagaaggagttggggccgagtcaagagcctgaggtggagacgtcgatcgagttctcaacccttccacccatgaggagaaagcacacagagttccctctcatattcccaatcagcttcatcaaacttgggcacggtgcatgcacattcaacaatagaatttgccattgtgaagcaagcacactcacttgcttcctggtgcacgcacgcaaggccttgagctgcgcctcgcactttgtcgtgtcgtggtcgcgactagctacgcaatnnnnnnnnnnnnnnnnnnnncagcagccgctatggtgcagaccggatcaggatcggtcgaggccgagtcaggcatcgttggaccacaggattgatcactcaatcgcggggcccttgggcaaaatgttaggagcctctcgcagaatacagcgcgccctgccccggggaatgatgtggaaaggaagaagcctcttcaagattatttccgattccccgaaacgtggtgttgcaagcgccatacattgtttggctgcgaatatgaagcgcattccaagtaggattggaaggagtaccacagatcagtgcaaattcaggagcattcgtcctcggaccgtgcacgccctgaggacccacgtccagtgtggcgcatccaagcaaacgcagaatgtatgcaggaccgatggcactgtgggtcgaactctgctccgtccattcagatcaggacttgaggtggccgcccnnnnnnnnnnaccgatggcactttcgacacgcgcttacccttcccctgagcaggtaccccagagcaatggagccgctcagaagatggtctccgcccttgcagctgcagcgctggcgatgctggcggcggactccnnnnnnnnnncccctgagcaggtaccccagagcaatggagtcgctcagaagatggtctccgcccttgcagcagcagcgctggcggtgctggcggcggactcttcccgcctcgtcctcgccccgccccccgccaccgccggcctcatctccacagacccggtgaaggacgccaaagcactgttgcgctatgcgctgcccatccacaacacccccatcaggcaggtgcaggagtcgctggagagcatctcagaggcgctgaggattcctgggggcaaggcctttgggccaattggacgggcggtccggaatgcagcgtccatactggacagggagacaggcaccatcaccaaggccctcgtcaaggagcgccagaagcagggccaggacgatctggtgctgctcaagcagggaagctgtgaagggaattctggcggcagtacaccacagccatgttgcgaacccaggtattcacccccttttgaacggcgcgccggcgtcccttcatggtgggctacaccaaggaacatccacccctgccgnnnnnnnnnnacccagaaactctctgagctgcaagccgtccttggaaacaaggacaagaatgacattccggtgctgcagcaggagtgcctgaacttggtaggggacatagaggagtctatggtctcgggctacccctttgaagtacccaaggagtatgccaacctcccgcaactcaaggcaagcggtcgtgggggattggggcgaggtcgagacctgcagcgttacaaccgtgaatacgtggggacactgagggcttgctgcttgtggagacacccggtgcccggtgcctcccggcacgctgtcggacaatgcgacccctgggggagaggggttaggtgtctccaggacacacacggagtattattggnnnnnnnnnnagagcgggaagccggagtcaggggtgagtctctgggaacaacacgggtcgctgtgccannnnnnnnnncctgcctcaacggccactcgacttgctcagggtcgtgccacgctgcaaatggatgtgaagttctccagtccccgcgaggacaactcgactggaggcaggatggtcattgtcgtggatggcttcaatgccccactcagctcccacggcctgagtgtgccggcagctcccacgccaacccnnnnnnnnnnttcctcatcgtaattgcctggctctctagcgtggaacaaacttggctaccacagcctgagtgtgccggcagctcccatgccaaccatcccatccccctccccagtgcgggaacctttgtggacctggcccataagggcttctatgatggcatgctcatccagcggtcagatggctttgttgtgcagagcgggaagccggagtcaggggtgagtcactggagacaacacggggcgctgtgcctctgctgtgtggtgatctcagaggagtcggcacgttatcctgcttctatgggaatcgccccagtgctgagaacggtgccctttgaggtcatggtgcagggtgacaagatccctgtctacgaagagaccctcgaggacaatggacgggcttcaccttgttcccaactacgacaggaaggcccacttgccctctgccctctttcactgcaggttcaacgagcagccagtgctcccgnnnnnnnnnnttttgggtgtgccacagggcttcaccttgtgcccaaatacgacaggagggcccacctgccctctgccctctttccctgcaggttcaacgagcagccagtgctcccannnnnnnnnnttcttcctgctgaagtcacgaataagtacattgtcagcaagaggatcaacccgtttccatctgcaacccttcgtgtgaaaggaatcggagctgacacccactggatccaatctgctggatgggcggtatgctgtgtttggatatgtgacagagggagcaccactcctgaaagagctccaggtgggtggtgccaccgctgttggcaggctgcaacatggacggcgggactctcagcgctgcactggcttgcatacagggtggcaatcggtcaccatgccatggcttgctcatgccaaccctgcacacacannnnnnnnnncctgaaagagctccaggtgggtggtgccacagctgttggcaggctgcaacaaggacagcgggactgtgagcgctgcactggcttgcatacagggtggcaatcggtcaccatggcatggcttgctcatgacaaccctgcacacacacacacacacacgccatggcaggggggggacaagatcgagcgcatcaagtcctgtcgatggtctggatgcaagaaagcttggtttggccccctaactccctcccccgggaggactcgtgtgatgaacactcctgagcgcgcactccgcacatcagccatcaagggggtccacgcggaggtggtgcccgggaagtcgctggtcaccagagttgccatcgctgatagcgcgatgccgatcggagccttgataacagcatcaagtagttccgaaacaccagaaagcagtcatgcgaacagcctcgaggcgggtgcgttgggggtcaaccaccgtgccatcggaacatgtgcgtgggacccttctgtaggcgatcatgcactgctatttctaaccccacggcatggacacagtggtggcacgcctccaaattgcgctacaaccccttcacaccactctgccgcctcgggactcgacctggaacagatggctggtggtgggagagggcagcgctgcatgcatccttggtctcgtcctggggggcaccctcctggctgcgcagacctggtttgcagatggcgtgctggagtccattctttctttcaattcatccagcttcttcacgtaaggggcgggtatgggctcaggaacagggacatgggatgcaaattgtatcgcgccctgcattacctgcttgggcctggactcaacagccgnnnnnnnnnnaaaggtgcgtgggacccttctgggcgggtatgggctcaggcacagggacatgggatgcaaattgtatcgggccctgcatcacctacttgggcctggactcaacagccaatgcctgccacatga

SEQ ID NO: 4558 - DNA, 618 bp, Chlorella protothecoides
atggcgcacgttggcagcttcgccggcagatcgggtgtcgtgtgcccgggccgaccggctccgttccagggcctgccgtccagccctcgcggcgggaggccctccaccagactgggcgctggacccaagaagctgaatacgtttgatgacagctggcagaagcggtggtttggcgcaggctacttcgcagaggagaaggatgtgagccccagctccatgtaccggaagatcgagaagaagaaggtcctgtccggtgtcgagaggctagggctgctcagaggggatatatcgacgccgacggtgtcccatttcatgctgatgcctctggcccatgtgtcgtccctctcaccctttttcgccgccttccgacacccaccgcctccccccacatgggcctctctcgatccacccccgcagcaaggcggagaaggcgggcctgaccctgaccaagatcgagcagctgggcctgctgggcgcggcggagaacctgggcctcctgagcctggcggagcggctgctggtgtcggaccccggcctcatcaccagcgcatccatcccggccctggtgctgtccatcctggccgccgcgctcatcccccacgacacggcgctgactag

SEQ ID NO: 4559 - DNA, 474 bp, Chlorella protothecoides
atgaggtggctcgggctcatcattgcctgctccttcatcatcatatcttcctgcttcatagcctacaggagcttccaggtgatgggtgcacgacactggcgcggcaccacagcccctttacatccccctgcccggagtgagtgcgacccagtgtgccctcctgtgcccctccaggtcctgccatgggggattctggccaccagtgtgaccatcttgagggtaccaacagatgaggtgcctcagctgagcaaggagttggcctgggctgctgccgacggcggcgagatattcgtgacctgggccaacgagcatttttcagactttgcggtgaactgggccttgcacctgaaagatgttggggtgcacaacatcctcgtcggtgccatggacgtgggcgcagccaaggcaagcagcactggaggcggcgggggtgggggcccagagcttgcgcagccccctctgttttgtgggtga

SEQ ID NO: 4560 - DNA, 201 bp, Chlorella protothecoides
atggctgcatacaaaccctgccacgccatctcccattccacgcagttcctggtgcgggagggtgctgatggccgtgaggtggcgggggtcgactgggagttcaacgcctgggggggtctgtatggcgactactccaaggatgtgaagatcgcgtcggccattctggaggtgaccaggcgtttggatgggagggtgtcgtag

SEQ ID NO: 4561 - DNA, 303 bp, Chlorella protothecoides
atgctgcccgacgccgcgatatgcaccaacgtgccatcacctgacacttgcaggtaccccatcatctttcccgttgcgctggccctcggggcgatgacctactccatggggcgccacctttggaccaaccccgaagtcttccccagcaagaagctgcgcacggagggcatccctgaggaggagaccaaccggtttcgtgcagaggggtactccaagtccatcttccggtctctacaggaggtgtgggcatgtgcagagcgtcagaacggttggggtgggtgggtcgacgtgcgtcgctgctga

SEQ ID NO: 4562 - DNA, 1368 bp, Chlorella protothecoides
atgcatgggcccgcaggcagcatggcgcacctcggccccaaaggcgagtgccagggcctgcatgcccaggcacacccccagcactgggatgggggtgcgctcccgcaggaggtgcatgctcacgccgatgtcgctgggcctggctggcgtgcccgggccgggcgacagcaccaccgcctggtacagcccccgctccagatccctgcgcagctctggccactccacttcatcgtttctgatcacctttggaggggctgcagggagcggggggggattgatggcaggatccatggtcaggacagcgtctacgaccaggggcggacgatagtggacaatggagtgcaggggtgggtctcactcgcacatcacatattgatctcgcagcccccaatgtggggtcgaatggcgcttgggcaaatgcagatcggcacatcgccagtcgcgtgcctttgccattgcgccgcgcggtgcggaaatgtgaggcgcgagcgcggtggcgtttttaagtccggaacttcaagtctcgagccatcgcgaccacagggcttcagtgtgcatcgcttgcgagtgctccgtcaggtcactccacctttgtcgcgattcataccatcggcctccctgcatggtatgatacggctcgcacccttgccgacacgcgcttcaaccttatgtcgattctttgttccgagacaggcgcgcaccaggacagcgtgcgctgctgaggcggatcccttcaaccagctgttccagaagagaaaacctacgggcttacggcccagctactggctgaacagccaggattccatccagtcccagctgaaggcaagcagtgttggcctgtgggtgccctgccctatgcgctgcgattcacacctcccaggcactgctgccttggctgcaaataacaagccctacccggaccatggcatcgaggttgcctaccgctttgctggatttgaccccttcgctcgcagccagtatttcggcatcagcctcgacttggggcagtttgagaggtaccgcaggatattctacactcctctgtacaggccactgctgggtcacacctctgtcgagattctaagtcagcttgaggtggacgatgtttccctggttactcgtgtcttggtcactaattctttccggagggaggaacaggtgtatgaggtatgtgggcctggggcggcaacccgagggtctatggctgtgtgggaatcaatcctcctgaagggaacagatgcaaaccaaacttccctcatgcagttgagcctgagacgtcgagtgggtggcagattcgatggagcctggttcactgagtcactgatcgccgagggttccagcaggcagacgctgtatggcgtgatctga

SEQ ID NO: 4563 - DNA, 771 bp, Chlorella protothecoides
atgctggaaggctggcatgcccttgatcacgtgcggctgtgctctgtaccccagtcccaatccctgctccccctgcaggagcctgagccggccctacgcccgcgtggaccgaccccggctgaagcgcaagatgctgtcagagtgcgtccgccatggcgtccagttccacagcgtcaaggccgaggacgcgacgcacggggatgggcgctcgacgctgcgctgcagcgatgggtcccaggtcacggcaagtctcgtcctagacgccagtggccacagcaggtccctggtcaaggcactgataagccgtcttgcgaccaaacagggtaccagggcgcgtatggcttcgtggcagaggtcgagtggcatccctttgaccctggggcaatgctcttcatggactggcgtgacgaccacctggcagaccgcccagacctgcgagcctccaatgaacggctgccttcgttcctgtatgccatgcccctgtcagccacatctgtgtttttggaggagacgtcgctggtggcacgtcccatcatcccctttgaggatttgaaggtcaggctggaggcccgactgaagtatctcggactcgaggtgcggggacgttgggtgctcggaggaatgaagatttttctcaatgcggtgatggacaatcagcacgctgctaagtttggatgtggcaacccagtgtcggaaaaagagcaccctgcactttcaatgacagccaaccctaccctcctctctgctcccaaagatcaagagcatatctga

SEQ ID NO: 4564 - DNA, 306 bp, Chlorella protothecoides
atggggttgggctgcctggccggtatgttggagctcctcaggatcagactccccatcccaccccttcccatcctcccctccacaaccacaggcagcatcggctacatctccaccaatggtgcctttgacctgaacatcgtcatccgcaccgccgtcgtgtggggcgaccgcatcagcattggggcggggggtgccatcacggtccagagcggccccgaggccgagtgggaggagatgctgctcaaggcccgcgtcctccgccggtcggtggcctcggtggatgcgctgggggttgtggcggcctga

SEQ ID NO: 4565 - DNA, 525 bp, Chlorella protothecoides
atggatcctgccatcaatcccctgcgcacattgctcattgacaactatgactcatacacatataatctgtatcagggcatcgccgaggtgtacggagggcacgcccgtgagcccgagtcactccacaaacccatccatctctatcagtgtgccttacaccccccgctccctgcagcccctccaaaggtgatcagaaacgatgaagtggagtggccagagctgcgcagggatctggagcgggggctgtaccaggcggtggtgctgtcgcccggcccgggcacgccagccaggcccagcgacatcggcgtgagcatgcacctcctgcgggagcgcacccccatcccagtgctgggggtgtgcctgggcatgcaggccctggcactcgcctttggggccgaggtgcgccatgctgcctgcgggcccatgcatggccgcctgagcggggtcaggcacagtgggcacgccctcttccacggcatcccctcgggtgagcaggcgggacaaggatgccgcatcctgctctga

SEQ ID NO: 4566 - DNA, 207 bp, Chlorella protothecoides
atgcgcgacccccgcctcctcctgaacaacctcaaatgcaacaccgcagtgggcgtgtttgggttcaagacggtgctcacccaccgcatgaccatggggtacgtggaggtggaaacaacaaagaacagcgtgctgatggcgccggggcgcaccgcgcgggggcaggtcttccactacaccgagatcgtcgaggtgtgtgtggtctag

SEQ ID NO: 4567 - DNA, 822 bp, Chlorella protothecoides
atgtaccacgagctggccacggggtccccctctttaaacctggacgggtggatgctgacgcgcgaggcggtgtgcgccaccttcgcccgcggcgccgcgcacgccgatatcgcggtggtggagggtgtgatgggcctcttcgacggcctggacggcgccaccgaggccggctccactgcgcagttggccaagtggctgcgcgcgcccgtcctcctggtcctggactgctccgccgccgcgcggtcgctggccgccaccgtccgcggcttccgcgactttgaccccggtgtcgacctggccggcctggtgctcaaccgcgtggccggtgccgcgcacgcgcgctggctgcgcgatgcgctggccgccggcggcctggccgagctggcggtgctgggggggctgcccagcgtgcccagcgtggcgctccccgagcgcaacctgggcctgcaggtgccgggggaggacccgggcggcgcggccgcggcggtggaggcgctgggcgcgctcatggcctcccatctcgacctggatgcgctggtggatctggcggcgcgggcggggtccgggaaggacggcccggcgcgcgcgctcatcggcccgccgcccgcccccccgctcccctaccgcctgtcggaggaggagcgggaggcgccggtgcgaatcgccgtggcgcgggacgaggccttctgcttctactaccacgagaacctggcgctgctggaggcggcgggggcggagctggtctacttttcggccctgcacgagcccctgccagggggagtggcgggtgtctacctgggcggcggctaccctgagctgtga

SEQ ID NO: 4568 - DNA, 561 bp, Chlorella protothecoides
atgcagttccctcagtatcatacccaggccctgtacgacatgtatgagggtcaggactgggacccgcactcaacactggacctgttggaagagctggagcgcgaggtggcggagtgcttgactctggaggcttcaacaatgcagaccagctcgacctccgcaattgacaccgaggaagcgacggcagacgccgtggatgcgagtcaggaagcgttcccggccctgggatgcccattggtctcaaatcgagctcagcagccctcatcgaggccgacctgggctgccaaggccgcagcagcagcttccgccccggcccccaggccgccgccctccgccgcggcatcgcagagggctggttccggcactccgacctccgccaaaccgatctggctgtcgggcgaggacgtgcgccgcttcgagaccggccagagcgtcgccgccgactactccgaggtcagggctgctgcgcgagaccacgcccggctgcggaaccagttcttcatgcaggcaagcaatatgcggggggtgaagtgggggggggttggaggtctgggagtatga

SEQ ID NO: 4569 - DNA, 813 bp, Chlorella protothecoides
atgcacgacggcgagtcgtacgagctgtgcctgacgacgcagctgaccaggcagggcgcgcccccggcctggcccctctaccgtaccctgcgcgccctgaatccggccccctacgcggcctggctcgacttcggtgcccacggcgggccccagatctgctgctcctcccccgagcgcttcctgcgaggagatcgcggtggggtgctggaggccaaacccatcaagggcaccgcccctcgccaccccaaggaccccgtggccgacgcggcctccgccgccgagctggaaggtgtgtcagggggtgggcctgggcatggaccctgtcatccaggaggactgcaggccagacccctgccgcccagcctcacctgtcaccctccgtcctccaaacacccttccagcctccgacaaggagcgcgcggagaacctgatgatcgtggacctgttgcgcaacgacctgggccgagtctgcgttcccggctctgtgcaggtgccctccctcatggccctggagagctttgccaccgtgcaccaactggtgtccacggtcactggcctgcggcgcgaggtgggctgggcgcaggagggggggggggtcgtggcggcctggttccttcaccttttccacgacccactcttccacctcccggccctgccccttcccctctacagactgcatctgtggtggactgcctgcgcgcctccttcccgggcggctccatgacgggggcccccaagctgcgcagcatggacatcctgggccgcctggaagccgggccccgcggtgtctactccggtgcggtgactgattga

SEQ ID NO: 4570 - DNA, 315 bp, Chlorella protothecoides
atgggcggtgcactcccgaccctgcctcagcgtgtgctggggttgggaggcactgctgggatggtgcacccctccacagggtacatgatctcgagggttctgggtgctgccccgctcgtggcagacaccataatcgaccagctctgctccgtctcagacagagcacaggaccgcaacacgccccgcgccccacggagcgaggaggaggctgatgcaatggctgccgccgtctgggcggcgctgtggcccaagcgacgccagaggcagcgagagttcttctggtttggcatggaggtaaggcgtgagggtgtttga

SEQ ID NO: 4571 - DNA, 894 bp, Chlorella protothecoides
atgaggcatgcggatcgtgtgccatgctgcggcgcacgatcttcactgtgtatcactgaagattctgcacgtcgcttgcgcgcaggcccgccaggaacggctccaatcccgcgtccctacccatgcaccgacgactcatgcggcccggtccttggcactccgctcagcgccacgatcgacctcggcctggtgcatgccaggttagggaagggcgcgctgccgagctctctcggcgccgcgccacgcgtgtttgagcgcctcttccgccccgcgccgcacgcctggtggctggacagcgcggtgaccgaccgcggcggccgctggtccttcatgggctctggcaagggtggcgcgctctggcgcacggcctcctacctgggtgatggtgtgctggaggaggggttgagcggagaagggggtgcctctgcatccacgacaacccatcgcctgcccggcggcttctgggattggttggacgaggacgtgcaggcgcgacgtctctgcccggcggcggcgaccgccgccgccgacctgccctttgacttctggggcggctgggtgggttacataggctacgagttggggaccgagctggggccgggggcagggctggccgccgatgtggccggaaacccgccccacgcctcactcgtctgggcggaccgcctgctggcgctggactgcgccactggggaggcgtacgcgctggcgtgccacattcagggcgacggccgggcggccgatgaggcgcaggcctgggtcgcaggcatgctagaggcagtgcaggcggtggcaggggagccggatggggagaccactcctggcgctggggccgccggatcccgcgcccagcccagaccctgtgctagacttccagccccgggagcggcatga

SEQ ID NO: 4572 - DNA, 627 bp, Chlorella protothecoides
atgctgacgcgggcgctgcccggcccgtttggcgagcgacacctggcggacctcctgctggtgcacgtggtggcgtggcccggcgcggcctgcacggcgagggtgcggcgcgccgcggagctggcgtttgtggcgtccccttgggcccctgcgtgtgagtgtggagggggctggggagccgggggagcgaacgcgccgcgcgtccgggtgcaccggctcacccgcggagagaggggcgtcctgcgcccacgtcccgtgctcgcgctcattccgcaccgcttgcctcctggcaggggcgcgtggcgcgagcggcgcggaatctcagcgcccggcgcgagtggacgttgcctgcgtccccgagggggcgcagcgccgcgacctggactcgctcctgctcccggccctgggcggcgcggcgcaggcccctccaccctcggaccccgccccctcggaggctgcatggctgcagggggcgcaggctgcctgggaggcggcggcgcgctccccggacctggcagagtactatgccaggctggagaggacggcgttgcggggggctgctggctggaagctgcattcacgctgatgccgcgcgggaggcaagcactgtggagtctcggtgtctga

SEQ ID NO: 4573 - DNA, 1509 bp, Chlorella protothecoides
  modified_base (323)..(332): a, c, t, g, unknown or other
  modified_base (889)..(898): a, c, t, g, unknown or other
  modified_base (1241)..(1250): a, c, t, g, unknown or other
  modified_base (1477)..(1486): a, c, t, g, unknown or other
cgcgcggccgcgcggctgctgccggccgcgctggcgccgcgcgaggccgccttcctgcccaccgccgcgctgcgcctgctggacacgctgcacgccatgctgccggggcacgccctgctggcagccgacttcgactcgctgccagaggtcagcatccgcggcgtcaacgcccccctggtcgccaccaccggtcgagcaggcacttcatctctcccccgcccgctcctcccccttcgcctcgccgtggacgcctctcgccttccaagccccgctcactccccaaaaccccccggctcacacaggagaaggggagcacgcgcgannnnnnnnnnccaggcacttcatctctcccccgcccgcttcttcccctttgcctcgccgtggatgcctctcgccttccaagccccgctcaatccccaaaccccccccgctcacacaggagaaggggagcacgcgcgaccacggcacctacctcgtcccgcgcggcaccgcagacatcttcttccccaccgacttccggctgctggcggagctgcatgccgaggcggggtgcggcgccgccagaccccggcccacctgcagcagcgccgtcaagaccgcggagttcatgggcatctgggcggcgccgggggcgacgcgcacgcgctctgggtacgagccgctgctgtccgactacagcaacacctccgtgttcctggggggctgcccggagctgtgcgacccgccgctgggcgagagggtgtaacagtcaggcagcgcggcaggagagggagcgtagatccaggacttcttggtgtggggggctgcccttctgcccatgggagcgagctgggcattcagaggaggggcagggcattcgaaagcagggcatcacttggctgcctgcatnnnnnnnnnncctttgtgtgggggggtgcgcttctgcccagggagcgagctgggcattcagagaagggcagggcatcagaaagcagggcatcacttggctgcctgcatgagggtgatgttgtcgcccttgagcagaatgcggcccaggggcttgcgcgtctgccgcttcacggaaacctcctcgccctcgtccagcacgaggttcatgtattcatcaaagccctgcgcgggggagggacggagggcgtgtgtgaaaaggatgggaaagattcctcttggcagcacccagggcatgggatagaggctgcagggacatgcagctccctcccaggcgtgccgggctgcgggtgtgnnnnnnnnnnagggaggaacggagggcgtgtgggggaaggatgggaaaggttcctctgggtagcacccagggcatgggacagtggctgcagggacaagcagccccctcccaggcgtgccgggctgcgggtgtgccgacgttgcagcgcactcaacagccacgctccacaccgtcgatcctgtgggaaccacccattccatcagaatcaaccatccccactcacgatgatgcggcccnnnnnnnnnngcgctgtatggggcatgacgtag

SEQ ID NO: 4574 - DNA, 285 bp, Chlorella protothecoides
  modified_base (124)..(133): a, c, t, g, unknown or other
atggcgccgaaagtcaagaggatcatgacacagcccattgtgagtgttggtgatggtggctgcagccctgtcggacaacggggtctgcttgcgcaggctgggtctacgggtgctacatcatgcnnnnnnnnnncccgtcttactccggctgccctctgcccccacctccagaacctgattttcaggtttttgcaaagtcggcagaaggtgcaaatatggctgtacgaccacaacgacctgcgcatcgagggccgcatcatcgtgagtggggatggttgtttctga

SEQ ID NO: 4575 - DNA, 2304 bp, Chlorella protothecoides
  modified_base (391)..(400): a, c, t, g, unknown or other
  modified_base (928)..(937): a, c, t, g, unknown or other
  modified_base (1079)..(1088): a, c, t, g, unknown or other
  modified_base (1663)..(1672): a, c, t, g, unknown or other
  modified_base (2148)..(2157): a, c, t, g, unknown or other
atgcctcacgtcaaaggcaataaatttaaaccagcagcagcagctcctgccgcgccgcaggtgggcgccctcgatgtcgctggcccttccccggtcggcaagcagcctgtgcctgagaaggcaagcgatgggtctgccccagcacctcgcggaagctcggacactccacgccccaccactcatggggcgcaagtccccactgctggaaagacagcagccccacacgcgacagcaccccctggaaagcggcggagaaagggcctgaaggcagcagcccccccagcacaacaggtagtgcagtcgctgccggcgacggtggtgccgccggcccccaaggcctctgcctccggtgccattgtggcagcccccaactgggctgcactcaaggccnnnnnnnnnncgccgggtgcaggtacaaacagcggccggggcgtcaccccctcttcccgcacgaaccccgtcacggccgtgctggctctggactgcgagatggtgggcgtcgggcccgacggggagaggtcttccctggcaaggtgcgaggggggcttgtactttttccgctccactccgctgctgggcaagtgttcaaagcttctggatggaaggagggccgcctgtgaccctcccttgcagcgagcgctgcgttctcatccccaacagtcagatgggaatgcctcaaatcaccccaggtcagatgagagtgcctctcaccaccccagggtgtgcatcgtgaatgctgaaggcggcatcctgctggatgtccacgtgcaacagaaggagcgggtcaccgactaccgcacccagttcagcggtgggtggaggggcgtggctaggcatgcatgtggtcaggaacaagtgatgcactctgaaagtatctgctgccctgagcgatgtgctgagtcgctccatggcaatacttttcctctcnnnnnnnnnnggtgggcgtcgggcccgacggggagaggtcctccctggcaaggtgcgagcggggttcctaccttctccgctccactccgctgctgggcaagtgtatcaaagcttctggacggaaggagactgcctgtgtccctcccttgccnnnnnnnnnnggtcctggtcggccacgcgctgcacaacgacctggaggtgaggtggggttgggcctatgggcgaagattgcagcgtgccggtgggggctgcagagcctgttcgtatgagggcatcagcagtgtatttgaacggagcgggtcaccgactaccgcaccaagttcagcggtgggtggaggggcatggctaggcatgcacgtggtcaggaacaagcatccgacccaaagatctggaccaggcttggccccgggaggttgtgcaggcctgggtcaaagacctggtgacaggcagggtcctggtcggccacgcgctgcacaacgatctggaggcatatgtgatgggtatggaaccgtttggtgtgctatgctgactcctgggcaattgccactgcctctttcccaaggtccacttccatctctcttttgctacccacaggcgctcgagatgagccatccaccagcagggttgcgggacacagctagatacccgcccttcatgttccagcaggtgagcccttccggacccaggccatcattatcgcttgacattgttgtcaagaggctgcacaaggggggcnnnnnnnnnnaattgccactgcctctttcccaaggtccacctccctcccccttctggcgtccacaggcgctcgagatgagccatccagcgacagggtcgcgggacacggccagatacccacccttcatgttccagcaggcacaaggggggaggtacaagtcgcggtccctcaagcagctgtctgctgaggagctaggactgagcattcaggatggggagcactccccagtggatgacgcccgggccgcgctgtacctctacctcaaacatcgcaagggtggaaagaagacaggaagtggcgctcaagcgcacaagatgccgacatgggaggagttgtcacggaatgatggcatgattgacttgtctgcagagctagaaatactttgcaggctcgtggcttgtaggggatccagctttcctcccgtgatgggcgttctgccacccgagtgtgctgcatgctgagttagaaacactttgcaggctcannnnnnnnnnagctccactcaccctgttgaggtgctgccaacagcctgtgcccgaccactatctacccaggccacggaaggcatcgcagcggagctcgtgcagctcgagccctgcacacccggagaggctgagcctcgcttccctcttgggccttag

SEQ ID NO: 4576 - DNA, 2058 bp, Chlorella protothecoides
  modified_base (49)..(58): a, c, t, g, unknown or other
  modified_base (552)..(561): a, c, t, g, unknown or other
  modified_base (633)..(768): a, c, t, g, unknown or other
  modified_base (1903)..(1912): a, c, t, g, unknown or other
atgaggaaagagatgacccccggctcagcacctccggctctgcctggcnnnnnnnnnnctaaaagtgtcggcagcatgagggaagagatgactcccggctcagcacctccggctctgcctggccgtgcgcccaaagcccctggtgacctcctgctgaccctttgtcgcttcttcaacatggtgaccataatatgcagtctggtgtgtgccgccgctttcggcatggccatcgcagtgcgggtgcacgcgccagacaaggacatctactacctctcgggccaagcggtacgcgtgtacggcttgctgacggccatcctggtggtatttgtggagctagaggtggccgccctggctgcctggtggcccctcctggagatctggttaggccgggcgatgctgcagagcttcgtaggagttctcacgtacaggtgtggtggggaggctgaggataggctcgtgttgtcatgcaggtgcatgactggtggtcgaggtgtcttggtgaaggttcagaatatgcaacccatcgagagtcaatccggtcaaggtccaccnnnnnnnnnngtatcgacagcttccctccgtcacaagccgacactcaattccatttacaggacatctactacctctcgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggaggctgaggacaggctcgtgttatcatgcaggtgcatcactggtggtcaaggtgtcttggtgaaggtgcagaatatgcaacgcatcgagagtcaatccggtcaaggtccacccaattcgacttgcaagcctctgctagaccctgcctctcaccctccctccccgctttacatgtgcagggaggccctcccccgtggcgacaccgacttccaccgcagcctggcgctgtaccgcggcatcgccagcgtcgccctcctagtatgctcgggggtgtatgccgtgggctggataagctgcctaggtaccatcaaacacagccacagcgtaaaccttcctttgttctaccattccagtccggacacgtcgcgaccagcgactacgcaaggcacaggcagagtacgaggcactggagaagcggagggccgagctgcagcggctcctgcaccccattctcatccccttgaatccctctgtatggcaatgatatgcggtctggcacccaagcgatgcagtgtgacgggtcgcttgctctctttaacatttgtgcaatgcaatgtctctgtacaccaagaagtgatggcaatcagacgctggggctcacccagggccgagcggtggaaggagcctctgttgcgcacgtgtgcagggatgaggacagggacaggcttctcctgtggatgcaagatggcagcttccactggtactgccctagtacctcacaggtggatgcccgggatgagtgtctgtgagggaaggctatcagtgcaccggtcatggaggatgttgagctccatgactgagagcttcgtctcgcggcgtccctcgcagcgccaggagctcggcagggtagacacgccatgcaatggcgtcacggcgttcctctggacgccagaggcggatggagtgctggtgggcacccagggcggggacctcctgctcatcaccttcccaccgggggcgggccccggcgtggaggagattgggtacgtcgagggcggggtgaaaggcgcggcgtggagccccgacggcatgcgcctggtccttgtcagcggcaatggacagctgctcatcatgtcagaggtgcgatcagatgctggctacgtcatgggaaactggggtcgctccatggagnnnnnnnnnncatggacagctgctcatcatgtccgaggtgcggtcagatgctggctatgtcatgggaaactggggtcgctccatggaggattgaggctgaccagcgccatctgtgcgtgcacacaacttgttcaagtatggacaggctttttgtga

SEQ ID NO: 4577 - DNA, 996 bp, Chlorella protothecoides
atgtctccccgcggagatcttcgcggcttggagccgcatccggccctgcgcaaggctcattcacagagcgatcgctgcctcaccctgccaaccaccgtgcatcacaacaaccacctccaaggcaagctgggcctacgggttgagggcgtgcgggagctggccatggaactggcggacgagctggtgtcggcatcgcgccccgcggaggccgccgcggtgcggctggagtactgtcgcgacgtggacgcggccgccgcgctgctggcggcggccagggagtggcgcgagggcgcgcgcgtcgccgcctcccacgcccgccccgacctgctggaccggtacgcggcgcgcctggagcacctggcggcgcggcggcgggacctggcggctgcccttgcggcggccgaggcggagcgggggcaggaggggggggatgattgggacggatccgacgcggggcgcgggcccgggtccgacgccggcgacgacgcggcgtcggaggccagcggtgtgaccgagctgagcgcgtatacggacgccagcctggcgcccagcgcgcagagcacgcgcagcgggcacagcagcgcgtccacactgggcggcaagcgcaggcagagcgccaagtcgaggcgcaaggcgtccagcctgcgcgcgtccagcctgcgcgtgcgccaaggcagccccgaggaggaggaccagctggccaaccacctgctgtcgcaggcgcccagcgccgccttctgcgccgagatgggccagctcgccgagttcctggtgctgctgggtcatgagtccgatgcccggcggctgcagcaggcggtgggagagctggtggcggcctgcgccgccaccggcgccgccatccttgcctcgcccccgccgggcatgctggccgaaggcgggcaggggcccagcccacagctggcgctgcgcgtggcagccgccgaggccgaggccaagagcgtgacgtggaagtgggacgtccttcgagccgtctga

SEQ ID NO: 4578 - DNA, 657 bp, Chlorella protothecoides
atggcagccgcggcggctttgctagccatgcagcgagcagcccggtgcccccagctcacagcccgggccccccagctcaccgacctgcgacgcgccctgacccccggcctcggtcgctgctggagcagcgaagcgacggatgggcccgagggcctgcccctggcccaggtggccaaggcgtgcctggccggcaacccccgggcccagctcacgaccgtgcggggggaggccctcaacgccgggacggagcccaaggttggctcgtgcctggtgcacgccctggccccccggggcctgccccccctcgtcctcctgcaccccgccctgcacgccgaggcgctccgtgacctggacctcaaccccaccaaccccgccagcctgtgctacggcgccaccgacccgccgggcctgctgcagcacgtcagggcggccgggtggctgccgccccgcctcgtgctgctgggaggcctggcgcctgtggcaccctccgaggtgcggggcgggctggcccgatgcaggcgctctgcctggagggctccaaatccacagattgcaggggccgaaagcctcgaagctggcttgttcgtgagagcccctgggcatcgccagcaccacatggggctcgcgggccgcctgccccgatggcctcgtgcctga

SEQ ID NO: 4579 - DNA, 336 bp, Chlorella protothecoides
atgccgggcctggacgtcggacccctgttcgagacggtgcaggccctggacagcgccctgaccgcccagctggctcatcccgggcaggccaccttcctattagtgggtgccgccgggctgctgaccagcgtgtcgccctgcaccctctctgtgctccccctcaccattgggtacatcggcggctacggcgatcaggccggcggcacgtccctgctggccaggtcggccgcctttgcgactggcctcgcggcctccctggccctcctgggcctcgtcagcggcctcgtgggtgtagcatacggacaggtcagcccagggtggtgctgggtggagtga

SEQ ID NO: 4580 - DNA, 243 bp, Chlorella protothecoides
atgcatccgcccggcgacgtgaggatttctgtgacccccggcgcacccaaacccaatccctgtccccaggcggcgggctcggtggcacccatcctcgtcagcatcgtggcgatggccatgggtctcaacctgctcggcgtgctgagcttccgcttccccaccctggactgggatgtgcgggacctgggcctcccacccctcgtgcaggccttcctggcaggtgcgtggacggctgggtgttga

SEQ ID NO: 4581 - DNA, 204 bp, Chlorella protothecoides
atgccctgggtgctgccaagaggaatctttcccatccttttcacacacgccctccgtccctcccccgcgcagggctttgatgaatacatgaacctcgtgctggacgagggcgaggaggtttccgtgaagcggcagacgcgcaagcccctgggccgcattctgctcaagggcgacaacatcaccctcatgcaggcagccaagtga

SEQ ID NO: 4582 - DNA, 2181 bp, Chlorella protothecoides
  modified_base (2143)..(2152): a, c, t, g, unknown or other
atgcgcccacccatccatgcacaccccctgatcctgcccctggaatccccccgcaccccagacctggctgacctggtgacgggcgcagagggctcgctggagagcgggacgcggctgtacctggcctgcctgcagcagtgcgtggtgggccacggcgggctggaggccatcctggtggcgctgtcggacgcctgggagctgctgcgccactgccgcgcgcacaacgcggcgctgacggcctacccctccggccgctgggtggcgccccagaagttcacgcgcgtgacgcgcaagttctggatgcgcgcctgcgacgcgcccgccttcaaggcggaggtgatcaagcacctccccgtcctcatctacggcgaccgcgccaagttcaccgagggcgacgtggaggcccggcgctgcctggccggcgccgcgcacgtcgccgacgccgcggcggtcacctcggtgtactttgacaaccccgaggagctgccggtgtaccacgcgcgcctgcgccgcgccgacggcgccacggcggtgcgcctgcgctggtacggtgagcgcgccgccgcctcgcccgaccaggagatcttcgtggaggagaaggtacatcgcgagtcctggaccgaccacttctcctccaaggagcgcgcgaggctggtacagggcgaggtggccgcgtttctggcggggcaagacgtcggtgggtcgcgccctgccgaggacgccgccctcctggcccgcgtccaggcgttcctggtgcgcgaggctcaggggccctttttgcggaccacctaccagcgcactgccttccaggccagcgactcggcggcggtgcgcatctccatggactccgacctgcgcatgatccgggaggcgggcgcgccgcgcgcgcggggcgactggtgccgcgaccttacccgccccttggcccccgccgacatcgtcaacttcccctttgtggtggtggaggtgaagctgcagcgcaaggccccggagtggctcacccccctgctgaagtccggcaagctcctggccgtgcccaagttcagcaagcacatccacggcaccgccgtcctcttccagctcctgaccgagaacgtgccgcactggttcctgccggacgccgctaaccccagcctcatgacgccagccacctggcacgagctggcggacaagtcggacgcgctgctgcgggacgccgcctcttggctctttcccagcgccgacgggggccggcgccgcgacgccgatcccgacccggatctcgcgcccaaggcctcgctcctgcgccgcctggcgcggcgcaaccgtaccgcccccgtcctgctgcagcccggggtcaagggggcggtgggaagtggaggcgcggaagccaggggccagtcgaccgccggcgcagagtggcaggcgcccgtgccgccggctcccgctggtggtggagggagtggcgagcgggccgtcgaggaggctggacacgcagacgcagcggagcacgacatcttgtcgggctccgctgcgcacgcgcgcatgcccacctggcccgtgtttgcggcgggggaggcgctgccgccgccgacgacgtgcgcggggcctggcgacggcgcggcacatcccacgcgcattcccacgccaccgccgtcggccttcaccgggcccggctccacgccgcagccctccgtctaccccgtgtcgcagctggttgctgtgcccatgatgctcacgccgcgctcctaccacggcaacagcggcggcggcgaggacaacggcgccggcgcgctgcagcgccactcctcctcctcggagcagggccccgggaacggcaaggccaagaacacggggtcctccacgccggaggacagcgcgcgcgacctggaggctgggcgggcgttgctgggctccgcgggcgacctcaaggtcctggggggccaggatgccgtgaccctggcggccacgcgctcggggcgcgtgcaggcgctggtgcgcacgcgcgtcgagcccaagaccttcttcgccaacgagcgcaccttcctggcctggctccagatctcagtcctggtcatgctcaccgcgctttccctgctctccggctcctccatctccgtccctggggcggggtccgccagcggcgggtccgaggcgtcctgcnnnnnnnnnngtgtcaagacccccttgccctgtccctga

SEQ ID NO: 4583 - DNA, 828 bp, Chlorella protothecoides
  modified_base (396)..(405): a, c, t, g, unknown or other
  modified_base (530)..(539): a, c, t, g, unknown or other
  modified_base (795)..(804): a, c, t, g, unknown or other
cggccgccgtctgaccccgggccagcagcaccacgccgctggtcccgcggtcgaggcggtgcaccaggcgcagctcaccggggtcaaacggcagcgccggctgggggcccagcacgccgggcgcgcgcgcgaggtcggccaggcaccagcggatgccggggccgccctgcgtggccaagcccgcgggcttgttcacggccacgaaacgtgggtcgacgtgcagaacggcgcggcccagcgccgccagcagggcgcgtggggccgcgggggccgaggggcgtgcggggcctcgctcggggtgctgcttggggtctggccgttcctgcttggggtctggccgctcctgcttggcgtcgccccggtgtgacacacacacctcaccggatccccatccannnnnnnnnncggtgggacaagggcgggcaggggtgggcgatgagctggcctggctggcacggaggtgacgcagtgaaaggagccatgcaatacccactcctgccacgcaatcttcccaggagcaccctgccagnnnnnnnnnngctgcttggggtctggccgttcctgcttggcgtcgccccggtgcgacgcgcacccctcaccgcatccccatccgagctcggagcgggggaccagcaggcgagcgccggggggcagcagcgtcgtcgcgccgacgcgcctgaccttgtcctgccctgggtcgaacgcgcgcacggtgcgggtgcggaggaggcggtgccgggtcgaggtggggagattcgggcctcggcgccgcagccaggacagggctgcggcggnnnnnnnnnncccagccctccagccaggtgctga

SEQ ID NO: 4584 - DNA, 879 bp, Chlorella protothecoides
atgcctcctgccaagctggccaccctcctgcgccagctggactccctctcgcgcctgtcggccacctccttaccttccaagtacatgcctcatgccggcttctcctgggcgcctttcggctgcgcccgggccctgcgcacctgcacccccccccgggcgagcttctcccgcagcccggatgcccgccccgcccccccctgcctcccccatggcccgctcctggaccggggcccctggcggcacgcccgccggatgagcgtggaggtggccgctgcccgccactcgggcgggccccagggtgtaaacccgggcgcccttgtccagttccgtcgcggcgaggagttccacctggggcgcgtggtgcgccccaactcccgcggctggcaggtgcaggacgcgtcgggggcgctgtacggcatccgcgcccaggacatcgcgtaccgcctgcccggcgaggacgctgacctggcggtgctgaccgcggaggtggagggcatgctggacccggccctgctggctctggggtgggaggtgtcggaggcctccgcgctgtacagcgtggcccagatggccagcttcctgtacgggtcggagggccccgcggcgcgcgccgccgcgcaccgcctgcttcagcaggacggcaccttcttcaagcaggtggggcgagagccgcccctcttctccccccgccccgcggcggcggtggaggcgctgcgcaccgagcgcgccgcgcgcgaagccgcgcgcgccgccgccgccgagttccaggccgccgtgcacgccgcgcggcgcgcgccgccggggtcaaagcccccgcctggggcctgggcggcggggccgcacgccgagcgcatggctacgctggccgcctacgcgctg

SEQ ID NO: 4585 - DNA, 720 bp, Chlorella protothecoides
atgtcaagttatttggctcttccactccactgctgcagcgatctacttgaaggccaaatttgcgacggtatgctgcaggctgcggcccgtcgcgggggcctgcgcctgcttggggcaccacatcgcccctcgcaagccctgatcgacgcatctggggctcaaagattatattccgccggcattgacggtgctcgcgcgggtgtgcagacggccgaaacgtcgtccccggcctcagctccaaaggcccctgcggtgctgcagctgcacagcgacgaagaggtccagactgcactcaatgctctcggtgggtacatgcgagatggtcatgaccttcgggcttgggtagatcggagcagggaagcggcaatgccggagcagcagcgcggctgcctgtgttgcagcaccgagattcctctcctacatctaacccgtgcaggtgcccatggccttgccatcctggacttcacggccgtctggtgccccccctgcaagatgatcgcgccactgtatgaacagcttgctgcaagtcaccccgccatcaacttctacaaggtcgacattgatggggaggccgtcaggggcaccgtcctggagcaggcggtctcctccgtgcccacctttgtgtcgtaccgcggcggcaagcgcctggaccagttcagcggcgctgaccgggccgcgctgcagctcatggtggatgcactgagcagcgccgcagcatga

SEQ ID NO: 4586 - DNA, 1017 bp, Chlorella protothecoides
atgggggggccggccaaccagctgggccacccgttgcgcatcgaggccgccgacgcggcggtgttcggctacgtgctgctgaatgactggtcggcgcgcgacctgcagaagtgggagtacgtgccgctggggcccttcacctccaagaactgggccaccagcatcagcccctgggtggtgaccgccgccgcgctggagcccttccgcgtccccgcgcccacccaggacccagcgcccccggcatacctgcgttcgcaggccggctgcaactacgacctggacctgcgcgtgggcgtcgcgccggcggggcgcgcggggccagaccccgtcacgcacaccaacatgcgcacgctgtactggaccccggcgcagatggccgcgcaccacaccgtcagcggctgcccgctcgtcccgggcgacctgcttggcacggggaccatcagcagcgaggtgggctcttcgggtgcggaagcattgggggtcccgtggtcatctggacgcgaggcatgccgcaccggctgtgggctgcgccaagacacgctttgctcggcgtactccgtgccagcgcgggttgaatgttttgagagccgatcagctgccatggggtttctggagtgcttgctgaccagggagcctccgatcggcatgggcaatcaaggtgcacaggcaggcagccatgctcctcattcctctgctgctgtcgggcaccacgctggcatcggcacgcctgcgcgccactcaatccttctgacctcctccacctcccttcccctgatgcccacactcgcagggcccgggcggcgcggggtgcctgctggaggcgacgctgaacgggacgaaacctgtggcactccagagcgccggcacgcaccgcgcctggctgcaggacggcgacagggtggtcctcaccggccactgtcagggcgagggttaccgcgtggggttcggggagtgcgccggcaccctgctgcccgccctggacctcaccttggcctaggcgcgagaggggccgcctag

SEQ ID NO: 4587 - DNA, 342 bp, Chlorella protothecoides
atgcaggccagggaccttggcggcgcggctcagaaccaagtcccggcgccttgcctcatcgttacccctctcccacacattcgtcaggcgatggactttgcggcggagacgctggggttcaggcacgaggacatcgtggcggcgggcgacagcggcaacgatgtggacatgctggagggggcgcccgctgccatcgtggtcgccaatgcccagccagacctgctggagtgggtggagcgcagccgctccccgggggttatccggacccgtggatcccgggcctggggcatcctggagggtctggagcggctggggggcgggttccagccgcccacgctctga

SEQ ID NO: 4588 - DNA, 732 bp, Chlorella protothecoides
atgcagcctaccacgttcagggcgttcgcatcgtccactcgtgcatcctggtggccttccagctctcctcccgagacggccaaggaaggagggaccagcgcagccgcaggcaccgagcctgccgccgcgcctgctggtgagcccgccacagaggccgctgcatccgatctcactccagacgagctgaagcaggcactgcaagccgccaaggagcagctggaactcgctcagaaggaggctgcagaatccaaggaccggctggtaaggacactggcagacatgcagaatctgcgagaacggacggcccgacagattgccgacaccaagcagtttgccgtccagggagtggtgaagtccttcatcgaggtggctgataacctggatctggcaatagggtctgttcctgagaaggagctggaagggggtgaggacgtcgatgtggagagggcgctcaccctcctgaagcggcttcgggatggagtggtcatgacggagagcatcatgctcaagctgctggagaaggagggtgtgaggaagtatgatccccagggcgagcccttcgaccccaaccttcacaacgccatgttccgtgtgcccaactccggggtcaagtctgggcatgtggcccacgtcattaaggacctggtatccgtgagggaagctgtcaaaaagttgggcacagtaagaggcaccagaattttgccactcttgtacacaaccgaggagaggtaa

SEQ ID NO: 4589 - DNA, 819 bp, Chlorella protothecoides
atggggctcgcgttgccaaggtctcgcgagcatggccatgcccgtcgagaacttcaatgccgcgttgttaaccagcctctcgctgtatgccgctcttcttcccttcccaggcacgcaagcagcggggcctgcgacccctccaactactccaaggtacatcacaaaccccgctgccccgcgccacgctgccgtgagcgcctgaccagcgtctcggcgttcacctgcaaggactgtgggaccacggtctgcctggcccaccggctgccctcagaccacgcctgcaccagccttgcggcacccgggggcagcagggcacagggacgctcctctgcaggcgcagttgcggctgctgcggcgcagagcagggtggccgctgccttttccaatcttttcagcggcagcactgcgcgagggacgccggcgaaaggccagggccggcgcaggcagcaactcccatcccagggggaggccgccagacccagcagcagcacggctggggtgccggcttctgcttgggagccccatgcgacgccacgctcttcccaagcgggctcccagccccgagccccgccctcttccgcgaacgaggaatgccctgcctgcggcgactgctttgccgacgtggggcagctcatagcccacgccgaggtcgcgcaccgcgacagctgggccagcggcgcccggctgctgcgggaagcctgcccgctgtgtgagctgcgcttccacgaccctgtccagctcgtggagcatgtggaaaggtcgcactcgggtggcaggccacagcagagggagcccgaggcggtgtgcgtgctgagctga

SEQ ID NO: 4590 - DNA, 258 bp, Chlorella protothecoides
atggctgtgggggacgcggacgaggctgatctcctcagcgtaggcacccactgcgcttttcccgactgcaaccagctggacttcctaccattcacatgcaagcattgtcgtggagtgttctgcctggaacaccgttcccaggcacagcatgagtgtgcacgcagagatgcagagcctggaactcttgtctgccccgtgtgcgccctggccattcgcccacggccgggagagtctcccgacgcggcattcgagaagtaa

SEQ ID NO: 4591 - DNA, 996 bp, Chlorella protothecoides
atgcttgtactcagagttccccactcccacccctcatctcagaaccagaccatccggccgcgcccccaggcgacagcaaacccgcaacccttgcgtcgatcgaccgctgccccccagcccagcgtggagctcgcctactccacgggctggtccggcgcgagtctgcatggatccattgctggacaggagtggcagaccctgggcctcaagcccgtggtgtctggggctggtgcctggcaccacctgaacctgcccgtgccggcccagggcaatcccccgacgcccctcctggagtttgtcatgacagacggggcatcgggatgggacaagcccgcggaaggtgggcactacaccatcgccgcgcccggccggtactgcctgcagcacgggcgggtggagagcgtggcccactcccgtcgcctgctcctggtcaccgacctggacgacacgctggtgggcgacgacgaagccaccgccgccttccgcgactggtggctggcgcgcgccatgcccgccggcgcgcgcctggtgtacaacacggggcgcgcgctgggcctgttcgaggacctgctctgcgccaagcgcggcctgctgccggagcccgacctgctcctgtcggcggtgggcacgcgcgtgtacgagcggggagccgagggcgcctggcgcgccgcgccggggcacgcgccgcgcctggacgccggctgggacctggaggccgtgcgtgacgcggcctacgcggcgctggcagcggtggggcgggacgccatgcacttccgcccgcccgcagagcagaacgagcacaaggtgacctgcggtgtccacgtgggcgcgctggcgcgcgtcgcgcaggacgtgcgcgagcggctggccaggcatggggtgcggctgcgcctcgtcgccagcggcgtcggcgactggaggttcctggacctggtcccgatggcggccggcaagcggcaggtgggtggtgattcctgtgtggggtgtgtcgtttga

SEQ ID NO: 4592 - DNA, 858 bp, Chlorella protothecoides
atgaccgttcttcataccatatcgatcgtcgtgcccggcactggcgcggagtcgttccctttttggggggtccctaagcaatgcagcacctggggttgcaggggaatggaggcaacagggctcccttcagaaactccccccacccgcttgtacagggtccagctggtgagcctgtgccgcttcgtgggcatcacaccctatggcaccgacgccttcctgcgcacgcgcctgcggcgccacctgcagcagatcaaggcggacgaccgcgacatccaggcggagggcctggcctcgctgtcggaggacgagctgcgcggggcgtgccgcgcgcgcggcatgcgcgcgccctttggtgagggcgccgccgacttcatgcgcgcgcagctggcggagtggctggactggagcctgaaccgcagcctgcccagctccctgctcctcctctcccgcgccttcaccgtgaccagcccgctgtccggcggccggcgcggcgtggacgaggacatgctgcgcagcacgctgggcagcctgcccgacgaggtggtggaggacgtggagctgtttgccacgcgcgacggcgacgacaagaccgaggcctacgagcgcaagctggagctgctggagcgggaggaggagatgatcaaagaggaggaggaggcggcggtggccgctgagacgcccatcacctccggcgcacagactgcgcaggagctgaccgccgccgtggccgccgcggccgtcgtgcgcgaggccgccgcctcggccatggtggacgtgctggagggggtgagcgaggaggagaaggccgccaagtacgcggaggcccgcaggagcaagatgcgcaaagtggtcaagtga

SEQ ID NO: 4593 - DNA, 1296 bp, Chlorella protothecoides
atggtgcaggccgaggcctccccagccggcctcgcttcgctgttcgaggagctcatcagcctcaaaaccggatcgcagctcctgggagatcaaccggactatgcacccgcgctccgtgctgccagcgagcagatcctcaggctgcgggccctgctccgggagaggtgcgagcacaccgagtccctgcgccaagacaccgctgcggccaaggccaagctggatgagagctccctagagctgaagaatctggcctatgagaaggagcactacaccaaggagaccaacgcctgccgggcattcaacacgtctcccaccgttccccccaggtcggcctatgccgatgaagccctggagctcttgccggtggaccagttcctccggatctggggcgaccaggatgtggacgatccccaccgcctcatgctcaaccgcctgacccacgagatggtgtataggtggggcaaacatctgtgctctctggaggcatggcctgcggctctggctcgctggatcagatctcctttttctccagtatttcctgcccgcgccatcagcctcccccactcgcatggccccttcgctcgcagaaaggagaccatacagcagctggaaggcctccgcgcaaagcgcgacgcgctggctgctgaggtggccggaaagcgcggcactgtgagcgggctggagagcgagctggcgggcctgcacgccaaggcgctcgcgttggccgagcggtacggcgcggccgtaccgccagcgccaggcgcagcagccgcggccctggcctccgcagcgacgctggcgccgcccctgtacgtcctgcactcccagctgctggcggcagcgcggaggggggaggcagaggcctctggcaggcacgccagcgttgaggtggcggccgcgcccggagaagatggccgaggtggtgagcccatcgtcgccctgcgtgtcaccagcggtgatgccgtgagcctggccgtggactttcggtactctgcggagctgggagcagtcctggccgcgccccacccgcccaccaccgctgcacaactggaggcggtggggggtggcggggccgcggcggcggggcatgcgcctgaaagcggggcctatgcctgggcgcagtccctggcggggctggacctgctgccggcgctgccccccgccccggcgtcggcggcctggagcgagacagagctccgggaagccatcgatcggtacacggcggcaaacaccgcgccctccatcctggctagcctgctcgaggcatcgcgccaggaggccatggaggaggactag

SEQ ID NO: 4594 - DNA, 1557 bp, Chlorella protothecoides
atggctgctgtccgccaaggctgctccaacgtcttcagcaaggccacggggggcgagatcccggccatcaagctgcgccccggggtggcactgcctcatgtgaccctgcccacgacggaggtgagggggggcgcgatgtgggtgtgcggcgtgcatggggtgtgcggcggcacacttcccccgtcccgggagtcttggaatcgcccgcggtcttgcgatgtccccatgccgcccctcacagggaggtcgcgtggagctgggagcgcctaccggaaggtggcagctggtggtggtgtaccgtggccagcacgatcccctggacctgacttacctggctgctctgcaggtacgggtggtgcactggcctgtttgggtatgggccatgcctgcaaaggtctctccagtcctgcatggcaacatgtgggcctgcaccgagtcactttggctctcttcgcatgcagcacctctaccctgagtttgaggagctgggagtggatatctccgccgtgtcagccgacacccgtggcaaggcctgcagctttgtgtttgacgcttgcgagcaaagtgtgcgtgagggatggttcaggcattgggattttctggatgccctttcaggcaacactctggcatgcttccttggccacattgttttgttctctcaccctctttcctgctatacatgacgcttctggccccgaccgccctctggcttggattcagcctgcacgttctttcccctcattatgccaggtggatgacctgaggggtgccgtcctggcagtgagccccgacaccaaggccggacgcatcggcttcaaggttgcctacggcctgaacgaggagcagatgctgcgctggggactgtatgtctccaagcccctgggccccgatgagtccagctccctgttctctggtgagttgtgggttggaggcctctggtttggggcgattgatgaccagatatcagtccctggggcgctgcccacaccaccagtccctcgctcctttcaaggtctgctgatgtgcatcccgagcacacaccagctccttacaatgctcctgtccccccctccccccttgaacacaacagagccggccctgtttctcatcaacccggcgggtctgctgcatgtcgtcacctactccaacgccagcttcgcccgccccgacctgaagcagatcgtgcagggtgggtttggcagagaggaccgagggactgtgtggcgtgacacagctgcggaacagagtgtgatgaggcacctcctccaaattctcccctcccgcaggcatccagtttgtgcaggaccgcaagctccccatccgcggcactttccagtgacgagccgggtggcccccccttgcgaggcatcctcatcccaacctgctcaagccagccccggccatactgcgcacgctcccttcccacgaatcggctctgacacacacacttctggagatggcctgacgattgcccctgttgtcattgacccattgtgcctgaaagcacccccacccatggacagggcacggcatatgtgcaggagtgaagggggttga

SEQ ID NO: 4595 - DNA, 546 bp, Chlorella protothecoides
atgtctatagaagaccatgcggccttcttcgcgaggctggtggagatggtgcccccaaagttctatctgcacaccgacgctggccgtgtgaacctgaagtacgtcaagaagtccgtgcgggatgaggccaaggcggccttcaaggctcaatacaaggagaacaagaaggcccagctggacccggatcaggcgaagagcacgctggacctgcagagggaggtcgctgcggcggcggcggcggaacagcgcgccagtgggcggggcaacgaagccggccccgccccgacgacaccggtggtggtcggagagcccgcggccactgcgtcccgtcagcctgcagagggtacagccgcccccgtggccaccctcgtgctgactcaaggtggggcatggcgctgcagggatcttggcttgcagggggttgtgatgccgtccaggcccagacatctgtttgcctggcaggtggtactcaaggggaggggcattgggaggggcactggactgaagcagggccaagctcacctttccccattacatctgcgatga

SEQ ID NO: 4596 - DNA, 1101 bp, Chlorella protothecoides
atgaagagtgggctctgggaaggctgtggggtgcatcagacgacgcggcggcccccggcaggtcacccttatgttgaggggtgtcgggctcgcccggccacgcgtactgtgacctccgatggcgatgactctacggagggacacatcattagcatcgatagatcaggcctctacgccccggatgatcacacggtggagggcgtggagaaggaggtggagacggcaatggctaggcacctgaagaccctcatcaagtttcggagcgggcccatcaccctggctgagtacatgtccgaggtgctcaccaatcctacagcaggctactacatcaacagggacgtgtttggcacggcaggcgatttcatcacatcccctgagatatcccaaatgtttggggaggtgagcggcggtttgaaggggtgccaaaagggagtggacgagggccgtcctgatcagtgcaggcttgaaagtttcggttcgcttcacaccgtcacaaagccaggctaccaacacttcaaacctcatgcaaccccgcatctccttgcagatggtggggatctggtgtgtcagcacctggatgcagatggggagcccgccgaggctgaggatcgtggagatgggccccgggaggggcaccctcatggccgacctgctcaggggaacggctgcgttccccactttccactctgccatacaggtgtggcctggagggggcagagttcgtcttttgggttggattgtggggcagtaggagatcctgctgcctcgcagctgcacggcacctggcccagcacctgccgcttttgtgggtgggggcaggacaccccaactcccctctcaacccgccgacgatcacccccgacaggtcgacctggtggaggtgtcgccggccctccgagccctgcaagcccgtgccctgcgctgcggcgggggcgggcatggggacgccccggggccgtcccggctcgtccccggtcggccgggggtcgccgtcgcctggcaccggtcgctggacggcgtgccccaggacctgcccaccctcttcatcgggcacgagttcatcgacgcccttcccgtgcaccagttccagaagaccggtag

SEQ ID NO: 4597 - DNA, 489 bp, Chlorella protothecoides
atgctggtgtgccgggcggtgcatgctgcatttcgtcagtccctgtcaccccctccgccactgacctccctggttgcatatcagcgaagcatctcacctttgaggccctgtgcagtctctcggcggaacatcttcgtcgagcctccgtctcgaaaggatgaggagctcaaggagctctacccgcccggcagattcaactccgaggaagatgaggacgagcgcccacctgcccagctcagcgtgccgcagcagcgaattcgacacgctcagacaccactggaagtcagcacagttggtcctgcagcccactcccgcgtcaagtctgccacctttgtgaaaagcagtgtgacggtggaccagtgcccccacgccacccaccccgaatttgccgtcattgggcggtccaacgtgggcaagtcgtcgctgatcaacatgctgaccaagcgcacctcccttgccatggtctccaagacgccaggtgggcattga

SEQ ID NO: 4598 - DNA, 1422 bp, Chlorella protothecoides
  modified_base (241)..(250): a, c, t, g, unknown or other
  modified_base (1000)..(1009): a, c, t, g, unknown or other
atgcgcgaggtacgcggtgacggggccgggctggcctccgccgccttcatcgccatcatcccctcctacatctcgcgctccgtggccggatcctacgacctggagtccattgccatcgccgccctggtcaccgtcttcttcctctacgtcaaggtggggcaaagggtgtttgaaaggtggtgtgacgaatgggaaggggaagggggggggaggctttgccttctggggcatgggcattcgnnnnnnnnnncttcctctacgtcaaggtggggcaaagggtttttgaaaggtggtgtgacgaatgggaaagggaaggtgggggaggctttgcctactggggcatgggcattcaggctggtacatctggcccatcacccaaacgaacctctcatttcgacgggaacgaatccccatcccccactgatttcccttccaaccctctctgaccagaccctgaacacggcgagcctgaggtgggccaccgccctcttcttcggctacctctacatggtggcctcctggggagggtacagcttcatcgtcaacctgctgcccatccactgcctggccagtattgtgctgggccgggggcggggagtgcaggcaagtgcctgggcctgtgatggctgtgcgtcaggcgtggacgtcagacgcggtgccgctgagcacggtcctgcgacggagcccgccacactttttgctgcccacagatcagcgtggacgtgtgacgcggtcccgctgagcacggtcttgcgacggagcccgccacactttatgctgcccacagaccagtgtcccatgctgcattccccatcacccaacgacaacgacccctttccctccccagtgaacatccccgtcatcggcttcaacgcggtcctgatgagcgagcactttgcgtcctttgccgtctttggcatcctgcatgccgcatttgccatcaaggtgcgccggtgtcgtggtggaggctgtagtgtcgttttggtgtggggtctgggannnnnnnnnnatcaaggtgcgccggtgtcgtggtggaggcggtggtgtctttctggtgtgggattggggggaggggtcgagttctgggggtgccttcaccggtggtcgcacgaatggatgagcgggaggctgtcaaaggagttgcagggttttgcaggcaggcatgctcacgcgtcggcaccacggccttgctccttcctccatgccacgctgttggtgagtcccctcccctatccccatcccacacactcacatgcacccacccccatcccgcctgcagtggatcaaggagacgctgccgccacgaacgtacgaggcggccaagcgcgtcgtgtggaccgtcggcacggccgtggctggcgtgatcctggtgctggtcaccgggtacgtcactgcctcccccacctttggctggacaggtag

SEQ ID NO: 4599 - DNA, 696 bp, Chlorella protothecoides
atgaaggtagacaattcagtagagctgatcagaagaccgctctgtaaaggagtggcgcacccactccaaagtggggagggaacggcgcgtgctgtgcgggaaatgggagaatctgctcctggggcgccatctgatcgggtcccggcgatgacagacgcatccaacacgccgcccgtgtctggagtcgcgaccacctccactgatgggtcgaagaagagcgacaagcggagcccaggctcgtctgcggccagcctgacgacagtcctcaccctgatcgccatctgcctgcttgccacagcagtccggcttttctcggtgatcaagtacgaaagtgtcatccatgagttcgatccatacttcaactaccgtgtcacacggtacctgacggaggagggcttcaccaagacctggaacttcttcgactctttcacctggtacccactgggccgcatcgtggggggaaccatgtaccctggccaagtgccagggcccagcccagggagcgggcacgccatggcttggggctgccacggtatgaatcacgtcctcgcaaacgccagtcccccaatccctgtcaccccatcctcccagggcctgatcttcactgctggcttgatatggaaggttctgcaggcactgcgcagccccatccacatccaggaggtgggtttgttggtgcttgtgaggctggaatga

SEQ ID NO: 4600 - DNA, 921 bp, Chlorella protothecoides
atgatctggccagctattgcgcctaaaccgggtgctggtgctctgctcctgggggtctcccagtatcggtttcatggtaatgtgatgtcacacgaaggccgacacaccgacatgcactggtgtggtgggattgccaggtcgtcctttggttcacttccagggaggctcgaagtccgtgacgactcgagcctgaggcccactttcagaagttctgtcaacacaatccttgagttcattgcatctcgcgtcgacaacggccttttggccgcgacggaggccttggcggtcgggaacctggcagaatgctcacgcctcctaagggtcgatgccgatgccagctcacttcgacaccgtcagcttactgtctctctatccctccttgctgcacacgattctaatgcgatctggaaggtgttcgacctcgatccccgaaggacaacgcttgcggagctgagagggcagtacgtccgcctcgcccgcctggtgcaccccgacaagacagggaccccggccaccgctgcagccttccatgcactgcaagcggcggccgccacctgcacgcgagacctcgctgcagcttcagcggcactgcctgcacacgagccagggtttgcatggtgggacgagtgggacatggaggcggcgcacagcgattccaaaggagaagctgggccggccggggcagcacccgctccagaacctgtctgggaggacatgagcctggaggagatcagggcggagatcaaacggcgacaggcggcaatgctcgatcctccacgggaccaggctggcggctctgtgccgctgcccctcctgcgccaggcgctggaggaaggcaaggccgccctgcggcgccgcctgcagcaggtcgaagcctacggcgctcgagaccgtgagggtggtttcgtgcgaggctggtga

SEQ ID NO: 4601 - DNA, 486 bp, Chlorella protothecoides
atgccaagaacggccgtgtgctggagtttgtgttcctcaccaacccaccaagacccctcccgccaccagctcagtgacgagacccgaccttggggcagggacccaaatttcgtgtcaccgacggcacgcgatctttcctgtgcgtgctcggttcaaggttaccaatcactgattttccaaagcatccaggtggccatcggggaaagatggcattcgggggaactccgggcagtgttgtcggtgagtggggtggcgtgcgaccgacgagacgggagactcagtacacaagtgccgcggaacttccggctcctggaggagttggagaagggggagaagggcctaggcgatggcaccgtgagctatggcatggacacctcggatgacatcatgatgcgcagctggacgggcaccatcattggtccacccagcgtgcgtcttggcgtgagggaaggggccgagggtctgtgggacaccttggcaccctag

SEQ ID NO: 4602 - DNA, 774 bp, Chlorella protothecoides
atgcattcatctctccgcatgcacttgccatcttgcagctccccctccgcgccacccaccccggcaccctgcacccacctccaggcggcgatgcgcatgttggacaaccgcaagctttccagcaagatcaactacaacgtgctcgccgacctcttcgacgacgcgcccagccctgcgtcagccgtgggaccgggggccggcggcccagaggagcccaggcagcctggtgccgaggcggccgtcgccgccaagctcagcgcctcccaggaccggcagagcgccgcgctgagcgcagagctgcgggccagccggactgcaggtgcgaggctgtgtcacggatgtttggttgtcgagagtaagcggacgggtgtgacgctctcatacaggacaggatggccgctaccggagcgccagggacgtgatctgtcagcgatgctgtctgacatgcaccccttctcctatcccgtggccatttcccatgccaggcaatcccctgggtgggcttggctcgctgcagaccgggtccctgggctccctccgacccagcgggctcaacacctccctctcccgctcgcggctgagcggcggcgtggcgacccgggcgcgcccctccggcctgtccagccccaagggcgacgcgcggcgcgtgcgctttgcccccagctagccgccgctagtgtacactgcccttgcctcctgtcgccccctggccatcctgcgccgtgccctgttccggtgcataccaactgtatgtcacaattcgttctcacctga

SEQ ID NO: 4603 - DNA, 774 bp, Chlorella protothecoides
  modified_base (342)..(351): a, c, t, g, unknown or other
ccccccttccagcccaccacaatgtgatgctggacatcctggaggtcccctccctcatgttgacctgcgtgcgcaaccgccactacgacgaggccctggacctgggcgcctttgtgcgcaagctggagaccctgcacggcggcctgcccctggtcaggcggctggcggccgaggcgcgcgccgcgtcggcggccatgcgaggcgcactgctgcgccggctggaggcggacgtggcgctgccagagtgcctgcgcgccgtcggcttcctgcgccgcctggcctgcttcggcgagcgcgagctgcgcctcgagttcctggtccggcgcgaggcctgggtggcannnnnnnnnncggcgagcgcgagctgcgcctcgagttcctagtacggcgagaggcctgggtggccacctgtgccgcgcaggccgaggaggagggcgggccggcctacgagtccctgcgccgcgccaccaacggcctgcgcctccatctgcacgacgtggccacacagtactgcagcgtgtttggagacggggcggagggcggcggcggcggcgggtccgcgggcggccccgcgccccactccgacgtgctgcccacctgggcgcagcgccgtgcggaggcctacgtggcgcacatccggcgccagctgccgcgcctggccgacggcggcgcgctggcctcggtcatggaggcggccatgtacgcgggcgccagcctgggccgcgccgggctggacctgcgcccgctcctggccccggctttcgaggacgcggc

SEQ ID NO: 4604 - DNA, 1728 bp, Chlorella protothecoides
atgccccccccccctcccttaaccccctccaacccaaatacagccgactcagatgacgacggcgcggcggcgcgcggcgccgagtcagacgacgacggaaagttccggctggcgcgcactggcgtggtggcgcggcccaaggaccgcgtgctgaccatggaccccaaggagatcacgtacgaggtggtgtccaagaagctgcgcgagatcgcgctagcgcggggcaagtccacgcgcctggaccgccaggagcaggtggagatgctggcgcacctggcggggctggcgcgcggcccggcccagcgcctgcaggtgctggtggccagcctgacggtggtattcgacatgaatcgccccacccaggcggccatgacgcccgggaactgggcgcgctgcgcggccacgctctttgacatcctggccctgctggaggcgcaccccgagctggagctggtggactcgccgcccgaggacgacgaggctggggggtttgaaggcggggctgcagcgggcgcggcgggcgcggcggcggcaggcgagcccgcccccggcacccccgcccgtgtctggggcaacctggcggccttcctggagcgcctggacgacgagtggaacgggagcctgaaggggctggacccccacgcgcacgagtacatggacaggctgcgcgacgagacggtgctcctggccctggcggcggccgtggcgcagcgctgcgaggcaacgggggcttttggcgccctggccaccgtgtccttgcgccgcatcgaccacctgtaccacaagacggcgccggtgtacgcggccatgcgcaagctggcagagctgcaggccgcggcggccgccgcggcgggcggcgatgtggccgcgcccgggcccgccgtcgaggaggaggagggcgggtcggcggaggggttcgagccccgcgacgggtccgccgccggccctccgccgccggtggtgcgcctgcccccgggcttcgcgctgcccgccgacgcggccgcgtcgctggaggccctggtgcgcaccgtctacgcgcatggcaccgacaaccagaagggccaggcgctgctggcctcggtgtactggcgcgccgtgcacgacgactaccacggcgcgcgcgacctgctgctcagctcccgcatccaggaccagacgggcgctctggagaaccggctgcaggtgctgcacaaccgcgcgatcgcgcagctgggcctggccgccttccgcgcgggcctggtgccggacgcccacgcctgcctggctgacctgtacggcaccgggcgggtgaaggagctgctggcccagggcatccaggcgcaccgctacgcggagcgcagccccgagcaggaggccatcgagcgccggcgccaggtgcccttccacctccacatcaacctggagctgctggagagcgtgtacctgacttcggccctgctgctggaggtgccccacgcggccgcgagcggcaacgccacgctggccggcggcgagcggcgccgcccgctgtccaagcccctgcgccgcctgctggacaactacgagcgccagacctttgtggggccgccggagaacgtgcgcgaccacatcatcgccgccgtgcgcgccctcagcacaggtacgaggttttggtggtcctgtgtctggttggtgggtggaggtgtgggaggggggggttgtgggaggagggggtgcattccggatgaggaggtgcgtcggggagggtag

SEQ ID NO: 4605 - DNA, 699 bp, Chlorella protothecoides
atgtatatgggatgccctttgtgcgcagcgcgtccctggcctctggaagtcgttcagtgtccagatgaatgcgaggagtccgcatgctgcgggcggagctcgactgagttcatgcctgccccatactacgggacccctaagcccatttcccctcccgatgcccagcccccatctcacacacacacacacagcttcctcatgggctcgtcagactcggagtcggaggacgagcggcgcgtggtgaagagcgccaagaccaaggcggtggaggagctgcagaacacgtgcaacgacatccgcaacaagatgaacatcaacgactggtcggtgatccagacgttgttcgacaagctgaacaagcagctggagaagacgatgaaggccacgggcgcgctgggcgtgccccgcgtctacatccgcctgctggtggagctggaggacttcctggccaagacgctggcggagaagcccaagctgtcgcccaccaacacccgcgcgctgagccggatgaagcagcagctgcggcgccacaacgcggggtacgcggaacagatcgcggccttccgcgagaaccccgtctctgacagcgagccggagagcgaggctccgccgagtgagccagactgtgagtttggagtccttttattctgcccttctttgtttggggcgtggggtggttatgattccatgggggtgtag

SEQ ID NO: 4606 - DNA, 1464 bp, Chlorella protothecoides
atgacgctgatcgacctcacctacaccgccttcctggttcccgtatctgtggcttttgacaaggtggagggctctggctcattcacctggatcacctacatggatatggtcggctccgccatctacgtggcggacatgctgctgaatttcagttcggcatttgtggtgcagtgggacctgaagcacatgctgattatggatgggaggcacgtcgcctcctactatgtcctacatggcggtttccttgtggatctggtcgcaagtgagtcgcgaatggagggacctgcgtgcttgatggtatctttgaccaactgcgttgatgatggcttgcccgggactctccgaactgcactgagagtctctgctgagagctcagatcctccattctgtggtgcgctggagttcctgtcgatcttagaggtttcctccacgccacctgcctgccagcccggacaatccccccaaccacccttcgcagccctgccaatcatcccagaggtgatcatcgccgcctcgccctccgccaacgccccagggctgaaggccatctacgcgctgcgcctgctgcgcctcgtgcgtagtgtttggtgcagacctgtacaagaaccccttctcccggctcctgatgaagtacatttcagcgcccgcgctgtacctgacatacttgctcatggctgtcttcatcatcgtcaacctgctaggctggcaggtgttctgcacgccgcgcgcacagggcctgcagacaaacacttcctcgatatgatgctgaatcacagcctgtccccatctcagtatcctgctctttgtcgcggagatagagggcgagcaaaactcctggatggcctacgcctccttcactttcaacgtcgtggacgccaacggctgggcgcagtgggtggtggccatctactgggcctcccagacactgaccactgtcgggtgagggcgggctgcggtggatcgagggagcaagggaaggtgcttgaaggagcacgtggcgatgatcggccttcctcatggcaccgggctcgcctccccgcacgcatggctgggttcattgagaatacctcgggtcgtccagtgaattccgacatgtggcagcagtgtcacaggaggtcgctgaccggcctgccagcccagcacgtccacctgttcccctcccagctacggggacgtggtggctgtgacggtggcggaggccctgatcagctctgtcgccatgctcctcgccatcctcgtatttgggtgagcgggcctgcattgcatgcgcctgatcctccaacccccggaatgcgcagcttcatcgtgagcgtcattggcgacctgctcaccgtgtcctccctgtcggcctggcggggccagcagatacgacagcagctgcagggagtggaagcgtggggcaaggtgggcggggagggggccacattggaccttctgcctaggtactggcagctgggcagatga

SEQ ID NO: 4607 - DNA, 540 bp, Chlorella protothecoides
atgtcccgcgagcctgagcccttcttgcaccccgtgcggtccagggaggagaaaggggtgagggtgcgactggagattggtcctagggaggcgacagcaaaaaacgcggtgctggcgctgacatcagcgccgggcgaagtggcacagcgcaccacactggcggccggcccgaagctggtggcggccgtggtggagaagctgaaggcgctgggccaggaggtggaagcatgcccggtgacgggccccaacgtgtctgggcccgcccatcttgctgccgcccccgtcgaggcaggggcctccggcaaggcacagccctcctcaggggcggcggtgaagcctgccgcggccgcagcctcgggcacaggaaagaaagcagcaccaccggctgccgcagcacctgtgcatgccagcggcgaccagctggatgacgactgggtggcagacggggaggcggggcccggcggcgaggccgctgcacccgccccgacctcgaccggcaagaagcagaagaagaaagggtgcagggtggtccgcttctga

SEQ ID NO: 4608 - DNA, 1035 bp, Chlorella protothecoides
atgcggtgtatcttgagcgctgcgaggctcgtggcttcgaggtgttccgccgtcgtgtctcactccccaaccttcttacatgcaccacgaggcgagggtggtgtggttgcagcggccacaagccacgcactgcgagcatcatcgtactcgacatcatctcccgccgatcttgacatcctgggtcaggacgcaggactcgtgcgcatcgacagctgtacatctgccggattcgtgataggggagtctctcatcccgggggccctcctggcataccgcggtctgctaaccggctggcgagtggacagcttggagagcatcagcgaagccagcctgagcattgtggacctactaaagccggtaccaggtgggtggcaaggaccccaaattgcatccagtgaagcatggggcaggacgccggggccacctggtcgcccgcagcctccagacagcaacatttccagtcgtcttccgcttcaacccgcagacctcttggtcctggggacagggtcccagaccctgcgccttccccccgcccttgccagaattgcgcgagccaagcatctgtccgtggaggtggcatccacggtgaatgcggtggcaaccttcaacatcttgaatcaggagggcaggaaggttgtgggggcattcctgcctttggcaagcccagcgccagagcttggaagaagaacgttcctcgaggagcttggcacaccttgccggcgcccatcgcagtggatctttcacttgattcttgactcttgtttaagttgcacgtcagctgtattggctgtcggagtgaaagtcgctcaagggggcctggctccaacatgtgagatgggagcagcgctgactgggcagagggccgctgctgtctgttttgcggtttgctttaggactcccgccccttccaataggtgtctgactggtcacaaagtggactacaaacctgacaagattgccaccagcgctcacagctcactccttgatgttggatgcggccgacgggatggtgtgcaccgcctcatgctccagtga

SEQ ID NO: 4609 - DNA, 252 bp, Chlorella protothecoides
atggccctcaagctccagtctgagggcaaggtgtacaacccacagcgcgccaagctcaaaaaatcgcacaagccgcgccgggctgtgcaggtcatcatcatccccgtgttttggaagcaaaagcatgcggagcaggactccattttccagttggctgacaggatacaggcggatctcagggccgcgggcatccgctgcgactgtgacaccaccaacgagctgacgccaggccagaagtaccgcaactggtga

SEQ ID NO: 4610 - DNA, 669 bp, Chlorella protothecoides
atgtccggcgccttccggaccactgccctgcctgggccggagcccactgcgaccacacgcctgcagctgctcgaccaggaggcaggcactgtgtcccacctgtcggccatgacggtcctgcatggcagcaggggtgaggagctacggtggggtgccgtcgggacctatccagctgcagggtgcaggcgcccatgcctgagaggcctggcgctcccggaacgatgcaggcttgcaggggagagccgtggttggcgggcggcgccatgggctccactccagcctggtggcgccaccctccccccctcgaccttccatccctttccatttcgaacagatctgtatgacgcaaagcgatccaagctgggccccgatccattgcgtgaggatgctgacgaggaactggtctggtccacggctaggctaccaagggccctacctgtcctggcggcaccagcaggcccccggcactgtagccttatcgcaagcccaggggagcagcgtcgatgcacctcccaccctggacgcgttgcagaaggtccccctcccaaccccacttacaggctgctgctcatggaccaatcggtggtggcgggcatcggcaacatttaccgcgccgagatcctgtacaaggccggcgtgcatccggtgagggcgcttgggtgggtgtga

SEQ ID NO: 4611 - DNA, 1002 bp, Chlorella protothecoides
atggtgctcgtggagggagcatgtgctgtccggcacatcccctccgacaccctgctccatatcctggagctgctcagctccagggaggcgtgcacggccgccctggtctgtagacgatggcacagggtggtctcttccctctcctgggcctcccgctatgccgagctgtggcacacccgggacccccgggtgtctcccacctggcagctggcattctcagcccgcatggcccaggcccggtccctagacctgcgctgcacccggaccagcatgcatggtcactccaaggacatcaagtgcgtcgcagtgttggcctccagccagctggtgtacacgggctcttacgatgggacgctcatctgctgggacctggtgacgggcacgagggtggggccgccgctgcgtcatggcggcaccgtccgtgccgtgagcctggacgagggctggctggtgagcggctgcagcgacgggtgcgtcagcgcctggacgcaggccggtgcggggtgcgccacccactacaatttggagcagcctcctctggccctggcgaggcacggcggacccggcagaatcgctgtccgatcaccccagaaacttgccaccgagtggccactcttcaccccatgtcacaataatcgcagtggttcctgggatggctcggtgctggaggtcaaccggacgtcgcagacggtgtgccgctccttctacctcggcgactggatcgtggggatcgcgctcatgtccgggcgcctgctggtggccgcgggaaaccgtgtcgtctccgcccgcctccatgccgagcctgtgctgcatggggggcctgcccgtgagtcagaggaggcaagtgagcgggaggaggaggagtatgccatgaccagcaccgtcaccgccatccttggctgcagcccgagcacagggtcgtgggccatcattggcgacggtgggtctgggctgggtgttgcaaaggaggagaattctggaagggagccagggcgtgtgtga

SEQ ID NO: 4612 - DNA, 768 bp, Chlorella protothecoides
atgggccccttgcgagacgcagatgaggggccattggctgtgcgctgcatcgcactgcggcccggcccagcttgtccaggatcccactgggaaggggggtggttgagccgaagctggcggcctgggtctgcctgtcgggagccgaggggactggctcatcacgacgctacctttgtctgtgtagccagtgcacacagggtggcatgcttgcacgatcccgccaccggcccggtccaccacttgatcacacagctgctggcagcggggcgccgctcctgccggatggccagccttacggccctccagctcgcgggctgctgggccctgcacccagcctcagctgcccactacaccgacacgctgcgcgagctgtgcctgtatggcttcgcggacgacgccacggcgctcaacggcgccgacgacgccgtggtcgacccagagaccctgctggacctggcggcggtgcgggcgccgccagatggcacgctggccgaagcacatgccgccacggagctcgcaccacgcgtggccacgctgtgcctgctccacgcctgggtgcagcaggcgcagcaattgggggaggataagctggcggcggactcccgccgcacggggcatgcggcctgggcgcagctcctccacctggcgctccacgacccggagctgtcctcgcccaagtaccaattcaaggggacgacgcaccggcgaaaggcgagtgctggtgggggggatggaggttggggtcatgttgagggcacattggcatga

SEQ ID NO: 4613 - DNA, 4059 bp, Chlorella protothecoides
  modified_base (887)..(896): a, c, t, g, unknown or other
  modified_base (1999)..(2008): a, c, t, g, unknown or other
  modified_base (2138)..(2194): a, c, t, g, unknown or other
  modified_base (2288)..(2297): a, c, t, g, unknown or other
  modified_base (2767)..(2776): a, c, t, g, unknown or other
  modified_base (3120)..(3129): a, c, t, g, unknown or other
atgcttggctggggtcttgtatcaatcctgtcgcattcatgcattgctggcttcaatctcccatgtcatgagcaaaaccaaccccaccccccctcccaaaccatacaccaggtgcggctgtggcaggccctggctgtgctctgccccctcatcgtggcgcaaagtggggacccggcgctgctcgaggaggcactggaccaggtcatgtcggcgctgacggtgaccaacgcatccacagtgaagcagtaccaggaggtggtggcagtggtactgctgcgtgccacgcccgatgcccccgccgcactgcgggcgagggtgctttctttgctgtgtgactgccgcaccagcaagcgggacgacctgccctccctcatcctcatcgccagccagttcctgctcctggaagcccggcccttgagggaaagtgctgagcctggccctgagcctggccctgatctagcagcagctgcaccgcctggaccgagcgtagggcatagcagcgcaggggctgcaccccaagcaacagctctggcccgggaggtggtctgcgccattgtgccctgggcactgagccacgttcaccccgtgcggacctttgcccagctcgccctctggcgactgctggagacctttccccaggtggtaaaggacgaccctgccctcgtcaccatgctcggcttcttttcctccaacaccgacgtgcagcggctgaggaccgccctcggcctggggcaggacctggattcattcgaccctgagagggcaacctgtccggccggtgtcctgtacaaggtgatctatgagtgggtcagagagcggaggttcggtgggatttcttgcccaggggctcggactgcgggggagggctgtggcacgctggatcatgnnnnnnnnnnttgtgtaacatttgaagtggttcttcgtcgagagacaggctgtggcacgctggatcatgttgggggctggcatcgaggagtagccctggccgggcgctccgatgagctttccaccttcgagggggctctggaacccctggtggacgcgattgctggcttcctcgtggccgagcggctcaagctgcggatcgacatgaaggatcggctggtaggcagctgttccaaatgtgcatgcttcatggaggagcaggctgctgttccaaaagtgcatgcttcacagaggagcagggtggggatgcgtgcgttattggcgggtgtggtactggcgggatgcccaagtcagcagtgccagaaccccaccctccatccaaaatgctcatggcaggaggcctcggtgcatgaagagtactccagagccagtgccggcaggccgtgcatccagcccagccagcccccaccagccccctcccggtctgctgcccagcgcaagatcacccccgccggccagtccgtagtggtggaggacccctgggctgccaccctgggcttcgcgcccctggcacagggatccctggacgacttcgaggccaatgagctggcgccagcgctgcgcgaggcgggcagggcgggcgctgcaccgcgccagcgactcatcgtggtggccagcctggtggacaagctgcccaacctggccggcctggctcgcacctgcgaggtgttcaggtggggggggcatgggtgtggtggggcgatttgtatatggaatggagcccctggacactctaggggtggtcggaagatcacagtgtgcgcagaccctggccgagcgcaagctcatgtgcagaggcttgatgttcctttcacgaggttgggaagcctccccgcctactcgccaagccaggaccacgcttgccacctccgcagggcgacggcactcgtggtggcagatgccagcatcgtgagcgagccgcagtttcagtccatcagtgtctccgcaaacctttggatgcccatccaggaggtgccaggtgggctggggtgctgttcgtgttcatgcatgtggagtacgacgtgctcaaacgtggaggtgggtatcctcagannnnnnnnnntgctgattgttttcatgcatgtggagtacgacatgctcaaacgtggaggtgggtatcctcagagatccaggacgtttgaggagtctctgcctaagccagaagcacagatcagcgagacatggccagacannnnnnnnnnnnnnnnnnnnnnnnnnnnnnnnnnnnnnnnnnnnnnnnnnnnnnnnnaccttagtgggtctggagcaaaccccagactccgtcagcacaaaggtgtctttggctcaggggtgtgggtaggactttgcgtggccggagaagnnnnnnnnnnaagtccctcaacccgccttgcctccccacccccttgttccttggcaggactttgcgtggccggagaagacggtgctggtgctgggacgcgagaaggagggcatcccagcgcacctgctggcccggctgcaggccacggtggagatcccgcagctgggcctcatccgatccctgaacgtgcacgtgtcgggcgccatcgctgcatacgagtttacaaggcagggtctggcgggcagggcctgagtgcagcgaggccagggcgccggaagggagacaggatttggagacaggcgcattcatcgactgcgcatgaggagggaagtgcgggggtgcatgcctcagcagatgtgcgagcatgtgacaggcatccacatgagattggggtgtggacagcagtgcaaacaggtcgtgactcgacgaccgctgggcactggggccatcagcaggacacttgcagatggacgagaaggnnnnnnnnnnacgacgactgctggacactagggccaccagcaggacacttgcagatggacgagaaggacacagaagggcgtaggcgatgccttgctcgcagtcgccggggtggagctatagttacatgtgcatgggggacagcccgcccccagaggggtcatgctcataccgcagcttcttctgcagcgtgcccacgccggggacgtcgcaggccagcccccgcttggagcgatgccgcttctcgatgcctgctgcagatgtggggcgagcgagcagtgcatggggcattttcaactgcgagtacctgtttcaggacacatagtctgggacagccacctttgccggctgcagtnnnnnnnnnnggacgtggggcgagcgagcagtgcatggggcaatgtcaacagcgagtaattgtttcaggacacaaattctgggacagccacctttgccggctgcaccagcctccggccgcagctcgggatggctgcgcctggatgggctggggcgctgccagcagtggcgctcttcaacagcacagcatcgccctggaagtcagagtaggcgatgcattccgcgcgcgccagggaggcctccggtatctgccacatggtatgaagggtgtggctggggtggagagacctagatggctgggtactgtggccagcagatcacctccacagagcccccgcaacgaccaggaggtgcatttgcaagaccagcttctcagtgcagtgcttcatcagtgcaacccccgcaaagctgttggcgctccagagccccagcacaatgacgcaccgtgtaaaccgcccagttgccctgactggagtttgaggccttcagcctcaacaccgagggcagctttccaggaaaggcactccccagcgaagtcgcccttccaagcacctctcgaagacattgcatgcatccgcacaccgcgcacctgggcccggaggcattcccctccaagactcgggagcgcagggagtgatggaggcaggcgtcgcagcacctcctcgcagctggcctccatgccgtccaactcgcaagcggcatccgggctgcaggccgtggctgcccagtccccgccccacattgaagtgtatctatcaatgaatggtatggggattggcaggctggacattgggacgtcaaggagcttcttcacggatcgtggaagtccggaggtctttcccagcaggacacgcacagcactcgggggttcgaaaagcatccaacgacagctgcttgtgcccccctcgttcacttctttccggggcaggtggtcagcgtga

SEQ ID NO: 4614 - DNA, 558 bp, Chlorella protothecoides
atggtataccccacctacaattccttcctggccatcgagtcccccaatgatgctgacgacaagcagtggctgacatactgggtggtggtctgcaccctgcagctgattgagaggcccctctatgtcgtcctctactgggtgccgctgtacagtatcttcaggctggtgctcgtcgcatggctgtcccacccacagttcaagggcgcaaccctcgtgtacgatatcgtcgtgcgccccgtcatcattgcggcagcgagcaaggcgaaggagctgcccgccctcaccccctttgccgagaagttcctgctgtcagaggtacaggcgggccaggacaagaagaccaaggcaaccagcaccaagagctcctccgcactcaaggcccccttctccacctccaccaaggccgcacctcccgcggccgcgctcccctccgccccccggctcttcaacgacgtgcccgccgtggtggaccaggccgcgccacccctgagtgagcccgctttcctgcctgccgacatcgtggagggttcgctggccgccaagccccacttccagtga

SEQ ID NO: 4615 - DNA, 1488 bp, Chlorella protothecoides
  modified_base (426)..(435): a, c, t, g, unknown or other
  modified_base (1196)..(1205): a, c, t, g, unknown or other
  modified_base (1368)..(1377): a, c, t, g, unknown or other
atgctgactgcttccctacacattcaccgtgtggtcaggcagtccgcaaggatgttgtacgtcaagacctttagggctctcccaggaagacagggcacctcctcggttctcaaaggggagcaaggtacgaagccccttgcataccatggcttggcaagctggggggatgctcccgggagcatgtccaccgagacaaccagattaatgaagtctaaaggagaggattaccatccccttcatgcatatcgggcccaatggacctgcacagctctgatcatcacagggaaaatcgcctgtccgacggaaaagccaggcagcagcatcggacgctgcgcagccccggaggcaacagggaggacatgcaagcgtcaactcgcaaagtcgttcttcaactctgcgttgttaattgtgtctctcacaaaatcnnnnnnnnnnacggaaaagccaggcagcagcatcggacgcggcgcagccccagaggcaacaggacagcggcaggacagggaggactgtaccgcggagcccatgcaggggtaccccacaggccccgggctggacctgggagccatgcagggcctgcagtccatctccctgctggggagcttcgcgccactggtggaagccccggagcaggcctcgggacagagtccgctggacagccccgggcatgagcagggcgtttctggcgggcatgactccctcacagggcctggcatggccttgaaaggccggagcggcgcatcgactgccggcaccaggcatggtccagatcactcacaatccttctgcagggcctctctactgccaagtggagggctgtggagcccagctggagggcctcaaggagtaccaccgggtgtgcacatggcaagggtgcctgttctgtcgtcatgctgtgctctgcgaagggcatgcactcgtgcttgcaaggactccgtgttccctccacttccttctcgcaccctgcgtgcatcctcagagcagagccacggtgtctccctcaaggactcatcatcgtcacgaacccaacacacacacacacacaccctctctactcacagcgctacaaggtgtgcgagtaccacctcaaggtcgactgcatcatgcgcaacggcgtacgctcccgcttctgccagcagcctggctgtggctggggtagcaggagatttccatgcaacatctcgtacgctgagagnnnnnnnnnnccacctcaaggtcgactgcatcatgcgcaatggcgtgcgctcccgcttctgccagcagtgcgggcgctatcagcccctggaggactttgacgacaccaagcgctcctgccgggtcaggctgcaggtgtgtgcggggagctcggccggcggtatggcccagcannnnnnnnnncaggtccttcctccctccctctcccttcccagcggcacaatcagcgtcgaaggaaacggcccaacgaggaggaggatgggctgcggccgctcgtccccggcgcccctttag

SEQ ID NO: 4616 - DNA, 1215 bp, Chlorella protothecoides
  modified_base (62)..(71): a, c, t, g, unknown or other
  modified_base (368)..(377): a, c, t, g, unknown or other
  modified_base (599)..(608): a, c, t, g, unknown or other
atggaatcccatgatttgggaaccttgcgtggtcccaccttcttcaccctcctgtcttctcnnnnnnnnnntgttccggagggctgcatcaaggtcagcggcgtgtatgagctgctgagtcaggggcgggtggccctctccaactcagaccaccctgccagccgcaactcgccggccgagcttgggcgcctgagggacgtgagttgtgaggccttggagtgcccgggaaaaggaagctggattgggaatggctctcgcttgtatggcagttctccttggttgcatttgcattttgctcggctggctgggactcttggagtggtgcatgggatcaatacctggtggggctgcatgggcagaggagcttnnnnnnnnnngagttctccttggttgcatttgcattctgccccgctggctgggactcttgcagttgtgcatggggttgatgcctggtggggctgcatgggcagaggagcttccgggaagggcgtgcgggttgcctccccggtcacgcttgaaccaagcatcggccaccgcgccggccgagagcatcggaaaggggaggccatgtgcacaccccatggcgcaggtggagtggnnnnnnnnnnggggttgcctccccggtcacgcttgcaccaagcatcggccgccgcgccggccgggagcatcgggaaggggaggccctgtgcacaccccatggcgcaggtggagtggaccagcacagggctgagcctggaaagcgcggcggtgagggcctgggggcgggagccaagcttcaccaaccacacaccctccttcacggggtgcctggactacgtctggctgagccgcggggattggcaggtggtcggcgccatggccatgccaggcggctcagagggcggggagcccaaccaggcggcacctggataccggccgctgcccagtgccgcggaaccctctgatcacgtggccctgggcttctgcttgaggctggtgagggcaggtggagccaaccccgaagggcagcgtaaacaagtttgcatgacgacctcgacggcagattctctgaaatggagagcactgatcacagaagtgagtcatgcagcagcgttcgctcacgtgcctgttgccattcgagcatccggaaaacccccttcgcaatactcttccctcctccccccccaccccacccccccgcagccgctgacggtgaattcggcccattccggatga

SEQ ID NO: 4617 - DNA, 537 bp, Chlorella protothecoides
atgcccttgccacattccaatacccaggcagcgcagagcgggcggcctccagacccagtccagctggcgcagctccaggcactggtctcactgcgcggtctgcacccccccgacgcgcgcggcgcggcagagtgcgccggtgagtgctccgccgccggcagcggcggcggcggcggagctggggtccaggggcggtacggcgttccgatcgcaggcgcggcgccggccccgccggccaacacgcgggagggtgatggcgctccggccggcacggccgtcgcgacggccgtgctgcctggcgccgcgccgggggtggcctttgtccccacccccgaggtcatgctgctgctgctcaagggctacgccggcatgttcaactacgcgctggaggacgcgtcgctgcgccccctgcccgacccctgcactgccgcggagggggccctggacccggggaccatggccgccttcatgcccctacccggcggggcgatgggcgagggcatccaccccagcctggagcagcagatgctgttctga

SEQ ID NO: 4618 - DNA, 441 bp, Chlorella protothecoides
atgacgctgaggagtcttcccccacatgcaaatgccacttggacctgcggccccttctccccaccaccgcccagactggacgccgtcgtgttggagccaggcgacaccgcgccctttgcgctgagagcacgcgcgctggacgagaccgtgctcgtcaagaggttcttggatttggagaccggacgggcattctgcgcggcagtcacgcacctgtactaccaccctcgccaccccgacctcaaggttttccaagcgcacgccgcctgtgcggctgtgcgcgcctttgcatcagcccaaggtggaccgcagcccctccttctggccggcgacttcaactccctcgccgagaagcgcgtgtcggacgagtttgacgagggtgcgctcagcgttgtgcttagcagcggtttgaatgggagcaggcagggggggtgcatgtggtag

SEQ ID NO: 4619 - DNA, 366 bp, Chlorella protothecoides
atggaggagtcggaggaagaggcagaggtgcgcatcgtgcgcgactatgttcgcgtggacccgcgcgcgggccgcgccgaccccaccggctatgtcacctcgccgctgacgggggagctggtggcggtgggcgacatggcggagcacatgcgcgtcagcctgatcgacccgcgctggcgcgagcagcgcaacgtcatgctgtcgcgcatcaaggagacgacgcgcgccagcgacgacgagatcagccgcaacctggcctcgctggccgccacgctgccggacgtcttcggcagcagccaggaggaggtcagcgccgccgtggggcgcgccgtggaggccgaccgcgcggcggcggctgcggcgggc

SEQ ID NO: 4620 - DNA, 987 bp, Chlorella protothecoides
atgtctccctcagtccctcctcccacgaccccccttccctccctcacgcccgagctcagatacaacgtccaccggccctgcgctgcccagtcctggcagcggacatccacctcccgcgcggtggccacccccgaccgcgccacggaggtccccccccccactctgcgcagccccggccccgcccggcccatccccggctacgaccccgacacggaccgggtgggggtcctgctcctaaacctgggcgggcccgagaccctggaggacgtgcgccccttcctgtacaacctgtttgccgaccctgacatcatccgcctgccgcccgcggcgcgctggctgcagcccgccgtggcctggctcatcagcacgctgcgcgcccccaagtcgcggcgcggctacgcggccatcggcggcgggtcccccctccgcgccatcacccaggagcaggccgacgcgctggcgggggcgctggcagaccgcgcggtgcccgcccgcgcctacgtggccatgcgctactgggcgcccaccacggagcaggcggtggcagccctgaaggccgaccgcatcaacaagctggtggtgctgccgctgtacccgcagttctccgtctccacctccggctcctccctgcgcctgctggagcgcctactgcgcgaggacgcgcagctggcagcggcgcgccacgtggtcatcccctcctggtacgcgcgccccggctacgtcgccgcctcctgcgacctcatccaggccgagctggcgcgcttcccggccgaggccgacggcgtggagatcttcttctccgcccacggcgtgccccagtcctacgtcgacgagggtgggtggaatcagggggaggatggggcagtgggcctgggtggatggaggggtatggagcatcaagggagtagggagttgcaatggggatggggcgagggtgggcggccaaccctctgggtgcatgcccatgtgcacgggtggtgctcttga

SEQ ID NO: 4621 - DNA, 588 bp, Chlorella protothecoides
atggagcagtgcgtggcgctgatcatgacggagctggcggcgcggggggtgcgcaacacgcacacgctggcctaccagtcgcgggtggggccggtgcagtggctgcgcccctacaccgacgacgccatccggtacttgggcgagcgccgtgtgcgtggccttctggcggtgcccatctcctttgtgtcggagcacatcgagacgctagaggagattgacatggaggagctggcagaggaggtgggcatcaagtcgtggggccgcgtgcctgcgctcaacaccaaccccgtcttcatcgccgacctggcggatgccgtgctggaggccctgccctacgccggctccgtggccggcagcgcggttggtgacgccctggtgcccatgggtgagtcgagacggggagggccggaggggtggggtgaggtgggagggaggggccggggcgaggggagggtggggtcccgagggccggcgcagcaagggttttcaaagccgtggggcagggaggagcgggcgccagcggtgtcaggcgctgtggctggccgctgggctcgtggcacgcgatccggccttggtgtatcatggtag

SEQ ID NO: 4622 - DNA, 270 bp, Chlorella protothecoides
atggcggcgggcgtgcagggcggggcggccggcggcgcgggcggcggcgggcggggccccgagggcgcgcagttctcgcgggaggagctgcgcgagctcttcgtgctcaagcccggcacggactgcgagacgcgcgatctgctgcaggcgaccggcgcggcgttcgccgacggcgggccgacctgcgccgaccccgccatctgcgcggcggccggggcggggctggtgtccttcgtgcacctcgagtcagagcaggggggcggggcctag

SEQ ID NO: 4623 - DNA, 186 bp, Chlorella protothecoides
atgtggatgggtgaagacaacaacggaggaaaggaaacgaggacagcaagggggcgtggcggcatgctggacgggaatccggccatggaccggcaggcgatggcgcgcatctggagggacggccagaagaaggcgtgcaccgtgtaccgcctgctcaccacaggtcggcgaggggtgtggcggtag

SEQ ID NO: 4624 - DNA, 957 bp, Chlorella protothecoides
  modified_base (292)..(301): a, c, t, g, unknown or other
atggccaagcggctcagtgtccgggacccggtccccagcgacattgacatcgcacagtccctggatcccctgccaatcacggagattgcacagtcgctgggcctggatgacgacgacttcatcacctacggccccaccaaggccaaggtacccatgtggccctcctgtggctggcttgatggtggctcatctgctggatgggatctgagaatcaaactgccttgccgcccaacgcccacgcaccctgccacactgccctcgcacatgtgtgatcaggtcaagctcgaggtcnnnnnnnnnntgagaatcaaactgccttgccgcccaacgctcacgcaccctgccacactaccctcgcacacgtgtgatcaggtcaagctcgaggtgctggagaagcaccgtgacacccccaatggcaactatggtgaggaggctttggaggtagagtgctggcatggggggctgggcccgagctctgggcctcggcaaccccctccacagtgcaggctgctttcagatgatgctttgagatgtgaggctactgttgtcccaagcggtgccaggggtgcgaaggccactgcggtcatcgtggcggggatcaccccaacccccttgggggagggcaagtccacaaccaccgtgggcctgtgccaggcgctgggcgcatatctaggaaagcgcgccgtaacctgcgtgcggcagccgagccagggccccacctttggcatcaaggggggcgcggcggggggcggctactcccagatcatccccatggaggcatgtggggttgaagggggggagggggtggataaggccggcgggaggggttcagagccctcctttccacctgggggctgccgcgcaggcctccatgtacgctggggctctgacctaggagagccgcctggcatggcagggagtttccggctcgcgtcgtgcgcctcaggccctccctga

SEQ ID NO: 4625 - DNA, 2514 bp, Chlorella protothecoides
  modified_base (1987)..(1996): a, c, t, g, unknown or other
atgccagcccctggccaggcctggcagccgcgtcgtttccccatgtcaatgtcgaaccccacctccacccccgacccacgcgcgcagggaaccccccccatcttcatcccccagttctacttccccgggacgggccccggcgcggcgcacaaggccagtgcggacaaggtggacgccttcttcgcggtgtacccgcagggcctgtcccttgacaacctgaaggcgctgctgaagcaggtgttcggcctgcccacccccctggcctaccccctcttctacaagatggcgccgggggaagagggcctggtgtcccgcgctgccctgcgtgcctggctggaccgcgccggcttctggggcctggatggcccgggcagggccatggagatcctgcgtgcaccagggcgtgacccccgccgacctcaagcctgtgctggccggcatcctgatcagtcatccgggcctggagttcctggcagagtccccggagttccaagaaaggtggatgggtgttttttcgggggggttggggcgttgggggggggtgtatgcatgcttggtgagtggcttggtcgggggggatgtggcgggtggcagcagttggagtttccccgcctttgctggtgctctgcctgcgctggtgcccagggagagggcgaggtggagtctgtggtccgagcctccgcctggacgcaccacctccgcggacctgctctgtgccctgccgcttcagcatgggttcatctgcccctcgtacgcggagacggtgatccaccgcatcttctactcgctcaatcgctccggaacaggggtgctgagtcagcgcgagctgcgccgcggcgacctgctggccgcgctgggcgaggtggacgcgcaggacgacatcaaccgcgtcgcgcgttacttctcctacgagcacttctacgtcatctactgcaagttctgggacctggacacggaccacgacttcctgctctcgcgcgacgacctcctgcgctacggcaaccacgcgctgaccttccggataacggagcgcatcttcagccaggccgcgcggcccttctccacggggaacccagctcagatggggtacgaagacttcatctggttcatcctgtctgggatgggggtagagtagggttggattgggggggggtgaggatccatgacacggggcgactggagggaatcagggggtggctggggcaggggagagcctctggcaatccagggtgtgaattcagggcgggatgtatggtcaaacaggtacaccagtggtaccttggtgcacgtggcctcccgtgttcagccacggtactgcgtagtcattccctcatccacctgcatcacaccacgcccacagaggaggacaagaccacggacaccagcttggagtattggttccgctgctgcgacctggacggcgatgagcacctgcacagcagcgagttgtatgtgagtgggacttgggatgagatgggggagtgggagtgggggggggggagcgtggtcgtgcctggagcgcacatgcagagggagtgtcgggaggttacgaagcatcggcacgcacgttgctcttcagcagcgcggtcgctgccgcggcctcctgcaaaccttacagcattaccgagactgggcttcaacctatcgtgtgttcctcctgtccgccatcccccgcacatgtctcgatcaacgcagtacttttacgaggagcagctgcaccgcatggagtgcctgagccaggagtcggtctcctactttgacgtcatgggtcagctgcacgacatgctcaacccagaggtgggagggcggggcggcggctgcgggtgctgggagatgcggggctgggcagagcatcccaggctgcgagtgcaacttggtgggccgatttgccacctgcgcgccgcacggcccttccaaatcccaacctgcaaaacccgacccgtcccacgtcccaatcctccaaccccttcctttccctccagaactnnnnnnnnnncctgcgcgccgcacggcccttccaaatccctacttgcaaaacccgatccgtcccacgtcccaatccctcaaccccttgctttccctccagaacccgacgtactacacgctgggagacctgaaacggaatcgggccatggcaggaaccctgttcaacgtgctcttcaacctgaacaagtttgtgcaattcgagacccgggacccattctctgcgcggcaggtgtgggactgggggcggggtgggatgcatcctgccggtcagctccgatcccgcctgcggcgctgcctggctgccgtgctccaccctgtcctgaatgggtgcctgtgtgctttatccttatcgcctgcacccttccccaacccctcctactcaaggaacgggaggagattggggtcacggagtgggaccggtttgcgcggcaagagtaccagcggctcgcggatgacgacggcgaggtggaggcagtggacgcggggggaaacacttggggcgcctccgcgctggaggtggacctctga

SEQ ID NO: 4626 - DNA, 2202 bp, Chlorella protothecoides
  modified_base (14)..(23): a, c, t, g, unknown or other
  modified_base (288)..(297): a, c, t, g, unknown or other
  modified_base (1993)..(2002): a, c, t, g, unknown or other
  modified_base (2065)..(2074): a, c, t, g, unknown or other
atgccgaggagggnnnnnnnnnncgggcggaggaacgggcatcaatcagatgaaaattgcagggccatgccgaggagggaccgccgaggccgggatgcgagggttggagcatcccgtagtttgagcaccgtgcccgacactccgacaccttaccaggctggggctcagatcaagcatctgagggctgctcataaccccaggccggcgaagtgcggcagttcagggggggggacgactcgatccgggcgccatgaccatgtggtgcgcggaggtgactgcctcgtgcannnnnnnnnnacgactcgattcgggcgccatgaccttgtggtgcgcggaggtgactgcctcgtgcagagatgcagggcgtcaggtccgtgcatggccggggtagagtcccacacatgttgtcaaggtgatggtcctgaactgggtaccgtgacaccgtaccccctgcccacgtggatcgctctctcacaactctctgcggaacactcgtccttgtcctcatcaggcagaccccgacgtcgcaacctgggttcgcaggccaatgccttgcacgacggccttccatgtgactacctgatccgaccttgcatagcccgtcccagactggctgtagtctccccagggacctgcggtctcagcccggggtcctcgctcttcaatctggggctgcgatccatggagagggtgggtaaaatccgcacaattatggcattagatcccgccgagctcgtccctcggcgccacaggtccattaccatggcagccattccatgccatgtcggctgcaatacatctgcaggcccccatgctcacccaccatcgcttccccccgctcctgtccagtaccaccaagtcggcaagatcggcgagggcacctatggcgtcgttttccgagctcacgatcgcgtgaccaaccgcctgcttgcactgaagcaaatcaggcgaggcgaaggggccgagttgctgcaccatcggtgggtcgtacggattcccgccctccccgactcgtcccatcccctaacctgcaggctggaggcagaggaggagggggtgccctccaccgccattcgggaaatctcgctcctgaaggagctgcagcatgagaacattgtgaggtatggccatctgctcgtggcatcctgggcctgggtttgggctgggggtgctggccatgccatgccctcgctgcgactgcgcacccgccgagcagtggcggtgcccgcctcggactggccctcggccccccagctgcccgcaaaccgcaaccccaacccttccatgcacagcctctatgacgtcgtgcatgaggatcgcaagctgtacctcgtatttgagtttctggacgtggacctgaagaagagcatggacagcaacccggccgccttcaaggaccctgcgctcgtcaaggtgcgttttgggaggctggttggcgcagttgccaggcctgactgtcccgtgaccatacctgcggaatccgcaaaggagtgtggcatgctgctgcaccgcgaccggcagctgctgtgtgcgccctccttccccgacgactccacgctcacagaactatgtgtatcagatgctccagggcatcgccttttgtcatgttcaccgtatactgcaccgggacctgaagccacaggcaaggggtcttgcgtagggtttggtgtgggggcgtggcattggagcccccacggctgctcctcatgtggtacaggattcccccagaagcaaccacacaatcacccggccccgcagaatcttctgattgaggagaagacaaataccctgaaactggctgattttgggctggcgcgggcttttggtatccccgtcagagcctacacccacgaggtcagagggagggagggtgaggcggggttgcaagccctcatgggcttagccactgttcgaacgggcaatctgggtcaggaggtcgacgcatcgctgacgacttgcgcgcccgctgctgttctcctccgtatgagccctnnnnnnnnnnagctcctcatgtggtacaggactccccagaaacaaccacacaatcacccggccccgcagaatnnnnnnnnnntgattgggcaatctgggtcaggaggtcgacgcaccgctggcgacttgcgcacccgctgctgttctcctccgtatgagccctccccacacctcagcacccctccaccctcattttggcgtgccaggtga

SEQ ID NO: 4627 - DNA, 1836 bp, Chlorella protothecoides
  modified_base (1096)..(1105): a, c, t, g, unknown or other
atgggtctcctgagcatcatcaggaaagtcaaacggcaggagcgggagatgcgcctcctcgtcgtggggctggacaatgctggcaagaccacggttctgaagcagttgacgggtggcgacgtcaagagcgtgagccccactttaggtttcaacatcgagacattacagctcaaaggcacacgtcattttgccacagacaccttcagcgggcatggatatctattgcgctgcgaatccctcatccttcccacccctaccatctcatccctgcacagcttccgcctcaatatctgggatgtgggtggccagaagtcgctgcgcagctactggcgcaactactttgagcagaccgatggcctggtttgggtggtggactccgcagaccgacggcgccttgaggacaccggcgccgagctggcacggctcctgctagaggagcggctggcgggcgccagcctcctggtcctggcaaacaagcaggacatcgcaggtgccctggcgccctcggaaattgagcaggccccctttgttcaggccatggctgggttcgtaaagttgactgcgtggaagggggccatgcctgaaatgtatcgaagccgctgcatggctgctcagcaagctacccaacccgctccctccccaacccactctctcaccaacccgctccctccccaacccgctccctctccaccccactcaggtgctgcagctgcagggactgggacggcggcactggcacctggcggggtgcagcgccgtgaccggcagcgggctccgctcgggatcggcgtttcgtacgtaactcccgcatgttgtgccacacatgcttttcgccttcactgctcccccgtgactctgggaccttggggcacacgtccaattggaaacttctctgagtccctaaaggcaaagccacttttcctcctctccatccgcctgaacagtcatcatgctggtcgggagtgtgggaggatcctgccaagcattgctgatcaaggcaaactttctcgcatcctgtcagctccttgcatcatgcgtcactaccccccctcagccctgagcgccagctggattcccaagcaaaacagggtccccnnnnnnnnnntaaggcaaactttctcgcatcctgtgagctccttgcatcatgcgtcactactccccctcagccctgagcacaagctggattcccaagcaaaacagggtcccctctggtctgacgccacatcgaccgcaatcactctggtccagctgttacacagggagcgcgctccaggctcaggcgtgcacggggatcttgtaggtgcgggcggggccctcgaacagctcgtgggtcttgcgcgcggccaggggcccgtggttgcccagcagcttggcgttcaggccgtcggcggccaggcgcccctcctgcttccactggatgtagtcctcgcggttgaaggcagtgaagccccagttccgcgacaccacgatcttctggcggccggggaacttgaacttggcgcggcgcagcgcctcctccgccaccaccacgtgcgcgtcgcggcaacggatggacagcaggatctggccgatggccacgcgagcgcacagggcaaagggcttgccgaaggcgccgcgcatgccggtctgcagccgatccgcgccggcgcaggaaagcatcttgttgatgcgcaggacgtggaaagggtgcacgcgcacgcgcaggtggaaggcgtccttgcccgcgttcttcaccatgtacttgttggcggcaatgcgggccgcctccatggactcagaggagatgttctccttctcccaactgagaagggggggggaagatggggatggacatga

SEQ ID NO: 4628 - DNA, 672 bp, Chlorella protothecoides
atgcagccccacctggccagcaccctgcccaccccggagaccgtgaacctgcgcgcccagccccagccctacgactacggcctgctgcacgtgggcggcgggggctacgacccaggccgcatgtcccccttcctgccctccgactcccccggcctgggcgtcaagctggagcttctggactcgccgcagcaggccccacagccccccggcatgccccacccgggcgcgatgttcagccgcggccatcccgacagcctgcccccggtcccgccgacggcgcacccacccaggcagcagcagcagcaacagcagggcggcggcggcggctcggcggcggccggcggcgggcagagcagccgcgggtccgacgcgcggtcgagcgcaccggcccccccccgccgcgacggccggcctcacgtcagccacagcacggtggagaagcagcgccgggaccgcatcaactccctgatcgacgagctgcgcgacctggtcccgccacaggctggctgcggcaccggtgaggcggccgagggcagcgactcgcgccggccaaagcacgtggtgctggccgacaccatccagctggtccgcgacctccaagaaaaggtgggcgggtcggcgggatggcggatctctgatgtgtggtgtgtggcttggggtgggcgtgagtga

SEQ ID NO: 4629 - DNA, 1047 bp, Chlorella protothecoides
atggcccctcagcagcccacgaccccacagcagcctgcaccccgcccggttagcctgacgccccgtgtgctgttcattccctcgcaggagcttggggtcgtggaagcctgcaacagccttgctccacgtgtgcctcagcctcagcagtgccaggccccccaacggaaacgccgcgacgacgctccccaggtcagccgaggacatggggggtttgcgcgggcactggcaaccatgcatctcttgtgctttgagagagcaagcgcagcgacccccgactacgtggcgatgctggctgaagcatgggcctgctgtgtgtggactggctgtcgacgcctggctggtcccaacaggtcctctccaagccccgcccccctcctcctcccatcgccccaggaggagcgcagcgtgcgcaggtccggccgagtggcaggcaagccggccgagttttacgacgaggacaacctgtaccgcagcctcggcatcgaccgcctggacgccttctcccggcgcggcacgcgctgcacggtcccggaccccgagcggctggccgccctgcgcgctgcgcgcggcggggccgcgggtggggctcccgaccacccgtccgacggcgcccggcccgccgcgccccgcgtggactcggggcggggcgtgcgcgtgcagggtgggcgtgtgtatgacagccggtacggcgtcacctgccactggtgccgccagaagacgctggaggaacacgtgcagtgcacggcgccggggtgcgggggggggcgccgcctccccgtgtccttctggtgtgtgccgtggcgtgggtggggggctgtcactcctggctctgggagggggcacggagacgggcgtggaccgctggccgtgcgagggaatcagggcatgcctgcgcagggcagtctggcggccaggcactcccaggccctgcccctggcaggaccccgctgtggctgtgagggggcacttccctggtggagtcggggtctccactccccacgctcgcaccatcatgcacccacgctcacactcgcacacgccaagtga

SEQ ID NO: 4630 - DNA, 495 bp, Chlorella protothecoides
atggaggcggcccgcattgccgccaacaagtacatggtgaagaacgcgggcaaggacgccttccacctgcgcgtgcgcgtgcaccctttccacgtcctgcgcatcaacaagatgctttcctgcgccggcgcggatcggctgcagaccggcatgcgcggcgccttcggcaagccctttgccctgtgcgctcgcgtggccatcggccagatcctgctgtccatccgttgccgcgacgcgcacgtggtggtggcggaggaggcgctgcgccgcgccaagttcaagttccccggccgccagaagatcgtggtgtcgcggaactggggcttcactgccttcaaccgcgaggactacatccagtggaagcaggaggggcgcctggccgccgacggcctgaacgccaagctgctgggcaaccacgggcccctggccgcgcgcaagacccacgagctgttcgagggccccgcccgcacctacaagatccccgtgcacgcctga

SEQ ID NO: 4631 - DNA, 543 bp, Chlorella protothecoides
atggcgagacgtgagtggggcgtcgcgaccacttgggctgccctcccgccgggctgcctgccggcgccagcgatggcctcgctccgccggggctgcaaaggatgtatgaggcgcgcggacatgcctgggggtccggcccgctgctacaggcagattaaggggaagccataccccaagtcccgcttctgccgtggtgtgcccgaccccaagatccgcatctacgacgtcggtgcgcgtcgcgccaatgtcgacaccttccccagctgcgtccacttggtcaggtgcgcgaggggctccagagaaggccctccgggtcagggagggagtcccggccttgttgacgtgagcccagactcatccccccagcaaacgcgtggtgggatttgtcgcgtggtaggagtcgcgtctccgggcttgagaaccctggtcaggagccccgggcgcgactgctttccaccgtgctgccttctggagaccaggggtggaggggaggagctgggagcttcagcaaagctggacggccggggatggcactggacctga

SEQ ID NO: 4632 - DNA, 696 bp, Chlorella protothecoides
  modified_base (173)..(182): a, c, t, g, unknown or other
atggcagcagtgctcttgacccttcagattgcgactgatgtgcctcctttgtcctctcctcaaatattggctgccaaagttcccagccgtattggtaaagatacacagggggggtactgctcccctcattcatttggaatgtggccttcgggtgagcccctcccgccgcctcnnnnnnnnnnaatgggctgccaaagttcccagccgcatcggggggtaactgctcccctcattcatttggaatgcggccttcgggtgagcccctcccgccgcctcggcatgcaacctcatcaaggttgtatccatccaatggctccgaagaacaggtctgctcgatcggcggaggaggctgctgatccctcgtttgaagtgaccccagatacgctgcagcagctaatggccagtgggaacaccgaactggtcggagctctccagaaagcattgggaaagatggtcgggtcttcgagcggctacatcgagtccctgcccgaggctgtgcagaggcggattgaatacctgggtgacatcgatgagcagcggtccgacctcgaggcggagttcgatgccaaggtcaagcagctggaggaggaatacagcgagaagtatggtgcgcagattgagctgtggtgcaaccaggcgttgccatgcctgcatggggttcaacaccagggaggtccattgcctccgtgggcctga

SEQ ID NO: 4633 - DNA, 3711 bp, Chlorella protothecoides
  modified_base (51)..(60): a, c, t, g, unknown or other
  modified_base (189)..(242): a, c, t, g, unknown or other
  modified_base (566)..(575): a, c, t, g, unknown or other
  modified_base (1689)..(1698): a, c, t, g, unknown or other
  modified_base (3519)..(3528): a, c, t, g, unknown or other
atgcacacaaagacaaatgtgcatacaccgccccccagcaccgccctcgcnnnnnnnnnngtgcccctccccctacctcctcaggcatgctcacaaagacacacatacatacatcgccccccagcaccaccctcgaccgccggctcacccgccggcacccccagccggtctgcggcggcggtcaggatnnnnnnnnnnnnnnnnnnnnnnnnnnnnnnnnnnnnnnnnnnnnnnnnnnnnnnccagccaatcgaggtccttgacctccagctgcgccacgcccagggcggcctccaccgtcttgggcacggcgcgcaccgcaaacttgaacacttcgctgccgttcatggcgatgttggcaaaggcggggtgggaggaggcggtgtcgtcgttcagcgctttgtccccggcgcccaggaacctggagtgcaggtgccgctgcccgttgccgtctgtgcgggggggagggaggcggtgggtgtttgggatcgagtgttcatgtgcttgaacccttcctcccccagcctgtcatcatctcccaacccccctccacacacgacgtcatnnnnnnnnnngtgccgctgcccgttgccgtctgtgcggggtggagggaggcggtgggggtttgggatcgagtgttcatgccctcaagcccttcctcccccagcctgtcgtggtctcccaaccccactccgcacacgacgtcaccctcccctacccaccccccaacacacacacctgatctcaggtcgtgcccgaggaggtacccctgtcgcgccagtcgatgtagcgcgacagcgcgtcggcgccgatgaccagcacgttgcggtatgcccccgtgcgcaggaactgtgcggcggtgaccacgcccatgacgaagccggagcaggcggcggtgaggtcgaaggcggcggcgttgcccgcgcccagccgtgcctggaccgcgcaggcggtgccgaagccgtcgtcaggggaggaggtggccagcaggaccaggtccacgtccgcggcggggacgcccgcggccgccagggcacgctgggccgccagcagggcgtgatcggccagcgactcgccctgggccaggatgtgccggcgccggatgccggtgcgggacacgatccactcgtcgtttgtgtccacaaggcgctccagatcggcgttgctcagcaccccggcgggggtggaggagccggagccggcgaagcgaaccccggcgcccgcggccacggagcgggggtggggggatggggtgcgggccaccgccaggcgggggccgggccgggccggcaggcaggccggggagatctgggccatgtgggacgccataccgagagacaggggtgcgcagggtccgggccgcgagggaagcagacccccgcgggggaggggggtgggtgggtttgggctcgaggagaggccccaaaaccggtcgcattgcgttggcgcaccccgcattcgacaggagatccaaactggcatcgcaggcggagcacgggacgacagatatgcaacacggcccgggcgggctcctggctcgatggcatgcggcgacgtgactcgactgtacaagggggatcgtatccatggcagaaattgagcctccatgtcaggaaggcttcagtcaccaaagaaggtgcacgattcacccaccccaggttccatcacttccaggtctgctcacccctnnnnnnnnnnaaattgtacgcgacacgggcatgcgtgggattcggcgaccgaacacgcttcccgggggggggtcgatcagtgatcactgctgcttgcactcctgcggctgtgcttggctgtccacggcctgcacggcattcgagggtaggagggatgaatcgccttgaccttcatgcacaaaggagcctccatgtcatgaagccttcagtcaccaaaggaggtgcacaattcctccaccccagcttccatcacttccaggtctgctcacccccgccttggggccggtcttcccggtcgacttggatcgcttggtctcctcctccccttctccctcgctatcgtcgtcctcactgtcgtcctggtggggagggagggatcagcaggagtcgatggccaggaggtgatcctctgacgtgtgcacatccatcaccccccgggcctccatcccgccaacgggcgcgccctgccctgacccacctcgtcatcggaaggggactcatcgtcggtctcgcccgggggggttgcgccatcatcctcgctgtcgtagtcctcctcgctgctctcgtcatcctgcagcgcctcgcccgtgaaccacaggtaggggtggtcgatgatcttctcgcggatgatctcggccacctcgtaatcgtcctccatggcggcctgcaggccctccagctcctcctcctcgatctcctcctcgttctcagggatgggcggtggcgtgaaccagttgaagaaggactcggtgggggtctgctttgtggggggggtccccttctggccggggcgcatcttcttcttcagcaccttcaccgtcacgttcttgctggccgacttccactcgatgggcgtggctgtgtgtggagaaggggggggggaagcaggtggggctatgcaggaggggaccgcgtgcatgggcgaagaaagagtgagggagggcagcgcagccagctgcatgagcgagctttggcgagtcccctccccaatccacctttgatgtcacggatgacaagatcctcgtcatcgcccataaaggtgaagctctgcatgggtagtgatcggggaggggggggccctggaagtggagtttccttgaaggcaaggaattggggaaagtccggcaatgcccctcactgccttcccataagcagggcatgcagccaccatcgtccttccgttggcaccccaaggccacgggcaggccggcctgctcgctgggggctgcctagcatgacacaccgaccccaatccacagacttggacccaagcatcaggcacccctttaaacttccagccgagcggcacacacctcctcctcctcctcctccgacaggctctcctcgtggatgtcggcacgtgaggactgatgaggccctggcagaggcggcccggaaccaaaagagtccaggcagcccgcatggatggcatgtgaggactgatgaggccctggctgaggcggcctggaaccaaaagagtccaggcagcatgcatggatgcaccacgttctgcactgaagcgttgcacccactcaagcagggtgagggcctccaaagatgccttgggagctcctcccccttggagcacagcaccgccctcaccagagtctccaggtggggttcgttccgaagcgcaatcatccagaagtcggggatgcccttggggacattgtcagcgccctcctcggtcaccacgcctgtgttggacgcagacgacacagagtctgcagctgcaggcaggagactgggcatgcggcctccatgcatgcagcgccagtcctggctcccacagtatgttcaaccgagtggcccaagcgacccaggacacacnnnnnnnnnngcatgcagcgccagtcctggctcccacagtgtgctcaatcgagtggtccaagcgaaccacgacacaatctctttccctgtcaccacctggggcctcggtgacgccattcacgatatcacgcagctccttgtccaagggggctgcgtggcagggacagggccaatctcggctggtggatcatga

SEQ ID NO: 4634 - DNA, 534 bp, Chlorella protothecoides
atgcagctggctgcgctgccctccctcactctttcttcgcccatgcacgcggtcccctcctgcatagccccacctgcttccccccccccttctccacacacagccacgcccatcgagtggaagtcggccagcaagaacgtgacggtgaaggtgctgaagaagaagatgcgccccggccagaaggggaccccccccacaaagcagacccccaccgagtccttcttcaactggttcacgccaccgcccatccctgagaacgaggaggagatcgaggaggaggagctggagggcctgcaggccgccatggaggacgattacgaggtggccgagatcatccgcgagaagatcatcgaccacccctacctgtggttcacgggcgaggcgctgcaggatgacgagagcagcgaggaggactacgacagcgaggatgatggcgcaacccccccgggcgagaccgacgatgagtccccttccgatgacgaggtgggtcagggcagggcgcgcccgttggcgggatggaggcccggggggtga

SEQ ID NO: 4635 - DNA, 288 bp, Chlorella protothecoides
atggagcgtgttatggccaccatgaacgcacacacaatcgtgtcgggatgctctgcccctggacgggtttcccacccccgggccgtcgcgccccacgcccccacagcgaatcgacgcgcattactgggcatgctgggggtggcaccacttgcattgagcatccctcgtcccgccttggctctcatccctgatgacgacgatgaggagcttgttgccaaggccaaggccagccgggccgagcgactggctagggataaacgccagatcgggcagtttgtagccacgtga

SEQ ID NO: 4636 - DNA, 948 bp, Chlorella protothecoides
  modified_base (406)..(415): a, c, t, g, unknown or other
atggcagcgctgacaggggatctgagggcactgcgggactatgtcatgactccaggggacatgcagaatcaatcagatagcacagtgctgctgagcgtaacgcatagcaatctgaaggctcgcttcatggagatccggttcgaccgccatatgacggtctcggctgtgaaggacaagctgtgcttccacaccggctctgcaccctcagccatgactctcagcctgcgagcagccggtggtggagccagtacaatactacagaatgacaagaagctgggctactactcaccacaagacagtacaggtgtggacctcttcccatgcacctgcagcctcgatcccttgcacatctcttcaccagggacacacttcatgtggaggatctcgaccccacatcagcgtctcnnnnnnnnnncgtgtgcctgcattcccaggggcgctgcagacggtgtcaaaatttcattccagagagttcaaggagacgaagctgcaagaggaccccacatggacgctggagaaggagatggaggcaaggtccaaggtagtcgggaacctgacaaatggagctgtgtgttctgtctggggactgggggtaaaggggactgctcaatactgtgtccagcgttaacccatctgaaaattcccaccccccaactcaggccaggggcgcaactggccccgcgccacagggtccggccccagacgactcgttccaagaggagctggccgccggcatcgccgtgggcacgcggtgtgaggtgcagggcgggcgaaggggcaccgtgcgtttcgtgggccggtgtccgagcctgcccgccggcttctggatcggcgtcgaggtgggttggtgaacgacccaggggaggggtttggcagggggtgcctgttgttcccgtcgacagcttctgccacggaccactcagctttgtttgcctggacgccctatga

SEQ ID NO: 4637 - DNA, 210 bp, Chlorella protothecoides
atgccccctctcaagaccatcgtgatgagtaacgacaagatgcaccccctgcaggacatggtcggggcctgggagggtgtgtgcggggcgctggaccagtatggcatgcggcacagcagggcctttgccaacctgtgcaacgccggcgtgcggccctcggagctggggaccgcggctgcgctggcgtgcaccgacgccgacgtcgcctga

SEQ ID NO: 4638 - DNA, 717 bp, Chlorella protothecoides
atgccagctgagggggttgatggaggggggtgtggatggataccaagggaggaggagattggcgtgggcgcccgtcagcctgggcgaaggggccccgtacgatgtccggtagtagaggccagtctgccctgccagcttgtctttagcgcgggaaggggttgggggataccgagcggctgggccaaccttggacctggaaccccactccatcacctcacccatgaccccaccgccccggacgcagagttccggggcatcaatgcctacagcgcggcccgcttcgccgcgctgggcttggaggaggcgaggcacgaccacggcgagccgccgcaggaaccccgggcgaccgcgcacgccgaggctcacccggcgccggccgcagcggcgcctgctgcgccccaggcggccgaggcagccctgccggctgctgcgccggcccccgccgccgcagcgacctgggagtaccaggacccccgtggcgagatccaggggcccttcacggtcccggagatgctggagtggtgggtttggcgcgtggctggcgtggctgatgtgcggggcggagggggccgggttgtggtcgtcgccggctcccacgctgcctcggggatcccactgcatgcccggggctggagcgacgggggagactgcggagcgttggggctaggaatgcgtgggagatcataccctgcccagcaggctactcgcatcccttaa

SEQ ID NO: 4639 - DNA, 1383 bp, Chlorella protothecoides
atgtcggcgcgggcaatcgcccatccggtgaaaaattggaatgctggcccgatcaagcatgtgccgctggtccatgcaggagagtggcattcctgtgccgcggcacatcatcgtggacagggaccatctggagtcaggccaggacccaggtactgtattgagcatagggatatggcagggcttgcaggtgggagggggagcgcatctgcaagccattcgtggagaagcccgccagcggtgaggggccgggtgctggaatgcccgccgtctcgcggagcagggggtgcctgctctgactgggccggagcgtcgaggctctgccaggtcaccttcccggaggctcttccgcaaggtgggtgggcggaggggcggccgcctgggtctggggcagcgattccatgctccaggagggtttggtactcgtgtgcacggcggcgggggtgccggcgcgcaccacccgtcacggtccccgtcaccttgaatcctgacatcccacgcatgcaggtgaacaaccgtagcgcagactacgacgcgacccacccgggcaccgtcaggtgggcgggatgcgtcctacatctacgaggacttcctgaccaccggtgggacggacgtcaaggtgtacaccatcggcccacgctacgcgcatgcgggtgcggcggggcctgggaggtgcatggcggcgacctctttgcccagcgtgcacgcggccgcgtggaccgacagaggcttcgtctgcgccctgggcttgggggactcgggtttcgatgtctcacacccccccttccaccccccccacacacagaggcccgtaagtccccggtggtggacggcaaggtgcagcgtgccgcggacggcaaggagctgcgcttccccgtgcttctcagcccccaggtgcgaacggctgggtggggcggctgtgggcgaggtcatcgccgaagtctctgggggtcatgggatggtgagaccagcggagtgcaggagcctgctggcaggcgaggggcccggccatccctgccgcgcacccccggcgcccccggcacccctccagacccagccaaacactctcccaccacccccacgccccatccatctcgcaggagaaggagacggccagaatggtgtccctggccttcggccagcgcatctgtggctttgacctcctgcgttccgagcgcggcaagtcggatgtgcagcgggaaacctcgcctggaggcggctgacggatgcccgtggtggtctcctgcatggggagcctgccgcggtgctagaaggtggcgagcgatcgggagcggggtcactctctgccggtccttcctagtccctgctggctcattgaaggcatgccctccccctctcctcctccccccctcccccggacccccc

SEQ ID NO: 4640 - DNA, 984 bp, Chlorella protothecoides
  modified_base (517)..(526): a, c, t, g, unknown or other
  modified_base (880)..(889): a, c, t, g, unknown or other
cctccccccaacaccccctaccccccaacaccccctggcccaaccaacccaacccacacgcagctcaccgagggcggcaaaggagttcatgatcaggttcacccacagcagctgcagcacgttcagggccagtgttcccgtggagaccgcggcgatgaaggtgacaatgagggccaccaggctgatggtgagctggaactggaggaacttgcggatgttagcaaacacgttcctgccccacagcaccgccttgacaatggaggagaagttgtcgtccaaaatgacgatgtcggcggcgtccttggccacctccgtgcctggagggagtggggtgaatcagggtggtggaatattggacttggtggaagcaggtggataaagtgggaaaactgcaggcatgcagaactacaaggggagcaaatcaagccccatgcactgtcacgccccaatagacacataactcaaacatgcaaaaccccttctccaccccacagtctgcccacctgcaatgcccatnnnnnnnnnnaggtggaaaggaaaatgggtggcgggggggcagccttgatgggagcgagtgcccatgctcagtacggcttgcaggcatgcacggcggtgacacaagccaagcaggtcccatacgctgccacgcccgaacaggcaaatccttcgacgtccaagaggatccttccttggcgcagtgccagcccacctgctatgcccatggccagtccgacatccgactccttgagggcgggggcgtcgttggtgccgtcgcctgtgaccgccaccacctcccccaacagcttcaggttgtgcactagggtgtgtttgtcggtgggcgaggaacgtgccagcacctgcacagggtgtgcaatcctcnnnnnnnnnntcccaggcgcttcaggttgtgcactagggtgtgcttgtcggtgggggaggagcgggccagcacctgcacagggtgtgcaatcctcatcgccttga

SEQ ID NO: 4641 - DNA, 567 bp, Chlorella protothecoides
atggaggggccagagttcaggaacatggacgagcaggagctgctgcagctcctgccacgcctccaggtgctggcacgttcctcgcccaccgacaaacacaccctagtgcacaacctgaagctgttgggggaggtggtggcggtcacaggcgacggcaccaacgacgcccccgccctcaaggagtcggatgtcggactggccatgggcatagcaggtgggctggcactgcgccaaggaaggatcctcttggacgtcgaaggatttgcctgttcgggcgtggcagcgtatgggacctgcttggcttgtgtcaccgccgtggccaaggacgccgccgacatcgtcattttggacgacaacttctcctccattgtcaaggcggtgctgtggggcaggaacgtgtttgctaacatccgcaagttcctccagttccagctcaccatcagcctggtggccctcattgtcaccttcatcgccgcggtctccacgggaacactggccctgaacgtgctgcagctgctgtgggtgaacctgatcatgaactcctttgccgccctcggtgagctgcgt

SEQ ID NO: 4642 - DNA, 690 bp, Chlorella protothecoides
atgaccgtggtcgacggctggttcgcgggggccgcgaccaagggcctgccggactgggccgacctgccgcagccgctggccgaggcggtgaccgagaacgtggcggtcaactccagcgcctacctggtggagagtgagcacggcggcgtggacttcgtgggcaaccgcaccgagtgcgcgctgctcatgctcctacgcggctggggccaggactaccgacgcaagcgcgaggccctggccgcgcagctggtcaccgattaccggcgcaagcgtgaggccctggccacgcagctcgtcaccgtttacgtcttcacctccgcgcgcaagatgtccagcgcgctggttcggcgcaagggcgcgggtctcacactgctgtgcaagggcgcggcggagatcgtggtggggcgctgcacgcgctacgcgggtgcgggcggtgcggtggaggacctgggcgagggcctgcgccaagagctgctgcagctggtcaccagcatggcctcccgcggcctgcgcacgctctgcctggctatgaggggtgaggcgaggcttgtggtgctttctctttggtccttttgggaggggggatttggagtcgggagggcgttatctggagccgggagggcgttatctggagccaggagggggagtgatgtgcaaggccctcgctgctcgctcgtgtgcgccgactga

SEQ ID NO: 4643 - DNA, 1449 bp, Chlorella protothecoides
  modified_base (369)..(378): a, c, t, g, unknown or other
  modified_base (545)..(554): a, c, t, g, unknown or other
  modified_base (624)..(633): a, c, t, g, unknown or other
  modified_base (926)..(935): a, c, t, g, unknown or other
atgtgcgagccaggcgctggaccttggttccggtgctcgaccccattgaagcgctgctggtggggctgggctgttagccccaccccttccaaccctccctctctccccaaaacccctcacctccccattgagggggccggctgggggtggagccaatggtctggctccacagagggcactcgatacgccctgcgacaactggaagcagctgtggctgcctgtgcgagccaggcgctggaccatgggcacggtgctcgaccccatgggcgcgctgctggtggggctgggctgtcacccccacctcttccaaccctccctctctcccccaaacccctcacctccccactgtccccccgcttcaatactcgnnnnnnnnnngcagctgcagtcgctcagcctagcccacaaccggctgacgggcggcgtgccggccgcgctcgccgggcacacgcgcctggtccagctggtgctgacgggcaacgcgctgacggacctgccggacgcctggggcgaggagggcgaggccgaggccgcggccgccgcannnnnnnnnncctgcagagcctgagcctggtgctggccaacaactcactgactggcgccatcccggcctttgcctccgcnnnnnnnnnngctcacgggcaacgcgctgacggacctgccaaacgcctggggcgaggagggcagtgccgaggccgcagccgccgcgcctctggccgcgctcagcctgggcggcaacgccctcgccggctccttccccgtcgggctggccgcctaccccgcgctggcctccctggacctcagcggcaacaagctgacaggggagctgccctccgccggcaccacgtttttccccagcctgcgctatctgtttgcgggcgggaacgcgctggagggcagcatcgggaacgccttgcaggagtcannnnnnnnnncgccggctccttccccgtcgggctggccgcttaccccgcgctggcctccctggacctcagcaacaacaagctgaccggggagctgccctccgccggcaccacttttttccccagcctgcactacctgtttgcgggcgggaatgcgctggagggcagcatcgggaacgcctggcaggagtcgggcatctttaacctggtgggtgattccctgcgtgggtgtgggtgtgcaggaaggacggggggaaaacgggggaggataactgaggagggagagggtgggggatgggatcggcggcggcggcttaccaatggtatggtggtggtgttttcaagtggtcggcaggctgcatgcgcggggagtgcacgctcactgggtggactgtgggcgcctctccaggcgaacgcctgttacctgaccgcccatgcgcactctaccatccccacacccaggcgcccttggacgccaatgtgcccgccacctggaacaccatctccctcgcgaacaacaagctga

SEQ ID NO: 4644 - DNA, 909 bp, Chlorella protothecoides
  modified_base (281)..(290): a, c, t, g, unknown or other
atgagtggtctgacagctgatgcacgcaccctgatcgaccatggccgcgtggaggctcagcagcacgcattcacctacaatgagcccatccctgtggaatcgctcacgcaggtactgatacggaaagtgctacccagcaggcccatgctctggtgcagattcataggagtggggcaacctatcgcaagggctgaatggcttcgagtatatgtcttaactcctcaacctcatccccaatctcctgcagtccctgtgcgacctgtcgctgcgatttggagagnnnnnnnnnncaatgctgtccagcaaacccatgatctgctgcagatccataagagtgggtcaacctatcacaagggccaagcggctttgagtacatgtctcaactcctcaacctcgtgcccattgccctgcagtctctgtgcgacctgtcgctgcgatttggagaggatgaggatggtggggatggtggcatgcgtcttgcctaccctttctcctcctgcaatgaccccacagagccgaccctttggagtggcactcctcattgctggctgggacacagactcagggcccgtcctgttccacactgatccttctggtacatttgtgcggtaccaggccaaggccattggttctgggtctgagggtgcacagacggccctgcaggagggattccgtgccgacatgaccctgaaggaggccgaagagctcactctgtccacgctgaagcaagtcatggaggagaaggtgagacctggtgcagaatgggtgcatgcgtttgtgtcaaggcccagcagtactcgcacagccttcccaacctcatgcatttctggctgcagtcttgcccgccgtcacactgctgcgaatgatggtggcgtctggaaggcagcacacattgtaacagcagcctaa

SEQ ID NO: 4645 - DNA, 1746 bp, Chlorella protothecoides
atggctcgcacatcgcccggtggaagggccctccagacacatgcacacgcatggctcgttgcggcgccccctgggcagggctcgacgaggggaggggtggcaggtcgagacgggccccgtgtggctgcccccttccccgctcactccctcctcccggatcactcagtacttgtagtccttcacgtacaggctctcgcccgtggcgtccaggtctcccttgcccagcgtggcctggccgttggcggaggcgcgagcgatgaatgcctcctgcgcggccttcacgttctccgtcttcccgccccaggccttgagcgtggagctctgcagcgcgcggccgaaggagaaggacagcgcccagggcttgggcaggtcggtgacctggttcatggccaccaggtgggcggtggcctcctcctccgactgcccgccggacaggaagacgatgccggggacggccgggggcacggtgcgcgacagcgtgcgcaccgtcagccatgcggcggtgcgcacgtccaccttgggcccctccgcgccggggagcaccatgttgggcttcagcagcgtgccctccagcagcacgtggtggtcgttcagcgccttgtagacggcgcccagcacacgctccgtgatcgcggcgcaaacctcgatgccgtgggagccgtcggagaggatctctggctccacgatgggcaccagcccgttctcctggcagatgaccgcgtagcgcgccaggccgtacgcattctggtggatgctcagctcgctcggctccttggccccgatcttcagcaccgcgcgccacttggcgaagcgagcgccctgctggtagtacttggcgcagcgcttgcccaggttgtccaggccctgggtctccgtctcgccgtcagtgccagggagggggaccacgcccgcgtccaccttgatgccggggatcatgcccaggtccttcaggatcttggcaaagggcgtgccgtcgttggcattctggtacagggtctcctcgaacaggatctggtggagacactgcacccactcagcaccaccacctgggccataggcctcccggaaccgcgggaccgggggacacaccctagcccggaacgtgcccacaaccccacgcaccacgccgctgatgtgcttgttggcgtcgggggtgttgaacaggagctcgcgcaggttacggcgggcagactcctcgttcgccacgccaatgctctccagctgcaaccgggactcggggtgggtcagggttgggacgggcacggaaccgaggacagattcgggacgcacggacagcatgctatgcacacgtgcatgggaagaggtcgtgaaccgaattcgacaaggcaaggggatgcccttgccgggagcgacgatggccttggcagtggcaatcagctcctcggcatactcgttcttccaggtgtttcccaggacggaagccattgcgagaatgggatgtggagcggaattcgtgaacggaaaatattagaatggcgagtcgaagtgtttatgggttgggtccccgctcgatcagggctttgttggcgtcggccggggtgcatgccgggcccttccctgatcacgtgcggagttagatttttcctgcatcaagggctgggccgccgtgagggtggcgccctggcgcagatgcaaaccctcaaaggtgccttgactgcttccctgtttttcttcagaacccaagagtacgtgcagctgcctgctgggactttcgattttgtgtga

SEQ ID NO: 4646 - DNA, 1995 bp, Chlorella protothecoides
  modified_base (937)..(946): a, c, t, g, unknown or other
  modified_base (990)..(999): a, c, t, g, unknown or other
  modified_base (1398)..(1407): a, c, t, g, unknown or other
  modified_base (1693)..(1702): a, c, t, g, unknown or other
atgcacctgctcacccacgagctcctgctctttgctactggcatctggaccaacaacatccatgacaacattgacggcaagggacagaaacagctactcccatacccattcccacaggtaccccctgtgatgggggcctactaccacaccatccatcacaccatgtacaacaagaactacggacactacttcacctttgttgaccggttgttcgggacgctgctcaccccagaggactatcgcgcgatgattgcagaaaggaagcacgtcttgctgcggcagtctgtgtgctgggttgcccttgctggatggtgtggaatggtgttcaaatgccggcgccctgatgacgtaacaacgccgtcaatttttgagccgcaacaacggcggaaatggaaacctcctccgcctaagtactcggagcaagataatttgttattgaaaattgtcttggagcgcccaacgcattcggttgtgtgcttggacgtttcgcctcctctcctcaggggctggcgtctctcgtgggggtacaagggcatccctcttgggctgtgcccctccggaacacggcggaatggcttcgtatctacgatccatatacaacagcctaccggatgttattgccacgaccagggtgcgcgtggtgggtgcctctcgagggaccaacgagccgtgctggtagccagggtcgcatggagaccccatgccacaacaaatgcgcaggatgccgacgactacataccagtcagcaaggaagatgcagagtgtttcagtatgtggggtgtgtccctcgccgatgagaatagggctgcccaggaaactgccttctgcaccccgtccggccaacagggtatattgatacagcagctcagagatgagctggagctcagcgtcaacataccgccccaacacagccggcgcttgacgcaagcatctattnnnnnnnnnncacaggcctgggctccccctggcccagcaggtttggggagaggnnnnnnnnnnactgaggcgattccttcgggccaggaagcacgacgtcgcagctgctcgcgccatgttcctgtcgaccctcaaggggtgagcgttgtgcacgcagcatggaggaggaaacgattgtgtcttcagcctcctcattctccccgcacaatgcagtggagggaggagtatggagccgacagggtgctgcaagatttcgtgttcaatgagaagcctgagtttgccaagttttacccagaaggtgggtctttcgtagtgcctggagcgaattggtgggagcccgcctgcgccgccgtttccataccacttctatgtggcttgacacgcatcacagttcatgcccccctccccccccatggcaccctcatcacaccaggctgctatggtgttgacagggcgggccannnnnnnnnncccccccccccttcccccatggcaccctcatcgcaccaggctgctatggcgttgacagggcgggccgccccgtgtatgtgcagcagccggggaacatcgatctggagcagctcttcaagttcaccacggaagagcgatgtgtgcgctaccatgtgcaggtgtaatgccgcggtgttctgcgctgtggtgatgtggggtggggggctgttgcaggtgccgcacctatgcagcttgctgagaccagctctttctttgctcgacggtgggtctcacatccattcctatnnnnnnnnnnttctgcgctgtggtgatgtggggtgggggggtgttgcaggtgccgcacccatgcagctcgctgggaccagctctttccttgctcgacgacgggtctcacatccattccttacccccgccccactgcagcaacaggagcgctacatcaacctgattgccccggcatgctcggtggcagcaggcaggtgcgtcgaccagtcccttgtcctcatcgacctccaaggtgcgggacttaaagggggggcgttgccaccgcatcgccaccgtgtggtgcacacccctgtgtcgtcctag

SEQ ID NO: 4647 - DNA, 651 bp, Chlorella protothecoides
atgagggccggccctttagtggtcgcgctcctggcagcaacagccgtggcgatctacgccagccctctcaccgacgtcctcgtctggaaactagggtcgaggggagatggcttggggcgtgatgagggcctggacctgacggtcagtggcaccggcattcccggttcggtcgaagcgtgggggacccccgcgcccgcctccctcacccggcgccaagagcagctgctagagttccgagaagagaacgctttcaaggacaacctggcgctcttctggctcccaaacgaatggcgtgcggcgatgccgccgtatgtacaaagctggctgcggaactggattatggtggccattctctactacgtgctgggcggcgtgtgggtctactacacatactacgcgttcggatcgcagctgttcaagcctggggagattccaagcttgggtgcgcagctggagcagatgaaggtatggtgtcggttcactggcaggctgggagtcccacccgcatgccgacaaagaatcagcagggttgacttcagcagaagactggctcacaatgcctttccggtgaagtcgctggttctggcagcatctgcaactccaggtttgcgctcgtgctgtacaatgttgcacctccttaaaatattgtga

SEQ ID NO: 4648 - DNA, 567 bp, Chlorella protothecoides
atggtcagcagcgatgcaatcataaattgtgatgactgggtgagtacgcttcaaactgtcgcagatgagcgtggcgcttcccctgctcgaccccaagaaggacacccccaaggcacgccgcccctcactggatgatggacacctccgcacacgtcccacccttatcccaatcccaaccaccccatgtgcttctgcaggctcaaagatggcaacagcaaaactgagatacatctgatcaacaaaccaccaaagtggaatcaaatgctgcaggcatactgcttgaactttggagggcgagtcacacaggcaagcgtgaagaatttccagctcatcacctcggaaaatgaggttggtgcagggatgcggggaaggtacagggatgcatgcgtaaagcagtggaatcatgcatcaagggcggccaggtctcctcggtacaccacaaagctcccgggtgctcccctgtctgggagatgtcactcaacattcgtgaaagttccgagaagtagcttcaccatggacttttcataccccatgacgctgctgcaggcacgtttccagattgcatga

SEQ ID NO: 4649 - DNA, 756 bp, Chlorella protothecoides
  modified_base (249)..(258): a, c, t, g, unknown or other
atgcaccctgacatctgtcgcgtcaatactcggggggtggcatcttcactcctgcgtcaagaggccatcagattgtttgacgagctggcagcctccccgcgccactccatccgctaccagctgcagccaggtgggaaggatgtttgggaaattcacgaagtccgtcctcgcctttctgtgtcacagttgcgcccttccctcaacgctgcgaacttgacccactgtgcgacgtttctcactttgcaggtnnnnnnnnnntcctcgcctttctgtgtcacagttgcgccccctcctcaacgctgcaaacttgacccaccgtgcgacgtttctcactttgcaggcgacatccagctgctctccaaccacacggttctgcatgcccggtcagcgtttgttgatgacgccgaggtgaggcctgccgctgccactgcgcgtgtgtgcccctgcagggaggtgttgacgacgcgctctggacctactgctcaggccctgctgccatgtgcagaaattcacacagtcaacaacttatgcaggcccattccacaccatgatcagacactccatcccaccccattcctcccggcacaggacccgaacctgcgccgccacctgctgaggctgtggctggcgcctcctgatgagttcccactgccagaggcgtatgcggacatcctgggggggtcggtggaggtgggcaagcgcggaggaattgtggtgagcggcaccaggctcaacatccccctcgaggcagagtga

SEQ ID NO: 4650 - DNA, 627 bp, Chlorella protothecoides
atgggggttgggtatgggcactacctgagggtctcctgcgactgcactctgatccacttgccagcccttgttgaagcttcccagctcgaggaagtgcatcaccggtggaatacccacccttttgcagcgcttctgtgcctgaatgaggcacggcagggtggggagagccagtgggcctcttcatgggcaggtatcagggcgctggggtttgagagacttgaggagactgcggggcctgctttgttcaaactgcgtgcatgtgcagcgaatggcacaacgctgggagctggcgcgtcgcatcacatgcaccaagcggggagagcaccaagttcaacacctccctcgccccatcacgctgcagtgcacaacgagttcctcaagctgcgccctgacctgggacccgtcatgactgagaactggtactttgacaggaagggcgaggtcccagccgggaagcagcccttcttcgccatccccgccttcaactacttccaggtatcagggcgctgggggttaagaggactcgaggagactgcgctgcctgcctttgttcacactgcgtgcatgtgcagcgtatggcacagcgctgggagctggagcgtcgcaccgcatgcaccgagctggtag

SEQ ID NO: 4651 - DNA, 1707 bp, Chlorella protothecoides
  modified_base (884)..(893): a, c, t, g, unknown or other
atggaagctatgaggtacctgtggagatgcactggacctgtcatgtcgctgtgcgagatgggcattgccaggctgcgctctgcagagcctgccttgcagtccatcctccacgctgacacctccagtcccatgtgcagctcacctctgcctctgccctgcggggctccacccaacatgctccagcttgatcggcaccggcatgcgagactgcaaggcgagcagggcttcttcagcccggccttccccaaagtccacagcgcggtacaccgtctcggagagcactgcggcagcagccacatcctgatggggggggaaggggggggggaggttagcatgtgttcagcgtcaggcccctatggtgagctggccatgcagagtcatgcagcaggcttgagtatgaggaccttacgatcaattaattcatgtgtcactcttcacctggaaagatatgggcgaggaggggcagttcaagtgcgagagcggagtggggatgtggacctgcctccctgtcgagaccgcagccatgttcaggaacacattttgcatggaggccagggagtgagtgctgctgcggaaaagtacgcggcatttgatctgtcccgttcgcgaggcgggctcctccggagttcgctacgtgttccatccggggtgagtctcaaccgagattccgatgtgacagagggcctgccgaatcaggacatagggccgactcccgcccggcttctggttcgttcgtccaagttccgcttgctggaacactcccgtgttctggcaaagctcgcgatgtgccctggaacgcaggaagactacaccatttctatcaaaatcttcagcacattttccactgtggccgaaaccttctccctccgacattcatttgtctnnnnnnnnnnaacactcccgtgttctggcaaagctcgcgacgtgccctggaacgcaggaagactacacatttcctatcgagatcttgagcacatttttcaccgtggccgaaaccttctccctccgatattcatttgtccaccgtgtgcgtcgtacttgacctgtagattccgaaaccatgcccgcggcagcagatctctttcccattcccgacaaggcgacaacaggcctgttagcgggcctgccgtctggtacgccgacgagctgattcaccgcccagaagaatggaggttccagttgagcgaggagcacattgcggagctggaggctgccgttgacgctgcgatcgagtccggacagatcctcgaggtgggatgggcaccggaaaggggccagggccgaggtgcagcgacatgtgcggctccagggcgcacgaattacctacgagatgcccttgttgtattgcagggcctgagtttggacaacgtgtccctgccgactctgggccccatcctgacgggcttccgggttgaggcggtccacggtcgtgggttccagctgatttcaggccttcccgtcgggcgctggagtcgggagcagacagtcgccgcctactggatcataggcctacactggggtaaagcggtctccaacaaccacaaggggcatcttgtgggccacatcaaggacattgggcacgaccctgccagccccagcaccagactctaatacgaatcggccacccctctgccctctgcagacgccacaagtgtagcgcagcccttccacaacgacgcggccgacctcgtcggtgagcctgcgtga

SEQ ID NO: 4652 - DNA, 249 bp, Chlorella protothecoides
atggctgcggtctcgacagggaggcaggtccacatccccactccgctctcgcacttgaactgcccctcctcgcccatatctttccaggatgtggctgctgccgcagtgctctccgagacggtgtaccgcgctgtggactttggggaaggccgggctgaagaagccctgctcgccttgcagtctcgcatgccggtgccgatcaagctggagcatgttgggtggagccccgcagggcagaggcagaggtga

SEQ ID NO: 4653 - DNA, 297 bp, Chlorella protothecoides
atggccctcgtgggcaacactgccagcgccactatgccagcgggccaccggcctgcgttcgaggccggcgtccaaatgctttttcagcgctggacagcgctgcaactgggagttttaaatgagtggggcggttccaacagtagagagaaggctgcaggcatccagcacgaggtgctggaatggttttatggcaagaaatgtcacgaaatgctggacctggcagacctactcgaccaggcaatttcagaggacttcaacatccaggcagaggatgacagtccgtaccaggtgcgatga

SEQ ID NO: 4654 - DNA, 258 bp, Chlorella protothecoides
atgcctcctcaccaggtcctgtccagcaactggagggaggagctgcaggagtacatcgccccggaccagctccccaaagagtacggcggcaccaaccccgcccctctctccgacccgccaggaccgtggcgggaccctgccatcgttgagaaggtgcggctggagattggtggggttccatggttcccataccccgtgcccttgctgcttcaggtggcagccctgaccgtcgacggctccttctgcttccgggcctga

SEQ ID NO: 4655 - DNA, 1149 bp, Chlorella protothecoides
  modified_base (404)..(413): a, c, t, g, unknown or other
  modified_base (1101)..(1110): a, c, t, g, unknown or other
agcaacaccgtgccgctggcggagcggggccctgggcgcagcgcggcggcggccccctcctcacccgagtcggaggcggagcgggagctcccagccgcgcatcgcgtgcgggacggccctgccgccgagggcgagacgcgggcggagcgggaggagcgccggcagcgagacgagatccgcgaggagaggcgccgcgagcgcgagcgcgagcgccggctggaagcgcgcgacgcgcatgggcacaagcgcagcaagctcacgcgcgaccgcgaccgcgacatctccgagaagatcgcgctgggacaggccaaggtgggtttcatcgtgtgtggaggggggccttgccaggggatgccagggcgggggccgttcagggtgggaccctggctgtggcgtaaccagcnnnnnnnnnnatcgtgtgtggaggggggccttgccagggggatgccagggcggggtccgttcagggtgggaacctggctgtgccgtatccggagccccggcgcccgggagcgggtgtcatgcgcactgccgctgtgttgcctggagaggtcccttctccccctcgcactcaatcctcacctcgccatggccatcttcactcttgccgaacccacttacctgcctgcctcccccccacccgacccaatcactcaggcaaccccccccactctccacccctcccctttgcaggtgtctggcggggaggccatgtacgaccagcgcctgttcaaccaggacacgggcgtcggttccggcctggcctcggaggacgcgtacaacctgtacgacaagcccctgttcgcggacaggagcgaagtgttccgcagccgcgggcggcaggacgaggaggtgcacggcgcgggggccggtggcgacgatgcggccggcgagcgccggttcaagccagacaagggcttcagcggcgtggactatggcgcggcgcgcgacgccgcggcggggcccgtacagttcgaggccgacgccgcgcaggccgacgtctttggcctggacgccttcctcactgacgtgcgcggcggcaagcggcgggaggggccgctgggcgacgcgccgcgcggcgggtccatggccgcagcgggnnnnnnnnnncaagggcttcagcggcgtggactatggcgcagcgcgtga

SEQ ID NO: 4656 - DNA, 666 bp, Chlorella protothecoides
  modified_base (454)..(516): a, c, t, g, unknown or other
accgcctccccgccgcccgcgctgcagacggcgctgcacgcgctgctggcctgcgctgaggccgcgggccccgccttcctgccccacgtgttgcctgcgctggagctgtgccgcgacgcgctgctccgcgccgacctgtacgacgagccggggctgctgcccgccgccgggcgcctggtgaacgccgcggtcgcgtcgctggggccagagtacgcgctgggctcccgcgcgcacgacctctgcaagctggtcgtcgccgaggcggcggcggcggcggcgctgggcggggggaccggcgatgatgactgcagtgagagtgccgtcggcggcgtcggcgagaacagcggcggcagtggtagcatgccctccactctcaccaccgtcgccgccccggcatcgcccgccgccgcgctggtggtggtgctgcacacgcagatgctggtgctgttcgcgnnnnnnnnnnnnnnnnnnnnnnnnnnnnnnnnnnnnnnnnnnnnnnnnnnnnnnnnnnnnnnngggcgcgctgcccgcggcagcccacctggcggtgctggcgggcccgatggcgtcgcgcagcgcgccgctgcgctccgccacgctgcgcacgctgcgccacctggcagagcgcgacgcggctgccgtcctggcctggccgggcgacctgcc

SEQ ID NO: 4657 - DNA, 852 bp, Chlorella protothecoides
atggcgattttgtggttacttttcggtatggatccagtgccgtggcggaaacgtgctttggaatctcagcacgggacccttccgcaagatgtattggatccctcccaatgtgtaagactccgcagattcttgcgatcactgctcctgcatgacatatcaccaaatctgcaatgtcgcggggcaggaagtcacgatttgagcttgcgttgtaacctagttgtcgactggctcctcgagaacaaatccaagcaggggaccacacgctggatgaggcggagaccaggcatccaaggtcttcaacggacccaagctacacgtgagtccttcaaggcactgggtgaccatgtcaaccagaccaagttggagctcatgcgaagccagatggtcgtgttcaaggagagtctcgagcagtttgcgctgaagtacaggtcagatatacgccgggaccctgccttccgagaaagcttccatgccatgtgcgtcaccatcggcgtggacccactcgcgtccaacaagggcatctggaaccgcctcctcggctttggaggtgcgcagggctgcatgactgggttggggcccaccatgcgagggcgaggaatgctcctcgtcctctacatccatcctgggaggggtagcatccctgctgcgcatcccatcagcgcctgggattgtgctgtgcgtcgagacctgcctggtcctccgatccagcgtgggggccctagtggagctcaacctcctgctgcgacacatacaggcaagggaccggagcggggccagatgccattcatgtcagtccagctcggcattgaccaccactggaaccctcaaggccccttgaacatgcctttctaa

SEQ ID NO: 4658 - DNA, 2541 bp, Chlorella protothecoides
  modified_base (753)..(762): a, c, t, g, unknown or other
  modified_base (1736)..(1745): a, c, t, g, unknown or other
  modified_base (2129)..(2138): a, c, t, g, unknown or other
atgcgctcgccaggcgttcacccagcggtgacgccgggcacgcgccccgtggcagggttttccaaccccccttcctccccccgcacacctcctcgcaggtctgctggatgtcgtgaaatcgttgcacgccgcgtcgccccagagaatgaccagggtgtcggggcccgacggctcgcccgggtcctaccagaagcggcgctacgcggcggacttcaccgacaatcctgcaggtgggatgcgctgccagtgggatgcgctgccagttatcggttaagaaaaggggttcagcatgtggcgctgggtgactcccgccacctgccatgccggcctgaggacggcgtcagcgcccaccctgcacactgcccaggggactacctgctgactctggacctgccggggagcgaggggctgcccgaggggccgacactgctggaaagcgcgctgggcatgctgggcctgctcgtgcgcacgagccgcgaggcggcccaggcgctggctggggcgggggcggtgccgctgctgcgcgacctgctggagtactccagccctgaggtcgtggagagcgcgtcgaggctctgcgccgcgctgtgcgcgcggagcaaggccgcgcggcgtgaggtcctggaaagcgcgtcctcggccctgctggggtgtgcgctggctgcggcggacgacccggggctggtcggcgaggcggctcggcgactggcggtcattgtgggagattgccccccggccgacctgtggccgcgnnnnnnnnnngtcggcgaggcggctcggcgactggcggtccttgtgggagactgccccccggccgacctggcggcgctgacggcggagcgggggccgctgtggaccgctctgcgcgcgtgccaagcaaagacgggaggaggcgatgctcccgacagcgcggcaatcgtcagcacgttctccaaagtgctggccctggtccggggctgccttgaccgagctcagcgcgcacagcggctcgcgccgcggcaatggccgcacgggccgggctgggatgcagtgccgcgggaggtgcgcacgctcgtcctcccaccaccggccgcagggaaggacacgcagccgctcgccttcccgaccctgcccaagggcttcctgagaagggacgggaaggctgaggagaggccggtggggcaggcatcctcgtacaaaaacagcagcgtgacgatccaggaactggaggcgacggcgccgccaacacccgacgcacagtcccctggcgacacccattccgaggcatcagcccagacgcggtgtgctgatgacgcacacagtcctgagtgcctgccagacctcagaacagtctacgactccacgcccttggatgctgctacacgacgagcccgctccgtgagttgcggtgatggtgtgacgttgagacggacctgggcgtcttacctgtcccagtgccgtgcttgggaggggaccatgccactcgaggccatgccaggatgccctgccggccgctcattccacaatcctaccctcaattctcacgcaccgcgatcctgtcccaggcctggctggcgaagcccgaggacagcagggtctcgtggcctggctggcgaagccggaggacagcaggatctcgtggacccagacctctacagatgtctcctgcctcatcagcctcccgcagggcacgcgggcggccgaggtcagggtgagtgcagctggttcttgtccacctgcagtgccgtgctcgggannnnnnnnnncacgcgggcggccgaggtcagggtgagtgctgctgcttctcgtctgcctgcaggtgcagcttcgagtctcttgcttgcctcattgacaagcagctcacgctcagctcttcgctcgccaggtgcgctttgcgccgctgcgcctggcggccgacttgcgctggtatggcaagctgctggacgcggagctctgggcgggcgtcaaggcgaccgacgccacatggtgcctggaggatgcagaggtgaggcaaggggaggacagggctgtggttgtttgggggggatttctggtatggcccggcctcaccgcctcccacaatcatcaacactttggctttttcatcgtgttcttcacaacccctcctcctccatctcaatacttccccnnnnnnnnnnctggtatggcccggcctcaccgcctcccacgatcatcaacactttggcttggtcatcgtgttcttcccacctcctcctcctccatctcaatatttccctcactcctacccctcctccctcaacacccaaacacccccagctgcacatcctgcttcccaaggcggcgcccggctggtggaaggcgctgctgcgcggcggcgccgagcgcacataccacgagctcctgcacgaggcggtgcacgccgatgagccggtgacggcgtacgacgagctgaccgacgactccaaggatctcatcgactccatccgggagaggcaggcctacatcgcagcgggcatgctggaccccaagggctttgacgactttcgcgtggtcatcggcgagaacagcctccgagggtga

SEQ ID NO: 4659 - DNA, 870 bp, Chlorella protothecoides
atgtcgcttgcccatgcagaggcggcggcccgcggacctggcagctgcgtggcctgtctcagacttgcccgcaccccacaggcacccgaccccaacatctgcacccctggactctcgttcccccggacccacccgcaggtgtacgtgtaccgcttcctgaccacaggcaccatcgaggagaaggtttacgtgtaccgcttcctgaccacgggcaccattgaggagaaggtgtaccagcgccagctgtccaaggagggcctgcagcaggtggtggacacctcggccggcgccggggccggcggtggcggcggcggcaacctgatgagcatcgaggagctgcgggacctgttcacgcacgacgccgccacgttgtccagcacctacgacgccgtctgcgccaagaagaaggccggcacaggcggaggggtgagtgggggagcggaaggggtctggaggagtggggaccggagtgcgcaggcgagggtgggaggaccagggttgggagcctccccgccatcctccaggaccagccgtccctctccagcaccgcgctcaacccaacacccatccacacacacacagggcgcccgtcttgcaggcgcccatcttgcagtgggcggcgcggcccaagccccgcagcgcgccggcgccggacccgtggctcttcccccggactaccaccggtcccaggtgggccaccctcccgaggaggacctggggtcctgggcgcaccaccgcagcgtgcacagcgtgcccgaccccgcgctgcgcgaggccggtggcgagcacgtgtccttcgtcttcgcgctggatgtggcggggcgggacatcgggcccgaggccccgctggcccccgtggcgcggcgcccg

SEQ ID NO: 4660 - DNA, 912 bp, Chlorella protothecoides
atggtggacttctgcaaccctggggtgctgggaggtgctggcgcgttccggcgctattttgaggggcccatcctggcgggcagggagcctgacgccagcgacgctgagccagcgagcctgtccatcgtccaggaaactgtcctctgcctttactgttcatcgcatcatcgagtaggcatgaacaactccaccacgccttgcctcaacctcctcccaacctcgcccgccaccctgcaccgtgcaggtggaggccggcgcctcacgcaccgccgagctttcctccatcgtcaaccacttcatcctgcgacgcaccaacacgctgctctccgcccacctcccacccaaggtggtggaggtggtgtgctgcagcatgacccccctccaggcctccctgtacacccatttcctcgactccaaggctgcggcagcgctcttcacctcccagcgtgccgccagggtcctcagcgccatcacctcactcaagaagctgctcagccaccccaagtgaggggtttggagtgctgtgggaaggggaagtggggtaggtgtgtgggagacatgggagcgctgagcagaggcatgcacccttcacaccagcaacagatgtgcatgttggagaggacgatgacagccgcctggcaacagcgcttccccacgtcgaccatgtacccacgcaggctcatttacgacacgctgcatgcgcccggggcaaaggggggcgacgccgatggctttgcgggggccggtgccttctttcccccgggcctgttcgatgacggacgaccggggcggggttccatgcccctgggttgggagcacctctctggtgagtgcatgactggggcatggggcgctgagacggccgtgggtgctcctggttggccagggcggcagagacgcgcgcgaggttga

SEQ ID NO: 4661 - DNA, 291 bp, Chlorella protothecoides
atggggctgggcaagacgctgcagggcattggcctgctgtggaccctgctgcatgcccgggcccccgccctggggggcacccccgtggctaagcgcgtcatcatctgctgccccaccagcctggtggccaactgggactcggagtgcagcaagtggctggacgggcgggtcaggacgctgcccctggccgagagctcgcgggaagatgtcgtcgcaggggtgaactccttcctccaccccaatcacatccaccaggtgaagaagggaggggcctgttgggagggggggtga

SEQ ID NO: 4662 - DNA, 291 bp, Chlorella protothecoides
atgaaccaaaccaccattgtacctctctggccccccttgtatcttcttgacccacaggtgatgatcgtgtcgtacgagactttccggctgcatgcggagcgtttcagggaggcgggcacctgcgacctgctcatctgcgacgaggcgcaccgcctcaagaacgacgccaccctgaccaaccgggcgctgggtgccatggcctgccgccgccgcgtcctgctgtccggcacgccgctccagaacaagctggacgagttttacggtgagttcaccgcgtgcaggaccgggtga

SEQ ID NO: 4663 - DNA, 783 bp, Chlorella protothecoides
atgaaatcctacacaggcgagctgtactgggctggcgacccccagctgctagcagaacgccgcagcacacgcaagctcatgcggcgatacaatcatgagatcgactatgaggatgaacccaccaagctgtctttgctgaaggagatgggcatcacctttgacgcgcagcacccccccttcttcgagccacccctcttcttggactatggctacaatatcaccgtgggcaaagagtgcgctgggaaagggtatactcgtttgaaccgtgtcttgaggcctttccattcaatagttctgatcatcacgaggctggccggcatggttcatgcagcgctaagctgctggccatctcccccttgtgattgcgcatggccgcgatctcggcccctcacttccctccgcaccgtcaaggttctactgcaacttcaacaccacgttcctggacatctgccccatcaccatcggcgaccgcgtcatgctggcaccgggcgtgcagctctatgccgccttccacccgcagcatgccgccacccgcaacggcggcctcaagcccgagctgggcgcgcccatcaccatagaggacgacgtgtgggtgggagggtcggccgtgatcctgccgggcgtcaccatcggagcgcggtccatcatcgcggcgggggcggtggtaaccaagaacgtggagccggacaccgtcgtggggggcaaccccgccagggtcatcaagaggctagacccaaaccaggccgcagcctgagaatgatggggatgagaaccagctcgtga

SEQ ID NO: 4664 - DNA, 2541 bp, Chlorella protothecoides
  modified_base (1250)..(1259): a, c, t, g, unknown or other
  modified_base (2173)..(2182): a, c, t, g, unknown or other
atggacgctggggccttgagcgtggagcagctgagtgcgctttctcgggccgtccccgacgacagcgagcgccgcgacctggagctgtatctgcagggcagccacccaaaacaccgcggggtcagcgacccagaccgcctgggtacagtggagcgttacttcctggagatcaaggacatcccgcgcctggcgcagcgtattcgctgcctcatcttcagcaggacgtatgccagcaccgccggcctggtgagggggatgggggtggggctggagtgcttacgcatggggctcgctgttgctgggtggagtactgcaagacacgacggccctccgcctccaatcacccctccttcccatccaaaccacccacccaccatcacagtgcgaggaccacctgggcatcatgcagagcgcctgctcccagctccagacctgcccaggcctgacccagctgctgacggcggtgctggagctgggcaaccacctgaatgcggggacccaccgcggtgcggccgccggcttccgcctggacaccctgctcaaactggccgatgtcaagggcgtggaccgcaagaccagcctgctgcactttgtggtccgccagttggcagcccagggcgacatcgtcgtccagctgcccgcccagctctccgccgtccggcccgcggctgccatgcaggtgcgagttgctgctacatatctgggcgattcctgaccctacttccctgcttggagctcacttccccaccaacccccacacttcaccctgcagctgaccagcatccgtggcatgatcgacgagctgagggcaggcctgcgcggcgtgaccgaggagatcatgcacgctgcgcgcgctgggcacgccagctgtgcggccgagtctgcgcatggggaggaggacgcggcaggatgtcgcaggttcagcgagctcatggccgcgttccacgtggacgccgccacccgcttctgcgccctggaggtgcgcattggttgggggggatggttattagctgcagcagcgaatggtctgggtgggtgggcccgccagttggcatggcccaggagaaggccatgtacgaggatctgcaccaggtggccgactactttggcgaggccttcaaggagacggaccccgcacacgtcgtccacgtcgtgcgagacttcgtcctgctcttcgaaaaggtcgtgcgcgagatgaaggtgggtaccaggggtgaagccggtgggtgcggtgccgtcgcggcatggannnnnnnnnngaaggtgggtaccaggggtgaagccggtggttgcggcgccgtcgcggcacgggggaggagggcgggggatggagcgccgcggcacggagcgcacggcaaaagtccgctcccagaaaaaccacttctaccccgcacccaaaccacttcccaggtgagcgaggaggcggctgccacctcggccaagcagcgggccgccatggcgaggaagaagggcaatgctgagcgtgccctcggcacgccacggggtgccaagggcaagacgcaaagtgctgccgtgccggagcaactgctggagattgaagcggcgcctggtcaggtggaggtggagcaggtggtctctgccatggtccagaccgtggcagaaagagcagcagatggtgttgagtacggcgtggctggcgaaccggcgacaatgaccgagctggggaaggtggatgaggcgaccgaggcgccggaggcggctgaggccgccaagatggcgggcgctgccctggccagcggatgtgcaactggggacctctcattggattctgaaggcgatactcctccgcctgtgttcgacgccgggctctgcaaagagcctgaagaaggtgtaggctcggcggcaacacaagagccccttcattctgctacatccatcatccaagcgtcagaaggagcagcctgtgcagagaatgcacactgcctcgttcaggggccagaggacgccagctcaagcgcagcagcgtcctcggtgcctgtcacccctgaagaggcccttgcgcctggcctggacatcagcgtggagaccatttcgctggacgagcagcaggtcagggacgagattctggacccctcaatcagagcaccacttggtggcaactgcacagcgcaggactcggcaggggccgagatcgtggacccccccgcgctgnnnnnnnnnnaggcccttgcgcctggcctggacatcagcgcggagaccatttcgctggacgagcagcagatcagggacgagattctggacccctcagtgagagcaccacttggtggcgactgcacagcgcaggactcagcaggggccgagatcgttgacccccccgcgctagaggaccccgacgctccctgccaagcggcagaccaggatctcccagtcatcgtcgccctgctgtctaccgatgaggaggtcccaggcactgagcagcgggcccagccctgtggggagggctgggaatcttttgatgaggacatcttttccaacctggaggccaggctcctgagtgatggggaggacaacagcgtgtag

SEQ ID NO: 4665 - DNA, 714 bp, Chlorella protothecoides
atgagcaatccccggtggtgtgaatacccgaggagccatgcacaggagagcagcttctcaggaccctctacgagagttcgcagactccctgcgaggcaagggcggggtggaggcccgggcagccgtgtaccaggcccagcgtgtggagatcgtgaggggcaaggacctgggccggtggatcgcagctcaccccgaaccttcttcccgctttcacaatggaggtgcggaccctatgcgttgggatggtctaacttggggtgcatctgtcttgtccaaaaagtggagcaaagcctgcatgcccgagaccacagcgacacccccgtccctcgaccattcctgccaacagccaagactcctgaggatcaggctaaagaggtggttgagctgctgctgcgccgcaacctcctgcagcgctgtgaacggatgttcaagcgtccacccccaggcagcaagaagctggtcaagtttcccaagaagctggtgccgccgggcccaggggatgtgaagtcgtttgcggaggacgcgttctatgcctggacgtatgaccggccatcctcaccttggatgctggtgttcacgatcctgggcatggctggagtcttggccgcctgcctcttccccctcgccccctacggcatcaaggtcaccgtgttttacctagcctccggcctgctgaccgtcatcctgggcaccctgccacaagctggatcctga

SEQ ID NO: 4666 - DNA, 363 bp, Chlorella protothecoides
atgcaggaggtgcccctgagcggcctcctcaagccactcgtctcggtgcagcagccagatgaggacaaggcctgggccaacagctggttggcccgcctatcagtgggtgtgagcctggcctccctcatcttcgtgctgtacacccactcccctccaaaaggggctaccccagcacaatacctccgtgtccgtgctcaccctgcaggcaccgtcacggccgaggcatcaaggtatagggacgagctgttcgacctgttcaacattcggaaagaagggaatgcgcgtctcggcaactccagcgcaagcacggcgtttgaagaggcccctgccgtggaggatgtaatccatgacagtgacctgtga

SEQ ID NO: 4667 - DNA, 840 bp, Chlorella protothecoides
atggcgctgttgcacaacggtccacactctaccctcccatgcatcagtgacatcaagtccaaggtctttgggcccgacaccttctgggtcaccgacgtcctgcccagcagcggactggagggcggcgtcatgttccgcggcaacctcaggggaaagcgggaaaaggtggtggctgaggtcatgcagcgcctgcacgacgcatacggtgcgctacgtggggcggctgcgtcagatcctctcgagccccctctccccatcgtgcctgtcctgttgactttccctgtaggaggaaagtacgtcttgagggtgatcctggatgtggaggcggccttcaaggccgacgaggacaagagcgaccgcagcctggactcctttgtcgccttcgaggtcctgcccgctgctgccgcggtgcccccgccccccgccacctggcagcgatgggtgggagtgctgctggtggctctgacagctgcatccaccctcagcttcgggctcgcctcctccctcctcttcctacccaaggtgagagggggtatgcttgcaagaaatggccctcaatctctggcttcaaaccaggccatggatccaagatgggtctgtgcgtacccgccaacatgcacatgtggagggctgaagctcttgctctgcaccctccctgtgccgcaggagaccctggccttcctggccaacccctccagcatcagcggggatgcgctgccgccgggcctggaagggttcgacccccaggccttcctgacggcggccgtgtctgtgggggcgctgagtctcattccacaggtgcgggacttgtggggccatgattccacggtgcagcagtag

SEQ ID NO: 4668 - DNA, 381 bp, Chlorella protothecoides
atgcccccctccttcctcgccgctgtaggttgcacacgatgcaggacactccctggtggcccgtctgcgtggcatccagctgaaggcaccgtgcgtggaggccaggctgggtggcggcgctccttgcttgtcacagcacacctttccctctttcctccgaccctcgccagtctcctggtgccgagcaccgcgctgggcacctttgggagcatccggcagctggcgtccctggtccggagccgcactgacctcttcgacctggcggcggcagggctgctgggtgggggggggacggccctggcgctcatgattgcaggcctgcaggcctctcacggcggagccgtcgccgaggcaagcgtttgcaggggctgtgcggagtag

SEQ ID NO: 4669 - DNA, 663 bp, Chlorella protothecoides
atcctcccaccccccccctcctcccaaacaccccctcctccccttgcaggcgagtggttttgcagcggggagtgcagcgccatccatgcccgcctgcgcgcccgggtggaggagggcgtggtggacatcccggggcacccgcagcacagctggcaggtgctgcgagggaaggacggccgcgtagccagcgcttgggccctgcgcgccgcgcaggaggtgctgcaggagtcctttgaccccatcgtggacatggtcacgggggcggacctgctgccgctcatgctgcatgcacgcagccaccgtgagtgggactataaaggcatgcacacactgctcctccggcacaaggtgatcaagagcgccagacttcatcctctgggttgccgtcggcatcgactccagtcaatcaggtgggtgagccacgactcccgcctcaccgcagccacccaccgctcacctcgcccccccacccccaccaaaaaagggcaagcctgtggtgtcggccatcgtgcgcgtgcttggccccggcgcggcggagctgccgctgatcgccacacgcttcgcggcgcggcgccagggccacgcccgtgtgctggtggacgccttctgcgctttcctggcggatgcgggggtgcaccgcctggtgctgcccgccgcgcatga

SEQ ID NO: 4670 - DNA, 285 bp, Chlorella protothecoides
atgtctgtggagatggggccgccaagtgccgtgacctgcgactggcaccaatgtccaacccccattctcccctcccccaccccctgtccttacaggccgctgatagaggcagccgcaaaggcccccctgcacagcgtctacgcccacatcgacccggtccccctggctgccgccagcgtggctcaggtgcacgtgggcgtgctgcgtgcctctggaaagcgtgttgcgatcaaggtgctcaggcccggcatcgaggacaccttgcgcacaggtgtgagtgtgtag

SEQ ID NO: 4671 - DNA, 552 bp, Chlorella protothecoides
atgatgggcgtgcatcccagcctgtccgccatgcacggcatgctcagcgcactaaacccacccgtccgccccttctcgacctatacgctcgtgccacagcatcggaccagggcatgccccccacccacccacatctcgaggccctccctgtggcccaccactcagcaatcggccttgctggcggacatccaggacgccctcctgtcctcgggcccacggggcatcctgcgtggcgcccaggtcgccaggatcgcggccggcctgaccctggagcaggcgcagcgcgtcgcccagcgccggccgcccctcccaggcccggcggtgctgcgcaggctgtgcgaggggctgggggccacctacatcaagctgggtcaggtcatcgcttccatgccctccttctttccgccagagtatgtccaggagttccaggcatgcctcgacgcggccccccccgtccccttctccgagatcaggtgtgctgctgaggcgggggaccatgtggggtgggggaggagcggctggggagtgggctggtgggaggctgggcgctga

SEQ ID NO: 4672 - DNA, 453 bp, Chlorella protothecoides
atgcaggcgcacaggagactcgtacgaccatgcgccgactcccgcccacgtctcctcaccccttcatcgccaggcaacctgctggtactgcgcgacggccgggtgggcttcatcgactttggcatcgtgggctccgtctcgcccgtcacctgggcgggcgtgcgtgcgctgggccaggccctagtcgccggcgactgggcggccgccgccgcggccctggccaccgtgggcgtcaccgaggcgcgggtcagtgtgcagggcctggcggccgacctggcggggctggcggggcggctgggggagctggacgcggccgcggtgctttcctccatggaggggggccccagcgccggggcccttgaggccatcgagccgcaggtggggtggggtggggtggaaagtgggaaagggcgtgtttttgcggtgtgggatggtgatcccaagggggggtga

SEQ ID NO: 4673 - DNA, 468 bp, Chlorella protothecoides
atgaccttcctggtgctgggggcgcggctgctggaggctgccagcccttccttatctcgcacctccctggcggccatgctctccgacttccggacctcggtcctgggcgaggcaaacctggaggctgaggcccggcacatggccgccttcagcgcctacctggacgccagcggcgcgcggcgcctggccacctgccccgagccctaccccgccttttccagccgccgggtgctggtcatggacctgctggagggcgtccccctcaccgacgctgcggtcgtggtggcgcacgcgccggggacggacccggaagccgtgctccgcgcggcactggacacctggaccggctccctgctggcctgcgagacgttccatgccgacgtccatgcaggggggagggagtcaagacaggaatgggagtgtgtggtccgagggctcagtgcacaggcgcacaggagacgcgtttga

SEQ ID NO: 4674 - DNA, 348 bp, Chlorella protothecoides
ggccgcggcggccgcggagcgcgcgcgcctggaggaggcctcgctgccgctgatgctggaggccatgtgggcggccaacgtgctggacgtgcagagcacgctgcgccacgtcacgcgcgccgtgctgcaggagccgggcgtcgaccgcgcgacgcgccgccggcgcgcggagggcctgctggagctgggccgtatcttcgtggccgccgcgccggggtcgacgggaaggggcggggccgctggggaggatgccaagaagcgcatggaggatgccatgctgcacgtcatcgagaagcgggcagggcaagtgcccagcgagccctgatgggggttcaccaggatgtgtga

SEQ ID NO: 4675 - DNA, 1452 bp, Chlorella protothecoides
atgaatgtaaattggcgacgctcttcctgcatcctggctccacctcggtgtggttcatcaactctcggcgcgctgatgtccctgcacattggattcagtggatggccttcccgtggagctctgtactcagggcacaccttgttaagaaggattacctttttaacagaatcccaattatctagaacaggaactcaggcattaactgtaccttgtcaccgagtgcgacccaggcctaaagggatgattggccagaaaaccgcaatcgcagtcagtttcctggccatggtgggcctgatatgcctggtggtccagccccgacaccctgacggaatggcgagcagggcgaactcgagtgccctggtcgaattctatggcgaggtaggcctgcaatacactgtgtatgggcatgcgggactgtcagtgcacatgttaaagcctgtcagcgctggacatgcgggagtgggaaccagagcctggaacctcaaaccccccccgcagtcgctgtgccccgactgccggcacatggtactggacgtcctggctcccctgtatgaaaacggcgttgcccagctgatgcacctcaaggccacatccaccatgtgttccccctttcccatccataacccagagcctgcacggcgactcctggtgcgaccccagcacatgagcttgggtgcatgcacatgcctctggtgtgctggaaatacagcatcagaattcaagcaacttttgcagccccctcacccccccctcaccctgccaccgtttgatccaggtttccatatgtccagtgcctggccaagaatctcaccagcatcgcaaccgatgcgcctggctgcgcagagacccaggggtgggacgcctcggagctggatgcctgcgcgggaggtgagactgcgggaagggtttgtcattatcctgagcagactacgcttgcctgctgcgctgagcttgctgctctctcagctgacccacaactccctctgcatcggtgtcaggcgctcggggcgaggcgctggagaaggaggctggcgaggccaccacccagctgcagcccgccctgaccaatgtcccctgggtgaggacaatgctgggggaagcaggtcctttgaccctgcccatattgccactgatgtcatgtcaccagctgcatcgagccctcctgccaatttattttatgctcgacccctgcacagccaaacgctgtgcccctccctccctcctcccagcctgcgtgcatgggctcggatggaaggattcgcttttctagaaagtgtcggcgtgccaccctgttcacacttgcaacaagaaatgcctccctcgtcgtgctcccgcctgcaggcccagtgcgtgtgcagacctcaccgacaacacacgttttggttgaggggctgtcccttttgtcgcagcagtgcgtgtaacattcagatgcaagctggagtaggagactga

SEQ ID NO: 4676 - DNA, 1089 bp, Chlorella protothecoides
atgcagctgagctgcgcccccaccttgggtctacaggctgctgttgcacgcagggccaccgtctggacccatagatgcaccccgcaaccgcctcaccctaggctcggcaggcacgttcacgcgcgcaggccaatccatgcagtgcatgcgggaccccaggggacactgcagtctctggagtccacccccctgatccagctggactcgcccagccccgaggagtcacatcagctggacctccccggcgtgtacgcggtatacgatggctctgacaccctgcagtttgtgggcatctccaggaaggtcggaatcagcctgaacagccacgcggagtctctgccggacgtcgtgcgcgcggcgcgggtcctctccctgccagatgcgagccgggaagagctgacggaggcatggaaggcctggctgcagcagtctggtggggtggtggggtgggatgctggaggaggatgccggggaacccgtggatgccacggggaagattccgccagggaacgctccgggtcccgcccaggccgcctggcactcccgccgggctcggaggcccaggcccgagctgcgtttgaccccaggcaagggcctgcaggacctcaccgtcagcctcgaggagctggtgcagaatgtggtgcagagttacaaggtatgggagtgtcagagtgtgctggaggccacacatgtgacccagcccacaactcccccttgccacctcgcgcaggtggtcgcctttgtcaaaggcacgcgcacctccccacagtgtgggttctcctacaaggtgctgaccctgctgaacgaggtaggatggcggggagggatgggctcgagatgcagtgtcaaaggtgcagtgatgggcagatggctgcatcaacgctcctactggccaaggtcgactatgaggtagtgaatgtcctggacgagcaccacaaccccggcctcagagagacaataaaggccttctctcaatggccaacaattccccaggtgtacatcaatggagagtttgtgggcggggctgacattctcgagcagctgagtggcagcggggagcttgtggagctggtcaaccccaccagctga

SEQ ID NO: 4677 - DNA, 618 bp, Chlorella protothecoides
atggccagaagagctctgatggcactcccttatggagatcgagctggaggtgatccgagagatgctctcgtgactttcggcgcgcaggtcttcccgctgacccggctgccttcatgctgtcaggtgtcgggcctcaagacacccaaattcagatttcatcagctgttaggtgaaagacaacattgctctgggggcgcccacctttctgcggctcctttcggagactcagggtgtctcacatctgcggagaagggagctggcacctggtggtcgactctcgacgggcatcccccgatgggggcttccaacagcaagttggacaaggtcatactggagctcccggacgacgagcgctacttcggtcttgagaattttggcaatacgtgctacgccaacagcgtgctgcagaccctctacttttgccggccattccgagaccgggtcctgcgctacgcggctgagaacccgccagggtatgggaatgagaatctgctgacctgcctggccgacctgttcctccaggtgcgtcctggggtccgggcatgtgggagcggaggcagtggagcaccatgctgcaacctgccaccaggcaatgggtctgtgttgtcacagggctga

SEQ ID NO: 4678 - DNA, 1245 bp, Chlorella protothecoides
atgggcggagcccatccctgcaggaactggccgctgcctcgacagcaagtgaagcagcgagcgcacaagcccaagagccccgcacatggctccaagaaatcttccaagggaggctggtcaatcagacgcgctgtctgtgctgcgaaacgggtgatgtgtgggttggtggttacagcttgtcacttgggtgatgcggttgcatgtgattttgcatggcatttactctttctgggagcttgtgtttacagaggggtgacatctgtgggacgacgcccttcaactttcatcctcattctcctgccagtcacgagtcgggaggaggatatgtttgatctgagtctcgagattgagcccaattgctcggtgacgagctgcctcaagaagttcaggtgggcatgcacagccgatgcaaggcagtgtggcttatacattggtgagggaatcgcaacggaagtgctagatggtgccgacaagttcttctgcgaccagtgcaacagcctacaagaggcccaggtgtgcctggctctacttttccgcatcctgatgcccattccaggcatctgtgaagcagtggcttgggttttaatatgggcagctgattatcgggatgatttagatcgcccttgggctttgagttgcatgctcacatggaagcctgtcagcagctcagccgtgtcatgtcaatcactctttgcagaaattcatgaggatgcgtcatctgccccaggtcctgtgcctgcatttgaagcgcttcaagtacaacgagcagctgggaagtgtaatggtaactcggctgacctacaccttcttcgccacgctcgctatttcccgacacgttcccctccccctcttccggctcccaccctacgccctgccagactgagcaagctctcccaccgggtggtcttcccctttgagctcaaagtggtcaacaccaccccggactgccccgacgccgacaccccctacgacctctttggcgtggtcgtgcacatgggcgcccagcccaaccacggtgggggtgcattggaaagcatgcgggagatgggctcaggggttgggagcggggtctgtggcgtgacaacaaagtccctcagggcaggctggaacatgttgtccatgcacaatccccctgccaccctgcatgaagggcactacgttgcgctggtgaagagctgcgggcagtgggtctgctttgatgacgaccaagtcatcgccgtgaccgaggcacaggtgggtgactag

SEQ ID NO: 4679 - DNA, 897 bp, Chlorella protothecoides
atggcagtgcaatgcctcatgaccaaggggccggctcctgcgggccaccacagaagttcatggcacgcttgcaagcctcacaatggaccactcaggaatcgtggaattgtgaaaggtcaacctgactccaaacagcctggatttggaggcgccttgctcgatttcatgattgccgggaagaagctgagaaaatggtatggcgcggaagatttgagtctggtgaaagacgaagaggagggtcctgagccccaggacaggagcgctggcaatgcgccgcctccctccataatacagcggctcagccccgagaccatcctggtgatggatgtcgactcggacccggtggccgagctctgcctcctgcagctcatcctgacgcgggcggaggtggcggcctgcgccaacgatgaaagcgccgctcgacgcgggttcggcgactatgtcacggtggtgtcccgggaggaggcgggccgcgcggcggcgcgctgtgcggtggcggtggcgacctccgcgacagccgtgcagcgcatggtcgccagctgcgccgaatccgaccggctgccccacatcattgcactgcgggtggcgccaggccccaaggggggtctggcgcagctcagaccctggcagagggcagaccgccgtgatccagaggccctcctgcgggacgccggcgtggcatccttttctgtcatgagcgtggggtccatgagtgcctccatcggcccgcaggcaaggaacgcagtggagctgcagtggcaacctgtcacaggggacgacgtcatgggtgcccccgcgaacgtcacagcgatgcaggcagctgccctccttgccaagctggccagctcccgcaccagaggctcgggggtggagcttggtgtggctgtgatcccctag

SEQ ID NO: 4680 - DNA, 1080 bp, Chlorella protothecoides
atgatcaaagggcttggaggggctgccagggcggatgtggatcccgtcgcccagcgcgtgtgggcggcgagttcgtcggaggcgggcatccacgtcgtcacgcgctccaccttccccgcgcactttgtggggcgggcgggggcgccggccgcggtgtggacggaggtcagggccctgcctggctccgatggcctgctggtggacatcctgtgggagaacaagaccgcgacgcggctgccagagaccctgtgggtccggtggtcgccctctgagggtgcgatggagaaaggggggggcggggttggaaagcagcaggggtctcgttgcccgaccagcgtcaccacttccttgccattcactcgttcgtcatccccacgagcacacagtggatgcccagagctgggtcatgtacaagctggggacgcctgtgagccccctggaggtcttgcggaacgggagccatgccatgcacgctgtgggcgacgagggggtggccgtgagctccgcggatggcactcgcaggctggccatcaggctgtcgggttacacacactgggcatacgtgcagacttccctgccgtcgcttctactcaccagggccgtcttgacacgccgccgtccctcctgtgcagatccctggacgcagcgttggtgagtccaggagccccgacgccctttccagtgttggacgggaccccagccatggaggagggcatgtcctttgcactcaccaataatatctggggtgagtgggtgagcctgacaggggttttgaaaacccatgtgccccgcactgttggtgggacatccctgcatgcatcgacgaccccaacgcccacgctcctcacatctaagacatcccttcacccctggggtacggagacgtctcacatcgcccatatgctcaaccccatgcccctcccgtccctcattgccagggacaaactaccccatgccatgcctgtgcagggagagcatcaaggagcagggcgcaccttggcagccctcttctacgacttgtatgtaatgcaagcgttgccgcaacaaaataaggaacagaagagcaagcgcggcatctag

SEQ ID NO: 4681 - DNA, 1452 bp, Chlorella protothecoides
atggtggcagggccagggggttccgacaccaacccgccgagtcgcccctcacgcccgagccacggagtcctcgtggagctgtttccgacgaccaaatcttcaaccggcggtaccgcggtacgccggagccccctcaaagccaggcctgggctgtcgttccggccgagggagccaaatcttggcggttcgtggaccagatacgtcccttcctcaaggactagcctccacttcaaacgcgacaagatgacgacgcggggaatgatggcggagaacatgttccaaggcaaaggcgttgtattgggatggctcaacagtgtgttgagcttgaggctggagaaaatcgaggatgtgagtcgggtcggggcttggggcgtgggatgcctgctcactgatggactgcctgcaccctggcagtgtcaacatgaggaaggtgcaccagcagcgcggatcaatgcactgcagatattgggtcgagctcaagcactggcaagagacaggcgccaaccctttccgtacccttgtttccctctacaggtggacttcaatgtccgcaacgactacgagtttgtgggaaattacaaggagctacagcaggcatttaacaagcatggcatcgatcgggcgttcaatgtggcggcgctgagcaaggggaagctgcaagacaacaatgaattcatgcagtggttcaagggatactgggacagcgtgacgggtgagacgggattgcagccaaagtgtgctgcatgggaattgcgcgcaatgacggaccaaggcggactcgagatagacgactacgatgctctggcacgccgccagagctgcaagacaggggactggaaaaaaaccaatctcccgcttcgggtactgacccctttgcatctggtcacctccactgtgcagtggtcggccgcggcgccgggcgcggctccccgccctgccgccagggcttcctccgccgcccccgacacaatcgcagcctaccgacgaggcagcgcggcacccgccgcgagggcctcctccggcctcgcctcaaatgccaaggtctgtgtgcctgcattgctgctcaacctctgggcacatcagaaccctctcatgcacactggtgcgcaacgatgccaccccttctccagccatcctgttgcaatcctggcaaaccctcaatcagcatcaacccccaaacccctgcagtccgaggccaaggccgcactgctcaccaaggcagagctgagcgggatgacggatgaactgggagccctgagggtcgaggtggaggatctcaaggacgagaacgaggacctaagggcaaagctgcacaccctggagcacgaacgcgatttctacttcaacaagctgcgggacgtggagatcctgtgccagtggccggaagtcgccgccgccaagccggtgcgcgcctgtgtgcccttcggcttggtggttggggacggcacgtag

SEQ ID NO: 4682 - DNA, 633 bp, Chlorella protothecoides
atgtcgtcacggagaccggtgctcccgcctgcacaatcgcccgaccatcagccccacgctgctactccagaacatgtatcagaaccccatcctgaacgctcccctgggcgcggatggcttgcccctccccgtcgaccccaagaaggtccaggagttcttcgaggtgaggaggcgggggcagccatgggtgtctctgcttcagtgtcccttgctgcatcctgcagcagagaattcattcctttcctttcaaaccccgcatgccaggacttttacgaggacatctttgaggagctggccaaggccggggagattgagtacctgaatgtgtgcgacaacctggcagaccacatggtgggcaactgctacgtcaagttcagggacgaggaggccgcggcgcgcgccctccagctcttccaggcccgcttctacgccgggaagcccatcgtggccgaattctcgcccgtcaccgacttccgggaggccacctgccggcagtacgaggagggtacctgcggccggggcgggtactgcaacttcatgcacgtccgccccgtgtccaagcagctgcgcaagcagctctttgggcgctacagggacggcacgggcggctccaccaagttccatgacaagtga

SEQ ID NO: 4683 - DNA, 504 bp, Chlorella protothecoides
ccccggccccgtcgcggcgccggcggcgctggacgcgatgggcagcgccggcaccgccgtgccggcgctggcggtgcagacggagggcgagggcgcggcgggggccacgccgcagcccgtgctcctctactttgccatcatcgacttcctgcaggactacaacctgaggaagcgggtggagcgggcggtgaaggcccgcttccaccccgccgccgacatctccgtggccagcgcggaggtctacgccacgcgcttcaaggccatggtgcgggacctcttcgtccccggcccggacatcaaggactgaggcggcggcggcacagcggtatgtgtgtggagctgtcggcacctccgggggagtctcctgggccggcgcgtcgcatccctggtgcactgcagcaaacattggtgatgcaatccaggtgtcgccttggggaggcacactcccaaaggactctacccgcctccctcgaagcattgcctcgacgtctgacgctacggtga

SEQ ID NO: 4684 - DNA, 876 bp, Chlorella protothecoides
atgcatcaacgttccaacctgcgctcctcctctatgcaacacgcgcccacggatccgcacaccccatcctgccccaccacgcaaggttcccccctaggaaacctgctgtcaccccacgcaccgtgccatgcggcgcgtcagcgggaagctgatcttggagtcgtggaactgcttgatgttggcccgcttggtgtcggcggccttgatggtggccgtcttgatgatctgcagcgcggaggagcgcacgcggtggcgggagcccatctcctggtacatctgctccacggcgccattcagggtcacgtcgcggtactccttgaacatgttgtgcacgccggtacgggaggtgtaccgcacccagatgccaaagttcttgatggtggtcggacggcgctcgaagatctcgttcacggccacgatctgaccgttggccttcttcaccttgcgcagcttggccaggaagtacctgagggagggcccctcccctcgagccgagcgcggtgtatccggagatcggatggagtacgccgacgcctcctcccaccaccattctccgagcacagcagtttcctgtgggccttgggctcaccagaacttgctcttggcgcggaccgtgtcctgagcccacaacttcatgcggaagatggggggctcggcatccttctcagtcggcagatggcggcccaccacctggtactggtggtacttgtatcctccctgcgagtgagaggggatggagggctgagtcggcaccgcctcggactgctcccgggccccgtcggaggcgcgccgaacgggcctcaggcaccgccctccccggctgaccacgcctgcgtggccatacctgaatcggcattgcagcggggcgcccgttaa

SEQ ID NO: 4685 - DNA, 966 bp, Chlorella protothecoides
atgccgccgcggttggaggctgccactctactccatccccctcccagcgtcttgtttgagctgtgcgatgcgagggagcatgactccccgcccctgctccggctggcgtcccggcgcccccttgccctgctggccttggtgccccggcccctggtcctcttcacggcgggggccctgtccggcgccatcgccaagagcctgaccgcccccctggaccgcgtgaagatcctgctccaggtgaagggcgggttccagaagggggccttggccgcggccgcggcgcgcggcagcgtcgtgcagagcctcatcgccatcgggcgcgaggagggcctgcgcggctactggaagggcaatctgccccagatcctgcgggtcgtgccctacagcgcagcccagctgtacagctacgaggtgttcaagcacgccttccgggacggggaggggcggctgaccgtgccgcgccgcctcgccgcgggggcatgtgcgggtatggcagccacgctgctcacctacccgctggacacgctgcgcctccgcatcgcggtcgaccccgcctgccgcaccttggccggcgccgtggcggtgctggcgcgggaggggagcggcgcggccttttaccgtggcctcggcgcatccatgatgggcattgcgccatacatggcactggagctgtccagctacgatcttctgccaccagcgctgccctccttcgcgagggggttcctggcggccctcattgccacggtttcctgctatcccctggacaccgtgcgacggcatatccagctgtcggcggggaagtccatcgcctggcacgtcgctgcaggaggaatcgtgaggagcgacggcgtggtgggcctgtaccgcggtttcatcccaaactcgctgaagaacctgccgaacaaaggtggggcagatgggcgggcggcacaggggcggcggcattggctgggttgtgggaactga

SEQ ID NO: 4686 - DNA, 450 bp, Chlorella protothecoides
atgtgtcagtccattctcaacacaggcatcggttctgatccgggcaagctggccgagttccgggcgctgctgaggatgcggcgtgccgcccccgagctgaaggaggaccccgcctttgatgctttctctcgcctcctgctcaaggcagggctgtgggttgtgcatgtcgcatgggggttgagtggggagtgggccagctgcagcttccaggcatgcgcagcaaggatggctgggcgtagggatgtcgccggtgcccgagcacacctggggcgtggacatcaagaaagccctgatggactatacacactggagcaaccacaagttccatcagcaggtgggagggctgggttggagatcaggggcaggcggagcaatcagacacactgcacggctgcaggctgcacatgcgaggaagctgcacacttctggcgccctggatggggggcgtga

SEQ ID NO: 4687 - DNA, 297 bp, Chlorella protothecoides
atgggcgcagggtgggcattgctggtctgcctggcgctgacaacctcctgtcgtgcccatgacggagatcatgtatccaccgtgcatgtggtgttcggaaaccacctggatgtaggtttcgacggcatcgatccggctgtgggcaccgacgacaacgtgatcaacgtctatttccaccaccatttcccgaaagccttggcagtcgcccggttcctgagacagcggggcggagctgagcgctacatctacacgacccacgtgcgtgaagctgcaaaggccacaaatccagtggcataa

SEQ ID NO: 4688 - DNA, 519 bp, Chlorella protothecoides
atgggaccccgggccgggcattatgagggagggggcggcccagcacgcctccttcaattctccggggcgacttatagacctccccctctgcacgccttcaaccccatcccagccatcaagaccccctacctggcctccggcaagtttgacctggtcacctacgaccgcctggtggacgcccagatcgaggccggcgtggatggcctcatcatcggcggcaccacgggggagggccagctcatgtcctgggacgagcacatcatgctcattgcgcacaccgtcaactcctttggcgaccgcgtgcgcgtgatcgggaacacggggtccaactccacgcgcgaggcggtgcacgccagcgagcaggggtttgcagtgggcatggatgctgcgctgcacatcaacccctactacggcaagacctcggccgtgggactggccacccacttccaggcggtcctggccgaggggcccgccatgctctacaatgtcccgggccgaacaggtgcgaggatgggttga

SEQ ID NO: 4689 - DNA, 459 bp, Chlorella protothecoides
atggcgtgtgggacgggagccgctgtcacagtggaccatgcagtcccctgggcgtcacaggctgcggtgcactgccagccgccgtcgcatcctgcgggcgctggagaccctgcagatgcacaccaagcacaccgcgtgtccacgcgtcgccaggacatccccgacgacgtcatcctggccctgcgctcccaccccaacctgctgggggtcaaggagtgcacggggaacgcgcgcatcgcgggctacgtcggccgcggcgtgacctgctggagcgggaacgacgacgaggcgcacgccgcacggcacgagcacggagcgcagggcgtggtctccgtcaccagcaacctggtgccgggggcgtttgccgcgctgatggcgcgccgcgacgatgagctggcggccaagctggcggatctcatcgcctggctcttcgcggagcccaaccccattggcctgtga

SEQ ID NO: 4690 - DNA, 396 bp, Chlorella protothecoides
atgtgcggcctggtgaagccggtgttccggctgccctacgtgccgctgcagagggaacagcgggaagcgggggtgaagattctggaggcggtgcgggaattcatcccaggcgtcaaggtaccgaggggtcgcactgtggctcgagaccctagggtggaggcgtcgatgggtcccagacaatcccaatcctccagctgtggactggacggagaggggacggtcattcttgacaatcgcccggtccctgataccgtagaacatgtggggcctggttgcggccagcagcagagtaaactctcctcctaccacccctctgatgtgccttccccccccttcccaacgcaggacattcgcgtgatggaggacgacgagttcactgcgctcgcgtccttctag

SEQ ID NO: 4691 - DNA, 423 bp, Chlorella protothecoides
atgcccgacaagtccttggatgaggtcctggcggcggttggcctgtcgcaccccggcccgccccagggtcgcgagggggcgcgccccatcctggagtgggagagcacactggtgctggtgacgggcgtgaccgagtcacaccccgccaactggaaggcgcggtgcagggtgtacctgcgcgacctgcaggccgaggcggggctgagcgaggcggcgctgcagcacatcgcgcgtatcgccgggccacggtacgaccgcgggacggggcgcctgcggctcaccagcgcccgcttccccaaccgcgaggacaaccggcgggaggtgatgcgggcgctggaggcgctggtggcggagggccaccgcgctttccccagggagcaggcagaggcggctgccgggcaggctgcggcgcctcgggcctga

SEQ ID NO: 4692 - DNA, 498 bp, Chlorella protothecoides
atggccatgcgctcgatcgtacgcgcgtgctcacccctcggaacgctggcaggcacctccggctccaggctggcaacccccgcgatgctagcctgtggaggtgcttggtactccagtggccaagagcctccgtccagcaccgaacctccatctaccggcgatgtggtgcccgcagagggtggcaccgaacccgagaccagcgaggctccaggcctcgacccaaactaccagtacagcaaggcgcagctggcacactacgctcccgacccagagaagcacaagaggttcttgccccgtctgtcacgcaaagaccgcagcagctatgccgacccacaggtcgagcaggagttcttcgaagaggcggagcgcttcccgcgcgtccccgagggcgtccccctgtacaacctccgcgatgtcgtccctgagatctaccagtcccgctcaggtgggtttgggccgggtttgtgtgctttcctggctgtgcacctgggaccctag

SEQ ID NO: 4693 - DNA, 330 bp, Chlorella protothecoides
atgagaacggttgctcttctgcgaattcctccattacggcatcctcgtcctttaccttacagaatacaaggtgttctatggactggcatccccacccaccagctatggcggctatggtggcaatgcaaaggaggatgccaagtgaggcagggtgggcgggtggcccagggagcttaccattttcggagggttaggggctggacgtacacattcgagtacccgatttactggaagtcggaggtcgtgaataaagtgtccaagggcacacagggtgtggacggccgggtgttcaatgtgagtatcgcgaggagcatggcaaggggtgcttga

SEQ ID NO: 4694 - DNA, 438 bp, Chlorella protothecoides
atggcatcgcctcgtgcatgtcgcttgctggccatggtgctcggcatgctcattgcatgcgtccacgcgcagggaccgtcctcttacaattgccgcatggcgggcgaggcagcaaattcggcgtgtggcctaccgtatgctctgagcaattttcaaggcaatttcgcatgcgacagcgaagttctcgttgggagacccaaaaacatcggggagctacagaccctcgtggagtcctttccaaaagtgaaggtgcgacctcggtggagtgctgccctcggtcgtcataaattcgaacatggccatgaccgtgtcggctcgatccggcgcaccctcaatccttctacgcatgaccacccacgcaggccaatggagtgggggggtcctggtggaagcagaacttctgcgccggaaatgactcccagagcatcaacattgtga

SEQ ID NO: 4695 - DNA, 288 bp, Chlorella protothecoides
atggccgggcccctactggcctctcccccctcaaacatacaggacgagaacttcaagttcaagcacaccaaggtggggctcctgtccatggccaatgctggacccaacaccaacggctcccagttcttcatcaccaccgccctgaccccgtggctggacggccgccacgtcgtctttggcgaggtcatcgatgggtacgatgtggtgaagaagattgagggaaccaggacgtcgcgtggggacaagcccgtggagcccgtcctggtggccgactccggcgagctttga

SEQ ID NO: 4696 - DNA, 270 bp, Chlorella protothecoides
atgtcggtgacggagacaaccacgcgcatcagcaccaccctggccccctatatccagatggaagtggccatccccctggagattgcgggcacctgcctcaaggaggtcaacaaggtcgtgtatgggcggggcagccgggtgagccgggacttcaggaacccggcactgatccggttcgtgtcgggggagcccttctacctctcgcccacgcacggcgggccacggatgtatgtcaacatcgaggtgggtggcgggcctggctgggcgtga

SEQ ID NO: 4697 - DNA, 468 bp, Chlorella protothecoides
atgacccctacctcgtcccttcaggactggctcacactgtctggcacgccaaacaagggctacgaccaggggacccaagtgccaagggcgcctgcactggggcaagggcggctggcccgagtacgcctcctgcttcgacggcgcgacagagtaccccgactcctggtgccactttggctgcgccgtgcaggtgcgatgggcgacgcgcagaggggggcgccgggtcacccctgggccgggacacatccaggaactggcgtgggtgttctccagctcctcaccccacgcaccgcaatgcagaccctggacccctacgccaagtttgagggtgtcggcgcggaccggacggcagtgtggacatggaatgcgacccgcaacggcaccgtcgtgccctttgacacatgctgcaccgataccggcttctccccggagtgcacctgtgcctcccgcaccgactgccacgcatga

SEQ ID NO: 4698 - DNA, 1173 bp, Chlorella protothecoides
  modified_base (765)..(774): a, c, t, g, unknown or other
atgtcgtccgaagcagagcccgcccccatgatggtagatgactccgcgcccgacgaggcggcccccggccctccctcccccggcaaggggcccccgcccaagcacaaggccccctccaagccaggcaacggggatgagcctgcccccccccccgccggcggcggcgctgtgttcgtgtcctactctgaacgccgcgagcacgtgtccaacaagggcgggcgcaagaccgggggccacgtctaccagatcaagtttttcctggtggacgccacggggctggagcacctggcggcggtgggcgaggaccagggcgacgcgcactacatctacagcaaccagcctgggttcccgggtctgtacgggcacaacaagcaggacgtcaagcgctggctggaggacgtgatggcggccagccagctgcgcgccggctaccacctggacctggggggtggaggggcctcatttggaggggtcggcgcgtgtgctccttgcccccactgcgcacctgacagcactgagcccttttcactctttccctccccaacaaaaaaaatacaaaaggcacgagcggacggagctggacgatgggcgccacgccatgtgctggttcctggtggacgtctttggcaaggagcacattgccatctctgggaggcttgcacggaggagattgctttgggccggccggcaggccgcatggggcatacatcaggcagggtggaatgtcagtcagcctgtcacaggatgcaggggaggagaaggaannnnnnnnnnacatacccctgcgtctgcatgatgcccaacagcggcttgtccccttcccccacccaaccccccaggggaggagaaggagacgcgggacgggcactacgactactccacgcagggcgttttccacgtcgtagcccccctttcctgccacaaccaggcggcggtggtgcgctggctggacgagcgcgtggtgcacaagggccaagcggccgcggcggccacggggaagctgcccggcaacttccacaccgcggggcagtacgggcggtcgggcggcgtcagggcggggcgcaagcccggctccgacctggcccgcgccgcggcgctgaagaagtggcgcaccgcgcacggcggggccgtgccgggcgccgaccccgcgcaggaggcgcgcgacgcgctggc

SEQ ID NO: 4699 - DNA, 243 bp, Chlorella protothecoides
atgctggcggagacctttgaggcggtgatcgcggcagtgtacatggatggcggtctgccggcagtggtgggcgtgctggagaagacctttcccgtctccccagaccacctagacctgctcaagaacgccgcaaccgttgccctccccgtttccagcgagtccaaggtcctgctgcctcggccaatggatccggcgggcgaccctgccaatgtgcagcaggggcacgagcccggcgttgcctag

SEQ ID NO: 4700 - DNA, 624 bp, Chlorella protothecoides
atgggcttcgaggagatgcccaccaacaactacgtggagtcgtccttctggaactttgacgcgctgttccagccgcagcagcaccccgcccgcgatgcccacgacaccttcttcctcacctgtgagcggggcttgagggactacctggagcgggtgcgggagacacaccagacggggggctggggctccaccggctacgggtacgcctggcaggaggccgaggcggagaagaacctgctgcgcacgcacacgacggcggtgtcttcccgcatgctgtaccgcctggcgcaaaacggcttccgccccgccaagtacttctccatcgatcgcgtgttccggaacgaggcggtggaccgcacccacctcgccgagttccaccagatcgaaggggtggtggcgggggtggggctgacactgggcgacctcatcggcacattgaccgagttcttcgcgcgtctgggcctgcccaccctgcgcttcaagcccgcctacaacccctacaccgagcccagcatggagatcttcaggtggggtcgggaagagtggagaggccaggagggtgcgcaagggggtccaggggtgcttgcggggtgcccacacgcagggcctgtcccatggtcgtga

SEQ ID NO: 4701 - DNA, 777 bp, Chlorella protothecoides
atggctgcggacctggagtctggcctgctgcagagcatcgatgaggctggttccatccaagacaccggcgcctatgccgagtcacacagtgtcgatcacatggccctggtcggagtgatgaagagtctgctagcggccgagcttattctggtcgaggatatcgatcactcacgcctggccctcaccgaggaggcgaggctgtacctggaggcaggttcgcccgaggcgcaggtcttcaacgccattcctgagtctggcatctcactggccgatctcaaggtagctagcgtttgtaggttcgcagacaggttttgcccatgggcaaatggattggacaccaggtcgtcagcaccctttcgcaagcgcgcactgcctcaccctttcaagcaacatgtctggtgcctggttgatcctcctgtcccaaccccatgccacccccaaaccactcctggtcaggccaagctcgatggcaccgtgggcgacgtgggtttcaagcaggccatgcaacagcgatgggtcgccatcagcaaggagggcggggcgcccctcgtcatgcgcaaggtgcccaccatccaggatgccgtgcagacggcgctggtggcagtggaccgggggcaggatactgaggtggccgccgccactgtggcagccctgaagaagcggaagctgctcacgacagaggcctggaagacgtaccgcctgaccaagggtattaaatttgcgcggcagcgtgtcaaggaagccaccgatctcacggccgacatgcttgccaagtag

SEQ ID NO: 4702 - DNA, 474 bp, Chlorella protothecoides
atgtacagcggtcactccctcacctgctcgcatggcctccaggtgagtctggtggccagggcaatcaccttcacagatgtggcgctggagccccctcgtgagcccacgcccaaggagtatgaaaccctccagggcaagctcgggtacacctttaagaaccggtacctgctgcgcctgagcctgacgcagcagtgcgccgcagcagccaccaacaaccggaccctggcgtggctgggcgatgcggtgctgcagctggtgctgacagagcaggtgctgggggcggtgcagggcagcctgaccgccacgcccctgggtgtgctggaccggctgcgtgccaccctggtttcgcgcgccgccttccagcagtcggcgcggcaggtagacctggcgtcctatgtcatcatgtcgcggaacacgcgaggtgggtttgcatgtcgtgtgcaaggcatgaccctgagcacgctggatgcatga

SEQ ID NO: 4703 - DNA, 300 bp, Chlorella protothecoides
atggggcggaagaaattgccgttctaccgtatcattgctattgacagccgtacacggcgtgatggacggcctctggagtgctgccccgagtgggtggcggcgacatatctcctacactcccaaaacacattgctcctcctccttccaccctccttccctcagttcctgggatggtacaaccctttgagcaaggagaccagcctgaacgccccgtctatcaagaagtggctggaggtgggcgcgcaacccagcgataccgtggcagcactgctcaagaaggccatggtgctggactcataa

SEQ ID NO: 4704 - DNA, 1857 bp, Chlorella protothecoides
  modified_base (908)..(917): a, c, t, g, unknown or other
atggaggacgactctcagggcaagcacaaagcgtcggacgtccggtcccgctctgccctgctgacggtggcgctcttcgcaggcatttgcctcggattcatgggtgctgagcgcgtgtatctgtacaaccatggtggtgcggtggcaacgggcggtttgatgcgctcaagagtggctcgcagcctgggctccaagccagccaatgagctggagagggtgctgcgcgaggtggctcccactggagaggctgctgagattgcagtgaggttgacggcgtctggccggctggctccttgcaacccgtgcacccgacaagacaccaacattcggctccctcttcacatcctcatccaccactcacagagcctacaacgcctcccattcaagaactggatggtggtggcaatagatgagcagctccgggattattgcaaggagaaggggatcaatcattactaccgacctgtggtggtgagcgcgaggggcacttgctcggattgtatcccctgggttgtgggatcgctctggggacggaattttgtcacactgcagcttattcggattccggggacgcaggccaataccggggacaaccatgccatctctgcgatgaagttcgagattcttgaggagtttttgcagctgggatgggatgtactgctcagcgatgtggacatcatcacggtccagaacccctttgacttcttggtccgcgactcggatgtggagggcatgagtgacggctacgatgcgagcaccgcctacggcgagatctatggggtgagaagggtaaccgggaggggggtgagtcttcacatgtcactgcccctggccctgcgccagatttcctatcattcagctggtgagctgaggatgcatatcagggtacaaaggcaatgggcttccgnnnnnnnnnnattcagctgggcaaggcacaaggcttgtcaggtggttgtggtgtgcatgctgtctcagtccactacaagtggctcccaaaaatcaccacatgacatcgaatttccatgcattgcccctgcctgcttgccggcagtgcacacattatacattgtttgtgcacatggtgtctttctccagagctttatttggcctcgcggtagtcctgccctggcatcaacagccacagtacagctgaagcgctccagcccacacacccatctcctattactcaaccacctccccgctccaaaaccatccctccccagcctgttctggttgaaggccaacgcccgcaccatccgcctgatgcagcgcattgccaagcgcgtcaacaccgagcggcagtgggaccagagcgtgtacaaccaagagatcttcaatctggcgcacggcgagtacacctctccccaagttagcgtgagggtgatggacatctacctcttcatcaactccaagacgctgttcaagtatgtgcggaagctgccactggaccagcagaaactccccgtcatggtgagtcaaggaggtcgagaagggaggctgtcagtgggggccagcacatttgccatgtggcagtgcaattgcgatgtggggagaagctgcgcaggacctggcattgctacttgcactgagatggagttcctgattgggaactcccatgatgttatactcgtcgtagaggacatttcccagccccatccaagcgaatattgcgcccaaacttcttgctttacagatgcacatgaactaccatccggagaagacggagcggatgaaggcagcactgaagtactttgtggaaggggacaagaaagcgctggatgcgttcccggatgggtccatgtgagggggaacccttgtagtgaggccgccatagagatggacctacactccaagtag

SEQ ID NO: 4705 - DNA, 1410 bp, Chlorella protothecoides
atgagctttgcaaaacaaaacgcctggaagagagcggagaatagaccaaggccaccccttgccgagtgtatcggcttggaaattcgggcaccctctcaactggagcagacgaaatgtatcgcgagattcaaccgtcatgagcttagcggccgtcaggacgggcagtggttgcaagcatcgcagaggcgagatgcagcacccttcccccccggcgatggtaaagcatgcgcgcgcgaagttcgtcctacgagagggcgcccaggcatcacgccacggatcgcaacgacaaggcagggctcgatcccgaaacatagcagtatgcactcgatggagatcggaaggcgtgaaaggctggacaacgctctgctaacctgcagtgtccttgaggtcaggggtgagcagggttgtgagagggaccggttgaagttcgtggcccggggctgcctggaggagagcggctgggtcgacgtcgtccaggagctttgtcgcggtgagcggaaggtggttcacagacccatcgggcatggtgaccagcgctgccatgtcagtttcaagacacgaggtgccatggatcacctgcctctcgggacaccgcctcctcccctcccccaccccaatcccggcagcccacctgcgcaccgacccctcctttccgcttgggagcctcgcggaggccgtgcgccctgcagcccgcgccgcggtccccgatcacgtcaaggccacggtgctgaaggtcgtgcgtgccagcatctgccccaccgacgactcctagccccagcgacaaaccgcttctcctcggtccatctgcacggggaggtccagcgtgcagctggtgcacctcgtggccgcaacacgcccctgggttcacggagcgtccccccacccgggcccttcaacatgcacgtggtgctggaggaccagggcgtcagctgggtgccagctgacggccagcaggtgctcctggatgcgggggctggctgcctgcacaccgtggaggggcggctggtggcctccatccggctccccggggcgcaccccgacgtctccggcgccccggccacggccagccccgtgtcgacctccacctcccctgaccggccgggcggtcgggcctggtccccgcctgggggctcccccccgccgtcccagagcccccggactggcgcgaggggcccgcccgccgcacacacgcgcgcgctgtcgcgcgaggacagcctggccagcagcgccacgctgcgcacgggtctggtgtcggcgggcccccccgtgcgcggcatgctggcctcgctggacgggacgctgagcgcactgaggcgcggcgggcgccagctggagatcatcgaccacaccacgggtaacatgtttgtggaggcgccgggggccagcagccgtgggcagcagcaggggtga

SEQ ID NO: 4706 - DNA, 1422 bp, Chlorella protothecoides
  modified_base (875)..(884): a, c, t, g, unknown or other
atgggtgtcccatgccggatcctgcgccaggtgtgcagcactgtacacgtccagccagatccagccacaccaagcatgcccgactgcctctcctccccccgacgcatcgcgcaggcaaacatccagaagaacagcacccccgaggactggcgggccagggaggcagcgacctttgcctttggcagcatgctggagggcccaagccccgagaccctggggtctctcgtgtccgcgggcctccccttcctcctggcggcgctcaaggatgcccacccgcaggtcaagaacaccaccgcctggaccatcggtgagtgcagcggggccgtgggcggcaccctgcttgtcgacagcgcgcgacagcccaagtacccaaggccagatgcctgcacgcaccctgcacaccccgtcccctgcgcggctccccatcgcaggccgcacgctggagtttgtgcatggcacgggagccgcgctgatcggcccccagaacctgccccagatcatccaggccctgctggaggccatcggcgacgggccgctggtggccgagaaggtctgctatgcgctcagccagctggcggcagggttcgaagggggcgcgggcacctcgcccatgtccccctacttccagaccgtcatccaggccctcctccagacggtgcgggtcgagtgtggttggaggtgcccaagcgggaccaggagtgtgcgtggtgggtgggagggcactgggcgggctggcatgcagggccccgcccatggctagtctgcgtgcatgtggtgagaggacagactgcagccgccccggtgctgcagggtcgccccgctcgccccagcagcactccacgggaccccccacccccaccccctcgaacaggcannnnnnnnnntgcccaagcgggaccaggagtgtgcgtggttggtgggagggtactgggcgggctggcatgcaggaccccgcccatgggtagtctgcgtgcacgtggtgagaggacagactgcggctgccctggtgctgcagggtcgccccgctcaccccagcaggaccccacggacgccccccaaccccctcgcacaggcgtcccggacgacggcggacgccggggagacggcgcggctgcagacgcaggccttcgaggccatcaacgaggtggtccgcgcctcggcccccgacaccgtccccctggtggcgcagctggtgccgctgatggtggcgcgcctgcaggccgccagcgcgcacgccgcgccctcccccgaggcggtggagaagcagggggaggagcaggccctgctctgcggcgtgctccaggtcctgctccagcggctcagcgacgacgacggcgggcgcgccgctgcggcgcaggccgccgacgcggtggcgggcgcgctgctgggcgtcttcgcctgccgcgccggcaccgtgcatga

SEQ ID NO: 4707 - DNA, 1521 bp, Chlorella protothecoides
atggcgcaggtgctggacatcacctccctgctggacagcgcacagagccccgatgcggccactcgtaatgcggctgaggggcaactgaaagggctgcaggagtcccagttcccctccttcgtgctgtcccttgccgccgagctaggcagtggcgataaaccggtcagctcccgccgcctggcgggcctggtcctcaagaatgcgctggatgcgaaagaagcaagtcgacaggcaggcctgtcggagcggtggatgtctctggatgcgggagtgcggtctcaggtcaagcagtcgctcctggccaccatgcacgctgaggtgataatacgggactggggggacggggtgagacggcgaggcaaggctgcttcacctggttcggtatggaggtggtgtacttttccttgggcacaactacattcatctgtcacagaatcacgatcatatgtcccacaatcaccgtcctacgtcactcccactcccactctccctggcgcaccgggccattatgatgactcatccgattcaacttaccgtaccgccccccattccttcaccatcccctccctctccactcgccaggtggcggatgcccggcacaccgcgggcctggtcatcgccaaggtgggcgccatcgagatccccgccggctcctggccggagctgatcccgtcgctgctggcggcggcgggcaccggcaccgccgcgccaggcgtgcggcacgccggtctggagacgctggggtacgtgtgcgaggagcttggggcgctggaggaggactacctggagcagggcgcagtgaaccagatcctgacggcggtggtgggcggcatggacaagggcacggccgatgcggaggtgcggctggcggccaccaccgccctgggcaacgcactggagttcgcgcgcaagaactttgagtcggagggcgagcgcagctacatcatgcagcgcgtgtgcgaggggacggtggcgggggacgcgcgccttcgccacgcggcctgggagtgcctggtgagcatcgcggggaactactacgagacgctgccggcctacatggccgacatcttcgcgctcagccagcgcgccatccgcggcgatgaggagagcgtggcgctgcaggcgctggagttctggtgcagcctgtgcgaggaggaggccgccgcggaggaggagggcggcgtgctgcacggcttcgtggccgccgccctgccgcagctggccccgctcctgctggagcagctgaccaagcaggaggagggcgaggagggcgaggagggcgcctggaacctggccatggctgcggggacctgcctcggactctgcgcgggggtggtgggcgacgccatcgtgcccctcgtcatgccctatgtacaggtcagcgggtgtcttgtgcttctccggggggaggaacatggggtttgtgggagggtggggggtcagcaggtgtcttgtgcttctcctgggggaggatcgtggggtttgtgggggggtgagggtatcagaccaggcgcatcctga

SEQ ID NO: 4708 - DNA, 645 bp, Chlorella protothecoides
atgggtggggatgtggtggactgctggcgggggtacaaagtgaatgaagcctcgatggggaaggggccagggggcagggtcgaatgcgggggcccagtcatggcacagagctttgatggcccggtgggcgcgggacggcccctgtcaatcgagccgcggccaatccgctgtcttccccctgccagatccgatatagcactccaagacgtctcccgtgaagtgatcgccaccgagaatgctcccggggcggtgggcgcgtactcccaggcgatcaaggccaatggatttgtctacatctcaggccaggttcccctggttcccggcgtgagttgcatcctttgggtttcagctccggggcgcgggggggtctcggtccagaccaagaacttcaactctgaggatgtggaggagcaggcggagcaggtcatgaagaacctggaggccatcctgaaggaggctgggtcgtccttctctcgtgtggtgaagaccaccatcctcctggccgatattgccgacttcgccaaggtcaacgccgtgtacggcaagtacttccccgtcgacccccccgcgcgcgccgcctacgccgtgcgcgacctccccctgggggccaaagtggagattgaggcggtggcccttgcgccgtga

SEQ ID NO: 4709 - DNA, 1026 bp, Chlorella protothecoides
  modified_base (161)..(170): a, c, t, g, unknown or other
  modified_base (697)..(706): a, c, t, g, unknown or other
atgccccatctgtacgccccactttgcacagatgaaaagctgcgttactactttgagaactttggcgtcgtgcaggtggggtttgcggcaaagaaggactcgacaaatcgctggcttgctatcacggcggtagagtcaccaggatcgtgcgatgccctgcnnnnnnnnnntgtgcaggtggggtttgcggcaaagaaggtcttgacaaatcgctggcttgctttcacggcgatagagtcaccaggatcgtgcgatgccctgccgccgggtctctggaacgagtcgtgcggcgctttgcttcactccatgcaacttgcatgcctgaggccagcgcagctcccccccacccccccttccacacgcgcactgcctctcccttccctcatacaggaggcctttgtctcgtacgaccggcacaccggccggccccgcggctttggcttcgtggtcttcgccgaccccgccgtggcggaccgcgtggtgagccagacccacaccatcgaccggcgcgaggtggaggccaagaaggcgctgcccaaggaggactcccccgtgtccaaagagggcgccgggtcgaaccccgcggccgccagccccgggcccggcgcaggccccggcgccgcgccggcgttctctccgcgcacccgcaaggtgtttgtgggcggcctggccgccagcgtggacgaggccgccttcnnnnnnnnnngcttccccgcgcacgcgcaaggtgtttgtgggcgggctggccgccagcgtggacgaggccgccttccgcgccttcttctcgacctacggtgcggtggaggacgcggtggtcatgtacgaccacgagaaccggcgcccacgcggcttcggcttcgtcacctacgccgacgaggccagcgtggaccgcctgctggccgacggcccgctgcacgccgtgcagggcaagccggtggaggtgaagcgcgccgtcccgcgcgacgccatgccgcccagcccccggggcggccccttccgcggcccgcctgccgccgccgccgcggc

SEQ ID NO: 4710 - DNA, 861 bp, Chlorella protothecoides
atgcagggcggcaggccggtgctactacgcctgggtgggctgcagctcgcgggctgcgacgcgctggaggccctgaccctgatcatgcaggtgggtggcagaggggcggcagtgaggtccttgggcgctgaggatcctggtggtcctcccgggctcattctgaggccagcgctgggcttccctccccctctgctcccgccaccgccccttgccgctgtggcctgcggccgctgcggcgccacggccacgctggcgctggccctgcagggccgggagggggccgatgcggaagaggcgtgccccggctgccacgcacgcctggccctgcacgcctcgccccgcatcgtgcatgagcacagcaacgtgctgtgccggctggacgcgtcgcggtgcgcgccgcgagacctgtcgctgggcaccacggtgcagggccagtgcgggaactgcaccgcgctatgcgcgctgcgcggggtccaggtgggccagtggaacgcgcgcgcgtgcagggcctgccactgctccgtcggcttcaagggcacagtatctgcaatgcaacctcgagccggtcagccttcccccagcctgcatgcccatcattcccagttcgaccagccggagtttgaggagcaggggccgcctgggcgggatcctggcgcgcggcggagggaggcggtggcggcggggggtgggccgaagcgcagccgggcgcccgaccacatcctgaaggccggccagcccctgcccagcttcggcacctgccgccactactgccactcctacaggttgggagcagagggggggcaaaactggcgattctggcctgtcacaagggttgcagacctcctcttatacctgttttga

SEQ ID NO: 4711 - DNA, 1227 bp, Chlorella protothecoides
atgcaggctgacctgttggccctgcagtccagggtgcctggcttgagattgcagcgtgcagcaagggggaccagcgacgacgcccccttccccatcatcctctctgctgtcgtgactgcgccgccccaggggtcgcagtatgatgtggacagcatcaaggtcgtcgtccgactccaggcccccctccctcgacctgctgtcagcatcgaagtgcactcccctatcctgccggagcggctgcgccgggcggtggcggaggacgtgctggcgacataccaagtggaggccgctgcccgtgccggcgacgcgggcggcctccacctcgaccgcatctgggccgacctgcgtcggcgctgggtgaccctcatctccagctgccccgagctgctggaggcatacacgagctcagacgccgacgggcgcacggtccggcgctatgcattcgtggacgaggaagaagttccggctgggcatgggtctgccactggagcacccgacggcacaggcgctgagctgggcgaccgagcgagagaaggtgcctcgctggcggccgcggcggccggcctgactctgggccaaggccagggcgccggcccggcctcgccgccagcagcttccacccagcttcccgcccagttggcggcggacgtgcgctgggccgaggtgcggtaccgcgccgcctgccaggtgttctggcgcccgggtgggaggccgggccccgggcacttccacccagcttcccgcccaactggcggcggacgtgcgctgggccgaggtgcggtaccgcgccgcctgccaggtgttctggggcccgggtgggaagccgggctccgggcagcgcaggccgcccagcgcggggcagaggagcctgctgagcatgctgctggacctgaccccggcggacccggactggccggcgggggccatgctgcacctgtccctctctgtcgaggcggcggctggagaggatgggcagccaagtgttcaagtgtcaggcctgacctgctccgggagcacccacctgacaggtctggaaagcacggcgctgcagcgcctggtccaggccctcctgctccaggagggcggcgccaggctgcagtccgcgctgcgcacgctggagaacggcgggggcggcctcctgcggagcgcgcgctgcatcgccgccgaggtggagcggcgccgggctgcggcgggaggcaatgcggacggcggcgctgggaccgctga

SEQ ID NO: 4712 - DNA, 1980 bp, Chlorella protothecoides
  modified_base (811)..(820): a, c, t, g, unknown or other
atgcatcttcgtgtcgaggaagtgactggatctccctcgcagagagcctctgaggtggcacgggcagagcccaagatcgcttactactgtcgcctctatgcggtgtctcaggccgtgagcctgggggtgagcaacctggtacccgacatcaaggacctgctcaacaccctgctcgccagcctggagcacgacaagaaggccctggagctggggcccgacgacgccatcctgtgcgagacctttgccctgaccgtgtttgggcgcgcggaccgcgcggatcgggtgggccaggcggacaagaacaccgcgctcacctactacgcggccagcatcttcatggagatcatcaaccagttcggcgagctggccccggagaccctgctcaagcagcgattcgctgcctggcgcgcggcagagatccggcgggcactggcggagggccgagtgccggacccgccgccctcggccgcccaggcccccgttaccgaggaggacgaggccctgctggcctccctgaccagcatgcccagcgtgccgcagggtggtgctgaacccgaggccaagaatgagtcgtcctcgcagctggatgacttcccggtgcccccgcgccacgacgcgtcggtgcagaggagcgggaccagtgttgggccctcagccgactcagccgacctgcctggcccggggccggcggcggggccagaggctggaggtcaagggcgcaaccaggagcacaacggaaaggatgaggaggaggggtccctgcgcctcccctccccgcccctctctccccccatggggagcggagaactgnnnnnnnnnntggggccagaggctggaggtcaagggcgcacccaggagcacaacgggaaggatgaggaggaggggtccctgcggctcccctccccgcccctctccccccccatggggagcggagaagtaggcggccaggcccgccccatctcgggcatggtgtggacgccgccgccgcctcgcgccttttacaccttccagaaggattctggctgggatacatcagtccacgatgccatgccaccaacagcatgccgtcagcacccggtgcgtctctccatgaagccctctcaccccaccctgcaggtcctcttctgccccgagggggcctcggcgccggccaaggggacggtggcgcgcgtgtcgcccgccacgtccgcccagtgccctttctcgatcgcctctttggatcgctgcactccagctccttccaacaatgaacttccaggcagcatcgaggcctgcggggctgaggccctggtcccagacctggccaccggagagaatgtgctggtgcacaccccagggggggtcacgatggacgccaccgtcgcggcggtggactcctcacgctggtgcggcgcgcaaagaaggggggaactgggttgtgtgttgatatcaagccccccactcgactctttgcccgcgcatgatccccaccacacatcatcaccgtgcccacccttgcgccaccacaggccaccatcgtatgccgtgcgcctggcggacggtacctactccaccaccagcatcgagaggattgaggcactcgggacaggacccccgggcatgcctggcgacggcgaggaggagttggaggggctgaaaggcgagggagcctcggatgtgggccccccagcgccaccagggggcgaggctcggccgccgcctcccccgagccctcccaagcccaagactggggaggggctggggcggtcgccggtcgcgccgccgtcacggccagcaacttccagccttgcatcggcgggaccgccagccaggccgcctgagccgactacagccccggtgcccgggttcgagccctccctggcagccatcaccgaggcgcagaggttgaccaagacggccacgagcgctctgtcctttgaggacgtgcggacggcggtcaggtacctcaatgacgccctgcggctgctgacgcaaccatga

SEQ ID NO: 4713 - DNA, 321 bp, Chlorella protothecoides
atgccgaccaaacctggtttgcaggtcttggatgaggaccactatgggctggatgatgtgaaggagcggatcctggagttcatcgccgtcggcaagctgcgtggctccacacagggcaagatcctgtgcctggtgggcccaccgggcgtgggcaagacctctgtggggcgcagcatcgcccgagccctggaccgcaagtactaccgcttctccgtgggcggcctgagcgacgtggcggagatcaagggtgaggggaagcagggtgcaagggagggggccccatctcatcaccatggcgcttgcctgaaaccctgccattga

SEQ ID NO: 4714 - DNA, 1548 bp, Chlorella protothecoides
atggctcccggcgcaccccatccggaagcggcaacggcggcggcaacggcagcggctccccctccgagccagggctctgacggctccgacggcgcctccgccctggtccccgcctcgcccgagcagcgccaccgagaggtgatggccgtggcgctgtcccgccgccccctcttccccggcgggatcatgcccgtcatcgtcagcaacaacaagctgatcaaggagctgttccagctgcgcaagcagaacgcgcaggcctatgttggcgccttcatgcagcgcgtccccgatgcgcccggcaccgccatggacggcgtggaggacggttcctttgccgtcgacctcctgggtgagcagggttgctggaggatgtgttccttggatgggatgcacatcattcgtcgttccctgccccacagacacctgatgtctcctgagccaccactgctccacctctccttgacccgccactcgccggtttccatcgatcatccaatcacctgcacagggagcgcagccccgccgcacaaaaacgacgatgcggacgccgatcctgccgccgacccgtctgccgccctgcacgaggtgcacgccatcatcccgcacgaccagggcgcgcagctgctgctgctgggccaccggcgggtgcggcgcacggggctggcggggcgcgacccgctgtgtgtgtcggtgcagcacctgcgggacgggcggtacgaccccgagcaggacgagctgaaggccacgaccatggagatcatctccaccatcaaggagctgctggcgctgcacccgctgtacaacgagcagatgcgcaacttcatccagttcggcgccgacttccacgacctctcccggctcagcgacctggccgccagcctgaccaccgccgacgcaggggcgctgcaggcctgcctggaggagctgggcgtggcggagcgcgccgcccaggtcctgctgctggtcaagaaggaggtggagctgtgccgcctgcaggccgacatcgggcggcgcgtggaggagaagatcagcaaggaccagcgccgctacttccttatggagcagctgaagagcatcaagaaggagctgggcctggagaaggacgagaagagcgccctgggctgcgtgggggctgtaggggagtgggtgaggggcggcggtgggggttgcctgacgcggtggggtggcgtgggactggtgccagacctcccccaaccactctcgatgcacaggttccgggagaggctggagccgctcgggagcggtgtgccggaggatgtgcggcgagtgatcgaggaggagctggagaagctgcaggccatcgaacccgcctcctccgagttcaacgtcacgcgcaactacctggactggctcaccgccctgccctggggcaagatctccaccgagcgcctggacatccccgccgcccaggaggtggggggagagggggcagaggaggggggtcccgctcgcggaggagaggggcctcatggcttctacatcgggaacgctaccaggacaacagcggacgatggcgggtgggagtag

SEQ ID NO: 4715 - DNA, 1488 bp, Chlorella protothecoides
atgcccggcaagatggtgcagtgcctgaagaacacggggatcagcaacccctttgtcctgatcgacgagatcgacaagctgggtcgcggctaccaggcccttcttcctcaaaccctcctcaaacatggcaatccaacccctccgtcccacctcatccacacatccatctcgacccagggcgaccccgcctcggccctgctggagctgcttgacccggagcaaaactcctccttcctggaccactacctggacgtggccgtggacttgtccaaggtgctcttcatgtgcaccgccaacctgctggacaccatccccggcccgctgctggaccgcatggaggtcatccgcctcagcggctacatcttcgacgagaaggtggccatcgcccggcgttacctggaggtccaggcccgcaaggatgcgggcgtgccgcgtggcgccgtgcacatcaccgacgccgccatgaccgccctggtcgaggagtacgcgaggtgggtggtggactgcgctgatgagggacctggtggggaggagtctacaagctctgcgatgggctttgccgcatggggctcagggtacggatccctcctcgagcccatgccccactgtcaaccagcgcacacaaactgcataacaccctacagggaggccggggtgcggaacctgaagaagcagctggagaagatctaccgcaaggccgcgttccggctggtcaaggagggcctggtggacattcctgtggtgaaagatgcgcaggagtctgatggggaggcgacggaaggccccgacacgctgccgcccagcacaccaccgaccgcctcgatacagggggaggtgccgccgcccgcggagagcgtggagcgtgagcgcgtggaggaggaggctctgcccgccttcgacgcccccgcggtcaccgtggacgcgggcgacctggcggccctgctgggcccgccccccttcaccagcgacaagatctacgcctcggcaaccccacccggcgtggtcatgggcctggcctggactgccatgggcggcagcacgctgtacatcgaggccgcggcggtggagcgcggcgagggcaagggctcgctgcgcaccacgggccagctgggggacgtgatgaaggaaagcgcggccatcgcgcacacctacgcgcggcgcgtgctgcaggcgcgcggcgacgccgccttcttcgagcagtcggcgctgcacgtgcacgtccccgccggcgccacgcccaaggacggccccagcgcgggctgcgccatcgccaccgcgctgctgtcgctggcgctggcgcggcccgtgaggcccgacctggccatgacgggggaggtgacgctgacgggaaaggtgctgcccatcgggggggtgaaggagaagacactggccgccaagcggtcaggggtgcggcacatcctgttcccggagggcaaccgccgagactgggaggagctggcggagatgtacatcacacagggtgcctga

SEQ ID NO: 4716 - DNA, 1530 bp, Chlorella protothecoides
  modified_base (194)..(203): a, c, t, g, unknown or other
atgtttgggggtgcagggaaagcaaagggacgcgaggctgagggcaggcaacggtggcacctcccaggcttccaccctcccactccgcccctcgttgatcgatctcgcgaactggccatgcgcatgcccatcatcgttttcgagtgcagattccagcctgtgaacctgtttgttcttataaattcaccatcgcnnnnnnnnnntaaggccgttacaacggatagtatggtctatcgtggatgggcggaccaagggtgtatgctgtgcatgacgggcaacctcccgttgcaaacctcccgttgcaccacaaacctggcgcatccccatcatcgtattcgagtgcagattccagcctgtgaacgtgtttgttcttgtaaattcaccatcgcgggtcaggaccagagtgccgacgccatgatcggcacagaggccgggatggcagtgctcccccctgccatcaccaagaacatcgccgataaggtggcgaggctgggtggggtggggtggggtggccacctcgtggtgcggcgtcctgccacagccagattgctcgcggcgctggaggtggagcagatggtccgggcccagaccgtggctggggacagggaggggattgctgacctgctggacacgctggccatcaactatgcgctctctgccaaggcagcgttcgtgggcaggacaatgccacgttttcagacgaagtctgaattcaatcagcaccacccagctgctcccagtgcggccgatgctgtccgtccatttcagtgccagtgccaggtggtatcttgtacgtctgacatgctccatgcacacagtcttgcactgaaaatccacctgcactccccccgccccccgcaggccaatgcgcgcaagggcggcctgctgtgcctcgccgcctcggcggtgggcatggcctccgcccccggcgcgcacggcgaggtggtggcggaggccatgatgccacgcctggtcccgcccatcctctcctccttcaccgaccccgacgcgcgtgtgcggtattacgcactggaggcgctgtacaacgtggccaagtccacgcgcgccgctttcttagccgccttccccgacgtgttcgacgcgctctttcgcgtctgcgccgacgccgacgcgggggtgcagaacgcggcggccttcctgaacaacctagtcaaagacatcgtggccgaggcggagcagtggcggctggagccttttgtgccgcagctggcggcctgcctgggggtggaagacccgcacaagcgccagttcctgctggggtgggtgggcctgctggacagcctgcccgggcgcgacctggggcgccacctccccgacctcctccccggcctgctgggcatgctgggcgaccccacccccgagattgcgcacgccgcctcccgcgtctttgccgagctggaggccgacgagctgggcggcggcggcggcggtcgcggcgccgcgcggcgcaggcccgaggtcgatgcgggagtggcggccgtcatggccgccgcgctgacgcgggcctgc

SEQ ID NO: 4717 - DNA, 615 bp, Chlorella protothecoides
  modified_base (128)..(137): a, c, t, g, unknown or other
atgccatcgaccacctgtgcccccaatctttcccgtcggcaaggtgctgcaatcgcttcatccatggccttccccacccctcgacgccctgatcaatctttcccccctttctcccccaccaggcattnnnnnnnnnncttcgtcctgctcatcacggcgtgcggagtgaatagtgtcagccccgggtcggagaagggggggccggggatcgtatgccatcgaccagctgtgcccccagtctttcccatcagcaaggtgctgcaatcgcttcatgcatggcctcccccacccctcgacgccctgatcaatctctgccccctttctcccccaccaggcatcgtggcggtggtgggcggtgtggtctggacgcagtgcctaccgccggcggcgcgcgatgagtgggcggagcgggcctcgcccgcgctgggcgtcgccgcctcggtcctctgggcgggggtcgacgccgtgatcggcgcctgggactgggcgcgcttcaagtgggcggagctgacgcaccgcggcgcggcgcgggaggcctacttcgagccgctgtcggaccggctggacgtggacccggaggaccaccgctcgccccccttgttcaatgggccgtga

SEQ ID NO: 4718 - DNA, 1053 bp, Chlorella protothecoides
atgaccccctccccccccaactcccctccaaccctccaggtgctgggcatcatgggcgcgttggacccgcacatccacaagctcaacctggcggagctgcagggggagggcaagctggaggcggagggcgtccgcccccagacgcgggagcaggacgccatcaacgcggccaacctccccgtgggcgaccaggggctggacctgctgcccagcgcgggtctggtcaccagctccgaggactactaccccaccgtggccatcaacgcgctgatgcgcctgctgcgcaacccgggcctgtccgcgctgcacggccgcgcggtggccgcgctgttcgacatcatcaagtccatgggcttcaacttcgtgctctacctgcccaaggtcgtgcccgtgctgctccagctcacgcgcggcgcggacgacctgcagcgccgcgtcgacatggtgcgcgccctcaccgacctggtcagcatcatgcgccagcacatctcccgcttcctcaaggacttcctggacttggtgcacgagttctggaggggggcgcccgtcatgcagccttacctactcacgctcctcggggagctgtcgcgtgagtctgcctcgaagggcggggggttgcgtcggggagtgcggggaagaggggcttggcgggggggggggcatgccccgctgaggcaaggaaaaggtctgccagcaggcgtgcgggggagtcagccgtcgatgtcacgtcgagcatcacccatcatggctccaaatccccttgcccctcccccacctgccgcgcagacacgctgcaggacgacttccacacctacatgcccgacctgctgcccatgtttgtcgcggtgttcgacgacgccgagcgcaccggcgactttgccatggtgggcggctgctcgaccggatgggcaagatcccgctccgctgccacgagcgttcccctggcgcgggagtgcaagcagccgctgcatcgtgcatcgagcgtgcagggggtcgattcacctgcgccttcttttcctcgccgctcctcctactcctcccagggccacgcaa

SEQ ID NO: 4719 - DNA, 648 bp, Chlorella protothecoides
atgcagctttctgccccccgagcacaattctaccggggcaaggccttccaatctgtcgccccaggccgcaccatccctcctcgcgtccgtcgccaagtacccatcaagcccactgccaagattcctggggtggagcaggcgacagccgccctgaagacttaccgcgcggtctctaacctgccatcttgggtcacgacggtggcattcaccgctttccaggtgctgcccaagatcacccacaaccctctcccctttgtgcctgactccagccttctcttcaacctgctggcttggtacacgttgttgtacgcagggacgtccctcttcaatcgcaaggtgcccgcaggggtgggagtgcggaggagggcatgttcatgtgttcatgccaggacggtgtggaagggcaagaacaccccagatacccgcggatctcctaccctgcccatcccttccctccaccctcagttggagtttgatggcgtgggcacggtcatcgggccggcctacctggcagtgcaggcgatggggggcctggggtccttcctctccccactcaatgtggccacagctctctttggcgtcttcctgtcctacaggctgccggtgagaacgcgtgagcgggcagctttgccggcacaaggcagctga

SEQ ID NO: 4720 - DNA, 936 bp, Chlorella protothecoides
atggcgcggggcagcctgttcaaggtgatgcgggccagcgccgagggcccgctccccctgcgcctggtgcgcaccgtggcggtgcaggtggcgcgcggcatggccagcctgcactcccgcccccagccgctgctgcacctggacctcaagtcgcccaacatcctgctggacgacaagtggcgcgtgaagatcgccgacttcggcctggcccgcctcaaggtgcacgcgcacgtgaccccgggcgcgccctcgggcacgcccgagtggatggcgcccgaggtcctgcgctccgagccctacgcggagggcgcggacgtgtacagctacggcgtggtgctgtgggagatgctgacggggcagcagccctgggaggggctgctccccgtccaggtggtgggcgcggtggggttccagggcaagaccctgcccccgcccgccacgggcgaccccttcctggcccgggtctgcgagagctgcctcagccagctgccgggcgcacgccccagcttcgacgccatcctgcaggagctggagcaggagtttgcgccctccggctactccaagctgagccactcgctgagcgccgccggcatgcacctgcaggcgcagggcgagggccgcgactccggcatgcgcaccgggtccaccatgcagcgcggcagctacgaggagggtgcgcgccccaccaccagcagcacgcgcccctccttttcgctcctgtccagcgctgccgggggcgtgcgcgggtccaggggggacgcctccctccgcagctcctttgagggcgtgggcgaggggcggtccctggacgccgaggcgggggagggggcggggggcgtcggggcgccggcgcccggccgcgcgagcccgcggtcgccgctgaagtcgctgcaccctcagggtagcatgacgaacgcgagcccgtttgcacagtag

SEQ ID NO: 4721 - DNA, 654 bp, Chlorella protothecoides
atggacgaagtgtttccctcctcgggtggagagtacgaccgaaaggcctgcgccttcagattggccgatctcacgctggcagacgaactcgaatcactacggcagcagcttgcggcggaacagcgggctaggcgggaggcggagctgcaggccgagtcgagcaaacaagctcagctccgactccaggtgatagacgtgcattcagggtgtcgggaggaggggcatcgtggccaagagggaggtcatgatcatgcctgcgggagtatgatgcgttattcagagcgagatgtagtgcccccagcctgccccaagacgaagctgctgccggctgctcgggatgagctggcggcccgtctcctgaacgagcagcggcatgctctggacctggaggaggacctcgcctccctggagggtcagcgtggaggggagggtgatggacgtgccgaaggccgcgtcactgcccagagcccggccgcagtggcgcccagcaagatagtgggcctgcaggagcgggtggcggccctgaaggcggggcgggaccggctgatctcggcgctggacacccaggccgcggaggtggagaggctgcagtcgctcaacgccgcactggccgaggtggggggccgttgggggtgtcggggcttggcgcggtga

SEQ ID NO: 4722 - DNA, 402 bp, Chlorella protothecoides
atgagcctccccttcggggggggtgctcgccccctctggtgctccgctggcactccgcgcccaccacccccctcccgccaacactgcggcgcacaggccggggcctctcaaagatcgcacaccactcctcccggcccaccctgtatttccagacgcgccaaaatgacgcagttcctcctcttcgaggcggcctcgggctatgccctcttcgaggtgacggccctggacgaaatcggcacctcggtggacgccgtgcaagcctccgtcacagacctgtctcgcttcggcaaggccgtgaagctgacggctttcaggccattctcatctgccgccaatgcgctggagcaaataaatgccgtgtccgagtctcaggtgggtcctgcccctcacccgcctgggtag

SEQ ID NO: 4723 - DNA, 639 bp, Chlorella protothecoides
atggcgcgtcctggcgggcagcgtggctctcggggccagccccccaagcgcaagaagcgtgacgagttcttcgaggacgaggatgcagtggactttttcgaggatgccggagacaaccaggccggggaagaggcggacgagggagaaccaagcagcgatgaggaggagacagcggagcagaagcggcttcgactaggtggggcaccgccctccaatgacctccctccaacagccaaggagtacctggccggcatcagggcggtggaggctgcgggccgcgacggggccgaggacggcgcgagcgacgaggacgggctggacgcggccgtggaccgccggctgcgccaggacgccgccgaggccatggggtgggcgcagcgcgccctggcggcgcgtgtggtgctgcccgagggcgtccctcgctccatccccgggcagaagctgcataggggccactcccagagcgtgaccgcgctggcgctcaccgccgacgaccgcacgctctactcggtgtccaaggacggcaccatcctccgccacgacatcgagtccgggaacaggtggggcggaggaggagcgatagatgttgcaccagctgggcaatccggccttcactggtatgatctccacgatctatga

SEQ ID NO: 4724 - DNA, 936 bp, Chlorella protothecoides
atgtcctccggcgcggcggctggccccagcggtgcccccgccgcccactgggtcgtgcccggcgcccgccagaccagccgcgctgcgctgctcgcgtgcgcggtttcctcagacggcgtgtacgttgcggcgggcggcggctcccgtgtggtgcacgtctgggacacccgcgccggcctggcacccatcaagtccttccccgggcacaaggacgcggtcaccgcgctcgccttccgcctgggcacgcatgagctcttctccgggtcgctggaccgatccgtgaagctgtggagcctggacgacatggcctatgtcgactccctcttcggccaccaggcagaggtgctggccctggacgcgctgcgcacggagcgcgtgctctccgtcggcggcgaccgcacctgccgcctgtggaagatcccggaggagacgcagcttatcttccgcggctaccaccctgtgatcgagagctgcgccttcaccaagggcggcgaatgggtgaccggcgcggcagacggcgcgctgggcctctggagcgcggcgcgcaagaaaccgctgcagagcatccgtgccgcgcacagcgcggaggcagacgccagtcccctgggcagcatcggggggaatgcggcggcgggggtcctgtccgtcgccgtctgccccgcttcggaccttgtggcaactggagccggggacggcctggttcgcctgtggagcctggacaagggcaccaaggggaccaagggcctcagccagctgggcgggctccccgcgcgtggctttgtcaacggcctggccgtcgcgcggagcgggcgctttgtggccgccggcatgggccaagagccgcgcatggggcggtgggggcgcgacgggaaagcacggaacggcgtcctcatcctgccgctcacgctgcgcgccgaggatgcagccgaggagtga

SEQ ID NO: 4725 - DNA, 1011 bp, Chlorella protothecoides
atggcatctttgctggggcacattccactgggtgtggaccgaaccaccgtactccccctacacacatggcctcttgccccaaatgcgcagagtggagccgtggatgggcagcagctggcccggaccccgggggcactccctttcttcctccgcaacctgctgccggagacggacttttacatcaagtaccacagcctgcaggcgctgaggggtctggtggccgcgtgcccctccctcgtccaagaggtacccgatgccggcggatgggtgatctgccccatcctggcagcggccggccaccttgcgctgcatgcacgccgtggcgtgcagcgtgccgtccagggcgagccgctggcggtgggtgcgttgctggatgtgctgagcgggggccatgaagtgctgaggaacgaggtcttgctcctcctttcctgcctgctcccgggcgccccggagctggccaagcttgtcgtgttcgagggcgggttcgaccgcctcctcgacatcgccaggtgggcctgggccgtggggatgcatggctgtgccaccacagggggcctgggcgcgccgggcgcccccgccagcctggtggccgccgactgcctggacctgggcgccgcgctggtgcgcgacaaccccgccacgctgcgcatgctgtgggagacggggcacctctcccccctgctgggcctgctcccaggcgacgccgccgaccccatcctcccggccctcctgcgcctggtggcggccgccgccgggcccagccaggccgtttcccgccaaggctcggggctgggggggggcgcggagacgcggcagcatgtcctggccgcggcgctggccgcgggctggctgcccaggctcctggccctcggcctgggcagctgcctggggacagcgccggcgcatgaccagcagcaggctgaggtggggcctgagggccaaggtgttctctgcatggaaactcataacgaagaacccaggatgccctgctggcattcgatgggtgtatag

SEQ ID NO: 4726 - DNA, 399 bp, Chlorella protothecoides
atgcctccacccgctccgccttcccattttaaccacagtcggtacctggccaacaagtgctccattgcctcgcgcatcgactgcttcctggaccagtcgaccgacgcgtttggggccaagatgaaggagcaggtggaggagaggctgcgtttctacgaagagggtgtggccccccgcaagaacctggcctgcatgaaggaggtgatcagtgggctggccggcggcgaggaggagatcgtgctggatgcgccggtgacggagaagaagaaggccaagaaggccaaggcgccagccgaggaggaggaggggtccaagaagaagaagaagaggagcgccgaggaggaggccccggtcacggaagagaagaccaagaagaagaagaagaaggccagcgcatga

SEQ ID NO: 4727 - DNA, 366 bp, Chlorella protothecoides
atgaacagactgaacaagttcttggcatccccggcccaggacagggcgggaccccgggtcgatgcattgatccaccgggcaactgagagctccttccctggagatcgaaaagaggcggtggcggagctcaaggacctcatctcccaggacgccgctgcccgcacagcactgggctccttcggattcccccccttgctgacactgacgggggaggacctggagctggaccgctccatcacagagtgcctggccatcgctgtgtttgctgaggatggggaggtgagggccgacttgtgctcggcgagggaatgtcggccagcaggacgaggatggcacctttgctggggcacattccactgggtgtag

SEQ ID NO: 4728 - DNA, 462 bp, Chlorella protothecoides
  modified_base (41)..(50): a, c, t, g, unknown or other
atggtccaagggaaatgtcgatcatacctccctcacgacgnnnnnnnnnngagtgaggatgcagtggtcacgggtccatgtatacctctctcaatgatccacgggaaaggtccatcatacctccctcaccactggccccctcaaccacccccaccccaccgccccggccacagcttcaagcgctacaggaccctcgtctccgaggcgctgttcgacaagtacgacgccgtcgagcactgggccaaggtggagccccctgaggatgccgccgagctggaggccctgaggcaaagactggggaggaggttcccggtggctgccttccaggccgcgcgacggcggctggaccccaagaacatcctgtccaatgactgggtgaatgctctttttccactgccacagacagaggaggctggagactctgacgagggccagcctgctgccaaggccgaggcggcgtga

SEQ ID NO: 4729 - DNA, 1188 bp, Chlorella protothecoides
  modified_base (148)..(157): a, c, t, g, unknown or other
  modified_base (727)..(799): a, c, t, g, unknown or other
atggcagaggagggtcaccctgggaggctggctgtggtatcaaagggtcttgagacgacggccaccgcctgccggtgctggagtagcatcgtgcacactgcccctggcccacaccgactcggtgtgcgcgctgcatttcgtgcaaggnnnnnnnnnnaggagggtcaccctgggaggctggctgtggaattaaagggtcatgagacgacggccaccacctgccgagcctcgaccactctcaaacacacacacgacgcacaggagtccgacccggagctcttccggctcgccagagtgggcctgggctgcctgggggtggtggcggagctgacgctgcgctgcgtccccgcgcaccgcctgctggagacgacgagcgtggaaagcgcggcgcaggtgcgcgccgcgcacgcgacacgcctggccgccgcgcggcacctgcgctacatgtggatcccgcacaccgacgccgtggtggtcgtgcagagcgtggaggcgggtcccgaggccgccgcgcgcgccgaggcggagatcgcggcggctgcggcggcggcgggacaaggcaaagccgaccccgcagcggcgctgcacgcgctggccgtcaccgcgcgcctgctctcggagcgcgaggccgcaccgctgtctgccttccagctgcgcgacgagctcctcgcccacgcgcccctggacgcgggctgggtgcgacgcgtgaacgcggccgaggccgccnnnnnnnnnnnnnnnnnnnnnnnnnnnnnnnnnnnnnnnnnnnnnnnnnnnnnnnnnnnnnnnnnnnnnnnnngctcggcgggccaccgcgtgggctggagcgacgaggtcctgggcttcgactgcggcgggcagcagtgcgtgagcgaggcgtgcttcgccacgggcacgcgcgccgcgcccgcgggcgccgacctggcctacgcgcgtgacctgctggccctggtggagcgggaaggcctgcccgcgcccgcgcccatcgagcagcgctggacggcgggcagcgcctcggccatgagccccgcgcgtggcggcgcggccgacctcttctcctgggtgggcatcatccagtacctgcctgtgcccgaggacggcgacgcggagggggagcggcgcagggacgccgtcgtgcagaggtgtgtgctgtctgttttcaatggggcccaggacatgtgggagtga

SEQ ID NO: 4730 - DNA, 1440 bp, Chlorella protothecoides
atgctgaccgtaagggaaagcgtccaggccctgcgggagccagccggcgaggagcagcacactgagaccgcatcagaagtctccacactgcatgccatggaagcgatggtaggacgtctgtggggtggtgcaaggttgtgctgtgtctggggccagcactggggattggcgcacttggcgctctgtggctgcgatgaggacgtcgcctccaatgtggggcatgctcctgcctcaccagtcaggcctccccaacccgatgccttcctgatatgcacaatgcccgtgcaatcgcactcagagcatccctcaagatcgatgcaattcatacatcttccacaggatgaggacgaggcgctggcgcgcgccattgctgcaagcctggacgagccagcggctgcctcccaggcccctcctgcgcagccccgccccgcacccgccgtttctcggcccgccacccgcatccacaccctggcaagcgcgagcgggagggattctggcgaggcgcacgccgcgcccccgcccggcgccgaggtgatgctgccggacggcagctgcctggtgcggcgcgtgatcgacgcggacaacagctgcctgttcaacgcggtggggtacaccatggagagcgggctgcggtacaaagctcccgtcctgcgccagatgatcgtggaggcggtactggccgacccagggcagtggagcgccgccgtcctagaaaaagaccctgttgactactgcgcctggatcgacgacccacaccactggggcggcgccatcgagttgtccatcttgtccaagggaagccggggggaggatgggtatctgctggtgggttgcaaagcccgtggagggaggcggtacgggcgccagatcgcggccttcgacatccagacgcagcgcctggacctgtacggctccgagcacgccgactacaccgagcgcgtgctggtgctctacgacggcctgcactacgacgcgctggcggtgtcgcccttccccggcgcgcccgaggacatggacgccacggtgttccctgtggacggccctcgcacgcacgaggtcatgacggcggcggggcggctggtggcggccgcgcacgacgcgcgccagttcaccgacaccgccgccttcacgctgcgctgcggcgtctgcggtgctggcctgcgtggcgagcgcgaggcggtgggccacgccaaggccacgggccacgccgacttctcagaggccgagagaagtggtgcaaggcggggcgagatgcatgctggccatggccatgacgcggcaggccgacgtagacgccccaaccgagacctcctctcctggagattgtccgcactgagcctctgcgacaccgtgcatatacacaccgctgacacacccgctgccgcccttacttcttttacacacaaactcttgcttgccctgcctgccccgggatcatag

SEQ ID NO: 4731 - DNA, 780 bp, Chlorella protothecoides
  modified_base (630)..(639): a, c, t, g, unknown or other
atgatgttcatcgcccggggagatgccaagaagttgaggctagattctgccgtgcccccagcggtgcggccgcacactccgttcggcagcatcagcctcagccaagatactagccgcgatgctccccctgcaaccaaagagccgcgcacaggcactttctacccaggcgacttttgcctgcgtgctgatcagtcaccctgtcccgtcctgatcggcactggttggattgcctgtgacgacaccctgttcattccatcatcctccagagtgaggagtaggaagctggcagggttcaagaacttggacatctatagcctggggctctatgtggacgtgccacgactgaaggcgactgccgagggacaagaactccctctcagccagatgtttgatggtgcggtcaccatgcatgggtggaggcttgtggacgctccgcatcgtcatcaccagccggctcgtcacccagagccgatttctccacgctctggaggagaatttggcgccggtgatggagcaggtgtgagtaagggtggcgctcggccttccagcctcctggctggggcatcagtctcttcgagccctgcacgatctaaacttctgagtgtgtctgggcatcatgagatccacggnnnnnnnnnnccggctcgtcacccagagccgatttctccatgctctggaggagaatttggcgcccgtgatggagcaggtgtgaggaagggtggcgctcggccctccagcctcctggctggggcgggaaggggtgcagtcactgggttctag

SEQ ID NO: 4732 - DNA, 2316 bp, Chlorella protothecoides
  modified_base (601)..(610): a, c, t, g, unknown or other
atggatcctgacgattgggcaggaggctggcctgcgcttatccgacgcccgcatcctttctggggcggtgggcgtcccggagagcaggatagaggtagggcaaggtgcggacttggtatctcacgcatgggggggagggggtttggcaagacagcgctgaggactctagagccgtcaggagcactgatcaggagtgggagcactgatcaggagtgggtgcagtgcaacgcttggcctctggaaacctgttgccctcccttgctgcaccttcgagcccctgctgtgcctgatgctcctcccaccaagttcctccaacacccaacccccacctcttccctcccttcctcccgtcagctggagctggacatgcctgacatggcggccctggagagcctctgggcctccatcccggccgatcagcacagggcgtggggcgagaggctggcccacagcattgtccatggctcccccgtttggcacgtgtaccgggagacgcctgttcagagccaggagatactggaggctaccaagggggggatcctgctcagcgggctgcgggatgatgcgggcggcagcgcccaggccgcgcccccgcccgccnnnnnnnnnngggggatcctgctcagcgggctgcgggatggcgcgggtggcagcgccccggccgcgcccccgcccgctggcgtcgaggagccagaggcgcggtacatgatcgactggaagggggatcggctcaaggtgggtgtactggatgtcgaaggtgggcgactccctcccccaactcctcctcctgattgctgttgtcgccgcgctgcatggagacaggccaagggatggccatgtgcagcccagggcgacacaatgcggcgcaccccctccgaccctctcctcacaccaccaccactcccaacacctcgcccagatcaaccctggggacaggctgccgggagtcgggtgacgtctccgccaccgctcattccgctgcttgcaaacctgatgctccctgtgtggctgcccaatgcgacaatcccctcgttctcccaaagtgattgcctgctgcagtgcagcatgaagtctcggccccagggggcccacaatgctctgatacctcatccggcaccctgtcagccaacaagccctaccctcctgcccccctcgaccccatcagcggtcgccgcaagagtatccttgtcagcttacagcaagtggcagagacgcgagcctgagagggcgaccagtgccggccgggggacatcccccgccgccggaccccgccgcccgccccaaaggccctcacgccttggcgggcgcggcgcccttgggggcgtcggtgacgccgacgatgccggccgccaggcgctcctccctcctcgccagcttcctctcgcgcatggccttgttcttggcgcggcgcgcctcgaactggtcggccagcgccttctcgcgaatgcggtccgccttctgcttgtggatggcctccatcagcacgcgcttgttcttgtacacgttacccttgaccttcaggtacagctcgcggtacaggtggcggtcgatcttcttggagtcgcggtacttcttgagcatgcggcgcagcacgcgcaggcggcgcagccacaagaccttggtgggcaggcgggcctcgcgggttccgcgccgcttacctgcatgtgggtgcccgggatggaggggggggggcttcatgtacgcccagcagtgcccaccaatctccccccctccgtcgtgaggaaaacacgcaccgtagccagtgtgtcggcccttggccttagcctctgccgatgcacgcgcgcgagagcgggagtggatcttctcgggcttgcggatgatgaatccgtccttcaccagcttgcggacgttttgccctgtgacgatggagaggggagggggcgggccgtcagcccaaacgtttgcgacgagaggccgggcctatccgccagggactcgccgggccagcgggacagcagaggaagagcttcgcattcccacagcatccatgaccgggctcccaggccgtgccaggcgcagaggagccgagacagggcggggcgggaagccatgcccgactgcgcccgagccgggcagcgcctccgcccaccgctggctgctcatcgcggccctcatcccttatccataccctccacggactcacgggagttggccatggagatgtcgttcacctcattggggtccagccacaccttccgcagaccgcatcccagcacggacgccgccaggcgcttctgcagtttgagtgccaccatttcgagagcgccctgctacgttgcggggcctgtggcctga

SEQ ID NO: 4733 - DNA, 408 bp, Chlorella protothecoides
atgttcggagctatccgacgcacccccagcagcgtccccgggactcttcgcctcccacctgactcgcagctgcccctcgcctcgctgccccatcccctccctgaaaatctcatcccccctctctgcacatgtttcaggtttgccgagatcgtgcctgccgcgcagcgcaacctggtctacgcctttgaccgctgctttgagggcgcggtggccgcctttgcagccccgctggtgggcctgctggcagaaaagtggtacggcttctctggcgccagcaccgtgaccggggacagggagcgggacctggcaaacgcacgggccctggggtcagcgctcctcgccttcctcgccataccctggttcatctgcctctgcgtctactcaggtaccagtttgggcgtgtcttga

SEQ ID NO: 4734 - DNA, 882 bp, Chlorella protothecoides
atgagcaccctgataggcagctggcccctccaggccggggacaacctggtttgcgagctgtgggagtgcgacggcggcgtgggcgggtgtgacccggccaagccctccctcctgcccaacgccacggcgggcgacgaccggctgggggagctgaccctgggcatggacgactacgccgcgcagctgacgctgaccagcagcttcaacaccagcgccacgaacgccgcggcgggggtcatgctggagtgcgacaagtgctggcagctgtggagggacaacaacggggcgtgggtgaacccctaccgccagggcgacctccccgcctccatgcggagcggggcgggcatatcccccccgcccgcgccgcccgccggcgcggcggggtcctggctcgtggcgggccaggccggcgcggcgccagagtccggagcagcgcccaaggaggacgcagccaagcctgccgccaatgccccggtcgcagccgcacccgccccggcgaccagcgccccgcgggcggccgcgccctcccccacgctcgagagcggtagtccacggtccacgccgagcgcctcccccaccgcgccagcgccaccctcgcccgctcggcagcaggtcctggcgcccgtgccctcgcccccggccccacaggaggtcacctccttcgatggccccgacgagagcccctcgccagtggagcagagccctgcgacggccgagagtcccgcgccggccgacgcgccggtgaagggcggtggcctggccacaggcgtcatcgccgccatcggcgcggtcgtcgggctcctcgccctgctggccataggcactaccatctactgcgctcgccgggggaagtgctgcttcggacgcggcaaagtctcgtga

SEQ ID NO: 4735 - DNA, 1179 bp, Chlorella protothecoides
atgggggagctagccccggaggacgcggtgcaccgcacacgcaccgtcatcctcatcgccgccgcgtcgatcttagaaaaggcacggaggttggagcgtgctgggggatgtggggatgcgacggcaacccgcatggcgccgggaccgggccctcgctaccccggtcgcagagcgtcgagccccaatagcactttcaggccggtgccccaggctcagccctcagcccccagccctcagccctcccacccctccaccctacccttccccccgcagtgcgatgagcagatcctgcccgccctgtacgcctgggtgggggcggccttccaggccacccccactcagctgggcaacctggccctggcccgcgccatgatgcaggccctggccagcccgctgggcggcgtctcgagcgccctggccccccgcggcgccgtcatcgccgcgggctgcctcatctgggccaccttcaccgccctgttcggcacgctctcctcctacgccctggccgtccccgtgctggccatgaacgggctgggcctggccctggtcatccccaacgtccagagcctgacggcggactactacccccccggggcgcgcggccgcgcctttggcgccctctggctcgttatcagcctggggggcatgctgggcgcgctgtacgccaccaacatgggcgccgcgacgccgctgggagtccccggctggcgcttcgtcttcgtatccgtcgccgtcgcctccgccggcgtgggtctggccaacggcatctgggtgcacgacccggggtacgcagggcgggccgccgccgcgcgcgaggccggcgcctcgctgtccagcacgctgcgggccatgggcgcgggcgtgctggccgtggcgggcatccccaccttcctcctcatcatcacgcagggcatcgtggggtcggtgccctacgcatccctcatcttcctcaccctctacctccagctggcgggcatgagcgacgcacacgccagcctcctggtcgccgcctacctggcggggggcggcgtgggggggctgatcggcggcgccgtcggcgaccttgccgcccgcctctcgccggggcacggccgcatcctggccacgcagttcagcgtggccgttggcatcccctttgcctgggtcatcttccgggtgagcccgggcaccgcctggtaa

SEQ ID NO: 4736 - DNA, 424 bp, Chlorella protothecoides
atggccgagcggcgccaggacctgttcaccctgttccgcaacgccgcgcggctggacccggccgccgcgctggccttcgtgcgctccgcgctgtcggccgtgctgttcgcccccgacgcgccctggcagggcgtggagctggcggtggcgctgctgtaccagctgggcgaggcgccctccgacgccgacctgcgcccgggcacgggcgcgctggcggagctggcgctgggcgtcatgcgcagcgaccaccccgccgccgcacaccgcctcgtggccctgggcgtgctggaggcctgcgtgcgatacgcgcgcgtgctggccgcgccgggtgtggccgcgggcacgctgccccacgtcgtggcgggcttcctgggcgcgcgggggctgggccacgccgaccccggcgtgcagcgccgggccgcct

SEQ ID NO: 4737 - DNA, 1917 bp, Chlorella protothecoides
  modified_base (83)..(92): a, c, t, g, unknown or other
  modified_base (185)..(194): a, c, t, g, unknown or other
  modified_base (1480)..(1489): a, c, t, g, unknown or other
atggaggcaaagggcacgccggccagcgccagcgcgcgcaggcgcgcgttgagcaccggcgcctcggcgcgcgggtcggtgcnnnnnnnnnnggcgcctcggcgcgcggccctcggccagcgtgttgctggaccccaggcggttgagcaggtccttcagcgccaccaccgactcggcgtcggccnnnnnnnnnncgtgcccgcgcgccctggccaggccctccgccgctgccgccagcgcgcgaggccaggtggccggctccaggccgccgccggcgccgcgcaccagcggctgcgacaggcgctgcaggcgcagcgcgtccacctggaagcgggccttatcgctgatccactcctggttgatggcgtcgttgaggcgcggcgtgacgcggaacacctccggcccgcgcgcatcgacgcggatggcgctgccaagcgcgtcgctcacgtccaccgactcggtggaggccagctcccagttgcggaaggtgaaggccgagggcttggccgtcagcgcgcccacggggcacaggtcaatcacgttggcggacagctcgctggtcagcatgcgctccacgtaggtcccgatctccgagtcccgcccgcgccccgtcatgcccaggtcctccacgcccgccacctccttggcgaagcgcacgcaccgcgtgcagtggatgcaccgcgtcatcaccgtcttcaccaggggccccaggttcttgtccactaccgcgcgcttgacctccgtgaagcgggagcggtcagagccaaacgccattgcctggcgtatgattgggggggtgggggggttgaggaggggggagtggagaggagggggggattctgtgggccgacgggcgtgcgcaggggcagagcttttggggagccatggggccaaaggcatcagccgccatgtatcggccaggacatagcacccaggcgtcagatggggcagtccagggggtggttgatgagcaggaactccatcacgccctcgcgcgccttcttcaccaggggtgtggaggtcttgatgttcatgcccgggccagcaggcatggcgcaggatgccacaggcttggggctcttctccacctgccgggcatggaggaagggtgtcggggtaagccaaatgacgggtcgtagagattgcccgcagcgtgctgatcaatcacaccagcgggtgaatgtgaagggaccgaggacgcaagcattttgtcttggacctgacgcgaccggctcccccagtggtcaggatcctgggcccattccggcctcgaggcgcaataccgatcgcaacacaaccatcccacctctacaaggcacatgcggcagttgccggcgatggagagcctctggtgatagcaaaacctgtgctccgacaggggggcgggaggggtatgcgcaatggggcaaaggcggcaagcacggcatgaaggataccgtcttcgccagatgttcgtatgtagcctcgtgccagcctgccnnnnnnnnnnacgggagggcctcgtgccagcctgccttcccggatgatggaggcctctcggctcacctggggacgtccacgcccgcagcgtcgcaggcctgcagcacgttggagcccttgggcaccttcaccggtttaccatccactgtcacttcgatgagatcatctgcaggggcgggggcagcttgggcggccattgcccggcagggtactgtctcccacgaggagcccctccgggagaagcgctggagggcgcgcagccgctgcatgttgccgaccacctggcgtgccaatcgggtcagcctacttgcggcatgcaggtgtcaggaacgtgaccttggggtgggtgaccaggacgcaagcttatgcgtgtctcgcttggaggtgcttccgtccgtgggtggcgggaaagcagggagtagtaatgcaagtcgatga

SEQ ID NO: 4738 - DNA, 207 bp, Chlorella protothecoides
atgcagcggctgcgcgccctccagcgcttctcccggaggggctcctcgtgggagacagtaccctgccgggcaatggccgcccaagctgcccccgcccctgcagatgatctcatcgaagtgacagtggatggtaaaccggtgaaggtgcccaagggctccaacgtgctgcaggcctgcgacgctgcgggcgtggacgtccccaggtga

SEQ ID NO: 4739 - DNA, 1335 bp, Chlorella protothecoides
atggagacggaggggctggtgcatgccgcggtggcgtccggcgcggacgagtacctgtctaagcccgtgacgcgcaaggaggccgcgttgatgtggcagcacgtgctacgccggcgcgcgggcgggcggccacgcgtccccagccagggcaccgcctcctccagcctgcccagcgcggtggggctggaggccagcggcaacggggtggtgtcctccgtcagcccgccgcaggaaccggcggccggctcgacgcagggcttgctggcagaacccctgcccagcaccgtcttcaagtactgcgatgcggggcagcacccgaccctcggcgcggcggcctccctgagctccatcccccggcgccccagcaacgccagccaggcgatggtggacgtcgggtccgcggccgcccgcaccgcacccccgctggcatttgccgccggcgcccgtcgcggcgcgcccaccgcgaccaagggcgacgtcctggaggtgctgtgcgcgctgcggcggacgcaacgtgccgccgctggtcggctgcggcgccggctggaaaccgtggccagggacctggaggcggcgaaggaggaggccggcaggaggtggccccaggccggggaggaggacgccatgcagacggcggccccgcctgccaagcgccgggccgtgcaggcctctgatgcacggccaggagcggggggtgatcgggtggtgccggggagtgagatcgtcgaccaggccatggggcaacttcaagacctgtacttccaggacgtcgccaaagctggcagccacagcgaaggcctgagcaagtttgcacaagacctcgcggaactcacccgctgctcgaacctggagcccgtagccacactgaacagcgggcatctcggaggcacggccgaagtgatatgtgcggcggctttcgatgcctacgaggagcactttgcctctgtgggggtgtcccgtgtgatccgggtgtacgacttccacgccctcctggccaaccccagcgccctgcagtaccccatcctccagctgcacacccggtcgcgccttagcagcctgtcctggaacagctacctgcccggtcgcctgctcaccgccgactttgacggcggggtgcagctgtgggacctgtgggacgtgggcaccggcgccgacctgaacttcttcgaggagcacagccggcgcgtgtggagcgtgaacttcagccgcaccgacccctcccgctttgccaccgcgggggacgacgcctgtgtgcggctgtggagcacgggcgacgagaccagcgtggccaccatcaacgtccccgcccccgcctgctgcattgagcaccggtga

SEQ ID NO: 4740 - DNA, 1299 bp, Chlorella protothecoides
  modified_base (341)..(350): a, c, t, g, unknown or other
  modified_base (761)..(770): a, c, t, g, unknown or other
atgccggagtctcagcccagcagtcagatgagtcctcggcttccaacccgcacccagccccatcacctcctccactaccctgcagtgctgaatgtggaccccagcgatgaggacgtgcgccgctgcaaggtggtcctcctgctggagctgaatcgatttgccgacgcgctggctgcaatcagcgcgcatgggctggacaaggagctagcctttgagcgcgcctactgccagtacagggaggggaagcttgaggacgccctcgtcacgctccagatggtgtctaaggaccgccagggtgttgttactagacccagtggccgcctctgcgatgacctctgtcnnnnnnnnnngccacatcggccccatggggtgagtctgtgggtggctggtagggtgttgttactggacccagtggaccgcctctgcgacgacctctgttcctccctccctcactgccttccaggaggccaagctccagctagaggcccagctgcggtaccgcctggggcagtaccccgaggcgatcgccatctaccgccagctgttccagcagtacaaggcagagaccatggaggtgcagaccaatgtgctggccgcctatgtggcgggcggccaggccgcggaggtccctgccgtgctcgaggctatgaaggtgcgagtcgggagccatcctgcagtatcagcctcactctgtgccaagtccttgctgtgccgggtctgggatctgcattccctaggtgttctgtcatactgttcatcannnnnnnnnntgcagtatcagcctcactctgtgccaagtctttgctgtgctgggtctgggatctgcaatccctagatcccccccccgatcacctaactcctttccccccttcaccgtcaggcgtcccccaaggacagcttcgaggtggccttcaattcggcctgtgcgctgctggaaaccggggagctggaggccgcgcaggagcgcctgctgctggcgcagcgtgtcggggaagaaaccctgatcgaggaagggctggaggaggaggagctggccaaggagctggtccccatcaccgcccagctggcctacgtggcgcatcggtgaggtggaggaaagagggggagcgtgcagaggggtgctggggggtggggggggggttatggagagttccaggaggacgccagctttgtcggcgggcgctctcgtctgtattcatttgcgtcacgacccctcagaaccacatcccccctcccctccaccctcccagcataaactcatcgcaaccctaccaccccccatccccacctcaaaattaa

SEQ ID NO: 4741 - DNA, 1875 bp, Chlorella protothecoides
  modified_base (69)..(78): a, c, t, g, unknown or other
  modified_base (448)..(549): a, c, t, g, unknown or other
atgcggcccctgccgagttcccagggaaccgtgtaccttcgccctgtaccgctccacgacatgcatccnnnnnnnnnntgcccctgccaagtccccagggaaccgtgtaccctcgccctgtaccgctccacgacatgcatccatctcttacagccctggaacctgcactgctcaccccaacacacccgaccttttctcaatttcacaggccgaggtttctgtgctcaagctgggcaaggcccgggctgggaaccgggggatcagctggaaccacgaggaattccgtgcgcgcctgccctcgctgcagcgccagctcagcatcggcggcgtgtacgtccgcctcctcctggacggcgccgactcgggtgcgcctcgttctgtcttctgaggtggaacccagagctttggccggctcccagctttgccgcgctcaagacatgcccctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaactggctgcaccccgggacttcttcctggctgcctaccaccacttcctgtgcctgggagatgccgattgcgcaaatcccgtgcagagatcacccgcttccctctgaacgaacccaggagacatcctttcgcccctcaaaaagcgaccacctccctcctgccttcctcgtgcaggacgccggggcgcttgctgacgcggcgggcgccgccaccgcgctgccgcccgcgctggaacagcgcatcgtctgcgtgcgggccatggccgccgcctatgccgtgcatgccggcgcggtcggcccctttgacggcgtggagcatgtggcccgtgccgcggacgccaccgcctccaaggccctgcgcgccgcctgcctggccttcctggccacgctggtcgcgccggcggcgggcgtgggcgaggacggcacaggcgccgcacgccaggcggccaccgccaacgccgacgcgctgctgagggcaggcggggtgggcctactggtcgacgccctcgtcggtgcggggcggggttggatggggtccaatcgagggtttgcttggttggcagcccttaccagcaacctggaatcctcctcccctgcacagccgggcatgaggacggcggcggcggcggcggggtggcagccctgcacggcaacctcatcgcgtccacctcggcgacgcaaccgctgcgcttgtggagggtgcacctgcctgatggcccggagaggtgagattgtttggggagagtgccagtgctgttctgcggcaggaagagccaactccaagaaatcccctggacctgagcacccgcgccgcgcctcctgcctggggaatgctggagggacgttgacctcgaagatccatgagcctcaccaattctgcggccacgaggtctctcttcacaagccctcagccctcttctcccctactccatcccaacaccaccagggcctgcacccggcaggagctccgccaggcctttgcgcggggcgaggtgatactggacaccctgctctcctgtcccgactggcgctcccccacaagtctaggctccgtgcgcgagctgcgctgggccctgggatccaacgcgggcggcccgccgcccgcggcggcgatcgcggcggccgcgctgagcacgctgggcgcgctgagcgcgctacggccggcgctggatgccgcgggcgagcgcgtggttcccgcgcccgccgcgctgcgcgcgctgggctctggcgagacgctgccgcacctggcgcaggccctgctgaccaacgacccggccctggtgtcgggcgcgtgcacgctcatgctgcgcacgctgtgtcatga

SEQ ID NO: 4742 - DNA, 1779 bp, Chlorella protothecoides
  modified_base (786)..(795): a, c, t, g, unknown or other
atgctgcgtcacctgggggacttccccgcccggctgcgggagcatgggcattcgctgtacgagtacaccccctgcccgcccgtgggctacccagagatcgaggtgggtggtcaacacccaaagtctgcatgcaagagcccatacgctgacaggtgccctgccctatccccatccctcgacctgctcgaccaaattcgcagggggagctgtggtgccacaggtactatctgcgccacctggtcgatgaggtcaggttccctgactggcagatcacggatgccgtgccgttccttcagaggggggaagagggcggggaggtgggcctgcgggggggtgaggtgcaagcgaaaaggatggcttgagatggtgggctcgacgcgagaagtcaggggtgctgggacggctgtgaacaagactggtagcctcctactggcgtctggcatattgttgcaggcaacacaccctttccctgctggatgcctggcgcgtggagctggcccggcagccgctcagcatgacggagtcggatgcttgcgccgtgctgcaggtgcagcccgacggtaccgggcacgtgcccgaggactcgctcaaggccgcctaccgccggtgcactggggtcgagccttccaggggacggtggcaacccctggtgtggtttgtcctgtattgaggagctcaactggcatatgtctccatgtttctgagactttccgtccttcccagcgctctggcccgcctcaaacacacacgccccctgccccaagtcaccccgccaccggatctctnnnnnnnnnncatgtctccatgctggcgcgagccttccaccccgacaagaacccagatggtcgtgaccgctttgaggccgtgcagcgggcctacgcgcggctgcaggccggcgcggcgggcggccagggcccccagccctggcgcctgctcctgctcatccaggcgcagtgcctggtgttccggcgctgcactgcggagctagcgccctacaagtacgcgggctacgcgctgctgctgcgggccttgacaccgcccgaccccggggccgatgcctctgaggcccagcagctgctgggcggcgaggcgctgcccctggtccgcgccgcggccgagctggcgtggctgacctgcgccgcctcgggcccaaacgcggaggagctgtgtcgcagcggcggcctggaggcgctgggcgcgctgtttgagcgctgcgtggccgtgacacacgccgacgcgtcgcccatgcgcccggaggtggctatcctgacgcattgcctccacgcctttgcggccatggcgtgccaccccgcgccgcgctcggccatggagcgccgccccggccttgctagcgacgtggtgcgctgcgccgggctggagagggcgcacgacgccgtggacgccgcgctgcgctgcgccgtccacatggccgcctccccggccctgcaggcggccctgctgcgcgccggcgcgctgggccgcgtcacgccgctcatcctgcgctacgacgctacggtgcccggcgccgacggcccggcggccgaggtggtaccggggatgtcgcccggggacaggtaccggccggggccccctgtggcggatgaggccgtgaaccatggattcaaatcaagcgggtcggatgggcccggcgccccagcgagagacccgggcaccgcggagtcggcgcggctgaacgccagcgccatgctcgccgtgcgcaccctggccggcctggccggctgggcgggcccccccggccccgaggcccccgccagcgca

SEQ ID NO: 4743 - DNA, 876 bp, Chlorella protothecoides
atggcctgcaagcctttcacggcccacggcgcagggttcgcgcagggccccagggctgtgccccgacggggatccttcgcacagcccatgagggcggcctccaccgccggtgcttctggcgatgagctgagggacgagctgggtttcaagctcatgcgcaagggcgtgaaggagttcagcggggagaccatcctgacgccacggtgcgcgcaacacagtacggcttgggccaatgcacctggtgggccaaagcatcagatcccgcgtgggtgcgcggccgatgtcatcacgcgtccatcccggatccgccccagattctacaccaccgacttcgaggagatggagaagatgtactccctggaggagaaccccaacctgaaaatggatgagctggaggcgatgctggcggagttcaggcgtgactacaaccagtgccactttgtgcgcaacgctaccttccctgaggcggccaagaagctgacggggaacacgcgcaagatcttcatcgagttcctggagaggtcctgcactgctgagttctccggcttcctgctctacaaggagctgggacggcgcctgaagaaggccaaccccgtgctcgccgagatcttcaccctcctctcgcgcgacgaggcgcggcacgcgggtttcatcaacaagtccatgagcggtgagtgtgctttggggtgggtgttcatcatctatgccacctatctgtccgagaagatcgggtactggcgctacatcagcatctaccgccatctccagcgcaaccccgactgccagctgtaccccctctttgagtactttgagaattggtgccaggtgaggggcaaggggtggggcttggaccggcctggaggtgcaggctggtga

SEQ ID NO: 4744 - DNA, 534 bp, Chlorella protothecoides
atgtggagggattgccaggtcaaggctgtcctgagccctccttccgcaccccaacccccacatgctcaggatgagtcccggcacggtgactttctggcggccaccctgaagtgccagccggagctccttgagggcacggcggcgcgtctctggtcccgcttcttctgcctgtccgtatacatcaccatgtacctcaacgaccaccagcgctccttcttctacgagtcgctgggcatggacaccacgcgcttcaacaagcacgtcatcctggagacaaacaacaccacggagcgcatcttccctgaggtgcctgacgtggagaaccccgccttcttccagcgcctggacgagatggtgaagcacaacaacgccatcgtgcagattgggcggtcggacgcccccaactggcttaagaacctgcagaagctgccgcacctggagcgcatcgccaagggctgcatcctcctcttcctggctcccgccaagcgtgtaggctccttggatgtggagggtgacgccgccttccagtactga

SEQ ID NO: 4745 - DNA, 540 bp, Chlorella protothecoides
  modified_base (13)..(22): a, c, t, g, unknown or other
atgccacacatcnnnnnnnnnngcagggaaggtggggactctctgcggaagcaaagttgccttacccatctgcgaaaatgttggggtactcgtggagcctggcacagtgcccccccccccaccaggatcctcacttgtaagccacacattcagtcacctccattccctcttctccccctcattatgatacacaatgacaggttgctggcctgcctggcgaccgagatcctggaggcggtcaagaagatcgagaacgcggtgctgtcgatggcggcggtgggcctggccgtggacgacgaggcggggcgcgaggcggaggccagtgcgcgcggcgcctgcgccctgctggacgcactgttccccgcgctgctccgcgcgctgggcggcggtggggaggaggtggtggccgccgtgctccctttcctgctgtcctacgtaggctgggtgcgcgccgcggcgcggcgcaagggcaatgccgggggtggcgaggcgggcgccggggccgacggcgccacgaccccggcgcgcggcgcggcgcac

SEQ ID NO: 4746 - DNA, 1941 bp, Chlorella protothecoides
  modified_base (976)..(985): a, c, t, g, unknown or other
atggacacggcgtcgacagcagcgtggtcttcagatccctggtgcgcacctgagcaggggccaagggaggctcatcctgcctgtactgtccttggctgctggtatgctgcaggggcctgctctgttcatgctcacccctccatccccctggcctcgccaccccagtctggagcagcctggtccatctacatcgggcagggcagcggcggcctggccacgggcctgggcgtcatgctgaccggcgcaggggactggtacgctggaagctggcgggacggggctgtctgggggaggggcctgcacgtcttctcgcccccacccgcgggaggagggggtcccagccaggcctggcgcagggattttgccggctcctttgatgggcggccctttgggctcggccgggcaacgtggtgggacggcaggcaggagcatggcaggttccatggaacccaactggtggagcaggtggggtgcgaccgagtcgacgaggtggtgggctcggcgctgcagtcggccagagcagcatgcaggcatgcccggaggctttggcttcgcattgactctgagcatgctgcattcgcagcacaatgcctggcacaagcccctgacctgcccagtgctctttcacgcatagatgagacattactcgtctgcatgacgtgttggatggcggatcgtcccctcgagggcacttgccgtgccagccgtgaccgctcgcgcgcgcaaacgagtctcgggccttcccaagcagcctgccgctggaatcatcgccgcacacccccacctgcactcgccccgtcctctggccggcgcgggaccaccgcgggatgctgggctgaagagactgcattggaggggagtcgggagctgaagcaggtctcgaaggctgtcaatgccactccctggcttgtccccgcggcattgggtcccactgcacccttacctccgctgatcagtttatcgcaaactcttcccnnnnnnnnnncccgcggcattgggtcccactgcacccttaactcccctgatcacatggccgatgacttcgagaaggcggtgttctacgcctttgcccagcccggcactgcccccgccgacgtgtcggcccgggccggcgccgcgctggaggccgcgcgcgcgggtccccaggcctgggccctctgcctggcccaccttcgctcctcggcccacgctgaggtaaaattctggtgcctgcagacgctgcacggcctggtgggcgagcggtacggcgagctggcccccgaccagcgtgacgcgctcaagtcggcgctggtgggtaccgcgctgggcgaccccggcctggcccccttcctgcgcgccaagctggcgcaggtgctggtgggcgtggcctgccgcgagttcccctccgcctggcccgccttcttccaggacctgatcgcgacgctgcccgctggcccccccgccgccgacctcttctgccgggtgctggtcgcggtggacgaggatgtggtgtcgctggaggtgccgcgctcggcggccgaggcgcgcgccagcatggccttcaaggacgccatgcgcgacctggcgctgcccgacgtggcggcggcggccacgcagctgctggccgccagccacgcggccgacccgcccgccgccgccgcgctgctccgtgccctggcccgctacgtgcactgggtggacattggcctggtggccaacgatcgcttcgtcccgctgctcttcggcgtgctgggatcgcgggacgagggcctacgcgccgccgcagcgggcgtgctgatcgagatcgtgggcaagcgcatggaggccgagcccaagctggccctcatccagcagctgggcgtggtgccggaggccgccaagtgggctgaaggcctgccgggggccgaagacggcgacgccgggtcggagctcgccgcgaaatacgccaggcaaggcggctga

SEQ ID NO: 4747 - DNA, 4716 bp, Chlorella protothecoides
  modified_base (216)..(225): a, c, t, g, unknown or other
  modified_base (345)..(354): a, c, t, g, unknown or other
  modified_base (1193)..(1202): a, c, t, g, unknown or other
  modified_base (4215)..(4224): a, c, t, g, unknown or other
atgctgttcacagaacaaggtcgcagattccacccaatgaacaccgttccagacaaccatgcgccatggcaaggtctgacacttgcaggtgctggagtggaaatggaggctttcatgctgctgccaatccctgttcagggtgggaatgatggtaaacggaggccaaaaatgggaaggcgtacagtacaagtattgacattatcaatcgaaactacnnnnnnnnnngtgggaatgatgtgcctccgggaccccagatgcttgctcgtggcatcacataagagaatggatcctcagcgtggcattgttccattcatactacaccatcacaaatatcaagcagatcgnnnnnnnnnntgcctccgggaccccagatgcttgctcgtgacatcacgtaagagaatggatcctcagcgtagcattgttccattcatactataccatcacaaatatcaagcagatcacgatggtggcttatctacggtgactgcccgaggtctgggtgaggcgctcggaagtgatctcatgagcaggttgccccacctcctggtcgggacttggctcctcgcactggtcgcaggtgtgcctgaaatgtgcggtgtcacgacgaccgtggagcatggcgtgcacctcagtgccgctgtctcccctcccgtgaccctgctccagctttcagacctgcacctggccgcccccaactcctccggcgcctgggccgccttcggcgaccgggagggcgacctgcgcgccttcacggcgcacctgctgccccggctccgcccccgagccctgctggttacgggggacctcactgacggcaaacaggccgggggcaggggccagcagcagcccgcggagtgggccagctaccgcagcttcctggcagacgtcgaggccgcgggggtgcccgatgtgcacgacgtgcgcggcaaccacgacacgtttgacgtgccccgacgtggcggcgcggccgacctcttcgcggccagcgcggcgtcggcgcggcgccgggacccggcgcagcgtgtctatgcccagccgctatgggcgtcggagccggaccagcaagggccagagggcttcagaggccagcagggcaccacaccaaggaccgccagggataggtgtttcggtcacgttgcatctcccctctcgccgcgtcttccgcacctacgccccatggcgctggtgatcgnnnnnnnnnnaaggaccgccagggatagccgggtcctgccccgccgtcgtcctgctgagcctggacctggcgccccgcgtgggcctgcgcagcccctccaacttcgtgggcgtcgcagggcccagcctcctgcgcgcgctgcgcgtcggcgccgaggcggcgtggctgggccccggggcgccgccccgacgctgctcggcatcctcccccgcgccgccggtggtggccttcggccactacccgctgagcacggtggacgcggaggccggcgcctggccgctgggcacgctgcgccgcctggcccggcccctgctccagcccacgggcctgctggcggagctgctgcgcctgaacgtgacggcctacctttccgggcacctgcacggcgcctttgggcagcgcctgcacgccatgcacgcgggggggggaggtgcggcaggggtgcgagcgtagtttgctgggagcgggggggatgccctgtcccattgcaacgtgtagcgcacatcaggcggcctggcgccgggtgcccaggagcgtgccgggcccgagaggcagataccaaaacccttttgcggatggacaaccccatcgcagggcccagcggccacctggcagagctggaaaccgcggcgtggaaggacgaccgcaggttccgcctgctggccgtggacggcgggctcctgtccttccaggacttgttcttccatgcccccggcagccccgggcagcctcgcaggccggacgcggccgcccgccttgaccccggtgagttcctcgacggcgccaggcgtgtgggaggctggtcctgcacgtccctcaccacgggggaatccctggctgggagggaggagccgggggtctcacgtctgcctgttgcgacgaggatcgccgtagtcctcccaggtccatcagcttgctcacggtcgaactctccagaggatgcatcctctgtcccatgccgtgcaggacttgtctcacttctcacgacacctcaccttcccccaaaccctgcctcagggtgggcagtcgcctacaggcggcggggctggggcgtgacagccttggatgccagcgcaagagtccatggcgccgccgccctgatcaccttccccccagacgcgcggtacgcgcccgtgccgcagcacgcccgcgccgcgctcccctttgaccggggcaccgtccgagcgctggtgtacgacctggagggcgcagggccgggcctggtgcacgcccgcctcacgtgcggcgccaggggaagtgggcctgacgtggagctggcgcgccaggcgctgcaggcgctggaaccggaggcgccgggcccgacgctcttccagggcgtggtgcggctggaccggggctgccccgggaccgcggaccgggcctggctgcagatcgaagtctccggcggcgcgccgggcgggggcggggcctcgccacgtcaacacgtgcgtctcgagcgcctcgccggcggcggctggaccgttgctcccctgcccgagccgctgcccctggacctcggcctcctcgagacgataggcctgcgcgtcgactttgcggtgctggccttccggtgcgtggggagtggcggcgtcgtttgttcggaggaaggccgcagggttgcagcgtgctgtttgctctggcgtgggcgggcatcgtcctgggcggcctcattctaccccggttcctgcacaccaggggctggggtgagcgcatcgccgccagccccctgtacgccggccctgcgacctggggccaggccctggccgggaccctcacttggcccttggcgtccctggtcctgcttgccggccacacccgcgcctggaccgcagtggctcacaccgcacgcacatgtgccttctgtgtgtagggcgatcgtaggagtgacatggggggggtcaaagttcacagctggtgtatgcatcctacctccagctcggaccctgggcagcggggaggtggctgggggatgcaccccctggcctcctgctaccagggggtgtggcgacgctgctgcccgagggaggccgcctcgtcctctccacgcccgaccccttcttcgtggggctcctgcacacgctcacgggggccctgcctctgctcctctgggtgtcctgcgtggtcgggggaagggcgctgcggggcaggcgacgggcggcgctggggcccgtggagagcgaccaactcgctcagaatccaagcggcagcagcgacagctgcggcgagagcggcggctcccccgcccgtcggtccaggctgtctgccgtgcggcggcgcagcggcagcagggaaggcgtgggcggcaagggcacaacggaggaggagcggcagcccctcgcgggagcgggcagggggacgcctgcccgaactgccaggccagacgcccccttgcccctcctgcgggtgacggcggcccagggcctggcattctgcggcgtcgtggcgctcaacacggtgctgctctacaggcgcatgcccgtctttctgggcccctcctccctctggttttcgccgggggtcgcgtggatgcctgcactcgcccttttgctcacgctctttgtgtgagagcgaatcacatgggttacaaactcagatgcacagagagctggaggatacctctacaccaagcgctagccgctcatgatggctatattcagggtagctgccacgctgaaggactcacatgccatttaaatgctgttcacttgcccaattttgggtctgtacatggcagtgaagggaccttctctttcaatgtcgctccggtgtcagctaggccgtcatggagcacggcaccggcggggcctgcgactcccgtcaccgcctcagcatggtctccacctagaaatgaatgcgcctcgaccgcgtgggatggtgtctggcacagacaaacacatgttcgatttaagcccgatcatcataccaacaaacctgcagcgggagcgctggagcgggcggcagtggccgcatcttcagcactctttccagaccctgcacggtatcgagcggtaaaaggtcatgcnnnnnnnnnngagcgggcggcagtggccgcatcttcagcagtctttccagaccctgcacgatatcgagctgttaaaggtcatgtagaagcaggatatgcgttgcagtcggtaccacttagcatcgagccaggggggtggattcgtgttccacgacgctctcacctttggagggagtcctctgtgtctgacggaggcaacttgatggaggaatcgaaggtagctgggtggaagccgtggctgcggattcgcgcgcttgaagaacttcatgacgtcatgggagctgggcaggcgaccagcttcccgacctatcatccagcacgcttgtggcggcgtgtggtagttccgatgccgcacgccagggggactcctccggtccgatcgaatggaaacctccgtcattctgcaagtgcgtggatgcattgttgtacatgccgtgacgcgaccgcaatagccacgatcgattccatgcggcaggcccgcattgtgatggagcggcgctaa

SEQ ID NO: 4748 - DNA, 522 bp, Chlorella protothecoides
ggcggcggccccgccgcgcgcgccgcggtggccgccgccgtgcaggcccacttccggcccgagttcgtcaaccgcatcgacgagcaggtggtattcgagccgctgacccgcgaccagctgcgccaggtggcggcgctgcaggtcgccgagctgggcgggcgcctggccgatcgcggggtcaccctgaccgccacccccgccgcgctggactacgcggtaacccagtcccacaacccagcctacggcgcgcgcccgctgcgccgctggctggagcacgccgtggtgacgccgctgagccgcatgatcgtgggcggggagctgccggacgactcgcgcgtcacgctggactgccccgacccggccacgggcctgaccttcgacgtgcggcccgatgcggaggccgccgccgcgcgcgccgccgccgccggcagccgtccgggaagctcggccaagaagctgcgcctgaccgaccgcgcgctggagaacggcatggacctggactcggaggacgaggaggagtga

SEQ ID NO: 4749 - DNA, 2790 bp, Chlorella protothecoides
atgctgcagcgcgcgctgccggccgggcgtggccgcgcggcgctggaggcggacctcagcgcggcgcgcctcgctttcctgcgcgacaacgtcgtgctgggcaggggcgtgctggccaccggcgcattcctggagctgagcgctgccgccgcgagcctgctgaccggcaaagtgatcgcagggctggaggcggcgctgcgcgacatcgtcttcgcggtacacgtcagcctgcgcagctccagcggcgcggcgaccaaggtagtgtgcgggacggggcgcctgcccggctcgctggagatcaccaccccggagggcggccgcctgcgcacccacttccacgccagcgtcgccgcggcgctggaggatgacgccaaggtcggtacgggtgccgggcagccaaggggtcccgaggcgggcaccctggcgctgctcatcgcgcgtgcggcaatggcgcaggcgggccgcgcgccgaccgtggtggccctcacctcgccgcccgccggcttctcgccggcggacggcgagacctgggcgggtccccaccccgcccaggtggaggcctcgctggtgtcgcccgcagcgctggcggcgggctcgcccgtgtcgcgcgcgccgccgctgcgcgtcaccgcacgcatcgaggcgctggcgctgcctcctccaaaggagagcgtgcacacgtcgccctcccagaccccggcctggctggggaccacgctggcgcgcagccactacgccagctcccacgcgctgggcgccggcttctcgctggcgggcgtggagcaccggcgcctgctggcgcggcggcctccgctgatgacgccacgcacgccgcgcacgccccactcgccctttggcgcgggcggcggcctggccacgccgcgcacgcccatgtactttttgccttcctcccccggcgcgggcgactggtcgcccgcgcccgggatggcgcgggacggccccaacgccttcgaccgcgcgcaggaggcgatcgaggtggacgccgaggcggtgctggccgcggtgcgcgccgcggtggcgggcgcggtgggcaccgcggtgggcgacaacgacccgctcatggcggcggggctggactcgctggccgccaccgagctgcagcagggactggccgacgagctgggcctggagctgcccagcaccctggtcttcgactacccgaccatcgccgcgctggccgagtacctggtggggcgcatggccggcggcgccggcggcggcgcctcgcaggctctgggccccgagtcatccttggccctgtttgccgccagcggcgcagccgcgctgcccggcggcccgggcagcgctgtggcgctgatgggcgcggcggggcaggaccacctgctccagcgctacgtgcatggttccggcgacgccgcgagccgcgtgccgctggcacgctgggacgtggaccacgcggcgcgcggcccgcgcgacgacggcgcgctggccccccagttcggcgtgtttgtccccggcgtggagctgttcgaccccgaggcctttggcatcatgcgcagcgaggcagcgggcatggacccgcagcagcgcatgctgctcctggcggcgcacgccgcgctggcgcaggcggggggcgtgccctccgccggccgcgccgtgggcgcctacgtcggcatctccaccaacgactacgagcccctgtgcgagcgctccggcatccccatctccagcttcagcttcaccgccagctccgccagcgtggcctcgggccgcctggcctacgtcttcggcctgggcggtcccaccgccagcgtggacacggcctgctccgcctccctggtggccacccacctggcggcctccgccttccgcgagtcgccgctggccggcgcgctggcggcgggcgtcctgctctgcctggtgccggagtccagcctcatgctggcgcgcgcctccatgctgtcccccgagggccggtccaagacgctggacgcgggggccgacggctacgtccgcggcgaggcctgccgcgtggtctacctcgcgcgcgccgacccgcaggacccgcagccgggcgcgctgggcctgctgcgtgccaccgccgtcaacaccaacggccgcgccagcagcctgaccgcgccgcacggccccagccagcaggcgctgctgcgctgggcgctgaccgccgcgcgcctgcgccccgccgaggtcgacggcctgcagctgcactccaacggcacggcgctgggcgaccccatcgagctgggggccctggccgcggtcatgctggagggggtgcggcgcgacgcgccctttgccctggccaccgtcaagggctacacggggcaccaggagtccggggcgggcgtggcgggcctgctggaggccgccgcggtgctgacgcacgccgcgctgccgcccgcgctgcacctgcgcagcctgaacccgcacgtgcgctccgcgctgtcggggcacgccgccgtcgccatcgcgcgcggcgggccctacggcctgcccgcgctgcaccccggcgcctccaccctgggcgtcagctcctttggcgcgcaggggaccaacgcgcacgcgctgctggcgggacccggccaccccgtgaccccgcccttccccctggcgccgggggcgggcccgctctggcagcactctgtctgctgggcggcggccaggcctcaggtgaagggagtgggggtggtgaggcaggtgttccctcgccatgtgcagaccctcgggaggggggggccgccgtcctcaggaccacaggctggagcgatgtgggcgcataccgtctaa

SEQ ID NO: 4750 - DNA, 1965 bp, Chlorella protothecoides
atgcaggtagatggtgtggaaggggaccttgcccgtcagctccagccccatcatcaccatgcgcgccacccagaagaagaggatgtcgtgccccgtctccagcagcgcgccggggtaaaaccggcgcaggtcgggggagtcgccgggccagccgaagaccgacatggggaacaggccggaggagaaccaggtgtccagcacatcctcgtcctgggtcaggcgcagcgcacgccccgggaagcgcgccgcggccagttccagcgcctcggcctcgctggccgccaccacccagcgcgaggtgtcctcggagggcgcgcccggcgcgcccgcctcgtcgccctcccaggcgacgtagtaggcggggatgcggtgtccccaccagagctggcgcgagatgcaccagtcgcgcacgttctccagccacctgaaccaggtggcctcgaactcggcggggacaatgcgcacggccttggtgcgcacggcctcgcaggcggcggcggccatgcccgcacaggccacccaccactgcggcttcagcaccggctcgatgacgtcggaggagcgggagcagacgcccaggcgcatgggattgggcgccgcgccgcggaacaggccgcgcgccttcagccagtccacgatcgccacgcgcgcggcgaagcgcggcatgcccgcgaactcgccggtgccgtcgccgttcatcctgccgtcgtcgtccagcacgttgacaaactccaggccatgccgcttgccggtggcaaagtcgttggggtcgtgggcgggcgtgatcttgaccgcgcccgtgccaaaagccatgtccaccagctccgcgtcggccacgatgggcaggcggcggccgttcaccgggtggaccacgtgccgacccaccagcgcctggtaccgcgggtcctcggggtgcacagcaatggccgtgtccccaaacatggtctccgggcgggtggtggccaccaccacctccccctccccgccctccagcgggtaggcaaaggaggtgagcacgccaaactccacgcgctcggtgtagccgggcacggccagcatcgtcggcccggggacatccacgtagtccacctcgatgtcgctgactgcggtcttcagccggcagtcccagttgaccaggcggtggtcgcggtagatcaggccctgggcgtgcaggcgcaggaaggcctcctgcaccgcagcgctcagcttggcgtccatggtgaacacgcggcggtcccagtccaggctggcgcccagtcgccggcactggtacaggatgcggtcgccgtggcgcgcgacccagtcgtgcacgcggtcgaggaaggcggcgcggcccaggtcgtgccgggtctgccccgtctcccgcgccagctggcgctccaccaccgtctgcgtggcgatgccggcgtggtcggtgccgggcacccagcacacctcgtagccggacatgcgccgccagcggcacagcgtgtcctggatggccagggtcagcgcgtggccgatgtgcagcgaccccgtgacgtttgggggggggatgaccatggcaaaggggggcttgcaggagtcgctggacgcggcaaagtagcgagacgcctcccaccagtcgtaccttttcaggtcaggagaaggagtgggggagccatcggtcaaggcacacgggtgaaacgagggcgacgggagggcgaagatcgagggagcgcatggtgtgcatgcgagcctgcacccgcgtggtgcctgaacccggggccccagcacccagccgccccacaggatccaacacacccataccgacacgccatccaacgcaccagccggtctccacggccttggggtcgtagcccttgggcatcttgccaggcagctccttcttggagcccttgggggtcgtccgcgcctgctccagccatgccgccagctcagcggcctccacggcctggaaggaaggtgcgtcggggcctactctag

SEQ ID NO: 4751 - DNA, 621 bp, Chlorella protothecoides
cccccttccccacacgcagatggtggtgttctgccccaacctgggcctgctcagtgcggtggtgctgtccctggtccccctcctcctgccctttggctggcagagcctgctgctccccgtcatgccctacccccgctcccgcctggacctgctggacgcgccggtgcccttcgtggccggcatccagtacaagacgcccgaggtgtgggcgcgctgcggcgccctggtccgcgtcaacgtctacaaggaccgggtgagcaacgcggggcgcctggcgccactgccctcccgcgccacgctggccgaggcgctggcggggacctacgccgagctgagcgcgctggggcgcacgcccgccgcacgcgcgcgccccgcccaccaggtttcggacgcgcaggccgcgctggcgggcgtgttcctgtccacggtgcagacctatctgcgttccctggtgtccgacctccgcgcctacaccatcaccgacgtctccgccagccaggagcgcaccaggtgaatgggggggttgtgtgtctaggtggggagagggaatgtggtgtttcattgaggtggggtgaagaggaggggacagtcatggggaaacgtggtggaaagaagcagtga

SEQ ID NO: 4752 - DNA, 1290 bp, Chlorella protothecoides
atggagcgacgtccccccccccgccccacgcgcttgacccatcccaactcctggcggggacagggccgtccacgccccttgcaccgctcaccacccctgaggccccatcctccgcttccacccctcccctcgccctctcccggtccctcagaggtccaggtgctggatgacctgctgcacgtctttgtctccacggccgctgcagttgaccacgacgcgcgtgccgtgggccagcgtgggacacagcgtgtccaggtaggccagcgcgtggctggactccagggcggggatgatgccctccaggcgcgacaggagctggaaggcctccagcgcctgcgcgtcggtcaccgacccgtactcggcgcggcccgcgtcgcgcaggtaggcgtgctccgggcccacgcctgggtagtccagccccgcggagatggagtgggggtccacgatctggccatccgggtcttggatgacgtaggacatggagccgtgcagcacgcccacgcgccccagcgtcagcgtcgccgcgtgcttgtcggtggccagcccgtgcccggcggcctccacgccgacgaggcgcacggatgcgtcgcccacgaactcgtggaagaggcccatggcgttgctgccgccgccgacgcaggccagcagcacgtccggcagcccgccccaggcctcagcggcctgcccgcgcagctcgcggccgatgaccgcctggaagtcgcgcacgatctgggggaaggggtggggccccgccaccgagcccaggatgtagtgcgacccctccacgttggtcacccagtcgcgcagggcctcgctggtcgcgtccttgagcgtgcacgtgccagaggccacgggccgcacctccgcgccgagcaggcgcatgcggaacacgttcagcgactggcgctccatgtccttggtgcccatgtagaccacgcactgcagccccgcgcgggcgcagaccgtggccgtcgccacgccgtgctggccagcgcccgtctccgcgatcacgcgcttcttgcccatgcgctggcacagcagcgcctggcccagcgagttgttgatcttgtgcgcgcccgtgtggttcaggtcctcccgcttcagccagatctcggggccggagccgtcggggcggcggtagtgctccgacagccgctccgcgtggtaaacgggagaggggcggcccacatacgtcttcagaaggtggtccagctcggcctacgagggagggggaggggcggctttggttttagaaggtatcaggaatcgcgatggggtgtggtggagtga

SEQ ID NO: 4753 - DNA, 456 bp, Chlorella protothecoides
atgagggcgacacgaggtgcgcatcctcccctgcctgccgccttcccccgagtacccatcaccgaccagccacctcaaccccgctgcagctggagttccgcgattttgaggggccctgcaactcctcagaccacgtccagctggtggtgtcggatggcctcgaggtggacctccccatggcagaggccgtgggatcccttctccaccccccgcctcctcctgcccaataaacaaggcctgtttgacgtggacaaggagctggcccgactgcggaagcagcaggagcgactggagaaggaaagggcggccctggaggcacgactggcccgccccggcttcgccgacaaggcccccacggccgtggtggcggaggtgcgcggtgcgctggcggaagccggtcagcagctggcggccgtgcaggccaagatccaggccctggagtcgcaacggggctga

SEQ ID NO: 4754 - DNA, 930 bp, Chlorella protothecoides
atgactgagtggccggcataccgtgggcgtgacgccaggactgtaacacagccagatccagtgctcttccgtggcggggcctgctctgccctgttggcgctcgggaggtgcagggggaaagtcctgttccgacacccgtggacattcacgcccgcatgcctttcccatctgcccactcactcccagaaactatacgagcaatattcaagtattcattttgcggcagcggcagccgcgatgtcgttgcggaggcgcctgaagaacaacaggccaccggagggatgggagctcatagaggagcaaattccctcatcctcgtacgcggcgcaggtgatagaggactttgagcagcaaatgaaggaggcggtgaacgacgagcacgagggcaagcgcaagaacgagacctcctggaagatccacaggatacactgggagaagaaccggttcatttacgacctcatgtatgtccgcaaggtcatgtcgcgagagctggctgctgcgccaggcggttcgcgtaaagtcaattcttccacactctcaccaccttccccttcccagtacgactggctggtccgcgagaagatggcggacggcccgctcattgccaaatggcgaaagcccgggtatgagatcctgtgctccatgctggccatccagaagaacaaccacaactttgggaccacgagccactgccgcgtgcccatgaagctccgcgccttccagcagcgcatcacccccgacgtccagaccggctgcatctgctgcgcctcgggggacgggcgttttggcgggcccctctggtggaacaccccaatcgaggaggacacagaggagacggcggaggccaaccgcgcggtgtggggccaggagggcgaccagcagccggccccggctcaaggtgggtcgtgttcggtcttgcggtgggtgtga

SEQ ID NO: 4755 - DNA, 849 bp, Chlorella protothecoides
atggcggggtaccgtgacgtctgccccaaggccctgcgtgccgccgcgcccttcctcatcgtcctcgaccgtcccgacatcaagaatctagaacccaaatacagatggtggggaggggggggatgggtgaccttcccgctggctgaggtgtttaagctggacgtgaggggcatgaagtccatcgacgactacaccaagatcctgtccaagaaggggcggtggaacttcaaggaccgccagaagaagttcaacaacgccaaggtgatcaaccacgagtacgtggaccttcctcccggctccacggagatggtggcctcactctggccgctgtacaagtcgacgggggacgctaacggcttctgcgtgctgtccgagaaggagtttgccgatttccacctcaacacgccgggcctgacgctgatgctgatcagggacgtggcggccgaggggaagctgatcaccttctgcacaggcgtgcgggtggaggacacgctgatgcccatgtggtgcggcaccgactacgagaaccccctggccaagtcctgttccacctacttcaatatgtacgagggagggggagcggggcggaactggtttggctggggagagggtgtcgtgggagctggtcgcaaacacgcgctgtacgagtacgtgaaggtggccatcgccgacccagagatcaactgggtggacctgggtgcctcgcgccggcaggccaagaccagcatcgggttccagggctaccctgtgagcgcctacatccgctgcaagaacgccatcatggagtccatcgtggaaaccatggccgccgactatttcaagccctccgagctgatcgccgacccctga

SEQ ID NO: 4756 - DNA, 1545 bp, Chlorella protothecoides
  modified_base (306)..(315): a, c, t, g, unknown or other
atgcaccaggcgggcggcgcggggcggaggcggcagagggaggcctttgacgacgtgtgtgcgcacttcccaccggtcctgcagcatttcttcctcgagcgcttccacagccccggtgagtgggcgggcagggctggaggtcgagggagagcaggggccagagcacggtgcacactgcaagcatcttttaaaatccttggggcccagcccaccaccacgccggtaccagctcggtccccccaatcctgcacctttccttccccccacccaccccttttgtcgactgcaaacctgcccggacactgnnnnnnnnnnccaccacgccggtaccagctcggtccccccgatcctgcacctttccttccccccaccccacccctttgtcaactgcaaacctgcccggacactcccctcacctccccctcccccgctgttcacctgccacaatacaggcgcgtggcacacggcccggctggcctacgtgcgcagcgtggcggccgccagcatggcaggccacgtcattggcctgggcgatcgccactgccagaacatcctgctgcagctgcgcggcggcgaggtggtccacatcgaccttggcattgccttcgagcagggcaagtttctgaatacgccggaggtggtccccttccgcttgaccccggacctggtggctgccatggggccgcacggcgtggatggggtgatgacccgttgctgcgaagcggtgctcagggtgaggctgcggggacggcagtctctgatgctgactgcttgtcggggcaatgttggtggtggtgggggggggggacccggatgtcaggtgtggagaaggtgatcaaaccatggccagcgcgccagagggaatgggaattggcaaggcgatgggtcgtgagggggcgagggcgggcttgggggggagattccatcacggcgaccctgaatagtaagctggcaagattccgctggttcccagcctggttctggcaagattccgctggtgcccagcctggctgtgagggattggtcaccatccgagcagtcccacttgtgtgcccatgtgccgccttcagtgcacctcattcccttctcccaccccacccccaggtcgtgcgagcccactcggagtcagtgctgacggtgatcgaggtcttcatccacgaccccctgtatcgctgggcgctgacggtaccccaggcccacgcgcggcaggccgggaacgaagggggcgggctctcggaggggccgggggcggccggggtcatcaacgccgacgccgagcggaccatcctgcgcatcaagcagaagctccgaggcgcagagggcggtgagccctggacggcagcacgcttgccaggggaggggttggaagtggttcatcctgccgccgatctgcctgctcatgcccttctgaccctgcgatggggacgcacagggcgtggaggggcaggggcagcgcctgctacaggaagccatggacccagacaacctgtcgcgcatgtacatcggttgggcgccgtggctgtaagggtgacgccggctgcttga

SEQ ID NO: 4757 - DNA, 726 bp, Chlorella protothecoides
  modified_base (40)..(49): a, c, t, g, unknown or other
  modified_base (547)..(556): a, c, t, g, unknown or other
atggccactaccctggcagagtcaccaaaaacctcatccnnnnnnnnnncatgccacggtgcaactttgaagcgccagataaacccccatggccactatcctggcagagtcgccaaaaacctcatccctccccctccttccatcccacaagatgctggcgccggcgcggcccccgccgcagggcctggcttccaggccgtcctgacggagctgctggagcggctttgccgggaccaccccttccacgcgctcttccaggtgctggccctgaagaacggggacaggggcagggacggacggcgcggggtgtcccgaccgggcatgacctatgccgtggaccacgccaaggtcgccgcagcagaggcgctggtggcgcgattgaaggctgccggcgcgccgcccgctgcgagggagctggtcgcccaggtgggtgggaggttggggctggtaggatcttgtgagggatgtgatcctcgcagccggggtgcgctgaagctgcgctgcctgtgctcctcttgcgtcatcactggccattgctgcctctgtnnnnnnnnnngtgggtgggaggttggggctggtaggatctcgcgagggatgtcatcctcgcagccagggtgcgctgaagctgcgctgcctgcgctcctcttgcgtcatcactggccatcgctgcctctgggtctgggctgcgactcatgctctgccagaccacccagcccccctccctag

SEQ ID NO: 4758 - DNA, 297 bp, Chlorella protothecoides
atgcacgccctcttcttgcaggccgtggaggagagggaggagcagatgctgcgcgtcgcgctgcacaactacgcccgctgcctaagcacaggccagctgtacgacctccccgtagccttccgctttgtccagctctggctggagctgggcccccgcatcgcctgggtgaacgaccacgcggcggaggccttccaggacgcccccagccacaagttcctgcccctcgtctaccaggtggcgtcgcgcctctccaccggtgggcgggggggtagcatggggttcagggggttgtcctag

SEQ ID NO: 4759 - DNA, 1320 bp, Chlorella protothecoides
atgaagcgcaacaccgcactgacgcgcaagctgcgcacgctgacagaggagaccagggcgagcgtgctggaggacgcggctcggaccaaccagtccaagtacgtcgccgaggcggcggcggcgctggtggaggccccgcagaaggcgcgcgacgtggcccccgccgccgaggtggcctgcgcgttgcaccgacgctaccccgactttggcgaggccctgctgggcgcgctgcgccgcgagctggacgcacccctgcccggggacgaggagcgcggcgccctggcccgtcgccgtgcgctcctgcgcctgctggccgagctgacggggctgggcctggcgccctcccccgccctggtgatggccgaggcgcggcggctggccgccgggcgggaggagctgctgggcctgcccccagcccatgccccgccgccggggtccgtggacgcggacgcagggacggcggctgactggcgcgcgccggccgaggcgcgcgaggcgctgtcgaccctgctgcgcggcgcgctggcggcagcccgcgcgctggtggcgcgcggcgacctcgcggagagcacgctggcgcgctacgaggcgcggagggaggcgcgtgacgcgctgctccgcgcctgcgccgctctggccgaggccttggacgcgccgccgccggcactgggcgacgaggagggggaagaggacgagggccggggcgaggaggtggcggcgcagggcgcgggggcggccgccgtcgcgacggagtcgccgtttgaggacgaggagacccgcgccttctatgaggacctggtcgacctgcgggcgtacgtcccggccgtcctgctgggacccccagatgccggcgcagaggcaccggtgactgaccaggagacggggtcggcgccagacgatggtgacgctgatgtgtcagcagccgacgtcgaccacggcgacatgagcaaggctgaggacccactccccgaggctggcgcgccgggtcccacatggcccggagcgggtcccccggtatcgcccgaggcggaaggcagccctgccccaggagcagcagaggagcagagcccgctgcagaagcccaatgagctgcaggccatgctggcccggctgccggtctgcgtgagccgggaggaggccgacgaggcggcgctggccttctgctacgcccagtccaaggcggcgcgcaagcgcctggtgcgcacgctgtgcgacgtgccggggggcgcgctggcgctcctccctttctttgcgcgcatcgccgccaccctgggccgcatctggcccgacatccccgccggtgaggggctgaaaggatga

SEQ ID NO: 4760 - DNA, 846 bp, Chlorella protothecoides
atgcatcactctcccccacacatacctcgctcccctccaggcgagctgctgaagttccaggctttccccgcgggcgtggccttccgcgcgctcaagtccctgctggacgactttaccgggtccagcatcgacgctgcctgcgcgctggtggagaccgcggggcgcttcctggcgcgctcgccggccaccactgcacggctgaacagcatgctggacatcatgatgcggctgaagacagcccgccacctggacgcgcggcagagctcgctcatcgactcggtctactccctggtcaaggtgggagggagtgatttgtgggacgcatgcagggcccgccggtccttggggtgtgggctctcaagcatcgcgctccacagaccccggcctgacacacacacacgcgcacacacacacacatactgtgtcatacactgccccactccccaggccaagaacctggtgcggcagcgcaagcagcgcccgccgctgcactcctacatccgccacctggtgtactcggggctggaggaccgcgcggcagccacgggccccatgaaccgcctgcgccgcctgccctgggccgagtgcgaggcctacctggttcgcacgctggtgcgtgcggcctgcaagggccgccactcggcgctgcccagcctggcctcgctggcggctggcctggcgcgttaccaccccagtctgggcgtggccctggtcgactcgctgctggaggatgtcgccgtgggcctggagagcccgggagagggaggcggggcaagccatgctttcatgtgcagcgccggcaggccctctgcaagtccgcctggcgcgaggggcgcccctcgttga

SEQ ID NO: 4761 - DNA, 1122 bp, Chlorella protothecoides
atggcggcggtgtgcttcctgggggagctgtacaactacaagctcgtgaactcgggcgtggtcttccagaccctccagctgctcctcaccgcgacacccgagggggaggggtattcagcgccgggacaggggtgggtaggggatgtgagggaggctggggtcttgaagtggtccctgtggcccctggcctttgcttccacaattctcgtggagtgcatgctgcagctcatcgtcccggatgcctccctggacccccccggcaactacttccggatcaggctggcctgtgcgctgctggagacctgcggctcctacttcaccaagggcccggcgcggcgccggctggacgccgcgctgacgcgcctggccgcctataccctgtccaaggctgcgcccctgcccctggacgtcgacgtcgacctgggggacctccagacacggctgggggtggccatgccctccttttccaccctggacgcggcgctggccgcggtggccgagctggactccagtggcgaggcgcaggaggggccctccctggccgaggaggaggaggcggaggaggagggcgaggtgagcggggcctccacggcgagcagcgaggacggcggtgcctcctccggggaggaggagagcagcagggaggaggaggacgcggagggcgccggcgaggacggcgacgaggaggccctgctctcccccgccgccaccgctgtcacccccgtgcccgtggaggtggacgaggatttcgagcgcgagttcgcggccatgctcctggagggcaagcgagggggcgcgccctcaatcgccgccgacgcccagaccccgaccgtcagcgtgtccttcaacgtcatgctgcgccgcggcgcgcgcgacacgcgcacgctgcgcacgctggccatccccgtggcgccgtcggtggaggcgggcatccgcgcacgcgtggcggccgaggccgcggagcgcgcgcagctcaagcgcctggtcctggaggccaaccgccgcgacatggccgacgaggcggagagcgaggcggcggtcctgtggcagggcagacaccgcgccaagggcggcagccaccgcgtcagcttcggcggtgctggtcacaggggcgtcgggtga

SEQ ID NO: 4762 - DNA, 2316 bp, Chlorella protothecoides
atgggggtgcatgcgagcctcaaagaacatgcagggtatgggacggcagccggggggatgccagcgtccgcagcgcctgaagtcgcagccatttcctgtacgccgctcccaatggagcgcccgcgccgcgctgcctcgaccccacctccacgtcgcgggccggcccgcctcctccccaggctcgccgcccgccgtgcccagccctgccgctcaggagacgtggcggacctgtacggagcgatgctgctggctggtgcgctggatgtcggacaccaccaccaccaggtccttggcggccaccaggttgcggcgcttgagcagctcaaaggtgcgcgtcacgttggtctccgggtcgtcctcgaagcggacgaggaaagggatgacgccccagcgcaggttcaggcgctgcctcacctcctggctgtcggtgaaggcgaagatggggcagtcggggcggtagcgcgacagccaggaggcgttgacgccgcggcgcgtgaacacgaagatggcggcggcgcccaggttgtcggccatggaggcggccgaggcgcagacctcctccccgatgcgcgcgtccagggaccccgcgatgcgcggcagcgcgatggcacccgacccctcctcccggcaccagccctcgatgcgcgcggccacgatgcgcagcacctccagcgccttttgcgggaacagccccgccgcggactcgcccgacagcatcagcgcgtccgcgcgctggcgcaccacgtcggcgatgtcgctcacctcggcgcgcgtgggcgtgggcagctcgtgcatggactggagcaggtgggaggccacgatcaccggcttgcccgcctgccggcagcgcaggaccacctctttctgcacggagggcacgtcctccaggcggatctgggcgcccaggtcgccgcgcgcgaccatgacgccgtcggccgcgtccacgatttcggccaggttggggatggagtcgggggactccaccttggcgatgacgtcaatgtcgcgcgccgaacggctctgaatgtaggacttgaggttgttgatcacgtccgccgacttgacaaaggacaccgcgatgaagtccacgccctgctgcactgcaaagtccacatcaacccagtccttggcggagaggacagggagcatggcgttcttggcgcgcacgggccggccaccgcggcggaaggtcaggttggcgcgggacagcaccaggccggggtccaccacgcggcagtacacgtcggggccggccttgccctccacctccagggacaccatgccgcccactccaggtcgccaccagcctcccacagagtcgacaccgcaaggtccttccctcaccctcacctgcacgtcctcggcaaaggcgtcgtaggacacggcgatggcggcgtcgtcgcccaggctggcggccgggtcgcgcacggtgaacaccagctcctgccccgtctcagccttgagcggggcggccatctccatgatgtgcacctcgctaccctgcgtgtccatcatgatggccacggagtagcccttctccttgttcagggcgcgaatgtgggaaatgatctccgcgtgccaggcgtgcgagccgtgggacatgttcagccgggccacgttcatgccgttgctggccatggcgtccagcatctccttggactcgcaggccgggccgatggtggcgatcagcttggtacgccgtgtggagcggaagcctggtgcagaagcatgttgggttggggggttgagaacgtgctggggccgctcgctcatagggggcctggagtgcccagagcaagcgagtcggtgctccggctaggccgacccatccacacccactcgccccgatccctgcgcagatgggactcccgtacacaccaaacatgcacacatcccaccattgctgctcagctcctgctccagcacgctgtcgacctcgatctcgggggtgcgggaggtggtcaggggggttgcgacgtctgccactgccacgctggaagagcccgccctgcggggtttccgcccgttgccctttgtgttggagctggcaaacacgcgggcggggtgaaggctggagcggtggctggcaggcagcgcggccggtcgggccaacccggcacgggcgagggctgccgacatggcgtgggtaggggtgggggggggaggtgcgcggtgggtcgatcaaacttggtgcgctgtcatcacttgatgcgctactggatctcaatcggccggagagcctgcgggtgggtggtacttgaagctggcagatggctgaagcaggcgggacgcccccccggatcacgccttccgtga

SEQ ID NO: 4763 - DNA, 1743 bp, Chlorella protothecoides
  modified_base (1548)..(1557): a, c, t, g, unknown or other
  modified_base (1646)..(1666): a, c, t, g, unknown or other
atggtagtctcagctttaggcctctccgggcggaggggggccctggccgccctccgcgcccttgggggaagcagacccagccagcagaccggtgcagctgcatgtgtttgggggttgttgaggagcgatgccgcggctttctcaagcctacaaggcgtgccgtctgtgggttttagcctccgggccctgcccacgacagccagctgggtgccggctgttcgctgcatctccagcacgcctgcagcctggaagaccgtggaggtggaggttcccagcatgggagagtccatcaccgagggaaccgtcgccaccatcctggtccagccaggcgagacggtggaggaggactccgtgctagccacgctggacaccgacaaggtctccatggacatcaagtaccccaacaagacccctggcgtggtcaaggagtacaaggcggcggagggcgacacggtcaccgtgggccagctctttgcggtgattgaggagagtgagggcggtgccgcccccgccaagaaggaggaggcgcccaaggaggaggcgccaaaggaggaggtgcccaagaaggaggcgcccaagaaggaggagacaaagaaggaggagccgaaaaaggcctcccccccgcccaagaagcctgagcccgcttctaagccggccgccgctccgggcggcgcccccccctcctccggcccccgccccgagcgccgggtgaagatgacgcgcctgcgagcccgcgtggcggagcgcctgaagaacgcgcagaacacgtacgcgctgctgaccaccttcaacgaggtcgacatgaccgcgctgatggacctgcgcaaggcccacaaggacgccttcctggagaagcacggcgtcaagctgggcttcatgtccgccttcgtcaaggcggcggccaacgcgctggagacggtgccggcggtgaatgcggtgatcgacggcggcgacatcatctaccgcgactattacgacatctcggtggcggtggccacgcccaaggggctggtggtgccggtgctgcgcaatgtggatgccatgagctttgccacggtggagaagaccatcaacgagctggggaagaaggcgcgggacggcgcgctgtccatcgacgagatggcgggaggcaccttcaccatctccaacggcggtgtgtttggctccatgctctccacgcccatcatcaacccgccgcagtccgccatcctgggcatgcacgccaccaacatcaagcccgcggtcgtcgacggccagatcgtcgccaggtgcgcgcgtgagggtgtgttcttgggggaggggtgcgatgagaggcgacatcttcagccccatggcatgaggaggaaggggaagcattctttagagaccacaccccttggttactgcgctgcacgcccccctcagctggctcccctccagccaatcctctacccacctgaacttcaggcctctcatgtacctggcactgacttacgaccaccgcctcatcgacgggcgcgaggcggtcaccttcctcaagcgcatcaaggaggtcatcgaggacccccnnnnnnnnnnaagcattctttagagaccacaccccttggtcactgcgctgcaagcctccgtcagctggccccccttcagccaatcctctacccacctannnnnnnnnnnnnnnnnnnnnatgcagcccttcagcaccactggctgaactcacacccacgccgtggggctgatgcccccccatctcgacactgttag

SEQ ID NO: 4764 - DNA, 909 bp, Chlorella protothecoides
  modified_base (783)..(792): a, c, t, g, unknown or other
atggcacgtgcgcagcagcagctgggtgccccacacggcacggtttcagctgggcgcgagctctcggggaagaccatcagcgctactggggtagcgagtgcccggcagagtcagttcctggctccggtaaagaggcggagaaccgacaccccagtgttacgggactgggtagaggtggacaccttcggccatggatctagtggtggcaaactgtccttcccaggtgagatgcttcgacgcggtcggcacattcacgagatcatgcttgctgtaactgctgcccgcaagatcactccagcacacacctccgcccctccccacggagcaggatatggccaagacaaacaaggtgtttgtggccccgaggactctggcaaaaggcacagcctatctcgagatatccagctagtgagtccttttgtgggtcagtcgacataccatggcctggcagcaggctcttcaagttgtcagccgcgcaccttcatcccccccttgcacagtgtctttctggcggaggaggagcccagcatgcagccgggcaaggttggcatgaatgcgatccagcgcagggtcatccgggcgagctcgggggacaccgtggcggcccagcccttcatcccccctgggacccactttggcgcggtgctcctcaacgccgagctggagcccatctcgcgacgcgggggggaggtagacctgcctgcacccgaggtggagactcacatccagtccagattcgcagaccaggtgatgagtgcatgccgaagagagttgcttgttgcnnnnnnnnnngcccgaggtggagacccacatccagtccagatttgcagaccaggtgacgagtgcatgccgaagagagttgcttgttgcttgtggagcaacgagttcaggccgtggagtggcctctga

SEQ ID NO: 4765 - DNA, 675 bp, Chlorella protothecoides
  modified_base (83)..(92): a, c, t, g, unknown or other
atggctgcatctcgatgctggagtggttctaccccacaaggcctccatgctgtacgtatggagactgtctcagtcccatggcnnnnnnnnnntgtggagtggcctctggataggaatctattgaatcaatggctacatctcgatgctggagtggttctaccccataaggcctccatgctatacgtatggagactgtctcagtcccatggctgtccaagccatccgcctgtgtgcttgccagcaggacactgccatcaccccaccccctcacaggtcttcacatcgggtcaggagctgacctttgagttccagggcctcaactacctgctgagagtcagcacgctgaccgtagtggtgccagggggggagcagcagactgtgccgcgggccatgctgtccctggccaccagctgcgtgtttgaaacaagaaaggggagcggcatcaagattgtgggccagaagaggtggggcgggcggctttggatcagcgccgcgtgcattactgtctgcacttggcaggatctctcgaatggattccagctcgtcaggagtgtagtacatgcctggttgcgtgtccatgatgattgtggcacagctccacactcccccatcacacccctcgccccccagcatcatgacctcccagctgttcaagcagcgcgaggtgtcctttga

SEQ ID NO: 4766 - DNA, 834 bp, Chlorella protothecoides
  modified_base (210)..(219): a, c, t, g, unknown or other
  modified_base (666)..(675): a, c, t, g, unknown or other
atgggcactgggggaggaggcggcagtatcccgggaagtgagcatgaggagagtcctgcgtttcaggctgcaaggttgttaagactcactgcatgcaatggttgggaggatgtgcatccttggctgcatcctttgtctcctcatcgcagccagctcccttctacaccaccaggcgagcgttcgagtcccggcgcctccccccctcggttnnnnnnnnnnagcagatgtgcatccttggctgtatcctttgtctcctcatcacggccagctcccctctacaccaccaggcgagcattcgagtcccggcgcctccccccctcggttgtggagcggctggggatcaaacaccggaaaggcatcctgctctatgggccgccaggtgagatgcttggtagagtgtgggccgatcatctctcgcatgctcagcatggccccagaatatgcacgcctggcacccccatctcaggcacggggaagacgctgattgcccggcagctgggcatgatgctgaacggcaaggagcccaaggtggtgaacgggcctgaggtgctcaacaagtatgtgggggcctcagaggagaacatccggaacctcttcaaggcaaggcgtgagcgtgggtatgaagggcagggttgggggggagcttcaaatacggatgctgaggcnnnnnnnnnnagagaacatccggaatctcttcaagcgaccttgtgctggattaacggaaatgctggagctaaaggaggatgtggttcccaacccaaggactcaacgcgagtacttacatcagtaaaatctaaacctaccgtgcacaggacgccgaggaagactacctga

SEQ ID NO: 4767 - DNA, 519 bp, Chlorella protothecoides
atgccacctgcgcttccctccacaagggatacccacttcttgctgaggttgccaagcgatctctgttccgtcatgcagttcagaccgcaaccttcttcatccgctgactccgtcgctgtcacgggcgccaccacctccagttcacccctgcctctctccacccatcctctgcagtctcgcggcagcgtgcgggacgggtcaggcgtgcacgacaccatcgtcaaccagctgctgaccaagatcgacggcgtgaacgcgctgaacaacatactggtgatcgggatgaccaaccgcctggagctcttggacgaggccttgctgcgtgaggggcggctggacgtccacatggagatcggcctgccagatgagaacggccgcctccagatcctcaaggtgaggagtcgtgttgtggggatggtgaatgaggacaccaagcagggtgcacatacccatgaaatcgaggggggaggttgtgctttgtgtgcacggaaacacatgggcagcctgtctccctgctga

SEQ ID NO: 4768 - DNA, 1044 bp, Chlorella protothecoides
atgcagaggaagagtgaggagcccgaggctttgcagccaccccatgcgccccatgctcggtcatcttcgatccatgtccctcccagcgctacagtatgcacctcagcacacacttctcctttgcctcctcgtgcacaggtgaaggaggtgtacctggtgtacctcttggagcagctcgaggcgctgaagctgcgctccgccattgtttttgtctccacgcgccgcaactgctccctgctccagcacctcctggccgaactggggatcaaggccgcggcgctgcactccggcctgccccagcgcgaccgcgtggcggcgctggacaggttccgcgcgggcgtcgtgcctgtgctgcttgccaccgacgtggccgcgcgcgggctggacatccccgacgtcgatctggtggtcaactacgacctgccccaccttgcgcgggattacgtgcacaggtgcgcgtgttggggcagtgtgtgtgcagaggggtggtggatatatcgacgtgtgggtgcaactgcacctggagtgcacagcagtgttcgtgcaaggcctctttttggacctcatggccatgtagtttgctcctcagggtcctcctcaaagggtccacagcagggctgggtagatgcacaatctgtgcacccctccatgccataccagcccctgatgccaccgctcggcccccctcaccaaatccatcattgcagggttggcaggacggcccgcgcagggcgcgccggctggtccctgagcttcgtgacgcagtacgatgtggaactagtcagggccatcgagggcctactgggcaggcagctggcggccttcgaggcgccggagaaggaggtgctggcggggatcaccaaggtctatgccgcgcggcgcatggcggccctgcgcctggcggaggaggaggacgcggcgggggcgacagggcagcggcggaagaaggcgcggccggccgaggcagaggccgagcggccaaaggggaggccgggcggtgagcgcaccccgaagacggccaccattgcacgggaggaggtgtga

SEQ ID NO: 4769 - DNA, 435 bp, Chlorella protothecoides
atggtggaagagggcggcatcgccctcttcgccaggcctccttccaagctcaagacaagaccgaggaaggaagaaaatgcactacccaagaccgtgactcgccccgcagcggtggcggtgcctcccagtggcgccaaggcgggtgaggacgacaccgccacctttcgctcgctggggctctccgactggatggcgggggtgtgccgcgggctgggcatgccgtcgcccaccgccgtgcagcgtgcctgcatccccgccatcctggctgggcgggacgtcatcgcggtgtcccaaaccgggacgggcaagacggcagcctttgcactgcccatcctgcagctgctggcgcgcgacccctttggcgtctttgccctggtcttgacgcccaccaggtggctgggaagatggattcttgcttgttggaggatggcctga

SEQ ID NO: 4770 - DNA, 324 bp, Chlorella protothecoides
atggccgacttgtccaagccggtggtggaggagaacatccgcgtcacgcgcgccgacttcctgcgcgccctggacgaggtgaggccctcctacggcgccgccaccgagacgctggagcagtaccgaccgggcgggatgctggacatcgggccgcagtaccacgccaccctggcggagctgcagcagctgctggaaagcgtggagcagcaggaggcggtgcccctctccgccgccctgctctggggcgacagcggaacggggaaaacgggtgaggctcagtgtgcatggctggggtggtgcatggttggggtggtgctggcatga

SEQ ID NO: 4771 - DNA, 951 bp, Chlorella protothecoides
  modified_base (540)..(549): a, c, t, g, unknown or other
atgggggactctggcctcgacctcacccacaccagctggagggacgacctctggcttcaggcgtacggcatcagcccgctgaacatcctcgactacttctccctgagccctttctacgacaagaactgcagcaatgagggtgccaagcagcaaggcctggagctcacacagctcgccatcctcgcgcccggcatcgagtacgtgctgcgggactcccagccgccccacctctttgtcatctgccgccagcaccgcgccgcgccgtcggcccctgccgccccacaggcggtctactacgtgctggatggcaccgtgtaccaggcccccgctctgcacgctgcgctcaccaaccgcatggtgaggcgaggcgacggtggcggcgccatgcgcggtgttacaggggtttgggggactgatggctgggaggcttgccagcgccctggacatgcactgcgggtggagcaaggtcctcctcccagtcagaatcccgcatctggcactttgtttccagccacagccctttcactgcacccgtgccgnnnnnnnnnnttgacaagggggtatgaaagggacttgacagtctggctcctgggggtgccggcgttggtcactgtgtggcgtctccatagggagcaaggtcctcctcccagtcagaatctcgcatctggcactttatttccagccacagcgcttttactgcacccgtgccatcggcccgcggcttcacacactctgtgccccttcatcgcaggccaggtgtcggttcagcatgcaggcggcctttacagcgatgcaggaggatctgcacccatgcatagcaggtatggcgtgcagagtatcccggcgatagtgctcgtggtacctgcgacctgggcagcggcgggaggctggccctggaccctgacaattcccctgttcccactcaagagcccgtcatacagggcggcctga

SEQ ID NO: 4772 - DNA, 447 bp, Chlorella protothecoides
atggctccgacccctcagcacgtgtgcctccaccctttaccgcgctttcaacccctatactctcagggacgcctccctcgcctcacaccttcccctcccccccccttcaataccccccaggtgcgaagcgtccccgtgaccctctccctcacggaccttgctgacctggcgctgccccccccgcgaatcagggaggtgtccagcgtggaggcctccctgcgcctggactccatcctgtcggcgggcctacgcctcagccgctccaaggcagcagacctcgtgcgccagggctccgtgcgggtgaactggcgccccgtggccaagcccagcgtggagctgagcgcgggggacatcatctcctgctctggcaaggggcggctggtgctgcgcgatgcgcagcccaccgccaagggccgctggcgcgtgaccatgacgcagaccgtgtga

SEQ ID NO: 4773 - DNA, 621 bp, Chlorella protothecoides
atgttggttcgcaggctggttcccctgcctgccgccgggtgcacgctcgccgcgcccagtcctcgcttcaggcacgcggcgaccttcgcccgacggcacggctcctcctcggggctgctggaggagctggatcgcgaggtggatcgggccctcgagcgcgcgacgcgggccacggtgacttggacccccctggccacgggcttcgtctcccccgccgtcaccgccgccgtggtgtcggccctcagcacctccgcggacacgggggtgataccctggggcggctatccacaggccgagcgcgccaggctgctgctggggccgcgagacatgctggatgtgtgggcgggggaacccgccggcgcgccctggccgccgcccccgccgcccatccagatcctgcacgtgcgcggcaacttcctgttcgaccccggcaggcacgccgacttcctgggcgccgtgctggggactggcatcgagcgcagcatggtgggggacgtggtgggggtgggcgacaggggggcccatgtctttgtcagctccagcattgtcccccacctggaggccagcctgacccaggcaaggaggttttgggggagtggaagggatttgaactatggatga

SEQ ID NO: 4774 - DNA, 789 bp, Chlorella protothecoides
atgagatcacaaagaacgttgggacgagcttcgcaatgtgtatggcctgtcagagacacggctggaggccgatcccgggattcaagcgtccggcatgtggcagggcatgcgggcgcgaagcgccccgatgcctgtgctcccgtctccctcctcacaggacgaacccacaacgtgcggcaagggcggactctgccacacttatatcatcctccaccataccgagtcgcagctaggattttggccaacctggctgtcgcgggtgcgacagtcctgtttcgtgccgcaacgcaagcataccgccaagccctcgtcaacgcccagaagtccggtgtgacagcagacagcgtgggcgccgccgcccgtctaggcaagcagctgacccgccaggaggccgagcaaatactgggcatcgaggcaggggcaacgtgggaagagattagcaaggtgcgtggacctttgcggctcatgtgggtgggctattgtcatgagtctgggacatgcatgtggactgactgcgggctgcattgtgccacgctgtgcccgcgccctggtcatgcccacgccctggtcagtttgccctcaatgcctccctcctctgtgcagaagtacgagcacctgtataaaaagaacgaggaagccggctccttctacctccaatcaaaggtctaccgcgccaaggagcgaatagagcaggacctgcaggctgagggggtgcccacccccgacctgacagacatccacacccagcagcagcagcaacagcaaggggcaactgggaaggacgcgtga

SEQ ID NO: 4775 - DNA, 1992 bp, Chlorella protothecoides
  modified_base (153)..(162): a, c, t, g, unknown or other
  modified_base (1633)..(1642): a, c, t, g, unknown or other
atggaacgcagtgggcagtctcaccggtcctccgggaacctgcacacccgtgcgggcggtctgccatggcgagatgtactccagctgcaggcgcctcccgactgcttggcatgcgctggagggccgcaagccggccgaccaccgtacggtgcnnnnnnnnnnggtctcaccggtcctcctggaacctgcacacccgtgcgggcggtctaccatggcgagatgtactccagctgcaggcggctcccgaccgcttggcatgcgctggagcgccgcaagccggccgaccaccgtacggtgcgcgcgggggccaggggctcccctgcccggtcatcctctgaccgcggcctgcagcaccggcagggttccctggacggcgaggtggcccctcggggccctgaccgggggtcccacggcagcctgcactcatacgacgaggagggggagggccggccgggcgggggcctgctgggcggcctggcggccgccgccgacggcctgcccgcacgcaccaagctcatcgccgccacctccgcgtccttcatgatctgcaacatggacaaggtcaacatcagcattgccatcctgcccatggcccgcgagttcggctggtcccccaccgtctcaggcgggttgtgattcctgtcacccagttgtcggacatcacatgccgccctttctatcccaaatctccggacccccaccactcacccacacgcccgccactcccaccacaggcctggtccagtccagcttcttctacggctacctcatctcccagctccccggcggctggctggccgcgcgcctgggcggccgccgcgtgctgcccatcgcggtggccctcttcagcgcggccactgccggcgtgcccttcctggcgggcacgctgctgggcttgtgcgccgcgcgcgcggcggtgggcctaggcgaggcggtggcgccctcctgcgccaccgagatgatcgcgcgcgcggtgcccgtggcggggcgctcccgcgcgactgcggccgtcttctcgggtctgcacgtaggtgcgctggtgggcctgctggccgcgccgccgctgatcgccgccggcggctggcgcgcggtgttctacgtctttggcggcgccggcctcgtgtggtgcctgggctgggaggccctgctggcgcgcctccagcgccaggacccggccatggtggccctgctggacggcagccgcgggccgcggcccgtgcgacgtaccggggcgggcgccaggatctccccgccggcgtctgcccccgccccggcccccgcgacgccctggcgcgccttcctctccaaccgcccgctccaggccctggcctttgcccacttctgcaacaactggttccactacgtcatgctggcctggctgcccacctacttcaccgaccgcctggcgctcgacctggacggtgccgcgcgcttcgccctgctgccgcccctggccgccatcgccgtctccttcgcggcaggcaagatggagtggggagggtctcgggttgtttcctttctgggggggaatgtgtgattctgggtcctgcggtccagacatcgcagagggacatgcatggccgcaggccacccgccctgatccatgcgataccctttccccacccacccaccnnnnnnnnnngggagtggggagggtctcgggttgtttccgttttgggggggatgtgtgatgctgggtcctgcggcccagacatcgcagagggtcatgcatggctgcaggccacccgccctgatccatgcgacgccctattcccacccacaccctattcccacccacacccacacccacaccgacacccacacccacacccaccctcacgccaggctccggcgcggacttcctggtggagcgcggcgtggcggtggccacggtgcgcaagtctgcgcagggcctggccttcctggggcccgcgctgtgcctgctgtggggctcccaggccactgacgacgccgggatcgtggccagcatga

SEQ ID NO: 4776 - DNA, 1236 bp, Chlorella protothecoides
  modified_base (616)..(625): a, c, t, g, unknown or other
  modified_base (795)..(804): a, c, t, g, unknown or other
atgcattgcttgcagcagccgggtcgatcctcccccacccccaatggaaccccccctccgccatacactcgccttgttcttcaggtcgatgatgcgctggaccttggcatcagtgacggcgcgctcggcggccaccagcttctcgcgctgctcggcggaggagtagaagaagcccgcgttcacctccgacttctcgtactccagcgagatgttggcgttcaggatgaaggcccgctccacgctgcgtggcatgtccgggtggcgcgagccgtggtccagcaccaggccccgcaccagccgcgtgtcggtgtccagccggtggcgcatgtgcatgatctccaccatgtgcaggtcaatgggcgcgccgtcggcggggcgcactatgcacaccgcgtcggtcacgatgtcggtgagctggtcggccaggtcctcgcgcagcttcgtgcggagcgccgacctggcgacgcagcgcagggcctcgcggtcggacacgtccaccgcctccttgaagccgtccaggaaggtcagcgccgcgcgcttggccagctcataaccctgattgttttgggaagggtgaatgggggagtatgcttttggtcgggggggggggggagcnnnnnnnnnnacgccgccccctcccacgttgatcaatgcccggcacctttggcactggccacgccacctcacctccacgatgacgcgagggtggaggccctcgccaatgtagcgctccgcctgcttcatcagctcgccgatgaagatgatcatggaggtggtaccgtccctggcactggnnnnnnnnnncctgtggaacgagcgatcctatggaggggcatgcatgtcgagcacccggggcatcagtcgggtgatgcagcactggcgcagcatgcatcaagacgtcgacgcgagcacgcgcatggactcatgcttgggcgacaatttccgggaggccaccggcgtattagcccccgccacccacccggtgacgtcgtcctgggcgacggcagcacgtgcgatcatcacggccgtggggttctggatctgcatctccctcagcagcacgttgccgtccttggtcagcttgatgtctgtgtgtggtggggtgtgcgggcgctggcatggcaggggcacatcactttgggtgcctaccaggcggcaggcccgggcaccacggctgcgcaccaatccacccatttcgcaaccgcgcacctcctgcgccccccacaagcatcttaa

SEQ ID NO: 4777 - DNA, 339 bp, Chlorella protothecoides
atggtgacctatggcgcgatgagcaagcagcccctggccatccccgcacccctcctcatcttcaaggatctgcggttcaggggcttctgggcctcgggaggcttctcaaaggtgggtctgcggcggacccaggggcagggggtgggccgggagggttggggattgcgcacgctggcttccacggagagaatgaggagggaaggcgctggcacagtggcaaattccagcctcacatcccctacacccgtgcaggatgaggagggtctggcgaggaagagggaggtcctgaaggaagtcgcagacctcttcgaggagggtgccctggacgctcccaagtga

SEQ ID NO: 4778 - DNA, 651 bp, Chlorella protothecoides
atgatcatcttcatcggcgagctgatgaagcaggcggagcgctacattggcgagggcctccaccctcgcgtcatcgtggagggttatgagctggccaagcgcgcggcgctgaccttcctggacggcttcaaggaggcggtggacgtgtccgaccgcgaggccctgcgctgcgtcgccaggtcggcgctccgcacgaagctgcgcgaggacctggccgaccagctcaccgacatcgtgaccgacgcggtgtgcatagtgcgccccgccgacggcgcgcccattgacctgcacatggtggagatcatgcacatgcgccaccggctggacaccgacacgcggctggtgcggggcctggtgctggaccacggctcgcgccacccggacatgccacgcagcgtggagcgggccttcatcctgaacgccaacatctcgctggagtacgagaagtcggaggtgaacgcgggcttcttctactcctccgccgagcagcgcgagaagctggtggccgccgagcgcgccgtcactgatgccaaggtccagcgcatcatcgacctgaagaacaaggcgagtgtatggcggagggggggttccattgggggtgggggaggatcgacccggctgctgcaagcaatgcattcaaggtgtgcatga

SEQ ID NO: 4779 - DNA, 1101 bp, Chlorella protothecoides
atgggcagcttgtccggagccagcacaggggcctgcccgccgctccttgggctttgtggtgatcaaccagaaaggcatcgaccccctctccctggacctgctcgccaaggagggcatcctggcgctcaggtgggcagcggggtggtggtgccgggcggcggcccacctcgagggggcttcgtggtgatcaaccagaagggcatcgaccccctctccctggacctgctcgccaaggagggcatcctggcgctcaggtggggagcgggctggtggtgccgggtggcggcccacctcgagggtggacgggaaggtcctcctgaggactgcagcacaggcagggagtcctggcatccacgccttgggtttgttgattcggtcccgtggattcggtctggtcttcctcccccaccccccacccaccccttcctcgcccctccaccctcacaggcgatccaagcgaaggaacgcggagcgcctgcagctgtcgtgcgggggcttcgtggtgaactccgtggaggagctcgagccggagtgcctgggccaggccggcagtgtctacgaacacgtcttgggggaggaaaagtacacctttgtggaggatgtggccaagcccacctcctgcaccatcctcatcaaggcacgtcggcggggggcggcaatcgaggggcctggccctgtggtggggtcgacgggggtgccccgtgccactccagacagctgcgcgtgcttggggccgagcagtctgcgcagctgtcgctgcgcagaccatccttgcgccagacaccggacctggccggcgccagacaccctgccagctgggatgttgggcacatgctggacagtctccaggatgtggaccccatcggccaggtgaccagcgcatgtccccactcccaacaatcctccgcccggcactccttccccttgcagggccccaacgaccacaccatcgcccagatcaaggatgcagtgagggacgggctgagggcggtgaagaacaccattgacgacgcggcggttgtccccggagcgggggcctacgagattgcggcggccaaccacctgcgcagcgtcaccgtcaagacggccgaggggaggtga

SEQ ID NO: 4780 - DNA, 369 bp, Chlorella protothecoides
atggggcggcaggcagccctgtttatgaatatcaatgccgccaagggactctatgacgtgatgaagaccaacctaggtgggcgaggccgtggtgcccgggcctgccgcctggtaggcacccaaagtgatgtgcccctgccatgccagcgcccgcacaccccaccacacacagacatcaagctgaccaaggacggcaacgtgctgctgagggagatgcagatccagaaccccacggccgtgatgatcgcacgtgctgccgtcgcccaggacgacgtcaccgggtgggtggcgggggctaatacgccggtggcctcccggaaattgtcgcccaagcatgagtccatgcgcgtgctcgcgtcgacgtcttga

SEQ ID NO: 4781 - DNA, 735 bp, Chlorella protothecoides
atggccaccgcagtcacatgcaagtcgcttgtctacgagaagccgggggaccccgtagaggtcctgtcgctgaaggagagtccagttccctccccatcctcgcttaaggatgggcagatcctgatcaagctcattgcgtcgcccatcaattcgtcagacatcaacacggtggagggcaagtacccgctgcagcccgagctgcctgggacccctggcaacgacggtctgggcagggtggaggcagtgggccccaaggtgtcaggcctgagccccggcgaccaagtggtcccggtggcggcctgcccaggcacgtggcgctcccacgccgtggcggctgcgagcaactggctgcgcgtaccccccacgctctcccccgaggcggcctgcgcgctgtccatcaacccgcccaccgccctcctcatgctccgcgactacgtggatctggcgcccggggacgtggtgatccagaacggcggcaacagcgccgtggggcggctggtgagccagctggccgcccgtcgcggcctgcgcgccgtcagcgtcgtgcgtggccgtggcgacgcggccgccgacgccgagctggcgcgggagctggagggcctgggcgccgcgctggtgaccaccccggagcggctgaaggccgacctggcggccgccgggctgcccccgccccgcctggggctggactgcgttgggggggaggtggccctggccctggccaagaccctggagtga

SEQ ID NO: 4782 - DNA, 834 bp, Chlorella protothecoides
atgaatgattacatggtcgcgcacgtgtttctccaaccgaccgcaaaccacgttcaaccagtgcactcgaagggccgaagcacgggtgctgaagatgttggcgaccaccgcgcaaaacagggtgctgggcacctccagcagcacgttggtgggttcgagagtgtgagcgtttattttgtgatttcgttattctctgaaaggtttacgatcgccgtttcttctccccggcaacaggccaaggccgccaccgcgccattcaaggtcacggccatcaggagatccagcaaaggcatccgggcatccacatcagcccactgtactggtggcggagaagctcggagctggtggcgtggagatgctgaaggaagtggcggatgtgaggaccgtcctgaacatgaccaaggagcagctgctggagaacatcagtactgtggatgccattgtcattcgctctgcgaccaaggtgaggatacagatgtggttggtcttgatgtatctatcggtggctctggtgcaaggaacacgcaggttggagactgtgtgaccagctcagtctcatgtaaaaagggatggtctcaagcagcctacgaggtgacacgcgaggtgtttgaggcatccaagggccgtctgcgcgtggtcgggcgtgctggcgtcggaatcgacaatgttgatctcaccgccgcgagcgaggtgcgagcagcagcactgtcgggagtgtgtggtatgggagatctggggtacgtcacacgcatccctctgccagctttggggggcatgggtgtgcttcgcggggatccagcaacgagaatttcatatagcaactccagcaactga

SEQ ID NO: 4783 - DNA, 627 bp, Chlorella protothecoides
atgcaggagctgcttgcggcggccaagagacgtgcactgctgagcagaatgtccacccgctattctggagagggcgcccctggatctcagaccatggaccggagtgatgatagcctgcctcccggggagcagcgcgcagaggtctcagacacagcatggagggcaggtgcggacggccgagttacgctgccagccgggaaacttaggcccagcttgtgtgcaccgtgccctcccagccatgccgcatggaggcgggaagctggaggcgttcttcaccatcgatcgtgtgcgcacgctgctgcgtcaggagagcggccgtaccatgaagctggcggtgacggggcactccctgggcgccgctgtggcatgcatgctttccttccagctgcaccaggagtgcccaggtggggtggtggcgctgaggacctgcactgctgggcattttgccctcccggcggcctgatgagctggaacctgagcgtcatctcccgccggttctgcacatcactggtagttggcaaggacgccatcagccggctctccttcaacaccgtgaagaggatggtggacgagatggtggtgtgcctggcaaggtatgcagctggtcttgaatgtctcggaaagtag

SEQ ID NO: 4784 - DNA, 951 bp, Chlorella protothecoides
atgcgtggtcctggaggcacaggatggagtgggcgggcgtgtgaggacagacaggcacgaagggttcctgctggatcgcggcttccagatcttcctgacttcctatccggaagctcaggtgagagttgggggtcttttggggacaaggagtggtcagagagggtgcacgccagcggcagcggctttaagattttgcgctgcccttggcagggggcatccggttccggggctcctctccctgctcaaccctgtgggatccccgctcgacaagctgcgggtcggcctccttcgcctgcggacccagctgacaggagcccagagcctgctggctaccagtcaggagaccaccaccttggagaggctgcaggcaaggcgcaggatggacagacgaagcctgattgtctgattgactcatgggcggctgccaaggatcatggtagtctgtggcggggcggagggcttcagcgacgtcatgatcgacgccttcttccgccccttcctgggcggcatcttcttcgatgctgggctccagacatccagccgtctcctcctctacgtgctcactactatgcactggatgcgggcgaggcagcactgcgcggcggctgtgcgcatgctccgaggccctccccccatgaatgcactccagggtcaaactgcctacctgccggcggcatcggcgccatcccagagcagctggcggccaggctgcgggcgcccgccctccgcctcaacacgcgggtgctgggcctgacacctggctccggcggctgggaggtgaagctgggggatggggagacgctgcacgcccccgccgccatcgtggccaccgaggggccagctgcgcggcagcttctgggagcccggctggcgccaaatcccagcgcggagggtccgggggtgggcagcatctgcctctacttcgccatggacggcggcccacccaggtag

SEQ ID NO: 4785 - DNA, 1215 bp, Chlorella protothecoides
  modified_base (880)..(889): a, c, t, g, unknown or other
atgagagggagcttcgtcatgcgagcctggaggctcaccggggcctcgaactggcgcttcgggcctcgtcgttcccacaagcagggtggtgacgccaagcgcggctcccactccgcacgcgctggcgcgtcagcgtccctgcccttcgaccccaagtggcttctgctcccccccgccgctgccgccctgctgggcggagtggcctacgcccacaacacccagttcagtctgtcccccagcgtcgccacggccctgcagcagtactcgggccaacacacacccgcccacgactgggaggaggtcatcgccagcgagccgggcaccctgcgggtgctgaccgcggaggcgctgctggcccaggaccaccctttcctggaggatgaccacatgttctcggccttcgtcagcaagggcatcgtggaggacctgacgggttactacaaccccgagcagcggcgctggcacagcgtggtcgctctggggcgcgaagtttgtggcttcccccgcgtcgtgcacggcgggctgaccgccgccatgtttgacgagtcttttggcggcctcctcttcagcctcaagcaggccaaggccctggacttctggggtgagtgggccggggggtggggaatgggcaagggccgggaggggccggggtggaggggaggggccatgacatgggcccgaactccttgtaccaaatatgtatgtatgtacacaggcccgctctggcccactctggtgagagaagagattgaaggtcctgcgaggaagagacatcgcatcccatgtctggcgcctgacacccacctccctctcccccccctacctcgtccctcaggccccgcatacacggtggcgctggaggtccagtacaaggccaagnnnnnnnnnnccccctcccccacctcgtcgctcaggccctgcatacacagtggcgctggaggtccagtacaaggccaagatcccggccgggcagcgcctgctgtgcaccgcagaggtggaaagcgcggagggcaggaaggtgtggatgaaggccacgatgacagacgggccggggggcaaggtgtttgccacctcccgcgccctgtttgtggcgcccaagctgcagaaagtggtccccatggtcacctcctacctctggcaccgcgtgttcgggagcaagaaggcggcccctgccaacctggagtagaggggcctactggggaggccccgcgctga

SEQ ID NO: 4786 - DNA, 1497 bp, Chlorella protothecoides
  modified_base (235)..(244): a, c, t, g, unknown or other
  modified_base (1202)..(1211): a, c, t, g, unknown or other
atgcacataaatcttggattcgaagcaagctcaggtacagggcgaacacctgtgagttcgcaaagtccaagatggcactcacagcctcattctgcaatactcattcttacatcacatatttatttccggaaggataatggagtagccgcgaggtaccggagtcgtcaagaccgtcaccagggcgatggcgccggtggtcacccacgagttcgtggccacagtggccgacagcatnnnnnnnnnnagtcacagcgcgatggcgccggtggtcacccccgagttcgtggccacagtggccgacagcatcgcctgccgcgcccaccccgacgcctgccgcgccctggctcccgatgtcgagtacaggatgcgagaggtggtgcaggacgcactcaagtttgcccggcactcccggcgcacctacctcaccacccaggacgtgaatgccgccctcaagatgcgcaacgcggaggcacagcttgcatgactcacaggcagcgcctcgttgacgcggatgctgtccttccttttttggtgggccgtgatctaaggatgcatacctcgacacggcccctgtatggcttcagcgggcgggaccccgccaagttcctccgcgcggcagggcaccccgacgtgtactacgtggatgaccccgacgtgtcggtggcctccatgctcgccacccccctgccccggccccccgtggaggtggcggtggtgccgcactggctggccatcgacgggcgtcagccggccacgcccgagaacgcaccgcccgcggtgcccgcacgccgcgccgcgcctgccaaggccgcgccagctgcggcgcaggttggcgccccgccggccgccgcccccaacaaggccctgccggcggccagttctggcggcgagggggcgacgcccgccgttgccgggccccagcccgccggcgaggaggcgctggtgcgggcgccgctgcgccatgtgctcacgcgagagctgcaggcttacctggaccgcgtcggcgcctggctgcgtcacggctcgctggagggcgggggcgcgctggtggcgccctcccccgccgccgccgactcggcggtgctggccagcctggcgggcgacgcggggctgcaaccgctactgccctacctgtggcgcctgatcggggaggaggccggcgcagacctgcgcgagctggcccgcctgccgcgcctcatggnnnnnnnnnnacctgatcggggaggaggccggcgcggacctgcgcgagctggcccgcctgccacgcctcatggcggcggcgggggcgctgctgtcaaacccggcgctggactccggggcgctgctgcacgaggcgctgccgccactgctgaccgcgctggtggcacgccgcctgggcccgaaaggaggcgaggcgcactggggtgtgcgccgcgccgcggcgcacgcgctggccacgctgtgcgcgcgctacgctccggcccacgcctcgctcctaccacgcgtgcagcgcacgct

SEQ ID NO: 4787 - DNA, 492 bp, Chlorella protothecoides
atgaccagcaacatcgggtcggccaccatcctagagtccatggagcgcgacccggcggacatcaaggacgcggtgaccaagcaggtccgcctccacttccgccccgagttcatcaaccgcatcgacgagttcatcgtcttccagggtctgcagcgctcccagctgcgcagcatcgtggagatccaggcgcggcgcgtggcagagcgcctggccgagaagaagatgggcctgcgcctggagcccaccgcggtggactacctggtggagcgtggttacgaccccgcctttggcgcccgacccgtcaagcgggtggtgcagcaggagctggaaaccgcgctcgccaagggcatcctgcgcggtgacttccaagaggaggacaagatcgtggtcaaggcctctgcggacggcacccgcatcgagctgtcggtggcaggaaagaatggcgcgacggtgccgggtgacacagtaagccccgtgcagttggtgccgtga

SEQ ID NO: 4788 - DNA, 1599 bp, Chlorella protothecoides
atgtctccgcccctcccgctcacaccccccactccaccccggaacagttcgattatcgaccgtgcgcgccctgcgcactgcctggcgggcctccgcgactctccatgccccacttccccgctcatcgagggcggcggacccctgtccgccctcagggcctcccccgccgcctctggcgtgaccaccgcgcccgcgggtctctccagcctggcctccctctcctccgcaccccgcctggccgcgcccttcctcccctcgcgcctcgcgtccccaccccggcggtccatggccgcgcatgcggcgtccggcggcggcggcaagcgcatctcccagaccgacttcacggagaaggcgtgggaggccatcgtgtcggcgcccgaggtcgcgcgctcctacaaccagcaaatcgtggaggcggagcacctcttcaaggccctgctggagcagcccagcgggctggcgcggcgcatcgtcagcaaggcggggctgcagcccgggcgcctgctggagtcggccgacgccttcctgcgccgccagccccgcgtctccggcaccagcgagcaggtgctggggcggtcgctggagggcgcggtggggcgcgcgcaggagctgaagtcgcgctggggcgaccagtacgtgagcgtggaggcgctgctgctggcgctggcggaggactcgcgcttctgcggccccgccctgcgtgacgcggggctgaccccagcccggctggaggaggtggtgcaggaggtgcgcggcggacgcaccgtgaccgaccaggacccggagggcaagtatgaggccctggcgcggtacgggcgggacctgacccaggcggcgcgcgatgggaagctggacccggtgatcgggcgggacgacgagatccggcgcgccatccagatcctgtcgcgccgcaccaagaacaacccggtgctgatcggggagccgggcgtgggcaagaccgcggtggcggagggcctggcccagcgcatcgtggcgggggacgtgccggccagcctgcaggggcgcagcctgatctcgctggacgtgggcgcgctgatcgcgggcgcgaagttccgcggcgagttcgaggagcggctcaaggccgtgatcaaggaggtgcaggactcccagggcgcggtggtgctcttcatcgacgagatccacaccatcgtgggtgcggggaagggcgaggggtccatggacgcgggcaacctgctcaagccgctgctggcgcggggggagctgcgctgcattggcgccaccacgctggacgagtaccgcgagaacatcgagaaggacgcggcgctggagcgccgcttccagcaggtgtatgtggatcagccctccgtggccgacaccatctccatcctgcgcggcctgcgcgagcgctacgagctgcaccacgccgtcaagatctccgactccgcgctggtggaggcggcggtgctctccgaccgctacatcgccgaccgcttcctgccagacaaggccatcgacctggtggacgaggccgccgccaagctgaagatggagatcacctccaagccttcggcgctggatgaggtggaccgcaaggtgggtgggtgtttcggggggtaa

SEQ ID NO: 4789 - DNA, 291 bp, Chlorella protothecoides
atgccggggcttcagcactgcctccccaaacatcctccagaccttactgttttcctcacacacacacacaggcaactgaccgaggtggtgcgccgccggccttatgctgtggtgctcttcgacgaggtggagaaagcccacgccgacgtcttcaacatcctgctccagatcctggatgacggccgggtcaccgactcgcaggtgggcagcctggcgtggggtgtccagggaggtttgattggatgcttggttttgtggcaaagatccaggggtgccagggagcatgaatga

SEQ ID NO: 4790 - DNA, 564 bp, Chlorella protothecoides
atggcgcgcgatcctgggcagcacttcgacctcgcaaaccagcatgaacaacttcgtgatggactacctggttacggaggtggggacagagggtttcggggtggcatcctgcctctccggggctactatgaggctgctgttgccttcggccgggagacaggcacgacgaccagtgccaacgtgtcttcggcaatagagaggacacagatacgaaaggccatccaggatggggacatccagctggccatggagctcctgaatgatgcccacccccaggtattcctgatggtgcaatgcagagaaccagcgaccagggcccatgctgcgcagtctccctggctcgtacctgtccccaacttccgcatcttctggaaattccacggtcccaccggcccacagatcctggaggagcagtctggcctgctcttccacctccaacagcagcaggtcatagagctgatccgggcggggaggacggaggcggccctggactacgcgcaggagtacctggctccacgcagcgagaacaaccccgacctgctcctcgaactgggtgggtgctga

SEQ ID NO: 4791 - DNA, 729 bp, Chlorella protothecoides
atggagcgactgtccctgaacaaggcggcgcccagcgacaagggcgcggcggcgcggctggcgtccctggacgcgcagctgggcacgctaaaggagcagcaggcggcgctgtccagcgcctgggaacgggagcgggacgagatgaccaaggtgcagtcggtgaaggaggagatcgaccgcatcaacatcgagatccagcaggcggagcgcgactacgacctgaaccgcgccgcggagctcaagtatggcacgctgatggagctgcagaagacgctggcggcggcggaggacgcgctggcctcctccgacaccgcccaccgcatggtgcacaccgaggtcaccgagtcggacatcgccgacatcgtggggcggtggacgggcatccccgtcgcgcgcctggtcgcctccgaccgcgagcgcctgctgcatctggacgaggccctgcaccgccgcgtggtgggccaggacgaggcggtgtccgccgtggccgacgccatccagcgcagccgggcggggctgtccgaccccgcgcgccccatcgcctccttcatgtttctggggcccacgggtgtgggcaagaccgagctggcgaaggcgctggcggaggagatgttcagcaccgaggccgcgctggtgcgcctggacatgagcgagtacatggagaagcactcggtcagccggctgatcggggcgccgccgggctacatcggctatgaggagggcgggtga

SEQ ID NO: 4792 - DNA, 399 bp, Chlorella protothecoides
atggcactgctcatcttcgatgatgtgagcaccagtccgctggcagacctgatggacgtcgcacagcgacagaagacggccgacgaggtcaacccctgcatcctgcgcacccagctggaggtgggatcgctgggcaggggtggaggtccgagtggcttgcaatcgattcctgcggcgcacagcagcgttcgtctcgtccagatcaccaccgcgactgcccccctccaagctcattccccgactgccccactgcaggaggcggagtcccagctcccagtcctgctcaagctcatgctctggatgcaggaccgactgaagggcaaggtggtcttccccgtcatcgaggatgtgctggttgctgagcccatcctggctcccagcaatgaggctgccacatag

SEQ ID NO: 4793 - DNA, 1308 bp, Chlorella protothecoides
atgagcgtctcctcgtggtgcataccgcgcgtggtggggcccgacacatcccgtggagtcgccgacccgcccatcccctccccccttcccctgcaggctctgctgagccgcgacatcctcgtcaccctgccagagcacggccttcgcctcgcctttgagccgctgactcagcgcctgcgcctactggagatcctggacagcagccacctcctggtcacgtatcagaaggcgcgcgcgttcggcggcatggcgcaccctccctgcctgggcggcatgtatgacacctttgggccgacctacccaggtggggggcggggaggtcgtgccgtccccgttactccagtgctgccagatgtctttgatggtgggaaacacactggagatgtctttgatggtggggaacacactggaggtgtcatgcctgtggggtgcaactcaggtggctggctgaaatgtcaaccctccagtcgggaggtcacatccctttccctccgacgaatctcgccgaccccctcactctcctcttccccccccctccaaaccttgttctcagtggagtgggaccccgcgtcagcgtccttccctcttctctacccggggctcctcctcctcttcccggtgcccccctgcgacaaggccacgagtctggctcccggcaacgatgccccgcaggggttcccggtgccgcccaccacccaggcctcccgggtgtgcctcttcacaggcgcggctcgcgacgcggccgctgcgctggcctccccacccccgccacgcgggcaccccggtgcagcccgcgtgctgcatgccgtccccggccgcggagtctactccgaggcagggccggggggggcgaacaacgtctgcgtggagctaggggactccccccaggccgtcgtgacgcggctggggccgcccaccttcaccagtgctgccgcggagcaggtgcttggagttttgggttgggggtgtgggtgggagggccggtggtgcggcggcatccgccaggaagctaagccaggagaggagacaccagtgctctcacacgccccctcgccatgtcaccgggctgacgccgcccagtcccccccttgcccttgcagcgaggcctgggcgcccgctacgtctacatgtaccccgacctggggatggatgtcgtgttgggcgcacggactcacgccgtggagaagctggtgctgcacgccagcatgcccggctccgcaggcttcggcctcgcctcccgctgctccttcaggtgggcacggggcgctgcattttggtagtgtgcgaggcatgctcaggcaggagtga

SEQ ID NO: 4794 - DNA, 942 bp, Chlorella protothecoides
atgctcgcagagaccggcagcgggggccgcctcctggacgcctgcgacctggaggcagataccatcggcgtggcttctgtgccctcctcggcctcctccgccgtgctctcagactactttatttttgacacagagcccctcctggcggactggggcgccctgccccccatcaaccccggcccctaccgctccgcgcccctcgccgccagtgcgggccagccctgggccgccggtcccaccaccggctatgccggcagctttggccacacacccgccatcacagagtcatccccttttctgctggacggcacggccctgacgtccaccctgcctcccagccctggagggcatgccctggtcgccatcgatccccactcagtccccacgagggcatcaggcagccacccccacccacccccacacacatgcgttccccactgccctcgcagcgaggcgccccaggcctggctgcaacccccgcccagcgtggacggggctcccagcccccctccctacaccggcccgaatatgccccacacccagtccctgcctgagctgcacgtgcgggcgctgccgtcgcgccgctccgagccggagctgcgcctgcgcggcccggggtcttcacgccgcgggcccccctcccatccgctgccgcgctccgcctcggccagccagctgctggacggctgccgccccgccgtgccccacatgacctacctcacccccctgcacctgcgcaagggcaagggtgggcggcagcccgccgcggacccacgcatggacccgcgcatagaccccaagaaggcgcgccgcatcctcgccaaccggctcagcgccgccaagagcaagctgaagcagaagggcgccgcgggggaggccgggtcccgcctgcgccactcctctgacgacctggtggggctggaggtgggaggctgcgagtag

SEQ ID NO: 4795 - DNA, 813 bp, Chlorella protothecoides
  modified_base (358)..(367): a, c, t, g, unknown or other
ggcgcgcgccgacgccgtggcgcgagacgcgacgcggcggatgacggcggcgctgcagcgcgcccaggtcatggagctgaccatcgccgggctgaagcgcggcgcgggggcgcggggcgagggatgcgcgacagcgtcgggcgaggaggtccccccacgtccccccccgagcgggcgcgagacccggggtggcgctgccggcgccgcatcgcggtgcggggcgccaggcctggcaccggccgtcggcttcctcctgccctccagcgccgagccactttcccactcacgcaacaccagccacccctcccacccacgcggcagcgaagagagcgacgccccgaccccgcgctccgccgcnnnnnnnnnncgcgcagagccactttcccacccacgcaacaccagccacccctcccacccgcgcggcagcgaagggagcgacgccccgaccccgcgctccgccgcgccctcggacgccggcagccccttcggctccgacttcacgctgcgggagttgctgcagcgcaccgccgccctggaggcgcgcctgctggaggcagggacggagaagaatgggctgcaggccgagctggcgcggctgcccgtgtccagtgccggccgcaccatcaggttcctgatgccacctgcgctgcggcgacctacggcagaatcaccaacccccacctcccgccctcctctcctcctccctcgtggcaggagcggcggcgccgagaggaaatcgaggcgcggctggatgatctggagcgcgagatgtcgggcctgaggctggaactaaagcgcagcggctgccggtga

SEQ ID NO: 4796 - DNA, 753 bp, Chlorella protothecoides
  modified_base (142)..(151): a, c, t, g, unknown or other
atggtggacagcgccgcccacgttgcgtgtcgcaactcgttgcgatggtctaaggccatgcagcgctgctctggctgcggaaggctacgtatagattgtcctcggccgcatgatatccccttccccacccccctctccatgnnnnnnnnnncccccttggccccctgcagatatgtggtgaagtgcatgaagccccccatgagcatcttccacggcctgcccggcaccgcctaccagtttgagcagccgggcacgcataacgagctgaagcacatcgagaccgccaagaccatcctccgccagcgcttcctgcacctcctgcagccccgcaacgtcaagtatgagctgcacctgtacgccgagaacgtggaggcccctgctgccaagattgggaccctgatcctggaggccgcccagaacctggaccccacccttgtggtcactgccgcgcacaataaggtgggttttgagtgggcagatggtggacagcgccgctcacgttgcgtgtcgcaactcgctgcgatggtcctgggccatgcagcgagttgctctggctgcagaaagctacgtagagattaccatcggccgcctggtatcaccttccccacccccctctccataatcccaaagctggaggccagcgaccggtacatgggggatgtcggcagcgtggcgctctacctcttggagaactgcaagctgccgctggccattattcacccggaggaggacggcgcggacgaggcagagtga

SEQ ID NO: 4797 - DNA, 978 bp, Chlorella protothecoides
atgcgacgtcgcggcgcaccatggcctgccgctcctctgcgccgtgctggaggcgagcgtgggcaaccgcgtgtccgccacagtcgcgggcaccacgccggccctgctggagtggctgccacgggcgcacccccatctgctcccgggcctgctgcgcgcgctgcgcgcctccgccggccactccctccccgtcgccgacctgcgcgccgcgctgggcctgctgcgccccggggcaggtggggacctgggcgcccaccacgacggcctgctgtctctgctgggcgaggcggggagctgggcgcccaccatgacggcctgctgtctctgctgggcgaggtcgcggccgaccccacccccccggccttcctccacttcgaccccggggcgggggccgggtccggggtcgagagcccggcggcgcgcgccggcctggcctgcgcggcggcacgcaccgggccgctcctgcgtggcgggctggcgctgtcggtctggctgcgccgggaggcagagggccggggggatgtggccttgatgagggagagcgaggtgccgccgaggggccggacgacgccgcgtggcggcgctctgcagggcggcggcgatggccggccaaccaccactccaggcctccagggcaccctgagcgagccgccgccgaggggccggacgacgccgcgaggcggcgctctgcagggcggcggcgagggccggtcaagccccactccaggccaccagggcaccctggtttggattgaggaggcgcagggccgggccctggcagtggccctggactctgcagcgggcgcggtgtgggtgcatacctggtcccccgcgcatgccgcgctggccttcgacatgggtcgtgggttgaccagtggggcctggcaccacctgtgcctctcgctggcgccggggggcccgctgtcccatgcgacggccacgctgtggctcgacggccgcctgcaggtgcagatttga

SEQ ID NO: 4798 - DNA, 234 bp, Chlorella protothecoides
ccgacctcgcagagcgcggagccccacttggtcacatgccaccctgaccctgtcgccctgaaccccgccccattcctctccccaatcgcagtggtgggctactggtttgcggcgctgtcgccaaacatggatgcggccaatgccctgctgccgctgtacatcaccattcagctcctcttcgccggcttcctcctgcccaccggggccatgccaaactactggagatgggcagcg

SEQ ID NO: 4799 - DNA, 216 bp, Chlorella protothecoides
atgcagtacggctggggcgccctcatgaagaatcaattctatggggaccggaacgtcgagtatgtcggcgggaccatccttggcttctacgacctggctggcatcaacatgtggggctggctcggcatcgaggtgggggggagcacacaggcttgggcccggggtggaatgcatgcccttgatcatgcgggtgcctcgtcggttcccactccataa

SEQ ID NO: 4800 - DNA, 1455 bp, Chlorella protothecoides
atgggcctaactccaggcgccggcatagctcagaggaagtccaggccccattcagggaaccgcagcgggggcggtggtagggctggaccccgcacccccctctttccggagaactctggcgggggctttggcctcccgggcagcgccgtatcgatggcctggtcgccgtaccctgcagctgaggcgctcgccgacgcggtggcggccaagttgatattcgagacccccggggcgcgccccacctcggctggccactctgatgtggcgtcccggagccggccaccttggcctacgggcgtgaggatcggggaagacccaccgccccgctggccaggctcggatacaggtggagcgcagcccagtaagatgacccagggctccacagaggcagccacagcgcctgccttccctgatgcccggccagcctcttccacggtcccaaaccctggccctgccgctgcaccggccttatttacggccgccccaaatcctggccctactgctgcgccagccttctttacagctaccccaaaccctggccctactgcggcgcccgccttctttacagctgccccaaaccctggccctactgcggcgccggccttctcgttcactgctcccagtactggccctgtcgaacagccggccttctcctttactgtaccagcttttcaagccgatccagcccccacggctgccccgctgccacgcttcaccacagccgcggccccaagtgatgccccgagtgcctccccgccagatgccgcacagcctccagcactaggcgaaggaggatttgtgtttggggcagcggcgcaggatgccaggccagcgcgcgctcgaaaacccaagtcccctgggtctggcaagaagccggcgccaatcgctagcctgggggcgtcgaatggcaccgtcacctgggagaagatcctggaagcggtcgctgactttgacgccgcgagcgcagagaaggaggaggcggctcactccgtgcctacgccgtccccaccgcagtcaccatcccccacacaacctgtgtcttctgtttcggcgggtcccctgccccagccaccctccttcctgctgcgagcagcgcggcatgcctcccgctcgccgcctgaagactccgcaatcatggaggctcggcaggcggccgaggtcgccgccgaaaggctgcggcgcgcagggaacacagcctttggggagcaccgctgggaggacgctcgggaggcctacacacaggtacccgaggctgctgatccaaggcttagagcggctgcactgtggctgggtgcaagggaaagggaacgccttttttggtcccctcatgaacgcactgacccacatgcgcgcatcaccgcacctcgcaacaggccatcgagacgctgcggcccgctgaagccttccgcgccaaactcgcaccgctgctcgccaaccgcgcggccgcctggctga

SEQ ID NO: 4801 - DNA, 705 bp, Chlorella protothecoides
atggggttgctgacacaaaccggagggctcgcctcggaacccctcccacccccttcaagccatgatcaagcaacgcatggatggtccaatccttctccatcggaacgccacctccagggcgagcgcaactatgaggagctcaagggcgataccgggccgctcgtctaccctgcagggtttgtgtacttgttcactgcgctgcaggccctgaccgggggcagcatcgcggcggctcaggtgggcggggcaacagggcctgtttattacagaacgtggtcgggtggcgccatcgtgccagctgagcccagactttatgttggaagcgggggaacccttcctagcgcctgtcaaaactacccaaacccaggcaccacccctacccctctacaaaacatccaggcgatcttcgccggagtctacctgctgacccaggccgccgtcatggcgctgtacatccggtccagggcgctgcccccctggacgctgtgcctgctgtgcctctcgcgccgcgtccactccatcttcctcctccgcctcttcaacgactgctgggccatgctgcttgcatacgccgccaccctcctgctccaggtgatgctttcttgggaggtcccttatgtggctgtgcctacgagctgggtggcatgctttgtgatgctgcacatcctcagtgtccacgagttctgtagctgtttgcaactatga

SEQ ID NO: 4802 - DNA, 1005 bp, Chlorella protothecoides
atgcgactgcagctttcaaacaagggtagcaatgccgagacctactccaactttggaaacgtggtcgtggcgtttgcgttcctcctcatccccgtcatcggctggctcctggacaagaaggcccaagaggagggaggggaggggagggccgggcgtggacatggcgatcagtggatggaacgcttgctggagaggcctcgcgccagcagggcgatcggagcccatcgccggttgcgttgttccttccccgcctcgccaagtctgtccatcattcacgccgacctcccacgggtgtattccttgtttcccccacaaacccgcccgtccaccaaccctgttcagggctacggctccacgctgggctcaatcctgggcctgagcgtcctgaccctggtgctgcaggccctaccctcgctcccgctccaggtggtgaccatcctgatctggatgaccgcccgcttcttcatgtacgcctcgtactttgccatcttcggcgcgctctttggcttccgcaactttgggcggctggtggccgtggacaacatcttcaacggcctgtttgggctgctccagtatccgctcacctacctggccatccatcccctgaacgggaacttcatgtgggtcaacctcggccagcacctgtcatgccccatcaccactgccctgtgcgttgcccctgctgcatcatcacccaggccccttggcccccctcacccccaacctccacaccccaacacaccacaggcggcgtgcctgatcccgctctcctggttctgcgtggccatgtaccgctgggagcgtgaggacctggtgcccatccggccgctggagggggaggagctgccctgcgacatgctgggccaccaggagcgcaagaagctgaaggacctgcacctgcccaacctgggcctgggcgagctgaggatgccccacgtgcagctgccggaagccatccggaagctgacgcggtcggggacgcgggagcgtgaggtagatgtgtga

SEQ ID NO: 4803 - DNA, 633 bp, Chlorella protothecoides
atggttggccaccaggtcatactaccggaggggtacagggacgccaagttgggcatgatcatcgccgcaacgataggagagatagtgcaaggcagcctgctcaacatccttggcctcatcctgtttggcgtgtcccagtcttccggccccaatgccttcatcccggcctccatcttcctgggcctgggcggcatcaccttccacctggcccagatgcacgcctccgcgctgtacccaagaaagcgcggcatgctcaccgccgtcttcgtggcggggttcacgggatctggcatcattttctacctcctgctcctgatattccaggcagcaggcagtacgaggttagttgcgagggggggcccagagggggtccgtggggcggttctctctggaactcctgtgctgagtgagagcatgatgatgcagggccttcccaccagcacccagaaacactcgagaaactccccccacccccactccccccaatttctcctgcagggcggcgtacatgggcgtgctgatggggtatgcagggctctgcgcgctgtggatcccgctgagcgcatggatgatgccaaactcccccttccgggtgggccaggtctacctcctcaccagcaagtggaggtttga

SEQ ID NO: 4804 - DNA, 1122 bp, Chlorella protothecoides
gggaggggggtggttttggggcgggaggccgggggctgggggccgccccgacgtgtgtgtgtgcggaatgtgagctgtgctggggtatggtgtgccgatgccctggccctggtgcccaatcccagcatcactgccactggcgatgcaggactatggcgcgctcacctggtcgacctggctggtggccgtgtgcatcctgtggtcgcccttctggttcaacccccagaccttccagctggagaggtgcgtggctgggtgcaggaggaggcggagggggagcagggcgctgccctgcgaatgtcaaggctggcagccagcctggccccgcctcccacgtcaccgcgcaggtgcaaggacgacttcgaggcctggatcctgtggatgacggatgtgattgacagcgaggctggcagcacctggtactcatggaacaagtccaacctggaacgcatccgcaatgagaagatgagcctgaacaacccgatggccaccagcctgcgtgggatcgccggggcgctgccgaccgccgtcctcgccctcgccgccatctccaccctgaccaacaccagcatcaaccggtgggtggcagggtgtggtggtgatgttgggaaagctggagagcggttgaagctgggacacaagggcacgtgtctacacctggtgcgactccactcccggactcgacccctgcacctgcaggtgggtcatctttggcatcgcgtcagggggcttctggacgttcatcctcgtggtgtgggtggtcaggcgcgtgctactctccaactactactaccggctctggagggcgatgcgcacgttctgtttcctggtagccatagccttcctggtgagtgggagcggggtttggtggcttggccgtggtcagacaacgcacatcgcctgcaggaacgcagtatgctcaggtgcagcctctcaccaggagcagcacctcgactgcaacaacctctccccaccctccttcaggtctgctgcgtcatcttcatcccaggaggcttctcggccggggtcggggtgaagaacctgatcatcatcatcttcgccaacatgtctgccgtgtcggtggcgacacaggtcggtctggaggctactgctcccgcatga

SEQ ID NO: 4805 - DNA, 1005 bp, Chlorella protothecoides
  modified_base (159)..(203): a, c, t, g, unknown or other
atggttgccgagactccatcatggctcggcacatcgtggatgcttcctacaggtctgtgctggcctgctgacacggaggcttctggtccgtgcagactcgcacatgcaatgcaatcctggccctccgccaatcatcacctccccccccccccctccctnnnnnnnnnnnnnnnnnnnnnnnnnnnnnnnnnnnnnnnnnnnnnatggccacctaggacactggactggatcctgggttacattttcttcagcttcctcttcctgttgtccttcatccaagtcgtcgacatgctgcaaggagccatgctctacaacatgaagttcgccaaggccttgcagcgctctcgcctcatggaatccaatttcctgcccagctacgtggatagagccatggagcgactgtcccgtaccctccaggaggagattgtggcgtcatgcgccgtgtcactcaggccggtgactgaaccgttctgctttgaagagattcttatgccaatggctgttcccttgggacatcaatcatcctcggtcacatgcagtacttgcgctaagcatgactctacatggcttcaattcgtgctggtacagacactgacattcaaaccccattatgcacatttaatctttactaaagctcacaatctgaccgcgcgcgctgtctcggaagtggtggtcgggggaccagatgcccggccgggtgctctcatggacgcattcgacgagagcttgctcacagacagcgacggagaggatgacaagaatgtgggctggatggggaggatgcatgggaacagcaagcgttctccgcctgcatgccctgcaatatacccgcatgcgtcatgcatgccaggccatgatgcacgtcccatgatctctccacaggcactggctccagcgtcaaaggagcagctggtcttcctcatccaagggcacgagagtctgttggagcttgctaacctggaagacgaggtgaaggagaggcattctcgctttccctggctctag

SEQ ID NO: 4806 - DNA, 1758 bp, Chlorella protothecoides
  modified_base (8)..(17): a, c, t, g, unknown or other
  modified_base (372)..(381): a, c, t, g, unknown or other
  modified_base (600)..(609): a, c, t, g, unknown or other
atgcagcnnnnnnnnnncagcgagcgccccccccccccccctttcccccctgcccgccagaccgctgacggcggcactggcggcggcggggcggggcacgtttgtgctggacggggtgccccggatgagggagcggcccatccaggacctggtggatggcctgcgccagctgggcgtggacgcagagtgcacgctgggcacgaaatgcccgcccgtgcgcctgcacgccaccggcctgcagtctggagaggtgtgtgggcgtggtggggtcggataacgaggttttacagctttgatgtcaaggagcctgcctgtgttggtcgtggagggtgggtgggtcacgtgggtcacatggggttgtacaggtcgcannnnnnnnnnggagcctgcctgtgttggtcgtggagggtgtttggatcacgtgggtcacatggggttgtactggtcgcttggaggccctgtcatccaggagcacgaccgcggagccagatcctgagcatctgccgggggcctcttccatccctgcatcggatttctccagcacttactccattaccacccccccccaccccccttttgccccctttcgccctttccccnnnnnnnnnngggcctcttccatccctgcatcggatttcttcagcacttactccattaccacccccccaccgcccttttgccccctttcgccctttcccaaaaggtggtcctgtccggcaaggtgagcagccagtacctgaccgcgctgctgatggccgcgccactggcggagggcgagggcggcatccacatccgcattgccgacgagctgatcagccagccgtacgtggacatgaccctgcgcctgatggagcgctttggcgtgaccgtgcaccgcctggagggcctgcagcacctccacatccccgccggccagcgctacgcctcccccggcaccgtgtttgtggagggcgacgcctcctcagacccccggcaccaggcgtccgctttctgcccctttggcccccccccataacacaatcccaccctctccctccccaccaacctcaacttcttcccccccaaacacacacgccagcatcgtacttcctcgcgggtgccgccatcaccggcgggcgcctgacggtccacggctgtggctccgacagcctgcagggcgacgtgcgcttcgccgaggtgctgggcgccatgggcgcgagcgtcgaatgggcgccccacaccatcacgatcaccggaccgccgcccggcgggctgcgaggcgtggacgcaggctgcgtggacattcccgacgcggccatgacgctggcggtggcggcgctgttcgcgcacggggccaccaccatccgtgatgtgggcagctggcgggtgaaggagacggagcgcatgaaggccatctgcgcggagctcggcaagctgggggcaagcgtggaggagggggagacaagttgcgtgatcacgccgccggtgggcggggttcaggccgcggagatcgagacctacgacgaccaccgcatggccatggccttcagtctggccgcctgcggaggagagggagggaggctgcggagagggatccctaggcgtgactgcatacaagaggtgccagccccgggtcctggcgcaaatagccatgccctgggtgagcctgcgatggctcatgcttgcccctaccagtttgaggccaacccatcaccatcctggaccctgggtgcaccaggaagacctttcccacctactttgatgtcctggagggtgtga

SEQ ID NO: 4807 - DNA, 930 bp, Chlorella protothecoides
atggaggacgtgcgcggggagtcgtacctgggcatcaagatcttccgcttctactaccgatgcaccgcctgctccgcggagttctgcatgaagaccgaccccaagaacaccgactacacggtggagggcggggctacgcgtaactacgagccctggcgcgacaaggagaaggccaagctgcagacggcggcggagcgagaggaggaggagcgggggaatgccatgaaggtgctggaaaatcgcaccctggacagcaagcgggagatggacctgaccgccgcgctggacgagatgcagagcctaaaggctcggcacgcacgtgtggacaccgaggcggcgctagcggccctcagtcgcgcccgggagggcgatggggaggagccgccggacttggatgaggaggacgaggcagccgtgcgagccatgctcctgcaccgggcgggattcgtgcggcggctgtctgacagtgaggaggagggcagccctgtgggccctgggccggagggggggggcggcgggggaggggcagccaggccgcatgccccccgcctctcggtggcggcggccgcctgggacgaggaggaggatggcaaggagcctgcgccaggtggaaagggcgacgagatcgacgctccttccggtagcaagagtggctctgagccggctggcgagcgggcaaacggcgcgggcgagccggcggggctcgacgactaccaggcccccgcagccgcgccagcagcagccaaacccaaggcccctccggtcaataagcctgcgacagtcatgcggcgatttgcggtcaagccagcagccatcgtggtgaagcgcaaggcgccggagccagatggagagcctgctgtgcccgaggacgtcggcctgcagagccttctgggagggtacgactccagtgaccattacgagagccaatga

SEQ ID NO: 4808 - DNA, 714 bp, Chlorella protothecoides
atgtcgccgcaggaggagtcgtgggacacggtgggaatattcgtgttccctggcttcgagccgctcgatgcctacggcccaatggaactctttggaagcatgattcgagagggtctgcgcaaggtgaagcgcatcgtcttcgtggcggagaccgcgggcccggtcccctcatgcttcgggcccagcaccgtggcagagtacggcctcgacgactgcccccccctggacgtgctggtgatctcggggggcattggcacccgcatcctcatgcacaatacccgagtcgtggactggctgcgatcccaaatactcgatcatgacgtgcggcacgtgctcagcgtctgcacaggtgggtggggggtggggaccctgaaggcggtggactggcaaggtgctgccctcctagctgccaccggcctgctggacggcaagccagccaccaccaacaaggagctcttcacctacatccgccagctgtttcccgcggtgcagtggcagggaaccgcgcgctggatatcgcagggcaaggtggtcaccgccagcggggtgaccgccggcatggacgctgcgctctccatcattgagggcacctttggcgtggaggtcgcggagcgcgtggcgcgggacgtcgagtacattggcgactggaggcaggcaagcaacgacccttttgcgcaccattcctcctccgacgacggcgagggggccgggtag

SEQ ID NO: 4809 - DNA, 1275 bp, Chlorella protothecoides
  modified_base (255)..(264): a, c, t, g, unknown or other
  modified_base (854)..(863): a, c, t, g, unknown or other
atgaattggatttgggcaaggggtgggaacatgatcaggccccctgagccagctgtcatggtaaattcctgggcaagggaagcatgggagggggggaactcatccgtggaatgggttcagcccaccacccagaggaggaaggtccagatcaagtgccctgcatgctgcgggtcgcaccatggccatctcaaaccctgcacgtatatgagcccgcccccaagacgcccttggcttcatttggtcacctttgccggnnnnnnnnnnaagaaccgcgtggagaaggtgggattgatgcattggatttgggcaaggggtgggaagatgatcaggagccctgagcgagctgtcatggtaaattcctggggcaagggaagcatgggagggggcgaactcatccgtggaatgggttcagcccaccacccagaggaggaaggtccagatcaagtgccctgcatgccgcgggtcgcaccatggccatctcaatccctgcatgtatatgagctcgcccccaaaatgcccttggcttcatttggtcacctttgccgccccacaggtgccagcctcggactgggaggcgctcaagtcgccgctgctgggcctgtacgtccagcagtacgacccggccgacccccagacctacaagggccaggacctgaggagggtgacgatggcggtgagcccagccatggcatgccgcaggagctgtactctcagtacggcctggatgcgatgacggtggacttcatgggccacgccctggctctgcactccgacgactcctacatgcgccgggtgagaggcctcggggaaaagagggggggggcaatgccgccatcaggatcggggcctggcannnnnnnnnnacatgcgccgggtgagaggcctcggggaaaggaggggggggcaatgccgccattcggatcggggcctggcgctgccggccttctgtcccgggatgtccctgactcacaccatcccgcgctggagacggtgctcaagatcaagctgtactacgactccatgatgcggtacgagggcttgaagagtccctacatctaccccctgtacggcctgggcgagctgccccaggcctttgcccgcctgtcggcggtgtacggcggcacctacatgctcgccaaggccgacgcggaggtggtgtacgacgccgacagcgggcgcgcggtgggcgtgaagagcgagggccagaccgccaccgccaagtttgtggtgggggacgccagctacttcccctccaaggtgggtttctgggagtga

SEQ ID NO: 4810 - DNA, 951 bp, Chlorella protothecoides
  modified_base (82)..(91): a, c, t, g, unknown or other
  modified_base (935)..(944): a, c, t, g, unknown or other
atggtgcaggcgagaaactacatgttaccgagcgcagagcctcccacacgacactcgcccgatgccagaggagccttggcgnnnnnnnnnnaagaaactacatgttatcgagcgcagagcctcccacatgccactcgcccgatgccagaggagccttggcgctggcccgggagctggaaggggggatgcgcagcgacatcccaggcaaagggacaggtgacgctctcgggaaggagtggtgtcatgaagatgaggcgcgcagtcgcagacagagtgcatgctaatcacatgcatctctttcccttgcaggtcccgggcctgcctcgaatccatattcctgcaaccatggcgaaggccgtcgacaagcgtcaggcatacagcattatcggacttgccgcactgcaggtgactgcagacgccgtgggagggtctagtggagttccgtatgtgaactcgtgctctgccaagggcactggagtcgggagaccacttttatgttggagaaagggcgcatgctctcggtactcgagcgtcagggctcccgtctccacctgcacattcggccgcccacggatttgccggtactctacttccttccctgccttacccactcttcttcaccacaaacaggtcattttccaggtcgtcatcggcgccgtgacgggcaccaagctcgaccagggggatctgtgccagctcaacctcgacccacagagcggccgggtgtgcgatttcgtgtacaacaccgtgggcttcggcctgctgttctccctcatcctgattggtacagtggtgagtgggggttgttttcgggactggggtctgtgtagaggctctgtgctgcttgctgcacagcttcctggagaactggggctggccaaacgccccaatggcccttgtggcgaggtgatctgtgggctcctccctcacaacannnnnnnnnngtcctga

SEQ ID NO: 4811 - DNA, 705 bp, Chlorella protothecoides
gctacgcggccgacggctacgcgcgtgccactggcgtcggcgcggtggtggtcacctacaccgtgggcgggctgtcggtgatcaatgctgtggcaggggcctacgcggagaacctgccggtcatatgcatcacaggcgcccccaactccaatgacatctacagcaaccacctggtgcaccacaccatcgcacgcaaggggtccatggagcaggagctgcactgcatgcgccaggtgacctgcgaccaggtcatcatcagccagctgtccgacgcccacgagcagatcgaccacgccatctccgccgcgctgcacaactccaagcccgtctacatcgcggtctgcgccaacctggcggccctgcaccacccctccttcgacgcctcgcccgtcccctacagcatcacgcccaagcgcagcaaccctgccagcctggagcaggcggtgcgctgcgccgccgccttcctggccggcaagcagaagccggtggcggtggggggcgggctcctgcgcctggctggcgcagaggaggagtttgtgcgcctggtggaggccgcgcagtacccctttgccgtcatggcggccgggaaggggcttgtgccggaggaccacccgcagtggatgggcacctactgggggcagggcttgcagctcagtgtgcatgcggtggggaggtcgctgcgggttcactctcatgcgcgtgcat

SEQ ID NO: 4812 - DNA, 219 bp, Chlorella protothecoides
atgatcaaggtggagccctatcgcgtagtgattgcaggaggaaaaggagggcaggtctttggctgtgtccggatggacgacttcctgtgtggacttgcggaggcaatcacgcccaatgacaccgcccatcagatcttcaaacgcctctgggtgcccacgcccgtcgtagagcccagcgaggagggctcccccctgcgcaccaaggtcatttgcgcatga

SEQ ID NO: 4813 - DNA, 555 bp, Chlorella protothecoides
atggagctgtcgccgcacctggccccccacctccccgcactgttcaaggagatccggcgccggggtctggagctccacgcccgcccctatgccaccctggccctgtccgacatgggcgccgcgctgggcctgatccccgccgatctggaggcggagctggaggcgctgatcgtgggcgggcggctgtccgcgcgcatcgacggcgcggcgggcgtgctgcgcgcgcaccgccccgacgcgcgcgctggggcgctcggtgccgtcctggcggcgggagaggagtttgtcgcggccagccggctcctggcgcttcgggcctcggtcctgcagcacggtctggtgcaggtacttcttgtggctgtatatgtggaagaatggggggagggcatgggaaccgaaggtgggcacggactggtgctgtgcgctgggagttggacgctgggcatgtatgcgtggcggcgcacatgggcggcgtcgacactagggttcaatgtagtgtgtgccgcgctgttggcccggcatagctgtggggccggggctggcaccgagggctga

SEQ ID NO: 4814 - DNA, 1560 bp, Chlorella protothecoides
atgcagcacaagcagcgctgccccatctgcaaggcgtgcgtgggcaggagggaggtcgcccaggacgctgcgatggacgcggtgctcaacgcctttgcgaggctgaaggctgacaagggtgagattcacggactgtactcgagggagcgggtttcaggtttgttcagatgtgagcgcacagcctcccgaagtcatgtcaaggtgaaccgcatccaccctccaccgcttcgcagagaatgtgatggagctcgcgcgacaggtaggccccgggactgtgccccggacgcagagccagcggcccgccacctcccaggtgctccttcccggagccgcagaggagtgcagcgagcggggcacagggctcctggagtccgtggccctggcagggtgcacgggctcctagagtccgtggccctggcagggtgcgcggtcgatcaggtcccaccctgcagtccgcccaacgctcacacactagcagcagaccccctgtcgggctcgatctacctcccatcctcctcagtcaagaagcggcgcgtcccatcgtcccagctcgcccctgcgcccgaacatgaggctcccggcagcgctgccgaggacttcgtggtgccttcagctggaactgcggtccgcgggccccacgacgccgcgcctgccgagggcccgagccgtctcaggcggcgccagcgtgagcctggcagcacggcaacccaggaggcgtgcaccgcccagaccagcgtgacgctgagtcggcgagccggcacaggcgacgaggcagcctgtagcagttcagaactgcctggagcggcggcggcccccgtggcctcacccccccgggtgcgggatgctgccgcccccctcagcgggaaggcagccggcgccgagggccccgcccgcccgccaaggaagcggtcgcggcagagaggacccacgcggcgcgaggcgcggtgccgggagcgcgcgccgccgagggtcaggacgagcgaagggtctgggcggggcaatgcagtgggacgtcagcccggcaggggagctgctccgtctcaggggcggcgcacgcctttggacatgctgacccctgccgccgcagctgcgaccgccgaggaggaggagcggctgcgtcgcatccccacccgcctcctgccctggagctgctctgcctgcacgctggagaacaagttcgaggccaaggtgtgtgaggtgtgcctcacccccaagccaggcggcggcgcccgggcccaggcgccgcggcctgggtgtaccgcgcccagccccgacacgcaatctggcacgcgggcgccgtctcgcgccactggaaaggaggcgcgcggtcgtgccggccgcaagcctggcgccgaggaggagagccgctctgcggatcctcgcggagagcttgaggtcggcggcggcgcgatcaaggcgctggggtccgggctctccaacgtgccctcccccgggacactctgccagctggcccggtgtggggtcgaggtggttgacacctggcagccaggtgtgacgcacgtggtctgtggcgtcgacgcgcagggcgctgctacgtga

SEQ ID NO: 4815 - DNA, 1740 bp, Chlorella protothecoides
atgatgcggtacggacagaatcccatcatcatcctcgtcaacaacggtggctacacgattgaggtgcgagtggaggttggagttgcctgtgtggctcgacaggctgggcagccatgcacgtgctggcctcgaccagcagcggcgaaggtcacactcctcccacactgtcgagcacaggtggaaatccacgatggacccgctgacaacaactacaacatcatcaagaactgggactatgtggcccttttcaaagccatgcagaacaaggagggccagctttttgccaccagggcgaagaccgagaaggacctggaggatgccatcgaatttgcgaagaacgaggctgctgattcgctgtgcctcatcgagtgcattggtgatggaggctacgacgcgcgagcggaggctctgggggctgaaacatgcagagggtggtacaggggggccgctgaaggtctgaactggacgtggcaagagggtgagcgcgcacagggggaatctccgttgcagccctcgtcttgggaagcgctgaaaacaagtcacagaggcccatcccggccctcagcagccgcccttccacggtcgcgacagggcggcgggccccgcctgcagcccggcccgggccccacacagcgctccgtgccgcggcgccagggtcagccccgccaggtccagctcctccccgtgctgactcagagcgagctgggagacctggtgcagcgtgaggtcgcgcgtgacgtccaggcgcacgctgcgcccgctgcgcgtggtcaggtgcaacgtcaccggcgcgtcggcggcggggtccaccagccccagagccaggcccaggcagtgcaggaggacggacagccaggcaatcgcggcccgcagcgcggcccaggccgccgcctcgccgggcgtctgcgcccggcgctcgcgcaggagcaggcgctggcggtcgggcggaatgccggcgcgcgcggccacgcttgcgcgcagcttggccaggctgtcatcgggggaggcgacgaaggccacccgcctgtggacgccgatgttctcctcggcccaggccagaaggccacggccccgcacctcgcgtgtcaggctctccggcagcaccagccagttgaaattgtccagcacggtccaggccaaccgccggcggtgcgcgagacggttggcagtggagcgcagcagctccttgaccccgggaggccctcgctcctctgcatcaattgtgaaaaggcgaggaacgatgagccagtgcaatggtctataccctgcagccaaaggcagctgatggaaagaggtgaccaccacagtcctcctcaaatcaaggcaccacaccacaccttccacgaccaggctgaagcagtccggggtgctgccggcgaccttggccgcagctcccaagagggactccagcgagatgcctggggccatctccagccagctgtacccgccgccccgccgtctcacagccacatggatgggcgggggggtagggggctccggcgtggaccgtttcctgccaaacccggcggggaggagctgggaagcgcgctccatgacggcagtgtaggctgcagagccccggacccactccggagaagggggtggggtgggggaggactgctgcttcagctcccccgggaagctggaagtggggagaggcaccggccgggtggcaaggcagtccacgctcgaggacctcggcaggctcccatacctctgccccatggctcgcagtggtga

SEQ ID NO: 4816 - DNA, 678 bp, Chlorella protothecoides
atggcaaagagccagctggcggccgctgggggtctgtacagcctgtcccaggcaaagttcgaggaggcggcacgcagctatgtcgaggtatggggggtggacgggggactgccaccaggtggcagtgggaaatcttgtgaaggatcggatgccgagtcggctcgtcatatccaggacggtgaattctcagagccgtcaaccctcgccattgacatcgtgacgcaggtatcccccgacctgggttcggagttctctgacgtcatctctgcccaggggatgcggctggaggcggccttgcctgccgccctgtgttcctgtttggccacctcacaaatgctgtgcaagctgccctgcacagtagacacggtctgcaacccccctcccctcgggccccctccccccgggcgcattcccctttcctccacgcaggacatcgcgacgcatggggccatgtgtgcgctggcgtccctggatcggccggccctgcagagcctggtgatcgactcgccgggatttcgggagcacctggagtcggtgcccgaggtgggcgccgtgcggggctgggcgcggtttccttgtggccccggcaacttggtgggtgggggacgtgtggcacggcgcattgctgaaactcagctcatctcctcctctaccccgcccagattcgcgacgccgtga

SEQ ID NO: 4817 - DNA, 660 bp, Chlorella protothecoides
  modified_base (182)..(191): a, c, t, g, unknown or other
atggcaagtctgaccagcaacaagcacccctcccactctgcgccctgtgcgggctccttgtctcacgccgctcctgctcagcctccctcacacacacacacacacacgcgcggcgtgttctccactgcccttgcctcaatcacaccccactactcccaacttcccacccttcccatcccagnnnnnnnnnncggcgtgttttccactgcccttgcctcaatcacaccccaccactcccaacttcccacccttcccatcccagacgagatcgacgcgatcggcaaggcgcgcgatgcgtcctcggactcgggcacccaggagcgcgagcagggcctgctccagctgctggcggagatggacggcgcggtgcaggcggaccaggtgctggtcatcggcgcgaccaaccgcatcgatcagctggacctggcgctgatgcggccggggcgcttcgaccgcaaggtgttcatgggcctgccctcccgacccaaccggctgaagatcctcaaggtaaatgcggtgggtgcggggatcgtttctcatgtgcatgtgtgggggggtgggggagaatgcgctgcatggaaggagtccctggggttgggaatcgtcggcactcgatgcacaggcgagcatgccagtcctggtcgttggcgccgtgggtag

SEQ ID NO: 4818 - DNA, 750 bp, Chlorella protothecoides
atgagtcagcggggccttgcccgtgagtcgcagcagcgcctggccgactacatgtccatcctgcgcggcagccagaccgccgacctgtccgccaagaacttaggggacgagggttttgcctacatcatcgacgccctggccttcaacgaggtgtgcctggccgccgacttcagcaagaatgggatcggcgcagtgggcgcgagccagctggcgacggtgctccccagcaacggcacgctgcgcacgctgctcctcgacaccaatgccgtcggcgacgagggggctgctgagctggcaaagtgcctcgtgggtgcgctgggatctgtgatgcgtggggtgctgtgtcccgtcggtggcaacgcctcgctcaagtcgatcaacctgagcgggaacaacattgggaacgtgggcgccgccgcgctggcggaggcgctgcgcagcaacaccacgctgcgcacgctggagctggggtccaacgtgatcgatcctgccggggtcaagctgctggcagaagcgctggaggtgaacaccgggctgcgagccctgacgctaagcgacaactacctgggggcggagggggtggagaccctggcggcggccctgcgcagcaacaccgcggtgcaggagctgcacctgaagggcaacgaggtgggggacgccggggtaaaggccctgtgcgccgcgctcgagggccgtaaggaatcaggtggggtttgggcagggcttgagggaagggcctgtctgccgtga

SEQ ID NO: 4819 - DNA, 597 bp, Chlorella protothecoides
atggggtacaaccccatcggggcagagggcgcgcgcgcgtttgcagacatcctgaagtttgacatgcaggtggggtgggcggtgagggtctggcgaggtacctcgcggtgggccgggggagtggtgtgcaggtcggtgggtggtctgggccctggtgtgcccactggcactggggtgctcgtgattcccccccgccctcatcactccatgcaggtggagtccctgaagctgggctggtgcaagctggggcctggcgaaggggcgcaggccgtcgcaaacctcctgcagttcaacaccacgatccgtaccctggacctgcggggcaacaacctgggcaacgatggcgccatcttggtatcgcgggcactgaaggagcacaccaacgaaaagctgcgggagctggacctggggtacaacgagatcaaggacgagggtgcgtgcgcgctggcgcaggcactcaaggccaatgcggagggcgcgccgcgggagctcaaggtcaacgccaactacgtcacctcctttggccaggtggcactcacagaggcactggacatggtgtacgacatggccaagcgtcagatcaccatcaccttctag

SEQ ID NO: 4820 - DNA, 858 bp, Chlorella protothecoides
atgccgcacccgcgtcccgcccaactgccctgctttcccccgcccgcccgtccctttccaaaccccacctcgacgcctccatgcagggtggcggaggaggagatctttgggcccgacggcgcctcgctctccacggggcgtgagctgggcctggccagcgagctggcgcggtggctggtggtggactccacgctgcaccccgactaccgcaacaccgtcctgcgcagcaacatgaccctgggcggctaccccgaccccaccaccgaggtgcgagaggggaggggggacgagaggggcctgtgttctccctgggagggaaggggaatgtggatggacgagctgcacgacgacgccatcctggcgctgcaggaggcggcgcacgagcgcgccgtgctgctggtgcgccagcggcggcccgtgatcgaggcggtggcgcgcgagctctgcgacgcggccgacgagaccgtgcccgcggcgcgcatcctggacctgctgaccgccacgccgctggccgtgccgcagcgcgtcacggcccgccaggaggagcaccgcgccgtcgcggcccgtgtgctgggcgagcgccagctggcggacgacgtcgtgcgcgggctggcagaggtggtcatgggccgggccgagggctgggactttttgcagccgcgggtggtgtgggagaaggcggccgcggcctgcgaggcgctggcggatgcggagacgcgcgcgcgcctggccgccatgcgcgagttcgtggtcagtggcggcgccgcgccgctgcccccgccgccctcctccccgctgctggtgccggcagggcatggggtggggccccaggtgcccgaggacatctttgtgcgctga

SEQ ID NO: 4821 - DNA, 948 bp, Chlorella protothecoides
  modified_base (216)..(225): a, c, t, g, unknown or other
  modified_base (697)..(706): a, c, t, g, unknown or other
atgcgcccatccgcaccatcgggagtcaggggcgcaaagcggtggaggccatgtgccgccctacccgagccaaccaaaggacccagacttgctgcagaccatgagggccccagcaatcagccttccgtcattctgtcaagactgaaaacgtggccgacgagtgctctccattccctcatcgtggcgtggacccaaccaccatgtcacagctggcannnnnnnnnnggggcgagagttgagagtggtgggggtctcctcgcgtggatgcagagtttgagcctgtgtctgagcggccggcgagtgctctctattccctcatcgtggtgtggacccaaccaccatgtcacagctggcactaccatactggatggagtccagcgaaaaggtccaggcacgatggaagctagcaagagtactgggcttgacccttggcacgacgggcatcaggtgctggatggatttcgtgtgggtcttctttctcggtatgaagtgttgttgcgatcccataaaggtgtgacaggggatgatctgcatggactgtcagagtctgcagtgtattctgcttgggagcatgaagtgtctgcagccgctgggccctgccctgacattgcaggcctggatgccagcaagcccttggacatgtttggcaagagggaaatcccacaacatcagccactgtcaccccacgcagggattnnnnnnnnnngttggcaagagggaactctcacagcatcagccactgtcaccccacgcagggattactaccagtctctgttggctgtggagtggcgtgagtggatgacacgccgcttcacctccgactacctgtctggcacgtcctactacaacctcgcctcctccggcaccgtggacaaccctgatcagcgcatctccagcgatgtcaggtggccgtctcatttacccgcaacctctgcacaacatccatga

SEQ ID NO: 4822 - DNA, 1386 bp, Chlorella protothecoides
  modified_base (1077)..(1086): a, c, t, g, unknown or other
atggaaagagcaagagccttgggccacgagggatcacggggcagggcccctcctgcgggtagcttttgcatggatcaaccatcagccaggtctgcagttcctgaggcactcaaagccttccctgccaacggaatgcagattcttgatccagctgctgccggcagcggggtcatggtcgttgtctcagcttggagttttgttccccccacgcttcacactgttgctggccgcacatataaacgtttcccttcctttaggtcagctcccttccactctttcctcccagccttcaaccacatcctgggcgacgtgtccttggtggtctaccagtttgagtccctggccggcttctccgccatcatcgaccgcttggggcaattcagggagatcctggaggatgatggaggaactgcagcttcactttcctctggtaaggaagcgccagccctggacaaagggaacgacagccccggcacggcaaagttgaccaatggggtcgctactatctcagtggtcgagacggatgtggggaacacaggtgaaactaggcatgtggaggctgtgacttttttatctgcacctgggtgcagggcatacttcccagaatctgctgcctatactggcatccttcccagaatctgctgcctattttggggtgacacgctgctcacggtccaagatctgaccctcatcgtccccggcggtaccagcagcaaccccctcctcatcagcgccctggatctgaccgtcaggcgcaggtcctccgtcctcatcatgggtccttcgggggccggcaagaccagcctgctgagggccgtggcgggcctctggcgcagcggcagcggcaccatctgctgcccagcccgggggtcaggcctgttctttgtgccacagcggccctacatggtactgggcaccctgcgcgagcagctcctctacccgacctggaccaccgtggtcagtggccccggggtcagcggcgccgccgagtttactgtggtgggtacggggcgccacaatgggaagccgcagctcccgctgcccgacgacggccacctggtcgccgcgctgcagcgnnnnnnnnnntggggtcaacggcgccgccgagtttactgtggagggtacggggcgccaaaatgggaagccgcagctcccgctgcccagcgacggccacctggtcgccgcgctgcagcgcgcccagctgcagggcctgctggaaagggtggcgggcgacctggactgccaggccgattgggccgccatgctctcactgggcgagcagcagcgcctggctttcgccaggctgctcctcgccaggtccgtgggtgcggagatgactctgcgcaacgacccctgacgcctgcatggtgccttgttgtgaggtga

SEQ ID NO: 4823 - DNA, 1071 bp, Chlorella protothecoides
atgagcctcattcgagcggcagtcgtgcacccctctgctcctcgtggcttggcaagcatgcagtccctccccctcttccgctttggcgtcgtggccgacgtccagcacgccgacatacccgatgggagttccttccatggcgtcccgcgctactaccgtggagcattgcagctcctgcaacgcgctgtggacgacttcaaggaggcccacgtcaactttgccatgcaccttggagatgtagggcatccaggtggggtcccactcagcatgactcatcccccttgcaccctctccctgacagattgtggactttcacaactcagtgacccccgcggaggcgagcgcggtgcggtccagaccagactctgcgctgcaggacgtcctggacatctttactcggctggaggcgccggtctaccacatgctaggcaatcactgcctgtactgccacagccgcccggtgctcaaccagcgtctggccccttgacacacccctcgaccacccaaccaggcatcagcgagctccagggtgggcagcagcacagttactatgccgtccagccactggccgggtggcgggtgctcgtcctggatggctatgacgtgagcttgctgggctgggagccggggcacccgctgcatgagctggctgaggaaacactgcaggcccggaaccccaacaaggtgaggcctgtgtggcttggagtacgtaggacgtctcgtcagccgtcaccggatcttggtctagctgccgctgggctgcacggcggtgcagggagcgtgtggggcggcccacgatgccacaacagcagtcgctacatggagtggcgtgaagcatcactgaaaggcgtgagcaccttcagagcccattccaaccagcctcccccatttccccaatcctcaccaggagaagaacagccccgacggtctggagggcatggagcggcgcttcgtgaagtttggcggcgggttgtcggacgcccagctggcgtggatgcgcagccagctgggcgaagcgcgcgcagcgggcgaccgtgtcgtggtggcctgccacctgcccatgcaccctga

SEQ ID NO: 4824 - DNA, 786 bp, Chlorella protothecoides
  modified_base (22)..(31): a, c, t, g, unknown or other
atggatctttgcatccctgttnnnnnnnnnnatgggagcaggtccagcctggtgttgagtcaagtggccaggcagggccctccgctccattggctgggccgaggtggcaagcaagggcctcctactgatctcaggcgcccaaagcctggcccacatgcaatggtccacacgagagaagcagaccccagcgatcctgccctacacagactccatccggcctcccacttcccactggacctccttcggtctcctctcctacagctcattcacacccctccccaatccaccccccagacgctgcccagcgagtccctgtgggactccgcggacggggcggccgcctttggcgtgtctgccggcgccagcacgggcgaggtctcggccatcatcctgctcaagctggtgatggacaactacctgaaggcgggcgggcgcggcgcgtacgcgcccaccctcctgctgctccagcgcgcgctttcttctgggcggcctgctgcgcaggcccgcgtctttgacctcctctacaacctctccctgcacggcgagctgctctatctgtccccagccgcggaggtgcccgagacggcggccgccatccgccagagcggtgcggatcgggcggggctggcaggctggaggggagggggagggggatttccatcaacaccagcagactgggattggtgtctgttttgccgacggcgctggcttgcggacctcccgtttcagcagcgccgccctgcgccgctgcagcacagcccgtcttgtggcctgtgcgctgcctga

SEQ ID NO: 4825 - DNA, 198 bp, Chlorella protothecoides
atgccaagcttgcatgacactcgaccaccccaaaacctcctttcccctgcgcgcatcccaggcatcacgtatgtgagcgtgggccaccgacccaccctggtgcggtaccatgaagaggtactgcagctgcatggcggcggggcctggaccctgcacgccgcctccgaggccaagctggacctcctcggcgcattttga

SEQ ID NO: 4826 - DNA, 264 bp, Chlorella protothecoides
atgcgcgcaatgcaccaggttgcgggcgtttcgtcgctgcccctgcgtcctccccaccatgaagcgctgtgcatgcccccctcatcccctccgaccctccctccggcctgggccttcaacctcccaggccgtggggacgaggcgctggtctgggacacgctggtcgactgcctgagggaccagagcgagctgggcgcgcacatcggccgcggctggctgctcaagctgctgttggccagcgccgagcaggagctgcagcggtga

SEQ ID NO: 4827 - DNA, 375 bp, Chlorella protothecoides
atgaagtcatctcccaccccctcctctaaaaatcaaaaacacctactgcaggcggtgaacgcgccagcggtcctgctgtccacgctgtgcctggcggtagagtggctgctgcaggccccgcaggaggcgcgccagggggccatgctccaggccacccagctcctgctttccttcatcgtggtcacccccggtgcgggggaggaagcacggggcgacgcctcgcccagctcccgcccgcgccggcgctctacggccggctgggccctgggcccgttgggcgaggaagcggcgggcgagggcagcgtgggcgaggccggggcgggggaggacgggcacggcgacggcggggcgggggagggcggcgatcacaccggc

SEQ ID NO: 4828 - DNA, 555 bp, Chlorella protothecoides
atgcaccgcatgcatacctccacgcagctgctgcgatgctaccgggaggcgccgacgtccagagctcgcagcaatgtcttctgcgtcatgtatgactacatcacctcctcgcaggtgggccaggtcctgggctgtgttggataccagcacgggctaaacctctttggtttcatctgggggcctgaagggtcgagtatgtgcaccagccgcccatcgctccatcgagctgccagcctgacaacccccctttcaatcacctccacccatctgcatcccttcttgcaccaccacccccatctttacccccagggccccaacgagtacgacagctggtcccccgccctggcccagggggcgcactcctccgaggtggtggcgctgggcgcggccctgctgcacctgcgcgccgccgacgcgctgcaccccatgttcctggcgggcacgccggggtacgttcccggcgtggccgacgagctgaccactcagatggcggcggtgcaggtgatgctggtgatgctggtggctttgatggtggggtgttgggtgggagtttga

SEQ ID NO: 4829 - DNA, 576 bp, Chlorella protothecoides
atgggcacggtgggccccccccagcccgccatctccttccgcctggagggtgtccctgagatgaagtacagtcccagcgccgacccgccccgcggcgaggtgtgcatccgcggcgcctccctgttcaagggctactacaaggaccaggagaagacggacgaggtgctgacgcgcgacggctggttctacacgggcgacatcggggagctgagccccacgggcggcctcaaggtcatcgaccgcaagaagaacatcttcaagctgtcccagggggagtacgtggcggtggagaaggtggagaacgcctacaagctctgccccagcgtggagcagatctgggtgtacggtaacagcctggagagcgtgctggtggccgtggccgtgcccactcaggggcgcctggacgcgcacggcggcgcaggtgacgtggccgccaagtgcgctgacccggagctcaagaaggccatcctgaaggagctggcggcggccgccaaggagggcgggctcaaggtgggaatgtggtcaaggggtggggggggggggggaggcggaggatgggctgtgggtggcctgtga

SEQ ID NO: 4830 - DNA, 1158 bp, Chlorella protothecoides
  modified_base (674)..(683): a, c, t, g, unknown or other
atgtcacgcaagaacgacgtgcttccctttgaggcagggggcgacgtgtggctggagtcgcacggctccagggccaactgcagcctctttgccgtgggcacacactccaagaagcggcccaacaacctggtgctggggcggctgtacgactttcgaatgtatgacatgatcgagtttggggtgaaggggtttgcccccatccaggctttctcaggcgcacgctcttcccagctgggaaacaagcaaggccacccaaagatggaaggagaggttgatggctacatgtgtgtcccaacctctgccctctcatcgcagcccgcgtttgtctttgctggcgatggatttgagagcgatgccgtcctgcggcgggtcaagagcatgttcttggacttcttccgcggcaggcaggtggatgcgctcaacctgaagggcctggacagggtggtcttcgtgacctgtctcccagggtcaaagaccatagtgttccgtcagtacagtgtcaagctcaaacggtcgggtgaggttgtggccaacgtgcatgttatggctgggagctgcacgaggatggggcaggattcactgtttattgtatgggcctgggctgagagacttctccaggctcacagtgggaatcgtctcactccaactcacacaaccagggaccaaggtgccannnnnnnnnntgatacttgcctgacctacacacctcactggggcaggatcgtctcactccaactcacacaaacagggaccaaggtgccgcgcgttgagcttgagatcatgggtcccagtctcgatctagaggtgaggcggaccagggagcctgcggccgacctggaaaaggaggccatgaagcagcccaagctgacgaggaccaaggagaagaatgtggcgacagatgcgctggagggtcgggtgggacgcatctacatgcctccccaaaacatcgacaccatagcgctgcacaagtccaaggtgggcgaggcttccctccggtgctggcctgcgcacaacgcgcattcctcattatgtccgaggcgtattgcgagctcatgtctcctttacaaccacgataacacgcagggcctaaaaaagaggaaggatgcgccggaaggagcggggggggcagaggcgaatggtcagaagaagagggcatga

SEQ ID NO: 4831 - DNA, 372 bp, Chlorella protothecoides
atgggcaacagcaaccacgacgtggcccgcgccctgctggactgcgcggtacagctgctggcggcgggccgggtactgcaggtactagagtgggcggccgaataccgtgcgcgcgccgacccctccctcctgcgccacctggcctacggcgtgcttgaggcggccctgcccccctactcccccgcctttgcctcggccctgctgcgacttatgatgcatgccggggtcaagcagccgcgcgcccccggcagggacgcgggcctgcgcgcgctgctagatgagttcgccgcggggtgcagcgccctggagttccggccgcccctgtcctcgcgcgagtccgccttcctcctgggcctgtgcgatccgcgctga

SEQ ID NO: 4832 - DNA, 1782 bp, Chlorella protothecoides
atggccgtcccgaaactggacccgagtatcgggggcgcagtggcgatttcggagtactcatcatgggcgggagtccctgatgacgctcgtcatggcctggggccactctggggactcctatccggctcacccttgctccccactcctcgccaccgcagggttcgcgtggccaaggacggcccccccaccgtcaaggacatcaacaccctgtccgacctgttcagccactcagtctcccgcttcggcgacaagaactgcctgggcaagcgcacgaaggaggggtattcctggcgcacctactcccagaccgcgcgtgaggtggcggcggtgggctccgctctggtgtcggcggggctggcccccggcgggcgcgtgggcgtttacggccccaacgcccccgagtggatgatcaccatgcaggcctgcaaccgccagggcttctactgcgtccccctgtacgacaccctgggcgagtccgcggtggagtacatcgtcaagcacgccgaggtgacggcagtggcggtgctgggctccaagctcggcgccctggccgccagcctgcccgcgctgcgcgaccgcgtgcgcaccgtggtctactgggacgaggccgacgcggccacgctgcgccgcgtcgccgacctgggcatcgccgtgcacgctttccacgagttcgtcgcgctgggggaggcctcgcccgccgccgccgccaccgtgcaggctgacgacctgtgcaccatcatgtacacctccggcacgacgggcgaccccaagggcgtcatgctctcccaccgcgccgtggtgtccaccgtgctcagcctggacgccttcctgaccgatgctggggtgcgcatgggcaccgaggattcgctcctctccttcctgcccctggcccacatcttcgaccgcgccgcggaggagctcatcctctacgtcggcggctccatcggctactgggcggggaacgtgaaggagctgctgccggatgtcaaggcgctgcggcccaccctattctgctccgtgccacgcgtcttcgaccgcatctactccaccgtcacggggcagggtcctgacggtgcagccctcatcctcaccgccacgctcgagtcccagccctgctccgcccacccccccgcaccctccctctcccacatcacaccccagatcgccagcggcggggcggtgaagaagttcctgttccacactgccttcaacaccaagctggcccgcctgaagaggggcgtggcccaggacaaggtgcgttgtcaaacactgcggggcgcaggggcttgcggggcggtgtattggctgatcgcggcggtgtatgggctgatcgcgtgcctcgcccgcaccccccaccagttcagtgccttcccctggctccctggtgctccctgccccactcgcacgccgccacactcttccacgtgccttcaggccgcccccatctgggacaagatcgtgttcaagaagatcaaggccgcgctgggcgggcgctgccgcgtgctggtgtctggcggcgcgcccctgtcgctgcacgccgaagagttcctgcgcgtctgcatgggcgcgctggtggtccaggggtatggcctgacggagacctgtgccgcctccttcatcgcctacccctccgaaccggtgcgcgggcgtcgtggagggggagggggaggcggggaccgcgaaggacatccacagaatgcggcacagggttggccggaagagcgccgtggcgtcgtcagaccctgctggtgcccggccccgggctccacctgggctcgttga

SEQ ID NO: 4833 - DNA, 285 bp, Chlorella protothecoides
gctacgcccagatggctgtgctggtctgccagtggctggccgccgtgcaacatggggcagctgagaatgaccctggaaccccacgggccgccagccagccccctctggacgaggcctcctgtctcagagtgggtgggcttgatgtcagcgctaggccctgcagctgggtcctggagctggtgaaggagaggtttgaccccaagagcttccatgggatcttctccaggggcggggcgggcgcccccccatggctgcactccctgattgccgatgcaggtgagcaat

SEQ ID NO: 4834 - DNA, 1302 bp, Chlorella protothecoides
atgtcaaagcccttcctcatcagtacgataacagaggacgcccgcagacctagatcaggcttgccctggagagtgccacaccatgcatgtgctcccgatgcccagcttggatacgcagtggctggctctccatcctcccgtcctccaccccctgcgccgacagacgggcgccagctcatctacgacctgtctggccgctacgccaactcgctgctgctgaactttgcgatccagaagatcctgcagcagcccgggcgcgaagcggaggtcgcggcggtcgggccgcgcctgggctcctactttggcgtcttccaccggctcatggtcacgcgcctcagtgctgccctggcctccaccagcgagcgggagctggacaagctgtctgcggagatacaggcacgcggagggggagggcctggaggtagtgtgcctgcttgcctgcgtcgatttcgggaggaaggatgtcgggatgttgggtccaggcctacttttgctggccccgggtatgcagagaggcaaaacgccagccagagccagcacacctacattcacgtccagtcggtgttacagagcctgggcgcacacccccagggggcccgctttcgccggctggccgctgacctggcagggcatgccgcccagacccagggcgccgtggtgtggcgcctgagcccactgttctggggcgagccggggtctggggccgtgggtcccctgctcgccgacctcatggccagcgtggagggcggcccgctgcccagcctggaggtcatcaggctgtgcgccctctacggcgccgagccggccgaggcgcggcccagcctggacctcctgcgccaccctcgagtcttcagggtcctgctggcggccctgtttggccccgggcaggggctggcgggccaggccctcgccgccgcggtcgagctgctggcgcgagccgcggcgggcgggcccgagcgcgaggcggcggtggaggccacgcgcgccgcgctgatgggggcggtgacgctgacgcgcaaggcgctgcacgacgccaagctcagcgcggaagagctggagggaacgggcgaggtgcttacggaatggcagaactatcagaagaagggctgccgccctcctcccttccctgccgtgggcccagacctgattcggcctcgccatcgacgcagggctgctgtgcggcatggaactgcgcttggccaagccggcctactggagcacgaccttccacggtctgcgcctgcctcccttcctcgccctcctccgcagggtcataccgctgcagccccagctccacgatga

SEQ ID NO: 4835 - DNA, 552 bp, Chlorella protothecoides
  modified_base (191)..(200): a, c, t, g, unknown or other
  modified_base (503)..(512): a, c, t, g, unknown or other
atggaagcaggggcagctgggtttgtgaggaggtactgtccaggagccctggtttattggctggcaaggcagggtgcgacacgctcaagggatttgggaacggacagtcatgcagaccgttcctgtcctactgttgctcgggtctcgaaagtcgacctcgcgattcatgaaaagccccacctgcgctcttnnnnnnnnnncgagcctgatcgctgtggaggaaggcggcaggcatgggccggcacggcgatcatgccaccaccgcagcgattcaagggctcaggtgggctgctggacaacgcggcgctgcagcaggtgtgccccatcccctttgacgagggcaggctctggcgtggcgaggagggccccgtgctgaaggagcagctgcgggtgagcggggatgtcgggtgggggtggggagtaggcttgatgcttgcagccgagcatcgtcgtgtgtacctgggagggggcagccggtcagcctgcggcaggaggacagggannnnnnnnnntgtccagcagcctgtgcggagtgatgtggagggagcgcag

SEQ ID NO: 4836 - DNA, 1518 bp, Chlorella protothecoides
  modified_base (767)..(776): a, c, t, g, unknown or other
  modified_base (1361)..(1370): a, c, t, g, unknown or other
atgctggacaatgtgctctatgcacgtgctagaggagtgacaccctcccttcccgtgctcctataccaggacctcgcgggtttgaatgagcccaactcctgccatatgtctgggaccgtggtggactgctgtgagtattcatgggttgcaggatctggtgtttccgggggtcgtcattgggggtgctccaatgacaagggcgggtctggtgtttcggggggctgtcatcgggggtgctccaatgacaagggcggctgcagctactcggcggtggagcaggtgaatcgcgacgagatcggccccatcctggacaagctggtccagtcggccttcttccgctacttcaaggtggacctctactgcgactgccccttctggccggacgacggcatgtgcgccatgcgcgattgcagcgtctgcgagtgtgaggaggacgaggtgccaaagatctggcgcgcggccgaggggcgactcgcctccgccgactctcccgccgccgcctgcgcaggtgcgtgtgttggagggtgggagttcaggggcgacgaggatgcatggcacggtgttcgttggtcactgcacttgggagcacggaagccggggttgttccctcctggccagtggtttcttgcagcacggaagccggggtcgttcactcctggccagtggtatcttgcagatttgacggccggctggggcctctcgggcagaccaccaacagatcgctccgctgccccagcactccctcccttcaacccccactctatccnnnnnnnnnncaccaacagatcgctccgctgccccagcaccccccccctcaacccccactccatcaaccaccccacgagcagcggcggcgcaggagtcagcgctggaccgcacgctgcagccagacatccgacgcgcgctgctggcagtaccagactggcgcgggtatcgcaacccctggatgccggaggcggacgacgccggcgtggagtacgcctacatcaacctcctgcgcaaccccgagcgcttcacggggtacgcgggggagcacgccgcacgcgtgtggcaggccatctacggccagccggggctggaggcaggggcctctgccgcgccggagctccgggtcttctaccgcctcatctccggcctgcatgcctccatctccgctcatctagttgcggaatcgccgctgcgcgacgacacgcgcgaggtctacgcctggggcccggacctggccgagttcaagcgccgcctgggctccccggagctgcgggaccgcgtggagaacctctacttcgcctacctcttcgtgctgcgtgcggtgcagaaggcagcgccccttctgcgcggcgtggaatactccacgggcctgnnnnnnnnnncctctacttcgcctacctcttcgtgctgcgcgcggtgcagaaggcagcgcccctcctgcgcggcgtggaatattccacgggcctaccggaggaggacgcggccacgcagcacttcatgcacaagtgggcgtcatggctggggttttga

SEQ ID NO: 4837 - DNA, 660 bp, Chlorella protothecoides
atgacgcaaacccctcacctgagtaaccgtgcgggggaagccatcaagcacgaagccgacgcggcactccggggacttgatgttctcctcgatcaggccgaccacgatgtcgtcgctgaccagggccccagactccatggccttcttcgcttccaggcccaggggggtcttggcggcaacggcggcgcgcagcatgtcaccggtggccaggtggcacaggcagttctcgttcttgatggcgggggactgggtgcccttgccgcagccgggaggccctgggtatgtgtatgggaggggggtgagaatggaaatttggtgcacagggggccccccctggccaggcagccggatgggatgtcgggcccccgcgatcccaccatgcatccacccacctatgaggatgaggcgcttctcgggcttgttcaggcactctatccgacgctgcacctcatggatgagctgctcggtggtcacctcggcgaggtcgacggagggtgccatggtgtaccagtggtgcccgagcaggggttgatgcgaggtcgtacgatgtcaggcacgataggtttcggtacttgcgtatgttggcacattcatgcgcgctcgagcgtggggagcaagcacggttactaccgattcatgactcagcgtcggtgggcttga

SEQ ID NO: 4838 - DNA, 1134 bp, Chlorella protothecoides
gcgcgccggcgcggcgcggctcctggcccccggccgcccgccggccgccggccgggggcgcaacccagccctgcggcgcgactcgggcgccgggggccttttccagccgctgcccaccggcgcctttgccgccaagtgggaggacggccacgtctggaccgcctccgactttgtcctgcgcgcggggtaccccctggaggagcacaccgtgaccacgtcggatggctacatcctcaccatgcaccgcatcccacgcacagtctcgcatacccgcaaaacacacctccccacccccaccaccacagaccaccacccctcctcccctccccttcaggtggaaaggaagtcacgctcttccagcacggcgtgctggacacctcgctgggctgggtggccaacggttcggtgggcagccaggcctttgcggcctacgacgccggcttcgacgtctggctgggcaactcgcgcagcaacgcgccgcgcatgcacgccgaccgcgcatgccagggcctgcggtactggcactacagcgccaacgagcaggccatgggcgacgtcggggcgcaggtggagcacatccacgccgtcaagatggcggagctgggcgggagcaacggcggtggcaacgagagggagcgcggcggggcggcgggggaggggactgcaacctcacacgcagcagggcgattccgcgaggacgcaccggcgacacgctccagcagccgtcggaggaggacatccggctccaacggggcggcgccacggcgggcgcccccggccgacgagcttcaaggggatgatgagggcgagaggcgagaagcgacggccagcgccgccggcgcgggacgacgccaccccgcttccgaccacccgctacaagggcctgagtttcaggatccccgaggagcgccgcgaccccgcccccgagcacctgccctacaatcttcagggcgtggggcactccctgggcgcggcctgcctgctcatgtacgtcacggtgtgccgcatgcagggccggccacatcgcctgcggcgcctggtgctcatgagccccgccggcttccactcccacgtgcccagggtgagcgggggcctggtggtggggggatgatcgaggaggggagggactcgtga

SEQ ID NO: 4839 - DNA, 483 bp, Chlorella protothecoides
atgtgggagttgatcgctgccgctgctgccgggctcaatgccgggtcggggctctacattgccgcggcggagcaccccgccggcctcgaggcgggcgtcgccacctattggtccttctttcccaaggtctccaccaaggccgtgaccctgtccaccaccctgtccgtcctgactgccgccggtgctgccgcagcctacttcacaggtgaccctgatcgggacccagcctggctgacgtgcgcggcaggcgccctgaccgtccccgtgttcgacttccttttcgtcgccccgaccaaggccgtcattgacagccgggtgatgatcgaccagccagtcgcagagcgcgagtcgtggctcaggtcctggggccgcaagcagatcgtggatgtggcgctgaaggtggccacttttggtgccctgctcctggttctgggtgccaagggcgaggacggcgcgctcgctcgcctgacgcgcccccgctga

SEQ ID NO: 4840 - DNA, 492 bp, Chlorella protothecoides
atgccacactacaaccagtacagcatgcccgccctgagcctgcacaccggcgcccacctggtgcagctcataaatgagcgccgcttccggctgtacgaccgcgggtcgcggcgcgccaaccgcgccgcctacggcgtggcccggcccccggacctggcggcgcagtaccacctcctggccgggctgccggtggacatggtggcggggcggcaggacggcatcgtggccgcggcggacgtgcacacccactacaccatgctgcgcgacgcgggggtgcgggtgagactgaggaagtatgggcgtgggaggagggggatcgaggcggacacccagcccttgggtggtgaggtggggggccgctggccaagggcgaccttcaaggagtttgacgtgggccacctggacgttgtgtttgcgatgaaggacgaggtacagcattatgtactgcatcgcctgctgctgccccccgccccccttgggcccctggcgtga

SEQ ID NO: 4841 - DNA, 387 bp, Chlorella protothecoides
atggactgtgtggggtgcgagaagtgcaagatgtggggcaagctgcagttcctgggggtggccaccagtctcaagatcctgttctccgccgaggactgcagcggcgccccagtccccgagcaaggtgcgtgctgtgggagggttggggcgacgcagggccagctcaggatctggcctgtcccctgcctctacaaccccaggctggagaggaacgaggtcatcgcactcgtgaaccttctggagaggctgagcaactcggtggaaaccgtgcgcacgctgagcgtgcagctggcgggcggcagcgttgcgcacccccagggcctgggagccatccaggacgtggtgcagcacggcctcgcgccgcagctgcgcaccggggggggatga

SEQ ID NO: 4842 - DNA, 666 bp, Chlorella protothecoides
atgaatggtttgtatgagggagcttggatcggtgccgatgcaagcgcctgcgcggtggtcggcgctgtgatcggtggcgacccaccattccccgccacccaggactatgtgaccttccttgactcgttcccggcgccatcggcggtgtcggcggggcgcccgcccccccgcgaccccgggcgtgacggcgggcggcgcgagggcgtggactttgcgctggaccgggcggtggaggcgctggcccgcgaggtgaccgccgagccgggcgtgctggccttcctggccgcgctgcgcgcgctgggtggcacgggcctgctgggcgcgctgcgcacctccacccgcatccggctccaggccgagctctacgcgctgacgcagccgggggggccgcgctacgcctcgcgcgccgtcaaccgcgccgccttccgcgcgctggacgcgctgttcccgcgcgggcggcgcgcgcggcgcctggtcaacgccgccttccgcgtgctgcacccgggggagtggccttggctctggtgggacgcgctgtgggacggcgcccgggccgtgagggcctgggcgcggctggcgggccgggccgcgagggggctctgggcacggctcgccgcccgactacggtggcggccggggacggggcgcggtatcctgtgcggttga

SEQ ID NO: 4843 - DNA, 714 bp, Chlorella protothecoides
atggccaactgggaggagacgttgaaggcctgcttgcgggaggtgctggcgtacgccacccgcctgctcaacggcgcctccaacgccgtggtggccctgctgtttgggcgctccgcctcgtcgcgcatgcgtgccacccgagcccgtccctccccctgggtcgattggtgggcgagccgaggccggggccggacaggcaccttcaatgccatcctggctcgggatggcctggtgccgggtggggagagagcgggagcggatgggtctattgcgccggggttgcacccacccggccgcgcccagcgccagggatgcgatgatggtctcacacgactgccgccgaagtcgggcgctggcacgccgtggcgctggcggtgggggtggtggcgcggccggcgggggcgcggggcctcggcaagccaaagcggccctcgtgcagtgcgcaccagagtgcaaggcggcgagcgcgccccgcgccccgcgcacagcagcgggagcgagctcttccggcggccggggggctcgggacagtcgcagggcgccccccggcgcggtttcatggaggaggggcgcctgaatgccgagctggcgctgaccaacacctttgcctggctgcgcaccgccacccggcaggcgctgatgctgccggaccccagcgtcactggcagcggcgatcccggctgggggcccagcttcaacgtgagaggggtttga

SEQ ID NO: 4844 - DNA, 852 bp, Chlorella protothecoides
atggcaccctccgtcgacctcgccgaggtgaccaccgagcagctcatccatgaggtgcagcgtcggatagagtgcctgaacaagcccgagaagcgcctcatcctcataggtgggtggatgcatggtgggatcgcgggggcccgacatcccatccggctgcctggccagggggggccccctgtgcaccaaatttccattctcacccccctcccatacacatacccagggcctcccggctgcggcaagggcacccagtcccccgccatcaagaacgagaactgcctgtgccacctggccaccggtgacatgctgcgcgccgccgttgccgccaagacccccctgggcctggaagcgaagaaggccatggagtctggggccctggtcagcgacgacatcgtggtcggcctgatcgaggagaacatcaagtccccggagtgccgcgtcggcttcgtgcttgatggcttcccccgcacggttactcaggccgagaagctggactccatgctctccagcaagggcgccgcgattgaccgcgtgctcaacttcaacgtgcccgacagcctcctggtggagcgcgtgaccgggcggctggtgcaccccgcctccggccgctcctaccacaccaagtttgcgcccccgcgcaaggagggcgtggacgacgtgaccggcgagcccctgatccgacgaaaggacgacaacgcggagacgctcaaggcgcggctggaggccttccgcaagcagaccgcgcccgtgatcgagcactaccgcagccgggtggtgaacatcaagggcgaccagtcggccgatgcggtggcagcggaggtccgggccgcgctcaacgcctccacatga

SEQ ID NO: 4845 - DNA, 780 bp, Chlorella protothecoides
atgacagagacgtccgggtcccagcccccggggtgggacatgcggcgcaccgtgagctcccgtgccgtgcagggtcgcctggcagccgaggtgctgcgcaagctctccctggccgccagcgccgacaggaaggaggaccgggacatcatctgcagcgaggtgtttgccgacatcaccggcgacctgaacagcgctgctcagggtgcgttaggaggatggacttggctggctggtcgggggggcctgcgtccactcttcacgcaggggtgtctgacgccatccactccgtttcctccttcgccatcttccccttcccgatctcaaaaacctgcaggcagcacgggcacgctgtacacccggtggtacgaggtgctggccccctacttctgcgccgacgagggtgcgagcgaggcgctgctttccgcctgccgccggctgtggggccagcccttcaccacccccacctttgccctgctcctgcaccagtggctgctggtgcaccccggcgcgggcggcgcggaccagcgcctcaagtacctcaacgtcctggtctccggcgcgcgccagctgttcgtgggggacgccgagacggggagcgccgccttcgcgcccatgttcagcttcctggccgagcgtgtggtgctgtcgcccggtggcgcgcgcctggccgccctccccgagaccgggcgggaggcggtgatggccctggccgcctccttcgcgccctactacctggggccctcgggggtgagcgcttggggggggaggggcgggttttga

SEQ ID NO: 4846 - DNA, 489 bp, Chlorella protothecoides
atgcaggccttcagccccgcttacctcctggtcaagcggccggagaagggactgctggccgggctctggcaattcccgctcgccgagcttgagggcggcggggaggaaagcgcggccaatcagcagcgcgccgtggactccctgctggcgggcctcctgcccggcctgtttgatgagtccaaggaaagcaccgcgccgaaggtcgtgtcgcggcgggcgctgggcgaggtcgtccacatcttctcccacatccgcatgaccatccgagccgagcacgtcctcgttgcggcctctgccgcccagctggaggactggaagcgtggctcgggccgatccagcgagtgcccggagtgccagtggctggagcaggaagccctggacgccaagggcctcagcagcagtgtgcaaaaagtcctgaagctgtacaagagtgcggccaaggagaagaggcagtccatcaccagattctttgcggcgaagaccgagtag

SEQ ID NO: 4847 - DNA, 291 bp, Chlorella protothecoides
atggagctgggggcgacggtctgcgtccccggcaccgccccgcgctgcgacgcgtgcccgctggcgggccgctgcgccgcgctgcgccgccagcgagagcactggggcgaggcggggcccacgccgggggggccggggccacgggtcaccgactaccccaccaaggtgcggcggcgcatgtgggtgattgaccccggttttgcgtggggaggggggctccatgcctcctgcagaactgaaatcagctctccacagaagcgacacggggtccagcgggccccgcagcgttga

SEQ ID NO: 4848 - DNA, 273 bp, Chlorella protothecoides
atgcctcggtccagctccttctcccacaacctgcgtggcttgtcccggaagccgtccttcaactcagccgaggatctgcagcactggacggtggccgatgccatactacgagcagggtacccgctggagagtcacattgtcaccacagaggatggatacatcctcaccatgcagcgcatacctcgcaagggtgaggggcctgtggctggagtggggagtggaccggtagtgtgcctcctctgcgctgggggattggtgacggcctcaacgtga

SEQ ID NO: 4849 - DNA, 2436 bp, Chlorella protothecoides
  modified_base (82)..(91): a, c, t, g, unknown or other
  modified_base (770)..(779): a, c, t, g, unknown or other
  modified_base (861)..(870): a, c, t, g, unknown or other
  modified_base (1319)..(1344): a, c, t, g, unknown or other
atgtacgagcaatcattagcataccttaccagctcatactatcaacaggatcacttggtcaatggcatagtccctgccacannnnnnnnnncacgagcaatcactggcataccttaccagctcatactttcaataggaccacttggtcaatggcatagtccctgccacacaggggggatggccagcagggagcttttcgctgattggacccttcgccagctgcaggcaaggggactgcggctatgctgtccagatagcacactacgttctaatgcattacaatgttatccatgttcaaccacgaaaggccactcctcccactcctcaccccttgatgcccaggagtacattgacgaaagtggtggcaattctgccagtgcgaggagcagggagaatctcatcaccgaggcagcccgcatctcgcagcttgcacaggagcacacagccactcgcccatgccagaacaccaaattgttccacctgagcatctgcatcgcaggcagccgggaagtcagtccaagcgcctgctcccctgcctggccggggcccgaccgagttcttccccggcataggcagcgaatcagggccgccacccttcccacaggcacagccgccgcccctcccccccggtccaggcccggcgccgtatggcgggccacccatccctcgcgtcggtggcccgggtcaagtccctgcgcccatgcccccggctggtggggccaggaagaaggcgttcattgtgggcatcaactaccggggtcagcgcgcgnnnnnnnnnngggggtggggaagggggaaggggaagaacactgcttgaatcaggaaaaagcctgggtgcagactattccggtggcacaggcnnnnnnnnnncggtgggcccgggaagaaggcgtttatcgtgggcatcaactaccggggtcagcgcgcggagctgcggggctgcatcaacgacgcacagtgcatggagtacatgctgcgcacgcgctttggcttctcccaagaaaacattctgctgatgacggaggacatcagggacccaagccgccttgccccatgcctcaaatgagagagctctctcccctgactgacctccacaacacacagacccacgcggtacaacatattttgcggcatccagtggctcacttcagggatgaagccggtgcggtagggagcaggaggattcggttgcatgtccttgacgatgcagcgccctctttagccaatgcttggaggggggattccctggtcttccactactccggtgggtacgtgagcagtggggagcgtgggcatggacagagacacacccatgtgcnnnnnnnnnnnnnnnnnnnnnnnnnnagccagcagcctgactacagcggcgaggagccagatgggaaaaacgagacattgtgccccttggacttccaacaggccggcgagattgtggacaatgacctcaataggtacctcatcaatcccatccctcaggtaaggttgacggggtccagggccggcgcatggagtgcagaggcctccatgagggtcggtgcatggtgtgcagaggcctccatgaggttccagcagcagggcagacaaggttgggcctcttgtcctgtgtcttctacgcatcaacactcagccgcgctgcatctcccaacaccacaactcgcccgccccttgcccttttgcccagggcgtgaagctgcatgccatcgtggatgcgtgccactcggggtctgtgatggacctgcccttctctgccatgagctacaacggcgtgccccaatggaggagcgagtaccagtggcaacctcgcgcccacaaggtgccattgggttccagctggatacttgctggcaaggcggctttgctgtgcagatcggggcgtccacggactcgcagactgccgcagataccacccagctgtcaggtgacggggtttcggcagtggcgattgggaagcaaagagtgctgtatatccacatggatgatatgcttgcgagtgcaaattggcgggaattacgcgacctgtttgctttcgtggtactcgatcttgcatcacaaagcatatcagtgcgcccactgtttgggcatgtgctcagggtatacgtccacaggagcagccacgtatgccttcatccaggcaatagagcagcgaggaacgaccatgacgtgagcagggcttggggctgttttggaagggtgctcgttgctgtgatagggttttcgacctcaccaggcatcagcgctggttgtccacggcagtcagccttcctcggctcagggagaatgcaggctgtgggccctgaggctgatcatacagccctagttctccctgttttcctccaaggtatggcgagctgctggtggccatggactggacgctgcaccacgcgctgggaggctcctcgggcggcggtggcggcggcctcggcggatccctgctag

SEQ ID NO: 4850 - DNA, 867 bp, Chlorella protothecoides
atggcccctttcctggccattgagggcgcgaccctggcgcactacggcccccgcggctgggccagcctgtggaacctgctggacttgaccacctacggcctgcaggcctacatcaccttcctgcacctgggtcgcgtcacgctcaaggccggctggctgtcggtggcggcggcgctccagtgcatcctgctcctcttccgcctccagtacttctcccgcgtcttcaagtccacgcgcttctccttcgtggacgacctgaaggaggtcatgcatgacgtcaagtactacctcgtcttcctgctcctggtggtggctggttggggcctcgccctgcacatcctcttccgcgaggaccaggaggagcacaaggagttcagcacctacccgctcaccctcctcaccatggtcacctggctggacggcgacgtggagctggacggcctgcacaagagccacaacccagtcaccgcctccctgctgggcgtcggcttcgtcttcgtcatgggtgtggtgctcatgaacctacttatcggcatcctcaccgccagcctcgagcgggtgaccgacaacgagggcctgcgcatgctcctctccaaggcccaggtcatcgatgaaatcgacagcaccctgccaaggtgctggggaggaggggctgttcttcggctggaccacgtggaggtggccagcgtgtggggcaaggaggaggagaacgaggcggggacggagaacatggaggcgggggaggacggcgaggagggcaaggacaaggggccgcaggggctggagcagaaggtggacgacctgaagaaggagatccaggagctgaaggatctcatcatgtccatgcagcacacctccaccgcatga

SEQ ID NO: 4851 - DNA, 585 bp, Chlorella protothecoides
atggacgaggagaaccatcccctgctcgtgcatgcgggggaggatgagctgtgggacgcggtggaggagggggtgccgggcgccgatcgcaccttcacggtgaaaaggctcctggaagagcaccccacagaggtcctgagaacgctgcagaagcgcagcgtgcggcgtgtggcggagttcctcgtcgaggtgggatcgggcaccccagatccgagggcctggcctgcccaaaggaccggcatccgtaccgcccccgccagcatggatcaatgtcagaatgcggaccacctcgtcctggggcggctgggggacgactccatcctgaccatgggctccgacagccccaccctggacaatcccgaagagacctggctgcgcttcctgggcgcctcagcctccaagaagaagcagaagaagggacagcatggctggagcagcaccatcccggtgctggcatacagcatccgcgtggagaatgctgccgcccccgaccaggacggcctcctccagcccctgctcaagcgctggcagggggccggctgtggcatggatgtgtttgccctgcccgctgtgcaggcaagttga

SEQ ID NO: 4852 - DNA, 441 bp, Chlorella protothecoides
atggagcatgctggggccaagcagctggtggtccaggcgcagctgatcgatgaggtggaggccacggcctcggcgctcaacatcgccacttccttcctgcggctgaaccgccccgacggccacccagactacgtccacgtcctgcgcatccaccccgacaagctggatccggtggaggaggaccagctgcaccggaggctgggaaagcgctccgccaagcgcctgaggtcgaggtaccgtgggggtccccgggaggggagcgacagcgaagactcgagctcgagcggcgagggcggcgaggcgagcgcggagccccgcaagccacgggggacgcccgccaggcaggaagacgtggccaagctcctgcgtcagcaggccgagatcctggagctgctgcgcgccaagcacggcatcccgccctccaatgggcaaagtgcctga

SEQ ID NO: 4853 - DNA, 675 bp, Chlorella protothecoides
atgtgcaattcctgggcagcgtcctcatccccatgccacacctttgactcatcctcctcctctaccccccaacacacccacccctcgcagaagctggtcaaggacgtgtgtggccctcgcgtgaaggccaccccgtcgctcatcgccgccctgaagcagctggcggaggagtttgtggcgggcggcatcgcctttggcctgagcctggcctgccagcgccagtcggagtcgctggaagcggccgacctccagctctactaccagcgctgctggtgcgtgcccggcatggcatgcgcatggtttttgggggagggcatggacatccatgtgccagggtacgggggcacggaggtgcggccgtatcgccgaccagtgggcagcgacctccaccgctcccgtgcggcggcggtgcgggcgagcctggcggcgagtggcgagggcgccggcgccggcgcagatccggccgcaggtgcgtcgcccgcccccgtggcgcccagagcaaacggggaggcgacgccggccgcggtcaccgcgccctctgggtccgaagccaaacctggtgccgcagaggcaggccaggcagcccagggagcggggtcagagggcgttgcgcaagggagccctgcgccgccctctgcgacggagggcctgcccaacggcgacggcagtgcgtga

SEQ ID NO: 4854 - DNA, 1110 bp, Chlorella protothecoides
atgcatgcgcccgaccacgccccgacgtggagcggcatctgcgaggcgcccccagcccctggccctctttcccccgccccccatgagcaggagtcctgggcgtcggacccggtcttccaggaggtcctggccttctggtgggtgtaccgcgcggcgggctggcccgctgagtccatggcggcctgggcggcgcagcactacgaccccccccacgccgagctggactatgaggccatgctgctggatcctggcatgcaggccctggccgccgagtacgtggccgcgcatcccaaccggacctcgccgcagggcagcccacggcggggcgaggagggggggggcctctggcgcgcgggcatgcccggctcgcccgccgccggcctgcacggggcggcagacctggatggtggagcggctgatctgcccgaggacggcgccgggccgcccacggccttcgcggcggcagcctattccatcgaggaggaagcccacggggcgggcgtgtacacgcagcaggctaccttgtgttccatggatgccggagcttacgctggtgatgccgaagcgtacgctgacggaacagccggagcgtacgctgacggaacagccggagcgtacgcggccgatgcggaggcgtacagcgtcgatgcggaggcatacgctggaggcagcgcgggggagcaggacgcatctgcggaggcaggctcgggcgagcagagcgccgcggcgcgcctgcccgggagctggtctgtgcctgaccgcgtggggtccatctggcagcacgctgaggcgggggacggctgggcggcgccgacacaggtcgcgctgggagtggacggctacgaccccgagggggcggatgtgccgggagaggacggcgcggcggcctctgtgcagtaccagccccaggcggcgcgcgagctgcagtatcccggggcggacgaaatggcggcgtggcaggaactgcccggggcggcgccggcgcttcgcgacgcacggcgccgggcccgggatcgacggccagttgccggtgttggagccgcagccctttgccggcttcgacgagggcgaagagccgggagtgggggatggccatgcagggtgggctga

SEQ ID NO: 4855 - DNA, 606 bp, Chlorella protothecoides
atgtcgcccgggcgcctggcctcggagctgggcgtgccgcgctcggcgctgaccagcgccgccgccgtggtcgccgcctccgacgccgacacgctgtccacccgcgaggccgccagcgatggtgagggggaggggggcggggaatggaatcgcgactctcgctcatcggggaaggaggaggccggcatgctgttccagcagcgagggcactggccctgggcccatggggtcgtcgcaggcgccggggcggtccctgtctttccggcatccgggttcctcagcaagcactcagcgctcctgcctgggtttcttcgaggtatctgctcacgcaagccctccaaacccactgtttgccacgcagacgaagcggaggggcaggatgtcgggccgccggtggcggaggacgaggccgtgcacgaaaacggcagggcggcagactggggcgcgcctgcagacggcccgggattaccgtccggcgccggcgtggccgtagacgccctgcccagccaggacccctcgcccaggtttgctgccctggcagaagacctggacgccggcgcagacggtgagtggggggatgcggtgcgtggctgttcggttccttga

SEQ ID NO: 4856 - DNA, 1167 bp, Chlorella protothecoides
atgcgtatatggagcattgccccttccggtgggggattcgatcggaaacgaggtgcggaggagcacgcccttgcagaccgcagcgccgatgttcgcatccgcacaagatccatggtcctggcctccaatcagaaggtgttctgccgcaagccgtaccaggcaagggcattcggtccactcaaattccttgatggtcgagcggcagggttgccactacgaatttagccacgggctaatctttacattttcgcaaaccggtcacacttggcatgttcacattggatgcatatttggcgtaatggacgagatcgtggtgtatcacgttcgcgcatgagactggacgaggcaccctctcagagctcctgtctaatcagcacgcgtccctggggccgctccccgctcgcatcccttggcatttcaacctctggcgctgaccttccggaacaggccctgcagttctcggtacgctgcacgacggcttgtctgcgctgtcccacacaacaccgtcgatcgccttgcgtccaagaattgtacgccttgcgagagcgatggaggcagcctcgaccagatgggtttttgcttggctctcgaccaggctaccgcgaacagtatgtgcgaacaggtacgagatggtcgtctccacggtgtctccccttgatcaggaaactggggcatggcaggcgttctattgccctgaattgccggcgctcgctctcgtgttgcctgttgtcatccctctcattcccctcaccctcccctgcaccctcgcagttgtctggctggacagtgacagaggatgggcatggctacctacgcctgcgccagcagtaccgtatgaagtccttcctcaaggctctggagctttgcgatagaattgctgaggtggcagaggctgaggggcaccatcctgatgtccatgtgaccgggtggaacaggctggcagtggagctttggacccactccaggcatggcttgaccgaggtgagaaaaggaagaggatgccaggagcttgcatgtcacttgctcacgcctcaagctttcacaatgaagcatttatacatattgatggcccttctgcagaatgattatatcatggctgcaaagatcgacgcaattcccaaggacgacctgcttggagggaagaagaagaagtttggtgacatctga

SEQ ID NO: 4857 - DNA, 1059 bp, Chlorella protothecoides
atgaagctcgacctccgtgcaaggctccctcgaagagaaaagagttcgttccaggtactgatggaaatgcagaagcctttgcgtcagattaccgcatcagccgacctcacggtgttcccagaagatccagcaaggatattgagacaaggggttccaccattggagcaggcagcactcgcagatgagatcctccaatggattaccatgaagtcgcgctctgcagcctcagtaacaaggcactcttcaaaccgacatctccgagtagtgtgctgcccccgaacgagctatcaacccgccgagatccatcgggacacgggtgcaaagggtcgtcagcagtgccgtagagcgtggagtccgctgccaacccgcaccatgctgcgcttcgcagtaaaccgggtggccaccaaggccttccccgtcagggccatggccacccaggccactacagtctccaccgctgattttgaggcggtggctgcgctactggattccgatgagggccgcaggtccctggccaacatcaagtcgcagttcctggagtcccaggcacggttggcggagatcacatccgaggtcaggcacactactgggaaagggaaaaggatgctcacgatgaggctcttaaaagtgcgtggcgaaagttgctccggtgctgtccctttccttatggaatctccgtatgaccgtcccatggccactaagtgggacgcgacccagaacccatgcgctcttgccaacccaatccaggctgggcccaagattgactgggcggagctgcggaagaacgtcgaccctgcgctcgtccaggctcacgatgaggctctcaaaagcatcacctggcccaagtttgacaacagtgccaccatcgaggatgtgaggaagaagtttgaggccttccagaaggaggcggctgccctgtctgcggaggccgagaaggccgtggccgacatcgatcgcgaggtcgcgaagaccgagcgcatcaaggcgagcaccaagagtccgggttgtgggtcgtttgttcattaccatggggagttggagaggggtctggatgcttag

SEQ ID NO: 4858 - DNA, 1197 bp, Chlorella protothecoides
atgcgcctggcgcgcatggagaagtacatccggcgcaacgcgctgcaggtcaccttccgcgacgagctgaaccaggcagagcggcgggaggtggtgaactcggaccaggaggccaagaagctggccttctacctgttctggaacgtgaaggccgactacgggcgcagccacatcgtggacgcggacctggcggccttcgtccccgctcgcgacgtgcgcctggccgcggagctgctggacgccgacggcgacggcgtgatcacctcccaggacgtttgcgcggccatcctgcaggtcttccgcgagcgccagaacctggccgcctccctcaccgacaccaagtcggtggtgggcaagctggagaccatggtgggcgtggtgctgcacatcgtcatggccttcctctacctcgtcatcttccgcgtcgacgtcatgaacttctacctcaccttctcctccatgatcctggccttctccttcatcttcaaccagagcctgcgcatgatctacgagaacgcggtgttcctcttcgtgatccacccctacgacatcggcgacaccctgctcctggacaagcaggcctgccgggtggatgccatcaacctcacctacaccaccatgaccgacccctccaacgcgcagctgtggtaccccaacgagaagctgcgcgccgcacccttcatcaacctctcagcctcggggaaccggtgcgagaccctggccgtggcggtggacgtggacacgcccctgggcgtggcggaggacctgcgcgccgtcgccgccgcggtcacgcgcctgcagcccaaggaggtggatggcgagccgggcgtggcgctggccgcctccccagaccccctcaagtacgtgctggaggtgagctggacgctgagccacaacggcgtggacgcggcgcgcggcgcgcgcctgcgcaacgccgtgcatgcggccctcttcgcccgcctggcggagctgggcgtgcgcagcagcgccccgcccccccgcgcgcccgggaatgacgcgtacggcgcgctgagggcggcgccggttcacgaggcggcgccggcgccctccagggaggcgacgcaggcgggcgctgcgcaggcccgggcgcaggccggcctggccgccgccgtgcaggcggcagaggcgcagcagcggcgggggagcccaggcggcgccctggagcgccccgtgtga

SEQ ID NO: 4859 - DNA, 237 bp, Chlorella protothecoides
atggccgtcaagatcctctttttcgcaaggagtcgtgagcttgccggcgtatcggagacttcggtggccgtccaggcggctgacaccacagagagcctcctgagtcatctcctagaacaggagctagatggacgctttgtgttcagcctcaatcacgagtacctcgaacgtggatcagttgtgccgctgaaggctggggacgaggtggccatcatccctcccattagcgggggctga

SEQ ID NO: 4860 - DNA, 495 bp, Chlorella protothecoides
atgcagtgccacgcccaggtgtggctgtacagtctcctgaatacctcagtgcgatcgatgcagatcctacttccccgaacctcccctcccccgcctcctcgcagacctgcaatgctcaccccacgcatcctaggagcggtccccatcgtccctgtgtcgtccatcaaggactccctgacctggtatgagaagctgggctttgtcccccgcacggacgaggatggcgacgccgataactacgccctgctgaccctggggccggtggagctgcacctgcgccaggtgaactcctcggagaagttggacgcggaggccaatgccaacggggtttatgtccgcgtggaggggctggatgccctgcacgacgagttcaagggaaagggcctgagcagcctgaagggggtgcaggacacgcagtggggcatgcgcgagtttgcgctgtctgacccggatggcaccctgctgaggtttgggcagatcaagaccagcagctga

SEQ ID NO: 4861 - DNA, 1956 bp, Chlorella protothecoides
  modified_base (58)..(67): a, c, t, g, unknown or other
  modified_base (653)..(662): a, c, t, g, unknown or other
  modified_base (1878)..(1887): a, c, t, g, unknown or other
atgaccgagaatatgaagcctgtgtttgtttgtgatgcttatcggggcctgtccgctnnnnnnnnnncgggcgatccgattcaggcattcaaaaaatcttctcgagctgcgacggggtcgcgtcgcgaggggcatatcaccagaataatctcgtcattccgccacgccatgacggagaatatgaagcctgtgtatgtttgtgatgcttatcggggcctctccgccgctcagccgcccggtttacgcaatcggtaccgcggatctggaactgtacgcagcgacgttcagtacgacaatctgccctctccaccgagctgcatggatcacagatggacaccgtgtctgggcgatgggaaacgccatgctgtgtccatctcgcacgcatccccagcgccactttggaccttgggaaactcctttggaatcgtgcacgaagtgtgcagcgcctcgtgggtcacatcaaggaggcgtggattgcactcgcatatttgcgattgccacaaacaagcaccagcttcatcccctggtcgtccaattcccagccttcccaccccgccacggcaacctgcgccgtttgagatgcagggagggccccgaggtgtccttcagcgggtcgcccaccgtgtcgccgatgacggcagccttgtgcgcannnnnnnnnnacagtcctgcagtcgcagcaggccggcgactctcgcacacgagggcggtggggggatcgtcgcacgggagggtgcgcgcgcgcattctcgcccgagcacctcccccaccccgcacataaaaccctccttgcctctacttgaagaagcggaagatgaggccgtcggcggtgtgcgccaggaagaagggcgcgaacaccaggctctccaccgccatgagcttgatgaggatgttcagggagggccccgaggtgtctttcagcgggtcgcccactgtgtcgccgatgacggcggccttgtgcgcgtcggagcccttgccccccagctcgcgcgcgtgctccgaggcccccgcctcgatgtacttcttggcgttgtcccaggcgccgccggtgttggacatggacaccgccatctgcacgcccgacaccagcgcgccggccagcacgccggccagcgtgcgcacgccgaacagcacgcccaccacgatgggggtgagcatgaccagggcgccgggggggatcatctccgacagcgaggcggcggtggagatctccacgcagcggcggtagtcggggcgggcagtgccctccatgagcccggggatggtgttgaactggtggcgcacctcctccaccatggccagcgcggccttgcccaccgacttcatggtcatggcggagaaccagtaggggagcatggcgcccaccagcaggccggagaacacctctgggtccaggatggacgagtcggcgatggtgatgccggcacgcgtgatgtaggcgccgaagagcgccagcgacaccagcgccgcggagccgatggcgaagcccttgccgatggcggcggtggtgttccccgccgcgtccagcgcgtcggtgcgctcgcggatgtcctcgcccatggccgccatctcggcgatgccgccggcgttgtcgcagatggggccatacgcgtcgatggccaggcaggtggccagcgtgcccagcatgcccagcgccgcgcaggcgatgccgtacatgtgcgccagggagaaagagacgaagatggtcaccgcgatggtcaggcaggggatgatggcggacttgtagcccagggccaggccgaagatgatgtcggtggcggcgccggtcttgcatgcgtcggccacgtcctagaagggttagatctcctgatctcaaggggccaaggagcaccctcgggcgtcggcagcgccacgcannnnnnnnnngatgatgtcggtggcggcgccggtcttgcacgcgtcggccacgtcctgtgtgatcgtgaggatgtttga

SEQ ID NO: 4862 - DNA, 1278 bp, Chlorella protothecoides
  modified_base (651)..(660): a, c, t, g, unknown or other
  modified_base (906)..(915): a, c, t, g, unknown or other
atgcgggagtggccatctgatgtccggcatcacatgtgcaggaagggtgcaccgccggcagctgcccgcgcacgagcagcaaccacccatccggcacgccgcaccaccatgaaggaccccttttgccctgctttccaggccaacctgggcacgctggtggcggtgaccggcgtcatcctcttctggcggggggtctggaacatgtggtgcgaggggtgggtggggatcgatggcatgagtgtgcgtgtgggtgaaggcggagactcaacgccctttgccggtgctggcgcaagggagctgcctccattggacccaagaacgccggtgcgcaggccctgctcgccctttctttccccctggccattgcagggacacggtggttggcctctcgctcaccagcgacctgctgtccatgggcatcggcttgggcaccatgctctgcatccgctacttccgggtgcccctggcgcggacgttcccggagatgtgaacacgtttggggtggcatgggcgcggtggaggtgcgcgctggtgcacctcccgctgctcctgggcatgtccatggtaagagggcgcagaggcgcatggcgcagaggcaaacctggccttttgacgttcggtgtggagccctgcacaccctccgctctcctnnnnnnnnnngggtggcatgggcgcggtggaggtgcgcgccggtgcacctcccgctgctccggggcacgtccatggtatgagggcgcagaggcgcatggcgcagaggaaaacctggcctttccacgttcggtgtggaactccgcacaccctccgctgtccctggatgccatccgctcactccatcggcggcccctgtacttgtgcacagcagcagacacagcccgagtcattgtcccacagaggctctgggcacgnnnnnnnnnncactccatcggcggcccctgaactcgtgacaaggtcgtgtcaagggtcaagcttcagtataaggcggggaaggggtggggagcctggccccacccgggatccgcgttcggggtcaatggggcagcgcattggctgagcggggggggttttgccaaacatgagccccatgttggtgacgaggggacgatggccaggacgcccacaaccatggagctcaaccgagcgcatttgccgcagtgcacaggggcctcagtgcctgccacgaacccgcatcaagttctgcagcacggattcttcgctgacggtctggaaaatcggggggaaggggggaagtggggtggtgacatggtggaaggaccgtaa

SEQ ID NO: 4863 - DNA, 1377 bp, Chlorella protothecoides
  modified_base (1139)..(1148): a, c, t, g, unknown or other
  modified_base (1223)..(1232): a, c, t, g, unknown or other
atggggcggggggtggtgcccgacacgtacgagcacagcgccaacgcggcacggtccctggcgctggccggcgccgacgtggcgctggtcttcggcgcgcgcctcaactggcagctgcactttggcgaggcgcccaagtgggccgccgacgtcaagttcgtgctggtggacttggagccgtcggagcgtgacgcgcgcgtcagccacctcgtcctgcgcggcgacgccggcgtggtcgccgggcagctcctggatgcactccaaggttgggggggccaaggaaggggcattggagtgggtgatgctttggtggtgccacgggggctggggcggggaaaaagggctggatggacgcggcgggacctgggcaggcaaatggcgcgcgatggtcgaaacacgactgctgcaatggagtgtgagcaggcgataccccgctccccctggcacccctccgccctcgtcgaagccgtgctttcccgcggggtcaaagtccacttgtcccctgcgcagtttcctcctctcttcccaactccacccacccaagcccaaccccactcaatgcacggagctgccccgccccgagtggcgcgactggacgtcgcgcctggcggccaagtccgcggcggcgcgggagaagctgggcgcgcgcctggcgcgcaccacgcacccgctggactacggcaccacgctgcgcgtggtgcgcggcgcgctgggcacgctgccccgccccccgctggtggtggccgagggcgccaacaccatggacaacgcgcgcctgctcctggagccggtgaccgtgccgcgcactcggctggatgccggcacctggggcaccatgggcgtggggctgggctacgccatcgcctcggccacccaggacccgggccgcgcgacggtggctgtggagggcgactccgcctttggcttctcgggcatggaggtggagaccatcgtgcgctacggcctgccggtgacgctgatcatcttcaacaacggcggcatctatggcggcgaccgccgcgggcgggagctgcgcgccgccgcggcgcgggggctggcggccgtgggccacgcgggagaccccgtgcccaccgacttcgcccccgtctcgcgctacgacctgctggcgcaggcctttnnnnnnnnnngggcaccgccgaggagctggccgccgcgctgcgcgaggcgctggcctcgggcgggcccagcctgatcgacgtcannnnnnnnnngggcaccgccgaggagctggccgccgcgctacgcgaggcgctggcctcggacgggcccagcctgatcaacgtcgccatcgacccgcaggcgggggtggagagcgggaacgtgcacgccttcaacttcaagccgccggagaagtga

SEQ ID NO: 4864 - DNA, 1392 bp, Chlorella protothecoides
atgcgatggagatcgtgtggggttagtggagtcgcgccccgccaccgggtttcggccccgatcaccctcgttcccccccacggcccgctgatcctgcgcgatccaccctaccccatccaacaggttcgcggcggcgccagctccgggaactccaacggtcgcgagtacctgctggaggaggagcagcgcggcgaggccgagatcgaggagaaggtggccgacctgcaggtggccattgccgagggcgccacctccttcctgttcaccgagtacaagtacgtctcgttcttcatggccggcttctccgtcttcatcttcgtcctgctcagctcccaggacgggttcaagaccaagtggcaccgcgacgagtccggcgtgctgcgcgccccggccctgtacaacggcgccttctccaccatcgccttcatcgtgggcgccgccacctccatcgtctccggctacctgggcatgtccatcgccacctacgccaatgcgcgcacggcgctggaggcgcgcaagggcatcgcccccgccttcatggccgccttccgctccggcgctgtcatgggcttcctcctggccggcaacgcgctcctggtgctctacctcctcctcgccgtctactcccgcgtctttggcgacgactgggagggcctgtatgaggccatcactggctacggcctgggcggctcctccatcgcgctgttcggccgcgtcggcggcggcatctacaccaaggccgccgacgtcggcgccgaccttgtgggcaaggtggagaaggacatccccgaggacgacccacgcacccccgccgtcatcgccgacaacgtgggcgacaacgtgggtgacatcgccggcatgggcgccgacctgtttggctccttcgccgaggccacctgcgccgcgctggtcgtctcctccgtctccgccctgggcgtggaccatctgtgggtggccatgaacttccccctgctcatcaccggctccggcatcctggtctgcatcgccaccacgctgctggccaccgacctgcgccccgcccgcgtcgtggccgagatcgagtccacgctcaagctccagctcatcgtgtccaccctggtcatgacccctgtggcctacctcctggccgtcgccgccctgcccccgaccatgaccggcctcttctccgacgaccccatgcgccccgtcaagaactggtacctcttcgtctgcgtcgccgcgggcctgtggggcggtctcgtcatcggcctggtcaccgagttctacacctccaaccgctacgcccccgtccaggtgagcgggaggaggcgggaggggtgggcggcgctgggaagcgtgggtcggtcgacgcgtggcgctgccgacacccgagggtgctccttggccccctga

SEQ ID NO: 4865 - DNA, 1140 bp, Chlorella protothecoides
  modified_base (178)..(187): a, c, t, g, unknown or other
  modified_base (604)..(613): a, c, t, g, unknown or other
  modified_base (861)..(870): a, c, t, g, unknown or other
  modified_base (943)..(952): a, c, t, g, unknown or other
atgaactccgaggaacaggacgcagagatcgacgccctggatgccctgggtgccctggccgactttgcaaggtgtgttggcgtggtggtgtggagtgcattctgggctctgtgtcgtcaagcttttgggccccaatgtcttcctgacgtcctgaaccgcccaccccagaccctgcctnnnnnnnnnngggtgccctggccgactttgcaagaccctgcccccacccaaaatcgcccgtgcagcgagcaagccagtgaggatgagggcgggcacctcgcccgcggcggctcccatgggccggaggccgaggggcccggcgggcgggacctccagaagtggatccagtgcagcgtgtgcgagaagtggcgcaaggtccccttcaacctctctgacgccgacatcccggatgactgggcctgcggcgacaacacctggggcctggacagcgccacctgcgacgcggagcaggccatgagcaatgacgaaatcgactacatcctgtcggcgcaggccgcgcagctggagaccgaggccgcgggcgatgccgcgggggtgaggttgggcacgggtgcgggaggttgcaagggccgccaggaatatcttnnnnnnnnnncgaggccgcgggcgatgccgcggggtgagcgacagactatttttttttggggggggggccccctaggggcgaggccatgtgttgctatgcctgtgcggtttttggtgcagggtgaggttgggcgggggtgcgggaggttgcaggggctgccaggaatatctcgggtaattgacctgcgaaggcgcgtgccagtttccctccaccatgccatgtgcacgacaccagcagcgagcaagccgccctgcacnnnnnnnnnngcgaaggcgcgtgccagtttccctccaccacgccatgtgaacgacgcaagcagcgagcaagtcgccctgcatnnnnnnnnnncccccccccgcccccccccgccactccgcacaccgcagggcaacgcggcgacccaagcgcgccaacggacgcgccgcggggcgcgggccgccgcccgtcgcactggccaaggccggcggcggtgggcgccaggcgggcgccaaccaaaatgggcgcggtgtggatgtcgcgccgcgccgcgcaccccc

SEQ ID NO: 4866 - DNA, 948 bp, Chlorella protothecoides
  modified_base (763)..(779): a, c, t, g, unknown or other
atgatacactgcccgtcttcatcaacaacagatccagggcagcttgtgattgaaggacctctacgaccgcacatgtctcactcacaggattctgagcggtgcagtgataatacaccaagggatgctggcctgtcatctgatccacagctacacgccattcaggtgccgtcctggttggtcaagggggggccctccactggctgttcctctcccaagggggttttactcctggagatagtgcagttgacagcgctacacgccattcaggtgcctcctggttggtccgggggggggctccactggttgttcctctcccaagggggttttactcctggagatagtgcagctgacagcggtgcaaggcccgcaaagcctttgccattctccagaacagctctggcccaaatatgccaccttcaaatgacatgttcatgggagtcaagggcctacatcattactccaagtcccaagttctcttccctccctatgcagcccacactgtggaaataccctcgggaattgtacaagctcttggacgctgaaacgctcttctttgctttccaccaccttcccgggaccagggctcagctgcttgctgcacaggagctgtatcgtcaggactggcgataccacatgtggcagggagtctggtttcagtgcatttccacccttggggcaccgcagcgttatgcagagcccacagcggggggccagcctggcgacgactgggagaagggctcatacatctactttgactacctgnnnnnnnnnnnnnnnnnccatgatatcggctggtgctaccgtctgaaagaggacttcctgttccagtatgctgctctcgcggtgaggctcatgctggaagaatgtcggccagaaggcgacccaaagtctgtgaccttgcattgggcatggcagtctgcacagcattcaccatcgagaatttcatga

SEQ ID NO: 4867 - DNA, 1161 bp, Chlorella protothecoides
  modified_base (82)..(91): a, c, t, g, unknown or other
atgctgcgtcgggtggctgtcggggtcggggtctccccggaaagtcgtgtcaactccgcacatgactgtcacaaccctccannnnnnnnnnctgcgtcgggtggctgtcggggtcggggtccccccgggaagtcgtcacctccgcacatgactttcacaaccctccgcccaacacctccacctccctctctacgactgtcagagcgccgtgatggacgaggagaatcgagacctgtgggccaccttcagctacctgcagcgctgcctgcgcctgggccaccaggcacgcaccaaggtcgcccccccccgccgcgccccttcccacggcagccgccggcggcccgcgcacgccgtggggcgctcgcgcctggccgacacctttgccaccccggccaacgccacgtcgcagggggcgagtgcgctgcacaccccccgccagcccgacgccgcgccccaggccctgccccgcctggccctgcccgagcccgacctggccagcctggccacctccttcctcagccctgggaccgaggagctgtttgccgcggcgtgcaacatgttcctgtcccccggcaagctcatgttcacccccgggacctcgggcggcggggcgggcccccccgctggctgcggcgggaccttctccggcggcctcctgccggcgatgagccccctgggcctgcccgtcatcggacacaagaagctgtttgcggaggagctggacctcctggcggcaggaggggacctttcgggctgccccccttgcgcgctgccggagctggaggacgagctgtttgcaggcctggagttctgaggagcagagattggcacgaccgactgaagaggcccctccgcagcagctgtgtcggcgcagagaccacgtctcaacatcggggccaccccctctgcttcacgctccacctcctttccctgcagactccccatcgagatggcttcttgccacgagcgccacttgcgctccttgggaatgtactctgctccagggcccgcacgcgcatcgctgcagccacgcgaccacaccctttgccccctgccggactgcggcccccctgtatcaccaagccctgcccactgccctcgctggaaagaagcaggttcatcctggattgcattgcaccgaccgaaccctttgctgcatga

SEQ ID NO: 4868 - DNA, 1236 bp, Chlorella protothecoides
atgtccccccgcttctgcgtcatcccgctggaggagagcagcacgggcagcccgcggcgcggcgccggcgcgcccccgctgccccccgtggccgaggagggggaggaggagggcggcggcgacccgctggtccactcgcgctcctccaccgccacgcacgacgcgccggtggccatccgcttcgaccgcccgggcgctgggtacggcgagggcgtggaggagcagggcctgcgagcggcctgggaggcggtggtgcgcggccggggcgaggacgacaagggcgccagcgggtcggtcacccccgacctcaagctcagctgctgcgaggagctgggcggcgccaacggcggcgcgtcggggcgcgccacgcccgacgcggtgcgctcccacacgccgtcggcctcggggacggacgcgcgcggcggcagcgcggggtcgctggccacgctggacgaggcgcgcgggcggcgcgcaccgtgcggcggcctgatgcgctgctggcggcggccggggcgctccgtgctgcgcgtcacgccgggctggggcaggcaatacgccttcctgctcgtccgcgccgggatcaagctgtcccgcgcctggggcaccaaattcctggaccttttgctcctcgtcttcgcgggcatcgtcaccggtgaggaggagtgggtccaccggctggctggctcacaggtgtcgggctggaaccccgccccagtgccccgctgtgcggccggcttctgcccagcttctgtttgcgctgcgatccacccctccccggccaacaccattcatcgcaacgctctccctcacccactcaccacaggcgccatgcacggcacgggttggaccaactgggacttcaaggggcacatcgcactgatcatgctgaccctgggcatcatcgccgcctcgggcgcgctggccgtgttcgggaaggagcgcctggtgcactggcgcgagcgcgagtcgggggtcagggtcttctcctacttcatggccaacagcaccaccaacatggtagacgtgttcatacagcccctggtcttcctgtccgtgtactatagcatgaccatccccagcatcagttttgggctggtgaggcgttggagttgtgtgtgtgtgtgtgttggggggggtggcgagcaggtgccggcggcgcttgcgcccacacgtccatggcatgcacctcacctcgcctcctctcactccgcctgcacccatgctcttccatcgtag

SEQ ID NO: 4869 - DNA, 1632 bp, Chlorella protothecoides
  modified_base (107)..(223): a, c, t, g, unknown or other
cggcgcgacggcgggggcgccgcgcccggcccagacccggccgcgggcgacggccggctggtgagccagggcgcggatctggaggcgctggcgggcgcgctggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcggcctgcatggagcgcggggccgtgctggccctggtcacagcgctgcgcgaggtgtcgctgaccgaggtcccgggcccggggtccctggcccagcccaggcaagcgagggggatggtgcacgggtgactgacgagtggatggcagtgtgcatgaatggtcgtagggtttggaagggccgcaatgttgacgagagacagggtcttcagccgtcagactggaagggggccccggccgagagcaggcttgcccctccgaccctccgtgaaccagcccaccagtcactgtgcatgactcgcacccaggctgctggcgctggggcgcatgacggacgtgctgctggccaacacgcagcgcttgcaggacctctgggccgtcttcctcagggcctgcacgccgctgcgcccccactccccccctcgacgcgttctccctgctccccccaaccccacagccacgtgctggaggtgctggccgctgcccagcccagcgcgcgcgtcgtggtggtggaggcgctgggccgcgtcgtgtccggggccctggcccggatccccgccgccgcggccgcgcccggcggcgaggcccccgccgcggccggtgcgccccctgctccaggccctccctcgggcctggagcacatgctgctggtctcgctggagtcggtgtacggcggggagcgggagccggaggtgcggcgcgcggtgctgcgcgtgctgctgagcacgctgcagcgccacggcgagcgcctgggcggcggctggggcgccgtcttccgcctgctggcggccgtgccggaggcgcgcgacgccgctgccaccgacctcggcttccaggcagtgcagctggtggcgggggactttgccgcagggctgggggcggcacgcctccgccgctgcctggaggtggccgccgtctacggcgcgcagcaggtgcaggggccccagagggggtgggtttgtggggcatgcgtcggtgagaaccgaggggttggggcagagggcggtggccggggagaaggaggaatcggagcctggagtcccagaccggccctggggatcgagctgaggacccgagtgcaaggacctggtgggctgggcaccccccccgcctcctcgtgtcccagtcctgtgaggatctgcaaaccgttcccccctcggcaagactgcatgcctgctcacaccctccaccacacaggaggatgtgaacgtgagcctgaccaccatcagcctgctgtggaacgtggcagatctggtgggcagggccgcgccggggtccgaaggcggcgcccctggcggcggcacagaggaagaggccgtgtcgccgggggcgggcctgcgcctgacccaggaggagggcgatgtcatcctggagctcatcttctcggccctgcaggcaagtctggttga

SEQ ID NO: 4870 - DNA, 2367 bp, Chlorella protothecoides
atggcgagtctcccaccgagcatcaccaacgccagccgggaacagctgcagcagtacctactggacactctgaagaagctcaagtccagggacaagcggctcgaggagctccaggccgctgcgagtgcgagtgcagcggaggtggagggcctgcaggcccgcctggtgtcctcctcccgcgagtcccaggcccgtctggatgctgaggtggagctcttggcctcccagcacgcccgggagttgaaggaggcatccgccacagcccaggacctggtcgcccagctggcagcccgcgagcgccgcgccgcgcagctggagggcgagctggagggcgcggaggcacgctgcgaggccgcggagcaggccgcagctgagtccgccgcagagcacgcccaggtcctggagcaggccgtgctggagaaggaggcggccgaggctgccgccgcccggctgcaggcccggctggcggaggtggagacggcagccagggaggcccaagccccgagagcgcaggatggcaagcctgggacgctcccctcggatgcccctgggcccgaggcttgggcctctacttcgccggacccccagatcctggagaagatcgacctgctgaccagcactgtgtccgagctggaacagcgccaggccgagctgcgggcggagaacgcgcgcctgctggagaccgaggagcagacctccgccgagctgctgacccgtctggccgcggtgtccagcgccaaccgccagacttttgaggccctgggggagaaggagggcctcctggctgccgtggacgttatgcaggcccacgtggccaaactggagcaggcgctggctgagcgggagcaggaaagcgcggaactggagtcgctgcgggagcggctggccgcccgggaggccacggccaacggcggggagaggggaaaggatgacccttcagaggcggctgccccgcgagcggagctggaaagagcgaaagagcgcgtgcgtgagctggagctggagctggagaccagcgaggcggcgctgcaggacctgcgcacggcgagcgcggccgagtcgggccgggcggggggcgcgctggcggccatgcggaccgaggtccaggccctccaggccgagcgggaggcgttgcaggccgagtgcgctgaggtgaaggcggccaaccttcgccaggaggagcagtgcgcgaagctggagcgtgagctcgtgagcctgcaggtacagctggcgagcaggagcgaggaggcagcggcgctggaggcgcggctcgctgcggccgccgaggctgggaagagcggcgaagaggaggaggagcaggcactggcggacgccagggcggagctggcgggcgtgcgcgctgagctggaggccgcggagggcaggctggcgacggcaaagggcgagttggaggcccagactgcccagctggcggccaggagtggtgagctggagtccaggacctccgagctgaccgcggtgaagggcgagctgcaagcggcagcctcggacctggccggtgcaaagacagcggaggcacgcctgggctcggagctggcagaggcgcggcacggcctggaagagctgggcgcgcgcctcgcggcaagcgaggcgacgacggcggaacagcgcgccaagctggacacgctggcgggcaccctggctgatgcacaggtgcggcgacgtgggtttgagtattttgggtatggatgggcatacatcccactggctgggcagaagagtgcgagggggggtactgcgctaaagggcatgaggtggtgcgtttccagaagatgcaagcggatgaagggatgtggtcatgttgggagtgcaacccctaaacacatccagtcttccctaccctcctgcctgccacgccctcaggcggcagcaacttcgtcggcccagagagttcaggagctggaggatgccctggcgggcgcccggagcgccagcgccagcggcgactcggcggcggcctcccagcttgccgcagcgcagggcgccctggaagctgcgcagaaggagctggcgaccatccgccggcagcaggaggtggagcgtggacgtgtgaagaaggccattgccgacctcaagcggcggctggagggagcggcgcacagggtcctgacagattacaccgcagggagtcggatcaaggctgtgcggcgcctgtcatcgggcatcaccacgccctctcctgccctgcaatcacgtcaccaccttgccgagcatggcatctcatcgcctgtggaccttcccccacccaagcagggccacgcaggagaaggcagaagtcaccgcgtcggccgccgccgccgccgcccaggcccaggcctcgctggcggccggcgcggcccgcctggc

SEQ ID NO: 4871 - DNA, 1365 bp, Chlorella protothecoides
atggtgggcatcgtgacctatcgcaatgccgggatcatcgccgtcgagcccagcccctgggccgaggtgcaacccttcaacgtgagcctggacgccctggccgcggtgcccatcatcatcttcggcatgcagtgccacgcccaggtgatcaccgtcttcaacgagctggaggagcggccgcgcctggtgaagaatctgttcccctcgggcctcttccgcctgcgcggcagcgacgaggaggaagatggggcgcaggacgcggtggtggagggagttgcggacggcacaggggccgagactgagagcgaggctgggccgcgccagagcgggaagagccggaagctgcgcggcatgcgacgcgtggtcatggccgcgagtgagtgtggggcctcagctgacgaggggactgtgcttctttacctaccatggggacgagggttgggcgtgcccttactgtgcgcttcaagcattccccctaccccagtcccccgacacccaacgttccccagttggactgacggcggcggggtacagcgccatcgggctgaccggctacctggccttcccccactcggcccagagcaatatcctgaacaacttctcgcgccgcgacgggctcatgcagctctgccgcgcgctggtgggcctgatgaaggtggtgtcctaccccatcaaccaccacccggcgcgcacttgcacccaggacgtggtggccgcgctgacggggcaccgccccgacagcgccgccttcaacttcgcgcacgccgccggcttctacctggccaccctggccgtggccctggccgtcagcgacctgggccaggtgttcaaggtggtgggcgggaccaacggcgccttcctcatcctgggcctgccgggggcgctgctgatgaagtatgccagcgacaaggcgctggcctcgcgcattcctctggtggtggagcagccgctgctggtggcgcggggcgaggcgccaccgccgcgcccctaccgcctcctcacctccaagctgtggtgggcggggctgggcctggtggggctctgcgtgggagtgctggccctcaccatcgtgtccatcgtctaccccatgcagccagggggcgagtgagcgcgcccgtgggcggcaggggttgctgggtggcaggagcgcatgcgtcgcagggctgggaccgagagtgcaggccctggagacaaatgaacggggtcccagtagccatggagcttgccggcgggagggtgtgcaggtcacgctcctgggcatgcgactgtcggcaccctcagggcaaggaagttacactgagggatggggctcggctgatactgaccatccctccaccccacatgcaatactgtcaacaatggtag

SEQ ID NO: 4872 - DNA, 897 bp, Chlorella protothecoides
atgcgctggacgcgctgtgcacgctgcggtgcctggccgcctggcccgacctttcccccagcctcatctcccggctggcgtgccacatcggcacgcgctgcattgggctctgcgcgccagacctgtgcaccctggccggggccctgctccacctcagacacgtccccggtgggtgtgcctcctttgggtggggttccccagagttctcggggtggtcaggccgcactttgcacggatgggttgggttgggatgcagacggtcattgtcaaggcttcccatggatgatgctggtatccatgctttcccatgttgttacccgccgcactctgctcaaatcaccccttcttcccccccatcccccctccatcgtcagacgagacgctgagggacggactggtggaggctgcacgacgccaggtccgcgccaccccccctccccagctggcgaggctggccgaggcgtactgccgcctgctgggcggcttcccgcgccaccgcgggctgctgcaggcgctgcagcgccgcgtcgtgcacagcgcgcaggagtggagcggggaggacctgtcccgcctgctggcatgctttgcgcgctgggggtacgatgcgcggcccggccccttcgtggccgtggccgccgacacgctggcgcgcctggcgccgaggacgtcgcacgacgccctgctgcgcgcgctgtgctccctggccagcttggcccagcgctcccccgccgtcctgggccaggcggggctggaggtgcgcggcttcgtggcagtagccgcgcagctgctcgccgcagagcaggggagttcccgcctgggcgcgcgcgcgcccgccctcttcgccgcactggcgggcctgcaggcgcggccggggggcctgccgccgggcgtgcgcgc

SEQ ID NO: 4873 - DNA, 249 bp, Chlorella protothecoides
atggccgggggcatctccagcggtactcccggcgaagcatccgcacggtccagcatcgtgacgctgatcaacagcagcgtgggtgtgggggtactgtccctgccgtacgccttccgcgccgcggggtgggtggggggcctagccctgctggccttcgtggccaccgtggaggccttcaccctgtacgtcctctcccgctacgccgagcacacggacgccgtgacctacgccatcgtggtgggtgcttga

SEQ ID NO: 4874 - DNA, 336 bp, Chlorella protothecoides
atgccccttctgcgcaaacgagctgtcgagtacgacatccctgatgcagatacccacttccaagataatgaagaggttcgatttggtgtgagctacggctcgggccacgaggcatcgccgggtcacgctccaacccaaccctatgtgcaggtgttcttgatccggagcacaggcgaggtcgtgagggagtatgagacatacatcagcaaggtcaacctctacaggcagcgcatctggactgcggcacacacaggccagggcaagcttacctgggccgaggcaaaggaggaagaggaggaggcccgagcagcccttgccaaggtacaggcctcgtga

SEQ ID NO: 4875 - DNA, 228 bp, Chlorella protothecoides
atggcggcctccatgctttctttcgagccaatcgtggccctgggtcccgaccgccacctggccctcctccgctggctgacggacgcgctgctggaaacccagaaagtccgctcggcaatacagaagagggaggagacggcagaggacgtcaagcgaggattcagggacgagatggcagaggagcgccggcgccttaaggaccttctggaagccggtgcggggttgtga

SEQ ID NO: 4876 - DNA, 909 bp, Chlorella protothecoides
atgacccctctgctccccacacctgctacctggaggcgccccgtcatcgcactaccctccctcaacccccacccacacccccacgcaggagctgtgctcctcgctgctggacctggccgccgcggcggccgccgggggcatcacgctctgcgccgaggcggaggccgccgatcccaaggccggcctggcaaccttcgccaccggcctccgccaggtggcgagcggcgaggccggggccgtgcccacgctggccacgctgcgcaccgggatccagggccggctgaggggcctggaggccgcgctttccagcgctgcggccctgcaccccgtggccgacggcgaggggtcggcctccgagtacagctccgactcaggcgtcgagtcggaggaggaggcggagccgcgggccggcaggcctgccacacccctccaccgccgcaaggtgcgtggatgctgggggctgctgccgctggcctgtggcacagaggtccaactcgtgatggacaccctttggcaggcccccaacccccaccgttcatcacgccacacacaccacagggaatcgcgcgggtgagggaggtggtggacgacctgttctcgcccaccaagcaggcgcgggaggtgacgtctcgcctctggcgccgcgcctcggagcgcgcctcctggtccagcgacctcgggggcagcttcaccgcggcgcgcctcgcctactgcaccgcggtgctggccctccaggcccagccgctgctgaagcacctggaggctgacaaggcgggacaggccaagcaggcggcccctgaggcggccgtgaagccgcggccggcggccgcgcggccggcgggcgccagggacaagaggaagccgtccgtcgctcgcgaggggcgcgtcacccgctcccgcaccgcctga

SEQ ID NO: 4877 - DNA, 906 bp, Chlorella protothecoides
atggaggcggccgtcgcggcggccgctagggtcgtcgccgcgactcaaaaggcggtgacctctgctgaggctgctgtgaaccagctgctgaaaaggagtgcaaatcaggatcagcggacggctgcccaggacgtcaaggccaaggagagggagctgcgagagaagcagcgtgccgcggagcgggaggaaagggagcgtcagaaggccctggccaaacgctatcccatggaggacctgcagctcctggccgaaagccaggcggaggctgccgcccagggtgcgagccgagcctttggattatgcgacccgggtgttgtgggcgggtgctgcaggagcagcaaagcaacggcaactgatgtgcacatttcaagcaagggcaggaccagacgccttcctcctgaacacctcccagggaagccttgtccttcctctgacgtggtccagcccccctggctggatgctgaggagagccagcgggtgacgaccctgctgtacatcctggacaccctgcagcagtttggaaaaattctggacgtcagagcgccgcccctccctgagtcggcggccctccttgccccaggtggcgagagaaagggcgggacgggggtggagagctgtgctgaggatgtccagtgccacccactccactcgtggcaccgggcctcgcatgtccaaacctttctgggcactgcaggctcatgcatcccctcggcagagctgccggggtacaaaggagatcggccccccattcccaccctgcaggcgctgctggcagacctgcgagacaccgatgccctggggccccaggagaagcgctggacggcggtgctttcctccgccacctggcctgaagtgctgcggcgcatggtactgacgtggctgcaagaccccgacgcccatccgtga

SEQ ID NO: 4878 - DNA, 426 bp, Chlorella protothecoides
  modified_base (173)..(238): a, c, t, g, unknown or other
tcggccgccggcttccccgccgccgccgcgtcgccgccgcggccggcgcccggccaggagggcatcgcctggcgctgcgccgccttcctggcgccggagggggcctactgctgccgcgccaactcgctgcaggcctacgcagaggtgaaccgcgacgtgctggcggggggggnnnnnnnnnnnnnnnnnnnnnnnnnnnnnnnnnnnnnnnnnnnnnnnnnnnnnnnnnnnnnnnnnncgcgaggcgcccaacgccaagtacgagaactttgtccattcctcagtccaggtgggcaaggcgtattggggaccgagggtgcgtgggtggagagtccagggcaagggcggctgggctgcaagcccgaaccctcccttgacccggtgctgatgaaggaggcgccagtgtcagcaccctctgcacgatga

SEQ ID NO: 4879 - DNA, 678 bp, Chlorella protothecoides
atggggtccaaggcggcagtcggggcggggtgcatgatcggcgaggacgtggtgctgggcgacaagtctacggtcaagcgctcagtcatcggtcccaactgcaggatcggcgcaggcgccaaggaggtgtgcgctgcgatcactgtgcgccccagctcctcaatacaagacggggccaggtccccccctggcaacctccaaccccccacccaaatgacctcaccgtgtccagatcataaacagcgtgctcatggcagacgtgacggtggaggatggggcgcacgtgcacggctccatcctgtgcaacagggcgggggtgggtgccggggccagcctgagggactgccaggtcagcccagagttcagggtgggcgagggcgccgacctgcgcggggaggtgctggcctccagcagatgaaacgaatcagacagtgtctcctgtattgttttcctgcctcgggcgcccctgccgagtgctgcagcgtgtgtaacagcggttgccgttggaggggggggcgcagggcaggtatcttacgattgccatcctttcctaagaaacgtccacgagcggaagcacctgcttgcgggaccccaggcacttctccagcagataccacggccagcgccatgggctgcattgatcacacttctgtcaggtcacctaatgacattgcctga

SEQ ID NO: 4880 - DNA, 867 bp, Chlorella protothecoides
atgggggtgtccggtcattccggggtgcgggaccagcccggggacagctgttgcctgctgtcccggagtgcacatggggcataccacgctgatccacgcactcaaacccccccacaggaagcgtccgaagagcatcttcgtccgacacagcggcaagctcagcgggctggccgtcctcttcctgaccgccacagtgatctacctgcactcccaccgccgtaccctgcacagccacctggctgccaaggactaccagctgaatgctattgtggaggagaaggaggccatatcccgcaccctgcgggaaaaggaccacaaagtgagcgtgaagacggtggagagcgagcacctgcggcgcaccatcgagcggctgcaggaggaggtgtccacccagagcacgcgagccctggaggccaccaggctggccgaggagaccacgcgcgcgtcggcggccaagatcaaggccctggaggagaggctgcaggccgacaccgcgcgctacacgtcccaggtggggctgggacgtggtttgcttttttttgggtgggggtgtcctggcagggattgggtcaccagcgaccaggccatggcagggcaaggcggctgtcatgcgtgatcgaggcgggagcggctgccgccccgcggctttgctgggtcctgcagcggaccccgctttggtccacggcggggatgggcgctcccctgtccgaggccgctgtgcgcccttgtgcgggcggggagtgcaacgcccgcctcgccacggcgctgtccgagaaggcggccgccgacagccgggcaacgtatgcggagtcgctggcggccgcagccgaggggcgcgccacggccgccgaggcgcgcgcggccgcc

SEQ ID NO: 4881 - DNA, 1272 bp, Chlorella protothecoides
atgccccggcaccacccccctgtaatggttgcctgcatgccatgtcgccatgccccagttcccttcccccgccctcccattgccaaaacacagaagctgtttgacgcctccagctgcaccgccctagcccgggcctgcctcttcatcttcatcccctgcctgaccttcggcaagctggcacagtccgtgaccctggactcggtgctctacctctggcccctcgtagccaacatcgtggtcagtctccctgtgggcctggccctgggctgggcggcggcccgcctcaccggcatgccccgtgcctacaccccacacgccatgtgctgcgtggcctttggcaacgtgggcaacctgcccctggtcttcgtggcagcgctgtgccacgacccgcacaccatcttcttccgccgcctgggcgcgccctgcgaggtcctgggcatgtcctacaccgcctttgccatcctgggtgccacggtgctgcagttcaccgtggccatccagctgcttaagcccgagccggagctggcggtggaggtggtgggcggccgggcgggcgacttcaggctggggccagggtcggacgctgcagcgggcgccggggccccagcccgcggcgccgccgccgccgaccccgcgccgcgccagctggggccagggtcggacgctgcagcaggcgccggggccccaacccgcggcgccgccgccgacgaccccgcgtcgcaccagtgtcagcaggcaccaggaaagcgcggcgcggggtcggaggaggaggggcacatgctggccgccgagcaccctcagccgatctgggagcttgcgcggcgcgaggactcggacgccacgctggatctccgcagcggctccctgctcagcgtggagcttccgctcatgtcctcgccgcgcatggactcggccgccggcctcgccgcagggcgggagggcgcgggcgagggggcgcgactgctgccgggcgcggccgcgccggtacccgagcgccacgagccaggcgcggggcagcgcgctgcgaattcctttcgcgggcggctcagacacagcgcgcggcggctggcggccgtgccctgggcctccttcttcccgctgcccacgcaggcggcgctggccggcgtggtcgtgggctgcatcgcgcccgcgcggaacgccctgtatggccacgatgcgcccctcaccttcctgggggacacgatagagaccctgggcaacgggctcatcccctgcaccatcgtcctcctgggggcggtgctgtacaggtga

SEQ ID NO: 4882 - DNA, 666 bp, Chlorella protothecoides
  modified_base (567)..(576): a, c, t, g, unknown or other
  modified_base (634)..(643): a, c, t, g, unknown or other
atgcaaacgttagcgaggagccaagctcggatgctgcattgcgtccgagcttggcatctgcttccagcaggttatgccccatgcaccagtaaagcaacggcgttctcgcccatctgccatcctgccccgttgggccatggtcgcagaccctttgtgattctctcacacctatcctctacctggcagcggccatcaggaaggaggcccagcctccagagctgcagaccatgtgctgctgcctccacggccacagtctctgtgactccccccatctcagagcctgcaccccacaccgtcgtactggatgtgagtggcatgaagtgcggcggctgcgtgtcggcggtcaaacgcaccctcctccggcagccgggcatctccagcgccagcgtcaacctggtgctggagggggcggtgatcgaggcgcgagacgatgaggcgacggtgcgtgcggtgcgcgccctggcctcggccggatttccctccatcattcggcccagggaggctcacgatctgcgtggcaggggcgcagagaaggaggctgccagggaggaggagctgctgcagagnnnnnnnnnngcaagcccctcccttggatcctgtgggagcctcccaaccccctcatcgtcacgtcccnnnnnnnnnncctggtgctggagggggcggtga

SEQ ID NO: 4883 - DNA, 612 bp, Chlorella protothecoides
atgcggatcctcggatcggatgcactggtctgcctggcatttcgcctgtgtccggtgcatcctcaagcagggatcgctcccccttgcacactgcaggactctgcgagcctgcctcttcttacagcaccccacgatgcgctccgcaatgggctcgtgacattgaaggatggtgcaaagagcgggcaccccgtcgcgcaggtgcaggccggcctgcggagcaccgtggaggagagcaggatggccatgctgaagaatgtgtatggctcgggcctgccggcccgcattcagatcgagcggcagatccttgaaaggtgtgtggctgtgacctgcgctgcaacacgcaaggatgtaccgtgccttttgtgtggtggttctgagctggactcctcacacctgtcccccacacgtcgcagggtgggacgcctaccaggcctgccctcctctcgcatcggcctcgactccatgtctggggccctggacgacttctcattcgaggattaccttggcttgcctggtgactctgaggtggcacccccagaccttcactccctcatggaggcccacctcggcatggccagagtgaccaagccagcctctcgcgcatttctgtga

SEQ ID NO: 4884 - DNA, 1092 bp, Chlorella protothecoides
  modified_base (336)..(345): a, c, t, g, unknown or other
atgtgtcgcagccacagtcaccgagctgccccccgccgcacaggcagctcaggccaccctggcagcccacgcttcccccctgggcgccatcgtggccatgaccctgcatccagaacttccgggcttaatcctcattgtcggtgggctggggtggggcctgtgccagccgtcgagcctcgaggacctgccacccttcttcctcagcccctcggcccctgccgcccacacctgcggccgctggagcccgaccaggccaggtgggtcttttccgcgagcatgcccagcctgccgcttgcagaagttttgcatgatgctggaatccgcggtgctgtgccnnnnnnnnnnctcgagcctcatgccatgtatgttcacgcccctcctcatccagcggtgctgtgcctcgggagggcagacggcctcatggaggtgtgggaccttctccgggggcagagctgcccggtccaaaccctccaagtcacagacacggctgtgacgtcgctggagtttgatcccgctcagcagggccaggtgggcgcggaggaggcagggggaggagcctgggatggcacagctggccaggaccaccttggttggccatcatgcgtgggtggacatgcacccctgggagcgactggggaggtccacctggtgcagctgcccagagccgtccacaggcagagcattcgagaactggaggacttcctcacatggttcaaaggcgaaaagcgtgcatttttggcggcagaaagtgcccaagagaccgccgtcgagcatgactcggcgggaaaggaagggcaagaattggatgcccatcgtgccgaggaagcacgcgacatgagtgctggagtcaaggccctccgcagtgacagatcggttgaggacgaggaattcttggcagcgttgagggagtgggagctcaaaaggattgattggaggaatgggtccttaagagtgtcatgcgcacagggccaaccaggtgctggtgccaagggaggatgtgctcactccggtcctgctgtgatgccccgggagcctcatcccgggcgcgtcagacccatcgccagaatgcgccgagggccggggaagtcatga

SEQ ID NO: 4885 - DNA, 1419 bp, Chlorella protothecoides
atgcgcagaggagattgcttgggtctcctgcgtgagggaggccgactcgcatccacctcatggacaatctggaccctggggaactgcctcagagaaccaaggaggaagaggcaatgggctcgccagacccgttgtcatgcgtcagcagccggcaagcctaagcggcgggtggtcgtgactgggcagggtgtggtgacgagccttggtcaatccactcaacagttctacgatcagctgctggctggggcgagtggcatcacccacattgaaggctttgacacgaggggagctggcatgcacatgctagcaaacgcccctcttggaggggccaatgatcatgattctcctcagcaaagcaacttgtccttgacgcgccctcaacacacccaccccggcaccaggcgactactcgaccaagatcgccggcgaagtgagggggaggagggctggagggattggcggagggttgaagatggccagtacgctctgcctgcagctcagcacactgtctttgctggggtggcatgcatggccaggctcagttctaagagcaaccgcccccgcacacaggcgctggaggatgcggggctcccctttgagggacccggcctggaggatctagaccgaaagctgtgcggcatcctgatcggcactgcgatgggcggcatgacaacctttgccagcggcgtggaggccctgacgctgtcgggtgggtgttggatcttagggtttgaaggattaggggtgaagaggggaggcaatgaagttgtcgggaggatgcatggaaccccctcaggcctgtcgccaccgctgtggctggccgaggttgccgagagggccgcatgcgtgcgcaagggttctgtgtccccccatgactttgctttccaggtgatgggagcacagagtgtgtggattgtccaccatctgccacctcccttcgaccagcattccccagacctcaccccccccaccacccaaccccttcccgcaggccaccgcaagatgaaccccttctgcatccccttctccatcggcaacatgggcggggccatgctggccatggacctgggcttcatgggccccaactactccatctccaccgcatgcgccacgggcaactactgcatcatcagcgccgcgaaccacatccgcaacggcgacgccgtgctcatgctggcgggcggcgccgacgccgcggtcatcccctcgggcatcggcggcttcatcgcctgcaaggcgctgtcgcggcgcaacgacgcgccggagcgcgccagccgaccatgggacgcgggccgggacggctttgtcatgggcgagggcgcgggcgtgctggtgctggaggagctggagcatgcgcgcgcgcgcggcgccaccatcctcgcagagttcatcggaggtgtggtgggggggggctcgggg

SEQ ID NO: 4886 - DNA, 525 bp, Chlorella protothecoides
atgtgtcactttgcgcttggactgccaacacttcctgtccatacattccccagcacctggaacgccgccatctcgtggggcctggcgtctgcctgcctcctgcaccatgccggccacgctttgcacgctctgggtctgaccatgcatgcccactccggcgtgtggggctggctggggcatccctacgtgggcgctggcatcggagcggctgccctggctggacctggtcgcaccctcatcgtcaatggagctcgagccctgtccaggggtcaccccgacatgaactccctgatagccctgggcgtggccactgcctttgggacaggccttgccagtgcgtttgtgccgggcatccccttggacgccagcctgctggaggagccggtgatgctgctcgcctttgtgctgctggggaggaccttggaggcgcgggctcgcaaaaaggcctctggtgagtggcggaatcctaaggagacgcttgcctgtccctgcatgcactggcctggcatgtacctgcaggtgtag

SEQ ID NO: 4887 - DNA, 366 bp, Chlorella protothecoides
atggcggagatcaccctccggatcaagcccacaacgggctctccgcccttcgaggtgaagacgacgagggaggccacggtcggtgatctcaagacggaagtcgccagggcctgcgattcccctgcagacctgatccgactcatctacaaggggcaagtgttgaaagatcatgccacagtggagagctatggtgagcctggggtgatcaggagggcagagttcggagaagaaggtgggaaggttcgatcatatcgccgcatgacggtcccccactcgctctatccaggccttgaacacgaccacgtggtgcacatggtcaagagcaagggtccgcctgtgaacaggtgggtcaaagggggcgcttga

SEQ ID NO: 4888 - DNA, 183 bp, Chlorella protothecoides
atgggcggggcggcggggtctgcggtgcctgctccgcccgccaatccagaggccacgtacgccacgcagctgcagcagctgcaggacatggggttctatgaccgggagaccaacctacgggccctggtggctagcagcggcaacgtgcacgcggccgtggagcgcctgctcgccagcttctga

SEQ ID NO: 4889 - DNA, 1122 bp, Chlorella protothecoides
atgcaccccgcagtggacctcagcgcgctgtccaatttgatcccggagcagtcccggctcgtgatcgacgacggtgagggcagcggtgcctcgcgccaggtccccaccgacatcctgcgccgcggcgatgtcatcctggtgctgcccggggagcgagtgcctgtggacggcgaggtggtggatggcagggcctccctggacgagtcgctggtgaccggcgagagcaggtgcgagggttgctgtatgtcgagggcaaaaggactccatcctattcctcctctctgcccggcccagcacagtgacgcccgccaagttcccccctcaccaatccccccctccccaaccaatcaattcctgggcaggctggtccccgccgcccccggggccagggtcaagggtggggtcgtgtgccacgagggtgtgctgcgcgttcgcgccagcgccagcgccgcgctttccaccgtctccggcatcgcgcgcatggtggaggatgcgcaggcacgcgaggctcccgtccagcgcctggccgacgcggtggcggggcgcttctgcttcggcatcatggccgtgtcggcggccacgctggccttctgggcgggccccggcgcggcgctgttccccggcgccgtggaggccgcggggctgggcgccgcgggcgccaccgcgccctacgtcctcgccgcccgcctggcggtggacgtgctggtggtggcctgcccctgtgcgctcggcctggccacgcccaccgccgtgctggtcggctcctccgccgccgcgcgccgcggcgtgctgattggtggcggggatgtgctggagcgactggccgccgtggacaccgtggtcctggacaagacggggacgctgacgcaggggcggccgcgcctagtggcgcggcgcggcgcgggcgaggacgccacgctggccctggccgccgcgctggaatccgtcacgcggcacccgctggcggacgccttcatcgatgccgcgcgcgccagaggtgcggcgctggtcgtggagggcgctggattgtgcgcggtggtgtggagggatggcgtcgagattgagtgccatgtcaccgtcgaagagtttgcaggaattgtccttggccacaagatagcatga

SEQ ID NO: 4890 - DNA, 366 bp, Chlorella protothecoides
atggtgaggaaacggcgaattcgcccggcagggagcgatggagtgcggcactgctggcgcccatcacttggcccaccgccgccgccgccaccaaccccttccccactccacacggtgcaggagggcttgccggggggcgccgcccaggccgacgcgctgcgcgctgcgctagccaaccctgccatgcagagcctgctgagcaaccccgacttcatgcgggacatggtgagcaacaaccccatgctgcgccgcatgacggaggccaacccgcaggttgcccaagtgctgaatgacccggccatgctccaggacatagtgcgcatcatgggcaacccggtgagcgtcgggttgggtgggaccgggtag

SEQ ID NO: 4891 - DNA, 495 bp, Chlorella protothecoides
atggacaggttcgtaggcgctcgtcgctttcgggcacatggagctgggtggggatggtccagcaaggccagcaccatgggtgtcttgattcccgctgaccccaccctctccgccccacaccgttcagcaattcctgttcctgaggcggaacgtaagaggcccgccaagctggcgtggaccaccctctaccgcaagcagcaccgcaaggaccaagagctgctggtgcagcgcaagaagaggagggccgtgaccaagaacgcgacccgctccgtggcgggcacctccctggaggtcatcgccaagaagaaggcggagaagcccgagcagcgcaaggcctcccgcgaggccgccctgcgcgagatcaaggagcgcgccaagaaggacaaggcgtccaaggccggacagaaggctgccaacaaggccgccggcaagtctgtcgccaagaacgtgccccgcgccgctggcaaggctggcgccaagtccactggacgctag

SEQ ID NO: 4892 - DNA, 624 bp, Chlorella protothecoides
  modified_base (174)..(183): a, c, t, g, unknown or other
atggcagatgagaaggtagtacaggggaccatgcgcagcaaggtgtttccaggagcggctgccagtgcggctcagcagcttcaagcaccgccctgtattccctccccgccccccctcaaccaccaccacagacacacacaaagtacaaacctgacgttccagccgaccaggagnnnnnnnnnnccttcgagcatcgccctgtattccctcctaaccctccctcaaccacgaccacacacacacacaaactacaaacctgacgttccagccgaccaggagctccatgcggcggggggtgtcgaccgcggggccgcgaccgctggacatgcccagctgcgcgcagtcgttcaggccccaggtgtacacctcgccctgcaggaagggatttgggttgtgtggcaggggaaggtgacaggctggccagtgaggggcctaggcagacggggggaggggacaggggcgccgtggcatgggctcagaacccccctctctgacccaggccgccagaagcgaccatgcgtcacccagaagcaaccgtgcgtcatccagaggcgaccgtgcgctggccagaagcgaccgtgcgccagccggaagcgaccgtgcgccagccaggtcactcgatga

SEQ ID NO: 4893 - DNA, 4278 bp, Chlorella protothecoides
  modified_base (3105)..(3114): a, c, t, g, unknown or other
  modified_base (3547)..(3556): a, c, t, g, unknown or other
  modified_base (3639)..(3648): a, c, t, g, unknown or other
  modified_base (3859)..(3868): a, c, t, g, unknown or other
atgagagcatgcccgcacctggccagtcaccgcggcggtgtgagatgcgcccatggccaggcaggcccagcgccgcgccaccttgaggggctggggctcgtgaacctcctgcgcgccggggccaacgcccagctgcccacagctattgtcacctgggccggaagggggggggagggggagaggggggaagggggaggtggagggatgaggcaggatgggcagggcacctcctgtcccacacggcaggaaggaacttcccatcgatccttggaagatctgcgtgtaggcaagcccctctcccctcaattctcacaaccaaaaccccacacctccctctgctcaccacaaacccagccattctcgtcgagctctgtgctcacgagggggctgtgggggctgatctggcagtccacgtctccctgcaccccagggatggcgagcatggatgaatattcgagctctagccttcattgcatggtcagatccgggcagagaccggggcggtgggggcccgactggtctccgaggtctgggtgtcgggtcctcggtggttggggcctcgccggaacccccgcccctcgccctcgcggcatgtatcccaggccccacatccccaaatccaaccagcagaccccggcaggcattgccggctcagatcaccttgagtgcggctatgcgggggtgggtgcggaccttcaggttgacgtccctagggtggggtgggcccctgcctcccaccgtcgcgtccacattgatatccattccctacttgcttgtggggcgactggggcgagcaggccctcatgtgctggctgggatcccagttcggacggtggttgggcgagggaacgggcggtaccatgtgactcgcgaaagtactcttgcttgctcgcgcccgtgggaatcgcccaccacacgcgatcagtgcacggccgcggtcttgccaaagatcttggcctgctcctgcaggatggactgccggatgcccttgcccttgggcaggctgaccagcggcttgtcgcccttgccgatgacgaacacgttggtggcacgggtggcgaaggagtggcccacggcgtcgcggatgtacacgatgtcgaaggagcccttgtgcttctccttgcgggtgatggtgcccacgcgcccgttgttgtgcccgccggtcaccatgaccagggagccgacgtcaaagtgcacgaactcgcggatcttgccggtctccagatccagcaggacggtgtcgttttcctggagattgacgaaagaatgagtgatgaagatcggcgcaaccgagcaggtgggggtatgggtggcaggaatggcataccgggtgcgaaaacaggtccccagtggcgaggccccacgatgggcacctcggtgcagagttctttgcagcccacgagccatccccactcagttcccaagcaaacaacacaccaagcgagcactcaccctgatgtcggggtcggggtagcggatggtgcggccgtcgtgggtggcgatgtaggggatggcgcccttgccgaactgcatcctcttcaccttgcacagcttgtaggtggcctcctccttggagatgcggtgcaccacaaagcgccccttggcatcgtacaccaagcggaagtgctcgtctgtgaggggaacaggaaggggtgggaggactcaggggaggggctgtggcgcaggcccaggggcctgcaacctacgagtcacagtcgccacatcagcccgctcaggcgccccactgctgctcccacaccccatttggcgacacgaggtcttgtcggtcctcaccttgccgtccacctgcaccaggcggttcttcaggatggccacgacctcacgaccggtcagggcatacctgcaggggaggagagagggggagagggcaccggttgcagccatgggacagatgggagatactacggagggacactcagttctcccgcccaggggtcgagaggtggtcggcactcacttcagacggttgcgcagcagcaggatgagtggcaggcactcccggggcttgtgtgggccggcgctgggcttgggagcctgcatgggagggccaggggaacggtgacggagagtggcgggagccatcgcagggcatgccggaccacactggtggggccccggcgcaggcctagccccggagcgccgaccgcgggccagcatcctgccattgattggggacagaccatcaccgtccatccaccatccgcgggactcacgaaaattccgccaagcttgtccagcatccagtgcttgggcgcattcagccgcttcaggtgcttcttaggtccgcgaaccatggttgtaggagccccttggcggtcctaccgggctctcgatcaaactctaaaaggacagcacctggctcgctggtgcccaatgtgcggagagccgcccccaacccagggtcgcaatatgggcgccctttctaccacaccgcatgaaccacggttcgacagatcgggtaactcccacagagtcctcctcccgaaccgccagaccctcagatggtggatttgcagggttgaagtgaatctgacaactcttaacaaacatattcagagcttggcgctggtgccagccgcggattcgagccgtggactccccctcgaccgcctacgggtggattctcatctccagcagcgggccgagagggtgcctgcaccacacccctaccgtccaccaggagcccagagaggtggacgtcacctcccggtcaagatcctatgtgtctccgcagagtgggcatgcaaggtcagaccatgcccagcctcgaaatactgcttccctgggtccaagcgtccctgtccttcccaccggcggcatcttcaagtcggcagctgtggaggtgctgcgtcgagaaagacgtctcatgccaactggcgagatatgcaggcatgctggggtgtggacaaggaacgggtgcttgggcggtgtgggtttacttcagcacagattgcaacacacaatgccattggatcctggcaaaacagagactccaccatacatgccgcgcttcagcgcatcctcactgcatctgggttcaagtcgcttcatacatctgctcgcaggctggccttggagtggggnnnnnnnnnngatgccattggatcccggcaaaacagagactccaccatgtatgctgcgcttcagcgcatcctcactgtatctgggttcaagtcgcttcatatatctgctcgcaggctggccttggagtggggcctgctgacatgctcgggcaggactcccgaggcaacaatggcctcttccctctatggcgacatcaagcgtcgagaccacaaatccgtcttcatacggccgcaggagggactcttcggactgaaggagtggatcgaccagggctacttgccccccatgccagacaactcagtgatcatggcgcaaaccaagcgtggttgcaggccgacccagggctcctgggatagcctatgggccagagacaggttgtgcaccgtggctgagacgcgagaagcacaaggccgccgtgcttttgcctctgacccaccattgnnnnnnnnnngtgggccagagacaggttgcgccccgtggctgagacgcgagaagcacaagggcgccgtgcttttgcctctgacccaccattgnnnnnnnnnncccccacgaggcccctgggcatgccccttgccccaccccatgccttctcctgctcggtctcggaactggagatgggctcatcctccccatcctcctcctctgaagtctcttgaggactgtccacgcgcatcttgcgagcataccgctgcttcaccaggcggccctggagagggaggtggacaatggtgggtcagaggcaaaagcacggcgnnnnnnnnnncgaggggagcatggggcatgcccaggggccgcgcgggggcaagtgcattgggagcgtgcggggcactcccacgggtaacagacgcacgcctggtccttgtcccaccgacggatgccccccctcctccagagtgcgccccctgcaaggctgataccaggccgcccaggggcatcccagaggaagggcatcacccaggcggcgcctctccaccccgcccgctccacctccctgccatcctcctcagccagggcagcatgcggtgcagatcctggctgcgccactggacaagtgcacagcgcagggctcgaacctggagggactcccttggagacaacacgcatgtcaggacccctggaaggaggttgccggaccgccttcagccccgctgtgggcctggcccaggcaagtga

SEQ ID NO: 4894 - DNA, 561 bp, Chlorella protothecoides
atgctcgccatccctggggtgcagggagacgtggactgccagatcagcccccacagccccctcgtgagcacagagctcgacgagaatggctgggtttgtggtgacaatagctgtgggcagctgggcgttggccccggcgcgcaggaggttcacgagccccagcccctcaaggtggcgcggcgctgggcctgcctggccatgggcgcatctcacaccgccgcggtgactggccaggtgcgggcatgctctcattggttgaacggagggacggagggtaccaatggtcatcgagtgacctggctggcgcacggtcgcttccggctggcgcacggtcgcttctggccagcgcacggtcgcctctggatgacgcacggttgcttctgggtgacgcatggtcgcttctggcggcctgggtcagagaggggggttctgagcccatgccacggcgcccctgtcccctccccccgtctgcctaggcccctcactggccagcctgtcaccttcccctgccacacaacccaaatcccttcctgcagggcgaggtgtacacctggggcctga

SEQ ID NO: 4895 - DNA, 495 bp, Chlorella protothecoides
atggctcgtggggtgcaaagaactctgcaccgaggtgcccagcgtggggcctgggggacctcgccactggggacctgttttcgcacccggtatgccattcctgccacccatacccccacctgctcggttgcgccgatcttcatcactcattctttcgtcaatctccaggaaaacgacaccgtcctgctggatctggagaccggcaagatccgcgagttcgtgcactttgacgtcggctccctggtcatggtgaccggcgggcacaacaacgggcgcgtgggcaccatcacccgcaaggagaagcacaagggctccttcgacatcgtgtacatccgcgacgccgtgggccactccttcgccacccgtgccaccaacgtgttcgtcatcggcaagggcgacaagccgctggtcagcctgcccaagggcaagggcatccggcagtccatcctgcaggagcaggccaagatctttggcaagaccgcggccgtgcactga

SEQ ID NO: 4896 - DNA, 543 bp, Chlorella protothecoides
atggctgcaaccggtgccctctccccctctctcctcccctgcaggtatgccctgaccggtcgtgaggtcgtggccatcctgaagaaccgcctggtgcaggtggacggcaaggtgaggaccgacaagacctaccccgtgggcttcatggataccatcaccatccccaagaccggtgcgttggcatggctagggtcttgcgggatcatgggaataccgtcggcccagaggaagccacggcagggattttggtcatcctggagtgtacgtcggccttggttggctacccaggcacgctggggctcgcatcctgttgcacgctacgggcacgagcacttccgcttggtgtacgatgccaaggggcgctttgtggtgcaccgcatctccaaggaggaggccacctacaagctgtgcaaggtgaagaggatgcagttcggcaagggcgccatcccctacatcgccacccacgacggccgcaccatccgctaccccgaccccgacatcagggtgagtgctcgcttggtgtgttgtttgcttgggaactga

SEQ ID NO: 4897 - DNA, 1188 bp, Chlorella protothecoides
atgacgtgggtgccgcgcgctggcggggatggtgtggtggtggttggggggggggaccgccatgccacagcgttggccgagtctggcggccgtttgttgtggcgtgcccctctggtggcggcccgtgatgctcttgcagtgttgccacgcggtgcagcgtggggctgccgggagggccggagctgtgccaggatgctgcgcccaccctcaccgtcgcatgggacccctccatctcagacaggcactgctggccttcctcccccccgcccacccccaagtccccacatccctccgcgctgttcaggtgcgcaagatcgcctttacagggtccacccgcgtgggcaagctgctcatggcggggtctgcggccacgatgaagaaggtgtccatggaactcgggggaaatgcgcccttcatcgtcttccaggacgcaggtgcattcccgggggttacctcatcattctaagaaacctgcgtggtcctcctcgccacccagacctggcccaggccgcggcggcggtgacgacgtcgtcctaccgcaatgccggccaaacctgcatctgcaccaaccgcgtctttgtgcacgtgaggacggggcgggatggtgggatccgggtctgggtcgcatgggccatgcactctaatcaacgccagggggagtgtgggcgggaggcagcacagggacgcctggccacggcgttttggcgagccatggtggtcatcctgcccgcctgttcaaaaagcgtgagcctcgcatcaaccagtgcccacaatcactcagccccctgcctcgcgcacgctgtccctgatggtccaggagtctgtgcacgacgactttgtgaaggagctggtggaagcagtgcagaagctgcgcgtgggcgccggcatggacgcggcgaccacccacggcccgctcatccagcactctgccgtcgagacggtgggctggtgcagtggggcgctttcctgctcggaaacagggatgtgcagcgtgtgcgcagcactccaggcgcagctgcaagccttttgccgtcatgtgaggcacagactgccaccaacagggttatcttcctggtcctgcaccccttcccccgcaggtggaggccaaggtgcaggacgccatctccaagggggcaactgtggctgtcggggggaagcgcccagagtatgacgccagccaccctctga

SEQ ID NO: 4898 - DNA, 1095 bp, Chlorella protothecoides
atggtggtggcgggcgtggaagctacaggggcgcggaagctgcagggatgtggggcagcggtgccggccaagtatgccctgcgaaagtgtgcatacacattcgaccttagttgcgccttcctgccctacatggcggcccctctcccggtcacgactgcaggggcgaccatcgacatgcgctgcttccgcgaggagatgtttggccccgtaaccccggtgttcaagttctctaccgacgaggaggccatccagatggcaaacaccaccgagtacggcctggctgcctacttctacaccaaggtggcatgcaggggtggggaccgggaggtgaagggtgttgagaggcaaggcatgggtcatccgtggcgagggagttcccaatgctgccaaggtcgccatcgcccccgcccgcgccgtcctcgcccccgcccgcgccgtcatcgacccagcccctctccccccctgccctccgccgcaggacctggccagggcatggaagacggccgaggccctggagtttgggatggtgggtgtgaacgaggtggccatcacctcggatgttgcccccttcggaggggtcaagcactccggccagggcagggaggagtccaagtatgcactggacggcttcctggacatgaagaccgtgtgcatgggcctgggcctgctgctgcccgggtccagtctacaggatggccacttgagcaagccggccttgcctgtcccaaccccttccagcatgcagtacccttgcctacccctcttgcactgtgtacgacgcactcacactgtcgttacagggatggacaccgccatgaacgtaatgggctcaagggcgaagaatgggagaggacagggcacctactcgtcttcagtgaagaggaactggttgatgatgtgcacaatgttctcggagccggggacggcaatgtcggcctccaggatcttgccgcggttgccgcgctcgtagtaggtgttgttcccgaccgcgtagaactggccggcgttgtagcggctctcctggatctgcatttgcacgcaaggtgggggatgggcgaggtgggtggggggttgatggacggggaaggggtttag

SEQ ID NO: 4899 - DNA, 705 bp, Chlorella protothecoides
atgaccaactgtgctcgactgtacgccagcgccactcccggagaccacatcgccctgtgcaggccctgccagctgcagcccctgcgactggcagcgacctgcctgacggccgtcgccccggctgccctcgccccaccgacggcggccggtgcctcggtgctggtggcccctcagcccggctgcaggctctggtcccgtggcaggatcgaggcaggggcttcggcgtctggccccggcgccgtgctcgtccgggtgagggggtccgtccaaggagcaccaggcaccctgatgaccgtccccgccgcccatctcgcacctgcgccggctgggcatggggaagacgagctcggcgccgacccgagctggacttcctgtgatcaatacgaggcagcgtcctcatccgacgtcacctctgatgacagcaaggaggaagggaccggggagggcccagtgcccgtgaccaaccctctcggactcgcgagctgggaagcgcacacgcggggggtggcaggcaggctcatggtggccatggggtatggtggcgcggggctgggcaagcaggggcaggggcagacccagccccttcagaccgtggttctaacgcagggtgccggcctgggcgtggcaggtgggtgtggggccagaggcgggccgaatgtggggagcttggagcatccggtagcggtcgaggcggagctgcactga

SEQ ID NO: 4900 - DNA, 1467 bp, Chlorella protothecoides
  modified_base (41)..(50): a, c, t, g, unknown or other
  modified_base (142)..(151): a, c, t, g, unknown or other
  modified_base (226)..(235): a, c, t, g, unknown or other
  modified_base (360)..(369): a, c, t, g, unknown or other
  modified_base (674)..(683): a, c, t, g, unknown or other
  modified_base (1051)..(1060): a, c, t, g, unknown or other
atgagagggagagggcagccacatgcgcttgccctgtgccnnnnnnnnnngcggtgtcgtggcagccgagacatccacaggcaatatccgattgtccccaaaccttcctccgctccctcaccaacttatgaatccccaatgnnnnnnnnnnaagcaaatgcgtccttcccccacacctatcccaccccacctcatcctgcgctcacagacaccgaggccaactttnnnnnnnnnngagcagatgcgtgcttcccccaaacctatcccaccccacctccacctgcgctcacagacaccgaggccaactttgagcctggttctgcacagcacgagtctcggtcagtagggccgcaccgcccnnnnnnnnnntcagcacgagtgagtcaggggggtcagaattgggccgatcgcgcagtgcctgtcgtgctcactcccacggagctcttgaggccaggtctcggtcactttgcggtcgccgacttggccgccgtcaaccgcagcgtgaccccctgggtggtggtcggcttccaccgcatgatgtacacggattcgtactacggcttcacccccacctccagccaggtcgtggcgaccgacatgcgcgccgcctttgaggacctcttctttgagtacggcgtcgacatgacctggcaggaactgtcagcggtggggtnnnnnnnnnncgagtacggcgtcgacatgacctggcaggtgtgtgggggcgtgctctcaagtatcaagggatggggtgtgttggccggggtagcaggaactgtcagcggtggggtcgctgcaggaccattcagttcttcccatgcaacccctggacgcttcctcttcgaagcatccgctcgagggcaagccgctgccttgcatttgcccaagaccatgcccgtccctgacaaggaccgccaccctccaaccaccgagtctgatgctggctccctactccccgctgctgatcacagtcgccactccctcgctcccctccacatcaccaccctctgtccgtcccccagtatactcaccccccttggccccatggaccccnnnnnnnnnntcgctgctgatcacagtcgcccctccctcggtccctccacatcaccaccctctatccggcccccggcatactcaccccccttggccccatggacccccccccagggacacctgcacaactaccagcgcacctgccccgtctacaacaacacctgcgtcgactacgatgacgagggcgtggctcgggggcccatccacgtgaccatggggcacaacggcttcatgctgacccccttctaccagcccgaggcccccaacgcctttgacgggcagcccacctttgcgtcctttggctactgccgcgcggaggtcaatcgcacccacttcaacctccaggtgacagtgcttccctatggggttcaggatcggtcctctgcaaacgccctgcagccacgccacggggcatga

SEQ ID NO: 4901 - DNA, 708 bp, Chlorella protothecoides
atggaaccccctgtgcctcctgcttcccacagggacctgaagcgggtgcgggacgaggacgcgtcccgcttctccaacttccccgtgctgaacgaccgctacgtcctgctggacctcctgggtcggggcggcttctcggaggtgtaccgtgcctttgacctgtccagtcagcgtgacgtggcctgcaagatccaccagctgaacgggcagtggagcgagctgaagaaggcgtcctatgtcaagcactcggtgcgggagtaccacatccacaagaagctgcaccaccccaggtgcgagtggagtgccgaggctaggatggggtggttgagatgctgggagaggtcggtgtgccctcctccggggcctgcattcggtttcagacagcaggagggggaggatgaagacgtgcctggacggttgcagcgcaggggaccgcggtatatcgaggctcacattcctcccacgcctgctgctccaggatcgtgtcgctggtggacatttttgagatcgacaacaacacctttgccaccgtgctggagctgtgtgagggcggcgacctcgactcctactgcaaactgcatgaggtggggcgggcgctggatttggaatggcgggggagagaaggcggagaggcggaggcgggacccgggctcgccggggccccttgcagatcggcgtcttggaaatgtcctactcccagggtggtga

SEQ ID NO: 4902 - DNA, 993 bp, Chlorella protothecoides
atgacttggtgtggtctgagccttcgctcaaagaatggggaaatctggaggacaggtgagcaagctcgaaacgcagcaagatcaatggcgctgaggcctccttgcaagcatcagccacctgactctgtactcactgggcggtggggagaggaggcaaaactgtcggcgaactggacgcctgagatggagggtgaggccaccgagttctactgccggaactacatcgacaccttctccaccacccacattgccacggccatggcatgcatcccacagctcatgcagtgggtgaagtcgactgatcctgcacagggatgtccatcggcacatctgattgagcgtgctcgccctaggttcccacagtcatcagcttgcacatgcaagtgctgtcctgctgatctgcctggccctcaaccgactgctttgcagggatggctgggacgtggcctgcctctcagttctgctcaactcaaccttgtcatgtcggcctgtgcatacaagacatacagctccgcgcctcatctctgccctcctcctgacgcagggcctgttccaagtggcgaggcgctttttcctcctgttccagaagcacaccaccgtggagcgggtgccttgctatcctcttctagccaagccaccagccctacacattgcaagcaggagactctcccagcatcctggctctttcacccacagatgacaccactcatgggttgttgttcagtgcagcctttcattccctccctcctccaacccccttgcaggagctaccacagcgtgcattacctgggtcccactgttgcacttttctctgtggacatgaggacccagcggacccgctccgtctgtgtgccagaggtgggaattgagtttttaggccggggaccggagctgccaagcagccaggcacatgctgttgggagtgcactcctgactcgatctgtgctccagtgggggtgcttgcctggctcaccgggcgtggcgtgcccttaa

SEQ ID NO: 4903 - DNA, 1164 bp, Chlorella protothecoides
atgatgcgtgcgatactgccccggcgagggacagccttgttggcggaatggaccctggcgcgggcctgtacgccgggcctacagctcgacgccactcatggccttctacatccagaatgtagaagctttaccagcgacagccttgtccgcctgaccccctcaggcgagcacctgcatctctggcgagcgcgccctgcatgcgcgctgaccattgttggggtttgtgtgtcgcccaagaaacaccatcttacagccctccgacccttgccaatcaccaccaattccccccccacgcgccgtacaggggctgagttgcagaagcggggcacccacttcgccgccctggcgcccggcgccgcccccgggctggcgctgtggtcgcggctggtgcgccaggtgcacgccaccttcatgcccgccggctaccccgtgaccgtggcccccggctaccgcacctacgtcgcgtggcaggggctgcaccacgccgcgggctccgccaacggcgtgctggcctccacgttcctgctctatgcgctggggctgggcgcggaggccatccccaccgccggcgccatcaactgggtgctcaaggacgggctgggccaggctggcacgctgctgttcggccgcgccatcgcacacaactttgacgtcaacgcgcgctggtggtacgtggcctcctccgccaagctcaacctggccatgggtctggagatcggcacggcgttggcgcccgccgccttcctcccggccgccgcgctggccaacgcgctcaagggcctggcctggatggccggcggctcggcgcgcgcggtgttcaacggcgcgtttgccgccaacgtgaacatcgccgacctgacggccaaggccaccagccagaccatcgccgcctcgctggcggggactgccgccggcgtcgcgctggcggcgggggtggggcagagtctggcccccgccgccgccgcctacgccgcgctggcggccctgcacatgctgtcgggcgtgcgcagcgtgcgcagcgtgcccctggccacgctgaacccctccagggtgcacgcgctggggcgcgcattcctagacgggggcggcgcggccgccgcggccgccgacgaggtcgacggcgggctggccgcgctcggcgacggggcggtggtgcccgcggat

SEQ ID NO: 4904 - DNA, 594 bp, Chlorella protothecoides
atggaggcggaggaggcaaggcgggacctgcaggcggcgcgggcggcgcgcgaggacgcggaggaccgcctcgccgccatgcaggcagagctgggcgaggcgcggcgctcgggcgccgcgcagatcgcccacgtgcgcgccacgctgctacgcctggcccgcacctgcgcggcgctggagcgggaaagcacggcacagtcgctgcgcgcgctggcgccgcggctggggtcgctgggcgtgcgccggcgcggcattgaggtgcaggaggtgtgggaggagggccaggccttcagggatttgcgagccaagctcaccgcgctggccgagcagcgcgatgccattgaggccgccaggaaggcggccaaacggcggctgccgctgccggggcagccgctgccagaggagaggaatgagggcacggacgctgcagggacgtcgacgtccaccctccacccagaggactgggtcgtccaggtgggagtgcctggaaacactgtgcagaccaaaacggacaggcacccaggaggggatgtggccccagaccgatacagagctccagctcttcttcagacattctgtactgaagctacatag

SEQ ID NO: 4905 - DNA, 558 bp, Chlorella protothecoides
atgagcatattcgcgtggctcctagtcgtggcattggccgcatgtgcggccccagatgcggtgggcgccctcgcctccacggctcctcgcaagtctgcccccttccagacacgcaacctgatcgaaaaccaccagaaaggcttgaagcttagggtttccaccacctctatcgacacctcgggccagtatgttacggtctcatggtccggcgtcgaggtgcgctgcggggtgaggcggggctgcgacggccagcaccagctccatcaccctaccaacccatggcatcccttcccacaggacccagctgacacggatatggttgccatgtacctggcagacagggatccatccgaaacctggcccatgaagtacatctggacctctacggtctacaactactatgagcccatcaagtttgtcttcctgaggggcgcatttggcgacaagttcatcgcggccacctcagagaacatcacctccaccaacccccagcagcccacgcaagtgaagctggccttcactgaggatccgaggtgggcggggatgactgccggttga

SEQ ID NO: 4906 - DNA, 417 bp, Chlorella protothecoides
atgactggcttggagcccaacacccgctactactatgtcgtaggggacgagggcgagggcccctcctccaaggtcaccagcttcatcagcgcgcccacccccgaggacaccgttcacctgctggcactggccgacctggggcagtacaacgaggacggcagccgcaactttgcctactggtaccagtactacgagcccgccgacgagttctatgccatcgacaccatgcagtacacggtggggccgctgcctgagggtggccgcgggggtgaagagtgcctagggtgggttaggaccaaccgggcggccccagttgcagagtgcccttgtcatgcagcccttgacctcttaccggtccagctgtgctccagccacacgccgcccacacagcccctctccaaaccctgcctcagatga

SEQ ID NO: 4907 - DNA, 516 bp, Chlorella protothecoides
atgccggaggccaagcacaaaaagacagagggctctccccccaccgcggagcatgcatgtcgcaaaatggtggatcgcggctgggccgggccctacctgcgctacatcaacatcctccccgaggagggtgtctggctgggatcggttctgctcctcgtgcgcagtgagcgcctgggcgcctctcgcacgcccgcccagcccccggccgagtctgccgacggccccaccaggccaggggacacccagtcccatgacatcaccgctgagatggtgatgtgggaggctgatggcaaggaacagggccagagcacctcccagggggtgctgctgaccgaggtggaggggtggcaggcctggcgcttcggcatcagcctgtcgctgcaccgctcccagcgccccattgcctaccaagtcgccgtggggcctgtgcagacggagcagtgcgtgttctggattccagggggcggccagcccatgcactgggggtacgtgtgttgggcaagggctcagggatga

SEQ ID NO: 4908 - DNA, 1338 bp, Chlorella protothecoides
atggagggggccagccccccgccccaggccgacgactcggacgttttggatgcacagctgtacctggacgagccgggcgacgccccccacgccgcccaggaggatgcgcctcgcctcgcgggtgccggggcagtatccgggacgcaaccccccgcccgtatctcgcgcgtaccgcgcgtgacgctccgaacccttccattccccgcgcaggtaaagtttctggtcccaaacgtggcagctggcagcatcatcggcaaggggggcgtgaacgtgtcggacatccaggcccagtcccaggccaggatccaggtggggcgtgctggccaggccggcctggtccgcgcccggtggtccaaagggagcagacgaactgcctgcattgcgccgggcctggcccccaggggcagggcggcggcctgcaggcgacgcatgtgtcccttggtgcagctcgccaggagccccccccccttcaacggccaccctgccgctcatttcctccccgcccatccgcccattcccccctcccacccctccccaccccagctgagcaagattggggagccctggcccggcacgctgggcgagttcggcaccccccctgcccacgaccgcctgctgctgatcacggggacgctggacgcgctgctgaccgcgctgcacgcagtgctggccaccttccggtcggagctggcggcgctggcggccgtggccgcgcgcgaggacggcgccatggccctgcgcatgctggtgcacgcccggctctgcggcacgctgatcgggcgcggcggcgccaccatccgctccttcaaggacgcgtcgggcgcggtgttcaacatctcgccgcccccggggccaggtgatcccccggagcgcgtggtgcggctgacgggcacgcccgaccagctgctgcgcgcggtggccctggtgctgaccaagctgtcccagaacccggactacccgctgctcaccgacgtcagcctcggcttcggtccgcccgctgcggcgccggcggagacctggggcggcgccgcgccgccaccgggcggcggggcgggggccttcctgccccacgctgccgcggcggcggcggcgggagtggggaccaccagcctggtcatggccgtgccggaggaccgggtgggggtggtgatcgggcgcggcggcgcagtgatcaaccagatcaaggcggtgctgggggtgcgcatccgcatcagccggcggggggagtgcctgccgggaaccaacgaccgcagctgcgagatcagcgggccgccggagagcgtggcactggcgcagcgcctgatccagcagaaggtggagggcgtggagcgggagtga

SEQ ID NO: 4909 - DNA, 2148 bp, Chlorella protothecoides
  modified_base (310)..(319): a, c, t, g, unknown or other
  modified_base (484)..(493): a, c, t, g, unknown or other
  modified_base (723)..(732): a, c, t, g, unknown or other
  modified_base (1137)..(1235): a, c, t, g, unknown or other
  modified_base (1630)..(1639): a, c, t, g, unknown or other
  modified_base (1997)..(2057): a, c, t, g, unknown or other
gtggtccgccgctgccgccgcggcgcccgcctggccccgcgccctgcgcgtcgcgctggccctggaaagcgcggcccgccacctggcgtacagtcgcgtggccgacgcgcgcgccgggctggacgtcgcagacgggcttgcggggttcggcgccgagctggcgggcgtgctgggcacccgcaccgctcaccagacggaagccaaggcgcagctggtggtctccgtctcacggcggggggcctgggtccgggaccgtggcgcggcgcgagtcgacgacctcctgcccccggacgtcgccgcggcgggggcnnnnnnnnnncctgggtccgggaccgtggcgcggcgcgagccgacgacctcctgcccccggacgttgccgcggcggggggcaggcccacgcagaccccggatggcgccgacgacgttctgcccggcccgcggctggtggagggcgcgggtggcggccccccagcggccgccgcannnnnnnnnnggcccgcggctggtggagggcgcgggtggcaggcccccagcggccgccgctccgcgggacctgcactccctggagcaggcgctgctgctggcgcgcgcggcgctgctgcggaagggcagcgcgggcgacgccgtgcgtgcgggccagctggcggcctacgccgaggccgttgtggcccaggacctgagccaggaaatgccacgctgcatctccgggccgtgagctcacgnnnnnnnnnngggccagctggcggcctacgccgaggccgtcgtggcccaggacctgagccaggtgcggggttggaccggggactcagcaggggggtggagggggggaatcccctgcgcttgtggtcaaaacaaggaaaatgccacgctgtatctccgggccgtgagctcacaagagacacagattctcctctcaaaagacacccccacccccacacagtgggtgctggcgacggcggcgaggctgcagctcgcgcggctggagctggagcggccccgcacccgcgttcgtggcctggcctcgttggagggcgtggaggaggccgggcgcgcgccagggccccccgccgccgcgcgcctgcgctgcgctttcttcggcgcgctgccgctgcgcacgccgctgcgccgcgagctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggcctccgcgctgccattgttcgagggcgtggagctgtgggacagcgtgatcgtgtgctaccagctgctgggcaagcgcggcgcggcggaggcgctggtgcgccgccggctggaggtgcgccccagcgacccacgcctctggtgcgctctgggcgacctcagcctggacccgggccactaccgccgcgcgtgggaggccagcggcgggcgcagcgcgcgcgcgcagcggtcgctggcacgcctggcggcgggcgcggggcgccacgccgaggccgcggggcactggcgcgccgcgctcgcgctcagcccgctgcaccccgagggctggttcagcctgggctacgcgtgcctgaaggagcgcgaccacgcgggcgcgcgcgcggctttcactnnnnnnnnnnctgggctacgcgtgcctgaaggagcgcgactacgcgggcgcgcgcgcggctttcacccgcgccgcgcagcagcagccggacaacggcgaggcctggaacaacctgggcgcggcgcacatcgcgctgcgcgcctggcgcccggccttcgccgcgctgaccgaggcgctgcgccacaagcgcgacagctggcaggcctgggagaactacggcgcggtggcggcgcgcgcgcgcgagtggcaggccgccgcgcacgcgctgcaggaagtgctgcgcctgtcgaacggcgcgcggctggacctggaggcgctggaggcgctggtgcgccggctggagcgcggcgcggaggaggaggaggagnnnnnnnnnnnnnnnnnnnnnnnnnnnnnnnnnnnnnnnnnnnnnnnnnnnnnnnnnnnnnggaggggatggaggagggggatggggggaagggcggcgacgaggaagatggcgacctgctggatccttacgacgaagaggtggacgtgcga

SEQ ID NO: 4910 - DNA, 789 bp, Chlorella protothecoides
atgggcctcgtccccggcgcggccaccggcgcctcggtcgccgcctcgagtcccggcgcacagcacctagcggaggtgtggaacgcgctgaacgggcaattctcgcagtcccccgcgctgccggagctgaagcgcacggggtcggcggaggcgctggaggcggagctggccgcggccgccggcgacgagcgcgagctcaagcgcctgcgccgcaagcagagcaaccgcgactcggcgcggcgcagccgtctgcgcaagcaggccgagtgcgaggagctgggcaagcgggtgaaggacctgatcgcggagaacggggagctgcgcgccgagcgtatcgcgctccgcgcccagatcgaggtcctggacgccaagctggccatgtcgggagggggggaggcaggggctcgtgcagaagggcacggcaccacctgggaagggatgacgtggggacagcggcgggccctggcgcaatgcgcgacgagcgccttcaacctggcgctgggcgcgggggagctggagaagattcaggccgatgcccgggcgaagcaggcagccgaggcgaccaacgtggcggccgctattgcgcacgtgaacgcgctgacggcaaacagcaacgcggccgaccaggaggacgaggagggcgaggatcgggggcggggcggccctccctccgtgcctaccccagccagcgggccccagctcccaccggcggcggcggcgtcaggcgcgcaggcccaagggcacgctgcagcggctggggcgctgggcccccagagcacctcggcctag

SEQ ID NO: 4911 - DNA, 2154 bp, Chlorella protothecoides
  modified_base (31)..(40): a, c, t, g, unknown or other
  modified_base (1346)..(1355): a, c, t, g, unknown or other
atgagcaaatctggctatgcaacccccaaannnnnnnnnngcgcaaagaaagcgagagcgccggccccgcggcctggcacggcgtgggccccgcccgggacgattggggcgagcggtacacgggcaggcgctcgccgagcctcttcgtgctggacaccaggtcctggagcgtggcgcgtgtggcggcgggggatgccgatgcgtacagcatgggacagccggtctggacgccgcgaggtgaggttcatgggaaggggtgggagtaggcgatttatcacgggatggcatcgtgtttgtgcgctggccgcacgcccccgacaacttcccgggcttgacgcagcgcctgggcattgtctactgcttcaaccgcccctgccacctggcactggcgccgtggctgcagctggacgccagcgccagggacgaggctgccatcgagggggcgccgctggaggcggggttccagggcgcggccgaggcgcccgcgggcggatcatacccagccgcgacgctgctgacgccggggatgagcagcgccttctcgccgcggttcagcccggacggcgggacgctggtcttcctgagccaggccgccgcggtggagagcggggcgcacgccgcctcggcgtccctgcacgcgctgacctggtgcggggcggggccggcccgggagcccccgcacatgctggtcggggtggaggcgggagcccctcccgcaggcccagacccctacgccgccttcccgggcctctactccggcctgatcccggcccagccctgggtggacgccgacacgctgctcctcacctcccagtggcgcagcaccacggcagtgctggccgtgtcgctcagtgcgcgcagcgtgcagcgcgtgagccccccgccggggcccgaccacgccagctggagcctgctggctgccgacgcgggtgggcggcgcgggtggactgcgcggggagtgggaatgcggggttgcttgagggtgtgcctgcccatcgccagcgccaggcgtccatctacagggcaccgcaggccgggcggctggcgcctgggtgcccggccaccgattgccagcttgcgtcactgggccacttcccagcgcggtccctggcttcagcctccccagtgcgctacacacacatctccctgcatcaacccccctcgccgtacgtcgcccacctgggccgcggcgaggccctgggccccacttcctgggctcatctggatttgggggacgccgaggacgacgcggtaccgcccgagctggcagccacgctgcgcacgctgcgcaccaccgtcgtgtgcccccagcctggcgacgacggcgcagacggctcgggtcccgnnnnnnnnnngctggcagccacgctgcgcacgctgcgcactactgtcgtgtgccccgagcctggcgacgatggcgcagacggctcgggtcccacctgggaggccctcctgctgcatgcggccggcgagggcgcccctgtgtcggcaagcaccccgaccccgggagagccccctgccaacgacgatcagccgaccagcgcaggccgtgcggccaccaccgcagaccacatgatctccacaggctcctctgactccaccccccggcccctgctgctcatgccgcacggcggcccgcactccgccttctcctccgagttctcgcccgtgctgggcgcgctgtgcgcgctggggcatgatgtgctgctggtcaactaccgcgggtccacggggttcggggaggcttctctgcaggccctgcccggccgcgtgggcgagctggacgtcggcgactgcctggcagcgctgcggcgcgcgcgcgcgctgggcgcgggcgccggcgcgggcgcggcggtggtgggcggctcgcacggcggcttcctggcggggcacctgctgggccaggcgccgggcgacttcttcgcgggcgtgctgcgcaacccggtgctggacctgggcctcatggtccagctcagcgacatccccgactggtgctacgtggaggcgtggggcgcggagggggcgcgccgcgcgcgcgtcaagcctctttcggaagacttggaccgcttccacgccgtctcgcccatcgcacacgtcgacaaggtgtgtgtgtgtaggggtgagagggatggaagccgagtgagggaattgtga

SEQ ID NO: 4912 - DNA, 225 bp, Chlorella protothecoides
atgctcttcctgctggggggcaaggaccggcgggtgccgctgcgggacgcgcagcagtacgcgaacgcgctgcgcgtgctgcgcggcgaggccggccccgccaccaagatcctggtcttcccggaggacaaccacgccctggactcgccgcagaccgagttcgagcagtggatcacggcgttggagtggctgcagcgccacgggccggggtctaccaccatgtga

SEQ ID NO: 4913 - DNA, 612 bp, Chlorella protothecoides
atgggcgccccgcggccttcaacccccgccctcatcaccagcttccccatgggtgcaggcatgacgggtgtatacctccccctgatcgcggccggcgctggccaggcctgctggaaggagccggtggccgttctgttttcgcgctcgcacttcagcctcctggcggccgtggagggcgaggggcccgtgtcacccccgctgctggcgctggccggcgccgggcagcccctgctcccccgcttcctgacggaggaggaggagagcggcgcgcccccaccctccctccccctcctcgtcagattcatggcctgcgtgcagctggcgggcggcgccctggctgtgcgcctcggtcaaagcccccggcccaacgtcctgctctccctgctgcgcgccaggctgctgaatgcgggggcggaggctgtgcagagcggcggggtgcaagcggggtcggacgcggggcagagcggccaggtggaggcagggacggaggctgtggggagcggcgagggcgaggcgggggcgagcacagcacgaggcggcgatgcgctgacggtgcagggggccgaggcgccttcggcccggccagaggggctgccaccgctgcacccctga

SEQ ID NO: 4914 - DNA, 1020 bp, Chlorella protothecoides
atgcaccagggcgtgggtcgaattcgaatcacccatcctcccctccgtcagatcgtggtggcggtccccctctcgcccagcggccgtgactggatcaaggcaggccgggcctggcggcggggcctgcgcgccgcatacgtggccgacttcaacgccgatgccgagctgcggctggacggcggcctgcacggcgaggagttcatctatctcaactccaccgacatccccttccactactacggcaaggcggccatggtcccctctgtagcccacgagcactttggtcagtacaactacaagtggatgctgtacggcgacgacgacaccatctggttcctggactctgtggtcaacattgtcaaggggcgtggggcccttcagagcattacatggtcagttgtcgtcttggggatgttgctgggttcaccaacgtctgctgaggttccccaggcaatgtgcctggggctacgccagatgttgcatgccgaagcacccgggccccggccacagaccaccccattcacatcggcgctgcgctcccagcttcgcgctgctcgacccagacatgccgcacctgatcaccgaccacctctggttctggggccacacagagggctccccctcgcaccccgtccatccggcggcggatgccccccgctgcctgccctgcggctacaacaccagcctcctggcggggctggcgctgcccttcgacccgcccctggcctgccccttctgcacctggcagaagctctgcgcggcggacgtcaagcggcgctctatttatggcgacgactgcgggttcaggccgcggggggggggagcaatgcgagccgtgtgcactcgtctcaggctcgcgcagagggaggggctgaactcgtgccggctccacaggacaggccacaggagcagagaccgcacatggcctcacaccctaacccttcccgagaccctgctgccctcaggaggcagagttcttggcgcacggcggcggcggcatcatcctcagcgtgggactga

SEQ ID NO: 4915 - DNA, 513 bp, Chlorella protothecoides
atgtccgcgcagcggggcggcgacgaggcgacgctcatggacgagggcccgtcgctgtcgttcgggccgctggtcccgctggcggagcagggcggcccgggcgccgcgcccgcggggccggccgcctccaccggccagccagtgccggtggtgccccaaggggggcacgctccctcggcttcctccccccccctcccccccgcgcgcggcgacaagctggagccggcggcgctgggcgacgatgtggcgcaggtctctctgtccaccatgagccgcatgcaggccatgttccaggcggcgctgcgccaggaaatcccctactcccagctggaggagttcctgcgggcgcacaacctgctgccggacggcacgccggcgggggcggggggcgtcacccccccgcgggcgcccacgcccacgcagcagccggggcccacaggcctgacggacatgaagagcatcgaggccgcgctgccagagtaccccgccggttcccatggccaccggatctga

SEQ ID NO: 4916 - DNA, 675 bp, Chlorella protothecoides
  modified_base (242)..(251): a, c, t, g, unknown or other
cgcgctggcgcggcacggcgccggaccccagcgcacgcagcgcgcgctggcggtgctgctggacgccgcgcgcggcgaggacgggcgcgtgctggcggcgggccaggtgctcctgcgcttcgcgtcggaggcccaggagaaagtggccggggtcatggcggacgtcgcccccctggcctacctgctcaaggtcgggattttggcatgggtggcgtgtactggaggggtggaaaggggggagnnnnnnnnnncctgcgcttcgcgtcggaggcccaggagaaggtggccggggtcatggccgacgttgcccccctggcctacctgctcaaggtcgggatttgggatgggtggtctgtactggaggggtggaaaggggggaattctgcccgggctagggccgctggcatgccgcggccaccgctcctctgtcgcgccaagacccctcccaccacatcaaaacataactcctgcgcgcagttctccggcgaagccgaggcggcggcagtctgggagcgggtgtgggaggagagcaccgcctcggtgggtagcggcgtgcgcctgctggccgcggagatctgccgggaggccggtgccgcgctggcgggcgcgagctggggcgccaagcgtgcgggcgccgccgcgctggccgccgcggccgccgcggcgccggaggcg

SEQ ID NO: 4917 - DNA, 645 bp, Chlorella protothecoides
  modified_base (49)..(58): a, c, t, g, unknown or other
atgtctgggcagcaacgcgccgacctcgccaaaccttgcccacgtctgnnnnnnnnnngaaggctacgacactcccaacgcagaggcccgcggatgtctgggcagcaacgtgccgacctcgccaaaccttgcccacgtctgagagcatcccctgcttcaacacccccccctcttcccccctcgcgcccgcgcccgcaggaccaagagcagggtgctgctcacgaggttcacggcgcgcgtgctcatccagcccatgtaccgacccgacttcatcaacctgcacgcgcaaggctggggatgctgccagcctgtgcggaggagtggagccgggcagtgtgcactgcgccatggaccctgcacagaaatctgggtctagcatgtctgattccagactccggccaggctcacacagcgccccccctcccttcttctaactcagggtttggagtgctgacatcagcctacgaccggtcgcagcggtacctgccctcgctcactgccgcccaggaggcactggatggcctgcttgcccccgggcagtgctcggccctggtccaggctgtggtgaccaagtacatcgccctctcctccgaggagctggaggagtggcaggcggatgccgaagggtgcggtgactgctgctga

SEQ ID NO: 4918 - DNA, 675 bp, Chlorella protothecoides
atgctggagcgcgagacggagtcggtttccagcgccctggtggaagctgcggggcagttgcaggtgagtgggtgtgggcaagtggtgtgctcgatggcggggccaggctgcaaggagggtgacggatctccatctcatgaagtcgatcagaggagacttcccaggcccagagctttggcgtgcctggagaaggcttggggaaggaagccttcaagtcacgcggtgcagaggagtctgcgccactgcccccgccgctccgcagtcctccaggacgccttgcctcttcacctcaccattgcccctgcccctcaatccccgcacccatgtccacagacggccccgctgaccagggaaactctgctgctgcgggaggccacctaccgcgcgctgggggagtgcttcagccacgtccggaccaaggtcgatttcccaaactggtacgagacggagctgcggggcatcctgcagccgacgccgaatgcaggcttggacgcccacatcctgcaggcgcgggccctctggctggtgggtgtgtgcggcgaggagctcggacacgagccctgggacgaggcctttggcctgtgcgccgcccacatctcctcgccggacctcgtggtgcgctgctgggcccctgagcccggctggtgggacccgggagtcgcatggggaggctga

SEQ ID NO: 4919 - DNA, 1476 bp, Chlorella protothecoides
atgagggcggggagacgggggaatgacgaggcggcatggaagagatgggcagctcgcctcatgctcactccaccccagcaccatacacacccctaccccacacatcccttcgccctctcccttcccttcacagccgtcatctccatggggacggaggtgagcgaggaggacgtgctgaacgtgggcgcactctgcgaccaggtcatcgccctctccgactaccgcggccagctgtatgactacctcaagtcgcgcatggcggccatcgcgcccaacctcaccgtcctcgtcggcgagctggtgggcgcgcgcctcatcgcgcacgtcggctccctggtcaacctggccaaagccccggcgtccaccatccagatcctgggggccgagaaggcgctgttcagggcgctcaagaccaagcacgagacgcccaagtatggcctcatctaccacgcctcgctcattggccaggccgcgcccaagaacaagggcaagatctcgcgcgtcctggcggccaagtgtgcgctgggcgtgcgagtggacgcgctggcggacgtcagcgacaacggtgccatcggtctggaggcccgcaccaaggtgcgcagggtgggtgggcggccgccaagggtctgccggccggcgtgcgcgacagtccagggtcgtgcatgtccgacacgggcaggccacaagcctctgagcagaaccccgtgccaagaacgcgagatgggcacggatgcgtacacaggttttgaacgggggcaacagcgatgtgtctgcgcctggcacccgccccgtccgctcccgcagtgggcgggggggggaggggctcggccagggccccacagctcggtgcccggccccgtgccaggccgactacaaattgcatgtctcatgcgccgccaaggcggctgccaaactcctcttcgccagcagttcctgcccacctggactcaccccccccctccatcccccacccccgctgcaattgtccaggtggaggcccgtctgcgccagctggagggccggcagttggagggcgaggcagcgaggccccggggtctgcccggcgcagccccgtacgacgccgcgcgccagggcgccgcgccgacgctgctgaccacccccaaggcatacaacgcggacgcggacgtcgtcgcggcaaccaccgagaagaagaagaagaagaagcgggaggcggaggcggacgtagtggaggccgaggagcccaccaagaaaaagaagaagaagaagtcgggcgatgcaggggtggcagtgaatgaagaggaggcagaggcagccaatggccttgagaacggggataaggctccgtatccttgtcaggaaacagcaaacctgagcgatgcgttttcacacaagatcttcgacatcgatgatctgaagtctgtccaacgcactcaccccatcacgcacccctcgcagaaggagaagaagaagaagaagaagaaggcagatgcatga

SEQ ID NO: 4920 - DNA, 2751 bp, Chlorella protothecoides
  modified_base (118)..(127): a, c, t, g, unknown or other
  modified_base (1114)..(1123): a, c, t, g, unknown or other
  modified_base (1257)..(1266): a, c, t, g, unknown or other
  modified_base (1364)..(1373): a, c, t, g, unknown or other
  modified_base (1899)..(1908): a, c, t, g, unknown or other
  modified_base (2426)..(2435): a, c, t, g, unknown or other
atggatgacgaacttctgcgcgacctgctcactctggatggcgatttctcggtaagaaacacgagcttagacgctcaactcggctgcctttaccagctttgcccctccattccctggnnnnnnnnnntaatgaacggcttcacatgcacatcctggggccctgctttcgtagaatcctcgattgttgaaaatgaggatctcgtactcatcaatctctgccatgctccgacgacacaggcacctcccgcagcgtccgctccccccgcgcccgcaccgtacatccctccacccatcccacacccggctgccgctcccagccagtcccaggctcacgcggctcccctccacccggcagcacccgccgggggccagagtccccccgccccacctgcaccccatcctgccccagcagcccagggccaggctccctccaggaccctcagtcgctctgtggcccccttcctggccaagttctcacctgcccactggcacatgctgtttggggcgctgcacaagtatgactccgggtccaaggcgcggctggaggccatcttcgtgcaacgctaccccaagctcaaagcggcggccgccacctccacagaagcctacgtcgcggtgggcttcaagatgctggaggcgctgctagagtttctgcccgaggaccgcctgatcagcttcatgcacaagtgcgtggagcatgtggcagagaagaagtcagccgcgctggcggctgccgcgcagcagaagcagcagcagcagcagcagcagcactggcagcaggggactggcggcgagggtgcgggcgctgggccctctggtcgtcctcccagcgcagcaccccaacacccgcttccgacacagcctcccggccatccgcagcagccgcagcaggcaaagcccgggcagcaaccgctcggcggctaccctcagcagcagcaggggcgaccgcccatcctcggtcagggtcagagggcctcgcagggcggcgaagtgccgggggttgccctgggaaggccggtggggcccgtgtctggggtgggcttcccgggcagccaaggggatgggcagcagcgccttgggcacccagctgctggcgtcgggcccgtcaaccctnnnnnnnnnngggcggcgaagtgccgggggttgccctgggcaggccggtgggtcctgtgtctggggtgggcttcccgggcagccacggggatgggcagcagcgccttgggcacccaaccgccggcgtcgggcccgtcgaccccnnnnnnnnnngagggtgggcgggagtgggcggagggtgggcggggtgcgggaggagtgggcacagaatgcctggctacccctgcgtcgcccgacggtttcatggatgnnnnnnnnnnggccagcagcagtcaggctcgcagcagccccagcaggggcttgcacggagggaacccggggcggggccgggtgcacagcggaaggccggcggcaccaagcgtgggagcctgggtaggcaggagtaggtggagggtgcggggtgcgggagtgggcacagaatgcctggctaccctgcgtcgccagccggtttcatggattgctcggaggatgcggtgtcgcgggtgtgctcagggatgtgaccgctgtgacggcgagggaggtagcggtcaacgtgaagggaagcgtgcccgtgctgccagcaggaaggatcgcgacggggacatcgacgagatcctgggcgcagacgccttcattgacatggagcaggagactgacaccctcatggctggccttcctggggctgcttcctacaacggggcttgcccgagctggaatgcatgcactcgggaccccttctcctttcacctaggtgtactgcaagaagagcacctccttgccatcgccgggtctgcaccacggataccnnnnnnnnnngccttcctggggctgcttcctacaacggggtttgcccgagctgggctgcgtgcactgcaagaagagcacctcctcgccatcgccgggtctacaagtgcagcggacgcagggcctggcgtcggtggccgccagccagaccctgagcgagtggcggctggggaacgagtgcgtgaagcagatgcgcgcggcggggctcaaggtcctcaagccggagtgcttcgaggtcatccagcgcgccttccagtcgcaggccgagaccctgctgcggcgcgcgatggcggtggctcgccaccgccaggacaatgcaaggtgtgcgacgacgggggtgaaagggcgctcgtggatagaaaaggagagggtgagggggccgtcggcggggccagagggcaggtgccggaggggatgcggctccgactccttgccgtcacaccacagttgctggaggacgcgcacggtgtcgcctgctccaacgcgtggcacacggcgtcgtcgtccccaccgatgaagccgacacactnnnnnnnnnncttgccgcgccagcccggcgtgtcggtcacgcacgacccgcggcgaggtgtgctgggcctcgagcgcgccgcgcgcgcggcggccgaggcgaagctggccgcggagcgtgaggcgctgctcaaggccgcggggtcgcggcgggcggacgaggagaccaaggagcgggcccagaaggccaaggcagagctggcagggcgtgcgcaggccagcgccgccaacgccgcggtggcggccacgctcggcggcaagggcggccgcttcgcgcgcttcgagcgcctgggcgctgccggcctgggcggcaaggacggccccggc

SEQ ID NO: 4921 - DNA, 1029 bp, Chlorella protothecoides
atgctccacgctacccccactgctgctccgcatcatgcagctctggcggacgacgcggcggctgccctgaagctgcgggccctgtccaacctcgcagacctactgcaccccgagggggcgacgaggacagcgggcgagcgcccaggagcggtggcggtgggcagcgtgccgacgtgcaacggcaccggcgacgccctgtcccacgttggcagcatcgttcaggtgtgcggcagcggggctgcgtcactctgggcccgtgccctgtgggcggcagcggggctgcgtcactctggggcccgtgccctgcacccgattgcggcgcccacccgtcccccgccggccccgcaggaccactgggacctggtgctggcacgggcgctggagagcggcgcggaggaggccgaggcagtgcgcgcccgtgccctggacgtcatggaggccgtgctcaggtgctcggggggggggagggggcaacgtggcgccggcggtgcccttcctccctttcggttggatcctggaaatcacagggcacaccggagcatcgggttcctcctgtgtccacggctgcaatctcacacacccaccatcagggaggggctggttgggccctggacggcggtgcaggccctgggcaccctggcctgcgaccctggagcggagaacgccgcacgcgccgtggccctgctggggtcgctggtggcccgccacgccgcctacgtcggcgccgagcgcctggtgcagggcatccaggccgctcccgctttccttgctaccgcggacgccgggcacggggtgagggcagggctcgggggtggatggggagcgagggcctggtttgtgcagggctggggcctgaggcccctgaacgtgccggcctgtgacagggcagagtgtgcatcttgcagagggccgaaaggcatgggcgccgaatgccagaggacaccctgcgaccatccccctccgtcctcggggcaccctgcggcaggtgcgtctcctggagaggagcggcctctttgcctcgctggctga

SEQ ID NO: 4922 - DNA, 1245 bp, Chlorella protothecoides
  modified_base (222)..(231): a, c, t, g, unknown or other
  modified_base (550)..(559): a, c, t, g, unknown or other
  modified_base (1035)..(1044): a, c, t, g, unknown or other
  modified_base (1200)..(1209): a, c, t, g, unknown or other
atggtcagctgcagaacgctggaactgacctgccccatctataacccttaccagacagcatcaatgaaggacatggcgctggagatgaagcgcatgcggggccagatggaggacaacaaggacctggcagtgctcatggcggggttgaggggcaagaacctttcccaatctgactttgcagagaacgacgtccaggtcagcctcgtgcaggcatggcggggnnnnnnnnnncagcagaagttggccatgccaggcgtgatgcaactgctggagatggtggatggcgtggatgaagagcagctgccccaggtgtactctcccgccggcatccagctgtactggggcaggaggcccgtggccgtctgcaggcgcatcacccagctcctcagtgagtttggatggtggacaaggtggtgcaggacagttggtgtgcagggaggcctgtggccgtctgcaggcgcatcacccagctactcagtgagtttggatgttggacaaggtggtgcaggacagttggtgtacagggtgaagaacccacttcgctctctcnnnnnnnnnngtttaggcaggttgaaacgcacaaggaattgtactaagaacctgcccctgctgtccacacccacaaccctgcagaacccacttcgctctctccacccctcccctttcccccaaacagccatcggcgccggcttcctattcagcttggggcgggacgcgctggccgggacgctgcgggacaatgcagtggtgcacgccatccgcctgcgcggcatcctaacctccctgggccctgcctacatcaagctgggtcaggcgctgagtatccgccccgacgtgctcccacctgccgctatggtagagatgcagaagctgtgcgacaaggtgcccagcttcgactcgggcatcgccatggccatgctctctacggagctgggccggccctggacggaggtgtatgccgagctgacgccggagccagtggcggcggcctcgttgggccaggtgcagatggggattggaagcgcagatggggannnnnnnnnnggtggcggcagcctcgctgggccaggtgcagatggggatgggaagcgcagatggggatgggaagcgccgatgggtggccgcgagagtgccctaaagggggctgaagagttgccttgggtccatttcagaagcatgacattgatattcactgcgttnnnnnnnnnngggaagcaccgatgggtggccgggagagtgcactaa

SEQ ID NO: 4923 - DNA, 690 bp, Chlorella protothecoides
atgaccgttccgagtgtggctgcacatgacgggtctgtcccacccccttccaagctgatcaagaccgggcatgcgcctgcccttctcgtcaagaaactatccgagtacgctgtgcttccgaagcgaggctcagtgggagctgcaggctacgacctggccagtgctgaggatgttgtgatcccggctcggggcaagggcgtcgccaagactgacctcagcatcgcctgtcctcctgggacgtatgcgcgcgtggccccgcgctccggcctcgcagtgaagaactttatagacaccggcgctggcgtggtggacgaggactacagaggcaatgtgggggtggtccttttcaaccacagcgacgtcgacttccatggtgggctgtgcctgctgggctggggtgccagctggcagggtgggcgatgcctgtttcgacctcaccggcatgtatactgggtctctccacatctttcatgccctgctcaatgcagtgaagcgtggcgaccgtgtggcacagctcatcctggaggtcatccagaccccggaggtggaggaggtggcagagctccccaccacagtgcgcggcgctgggggctacggatcgacgggggtcagcgtggccctctagaatgctgctacattgaggacgtggagtgcaaccttcccagggcacaacctttatcagtgctctga

SEQ ID NO: 4924 - DNA, 1278 bp, Chlorella protothecoides
atgctgggcgcgcggcgtcctggtgagatctggaatacaaactctgcacgagcagatgttcccgcatcgcctggatgtcacctttcgaagccaaaagatatgggagatttccagcatcattatgcactgaccacctcaaactggggtcgccctgccgaggatgcagacaagtatgccctctcaatgttcctcacagacctacaagtatgccctctcaatgctcctcacagacctgtggcagaatcgattcctgtcgccagcccacagccagccttgccaacagcttccagtgctgcgcctaggaacggtgcaagtgccaccctgcgccagtccttcctagacctggggcagcgcagcttccacttcgtgcaatgcccatcctgcggcctcacctactcccccggccagccagatgacgaggccctgcatcgccagcatcacgccaaggcgtgcaggccagcagtgtacagggcaggcaagggccacactacggtctggtctgacgccgatgcctccatcatacaagtcccccacgacgcttcccaagcccaggtacttcaagcttgcttggaatcgagatgggtgcatcaacaaggctgtagtggtggcatcgtgggagctgcatctgacatcaggcaacctgaccctcacagcaatgctggctcgggagatggggctggatgccgcatggcttgggcgcacccggccgcgactgtggttgtatgtcgtccaggagtccaagcacgtcctgggggcggtctgggcagagcgacggctcgtccgcctggccgctcagccttcagacgaccatcccactcaggtggcacccatcagccatggccgctccgccccgacgcaggggcactcgccgccgggccactcccatgtcggcgtgcgcgcggtgtgggtgcgcgcctcagcgcgccgcagaggcgtcgccagccgactgctggaggcggtgctgggggtcgatgccgcgctgtcctgtcgactgccgagaggcaggctggcgttcacagaccccacggccgacgggctggcctttgcgcgcgctttcctgggacaggccggtgcattcgagccgccgcggtacacagacacgggggtgcaagcggagtgagacggcgcgtgactgcagtgacgcgagggaggaccgccctgtggacggcgcaccctcaggcttcacttcatgatgtacccacgccgactgctccagcggagctggtgcaaagggacagcgctgccgaggccgcggggctgggcgggtcacggctgtag

SEQ ID NO: 4925 - DNA, 834 bp, Chlorella protothecoides
  modified_base (137)..(146): a, c, t, g, unknown or other
  modified_base (692)..(701): a, c, t, g, unknown or other
atgcgatcgaagacggacgcctctgctgatcgcactatcgagtacggcattgctcactctcacgttgggattgtgccctttgagaggcatggccagtcggctggctattggagccgtggcgggtgcggcggtgggtnnnnnnnnnngtacggcattgctcactctcacgttgggatagtgcccattgagaggcatggccagcgtacatggggccctgactcagccctcactccatccagccggctggcgattggagccgtggcgggtgcggcggtgggcggagcgctcacctttgtagtggtacgtcggcatcctgcaaggtcgtcggtgggaccaggtcagtatttccttgaggtgaagctttcctgcccatcagaattccttactggcttgaggagggtgtcccattctgcaatcttccttcacgaagcctgtggtcgcaatactcaacaggaagcactccgtcccctttacctggtcatgcctcccatccctgcctcaagcatgtattcgtgtaagcatcctccactccctcctccaccgccttccctcataggcctgcccatgtccgatggaatccgcatgtacaccaacttcattgccagcatcgacacccggctgaggaaccccaagtgggtgatagagcacctcacccgctccaaactcaagggagatggcactaggcctcctgnnnnnnnnnncacccgctccaaactcaagggagatggcaccaggtacgtgctgcgcgtggcaagatccccaggccagccaggtcacaagtctccgtcgatgaatcaccctgtgggtgcctctcaggcctcctattgcctgtga

SEQ ID NO: 4926 - DNA, 2235 bp, Chlorella protothecoides
atgcacttgacacattgtggtgggaaaattaccatgcattcactagctcctcaaaccaggcatggtgtcgctgtaagagcgcacaatgcagcacctgtgcacgtgggtcctctcgtggcacctcctcccatgggagcatatgcgccacatgcaatgagccccctggatcgacgggctgccctggtcggtctaatgggggtcggatacctcccttggatccccgtatcccctgcgagcgccgctcgctccccaccctcccagcccgtgagggcgtacttgccacctgcctcgacaccaggctttgtacagtacaccccagatgagaagaagacccccgccatccgagcggatgttgtctgccaggacaggcacgcagaggcattgacgggcgagaggttttgctggggccacacccaacctgctttctgttacactgccgtaggggctcattctcaatatcctctcgggcaacttctgcatgccccgctgcgacgagccttggtacgaagccctcttccaaaatcaggcagagggcaaagcacaggtgggaaggaggttcatgccatcgacgccaacgagggtcataattcaatttttgatgacttgttcagatactcttacaggcctcagtgtgatccaatgcagctcatcgtggctccactgttccggcttatctccaaagccggagcccaactgagcgacattgggccgccagagcgggccattgagaaggtcggcaactatgtcacaggctcgtccctggaagccgaggacgatgtgatcagcgcgacttccaagactctcccggatgggcgcacctactacatctatgaactcaatgccctgcaggccaaggacggaccccacatcctggcttccctcaccatcaaaggggaccaggcctacctctttgtggtcagcgccagcgagaagcatgagtcagagagcgaggcagcatccttggatgatgttgcccgggggaaatgctctgcttggctgtctgccttgctgagatttgaaggtggtgtctctggcatcagatgctcccctggaccgcagacagggtatgaggatcaatcaagttcatgccagggcgtgggaacaaacctgcatgctgctgagagtaggagactcagtagcatggcatccttgcgtggtgcgtcggctttcgtaacagggggtgggagcggcattggacgtgctatctgcgtcgatctcgcaaaacacggctgccatgtgacggttgccgatgtcagcgatgcgggggctcgtgccaccgccgacctggcaggccccaatgcaaccccagtgcactgcgatgtggcctcctcggcgtcccaggaggctgcattcgctgaccacatccgtcgcaacgggggcctcgacatcgccgtgctgaatgctgggatccctgagagaggtactggtccagaggaggggctctggcttgatctctggagtcttcttcatcctcacaccctgcgttctcctaaactgaccgagtccgcggcgccctcgtcaacccccccttgccgctcaattacccccccaaacccggcctccatcaggcgacctgctcagtgcacaggacgactcctggcgccccaccctggacatcgatctgggcgcggtgctggacggcatccgcctggccagccaggccatggcccccgccggcgggcggcgggaggggcggcagggcgtcctcatcaccgtggcgagcgccggcggtttcttctccatgcccttctcccccgtctacgctgcggccaaggcgggcgtggtgcacgccacgcgctccgtggccaagcctctcctcgagcgcaacatccgcatctgcgcgctctgccccgaggtgagcttcccgcagggacctggcatgctcctcggtgccagccagacgcctcaggacctgtttcttcaagctcgcacatgcaccctccagcctgtctaaagccacgctcacccaccaacaccgcccccgtcagtaacaagcctctccactccccatcaactcagtttgtggacacgccgctggtcgctgaggctcgtgcccagagcgggccccagtccccgttttacagagcaacggcgggcaccctgctcaccgcagacaaggtggcagaggcggcgcacgtgctcatcaccgaccccaatcgcgtcggccagtgcctcgtcgtccgcatgaccggggagtggatggaggcggtgcccccttctcaaacgctccagtga

SEQ ID NO: 4927 - DNA, 1587 bp, Chlorella protothecoides
  modified_base (203)..(212): a, c, t, g, unknown or other
  modified_base (784)..(793): a, c, t, g, unknown or other
  modified_base (978)..(1016): a, c, t, g, unknown or other
atgaggtcatcaaaccggaggcccatggcctggcgcgatgcacacggagtgcccgaccgattcggaggcccattgctcgtcgcagctcccctgtcgatgagcccataccccagccgcccagcccgtcgcacccgacgcgccccccttcttcacccccccctcccaatcaccacccaggtacatccctcgccccgccacctccnnnnnnnnnntgcggcccccttcttcccacccccctcccaatcatcgcccaggtacatccctcgccccgccacctccaccagccccatcgtgccggcctggcgcgagtgggccacgcagggccttgccggcggccgcaccacgcgcaccgtcatgatccggcggctgtccaacgacttccgcgccgccacacggctcgagacgcggcccgtgcccgcccccggcccaggccaggtgctgctgcgcaccgtctacgccgggatcaacgcctccgacatcaactacacgtcggggaagtaccacgcctccaccgctgcggccgaggcccagctgcccttcccctccggcttcgaggcggtgagcgtggtggcggaggtggggcccggggtcaagcacccgcgcccgggccaggccgtggccaccatggtgtcgggcagcttctcggactacaccctcgtccccgcccgcgcctgcctggacgtgccgggtccctcaccagagtacgtggccctgctcacctcgggcctcaccgccagcatcggtgcgagggggggcgggcgcggggctgcctcgttcccccgannnnnnnnnnatctactcgggtgggctgatggcaggggtgtgtggcatgtggtcaaacatcaatgcacatgggggaaggagggagacagtggcgggcgcggggctgcctcgttcccccgacgcggctggcaggcaatgggctgcgcctgcatcctcatcgcgagggagcctccccttgtttctggtcggccttcnnnnnnnnnnnnnnnnnnnnnnnnnnnnnnnnnnnnnnncagcaagcaaccacacccacctgtccgcactgctgcaggcctgcaggagtgcgggaggctgaggaagggggagaccgtgctgatcactgccgcggcggggggcgcggggcagtttgcggtgcagctggccaagctggcggggtgccacgtcatcgccacggtggggtcggaggacaaggcgcgcctgatccggtccctgggcgcgaaccgcgctgtcaactaccgcaccgaggacctgaaggcggtgctgcgcgccgagtacccgcgcggcgtggacgtggtttgggagtcggtgggcggcgagtggtttggcacctgcctcaacgcgctggcgcagaaggggcggctgatcgtgatcggggccatgagccagtacaaggggcccgacggctggaagccgatgccgcacctgggcctgccggagaaggtgctgaacaagtccaccaccgtgacaggtgggcatgtcggttggggagggaagggggaggaggatcctgatgcaaaggaccaggtaccgaggggagtgttatgcagggccacttcacaccggcaggggtgcgctgaggcctga

SEQ ID NO: 4928 - DNA, 780 bp, Chlorella protothecoides
  modified_base (606)..(615): a, c, t, g, unknown or other
atgcaggtgcgatcgatccgtatcccccaggtaggcgacaaatttgcttcgcggcacgggcagaagggcaccatcggcatcacctacacccaggaggacatgcccttcaccgcggagggcatcgtgcccgacctgatcatcaacccgcacgccatcccgtcgcgcatgaccatcggtcacttggtggaggcgctgatgagcaaggtggcggcgtgcctgggcaaggagggcgacgccacacccttcaccgccgtgaccgtggaggacatctccactctactccacggctgcggctaccagcagcgcggctgggagaccatgtacaacgggcacacggggcgcgcgctggcggcgcccatcttcctcaaccccacctactaccagcgcctgaagcacatggtggacgacaagatccacgcgcgcggtcgggggccggtccagatcctgacgcgccagcccgtggagggccgcgcgcgcgacggcggcctgcgcttcggcgagatggagcgcgactgcatcatcagccacggggcctctgccttcctgaaggtgggtggggtggggggtgggaagtcggggttgggggagtgggttgccaaagggctnnnnnnnnnncgcctctgccttcctcaaggtgggtggggtgggggttggggagttggggttgggggagtgggttgccaaagggctgcatccaacaagcaggggctgtgtcgtgcgggcattcacggtggagtcccgacagggaggcgatcgtgccagccacgcattccattttga

SEQ ID NO: 4929 - DNA, 2331 bp, Chlorella protothecoides
atgttcggcgacgatgaggacctggcggtggccgaggaccaggagattgaggaaaacgatgcgtggtacgcgatcgtgtttgacgcatgcgaggagtggtttccggccccacctctgctccccccaacaccgaccagggcggtgatcagcgcctacttcgaggagaagggcctggtgcggcagcagctggactctttcaacggcttcatcaacagcagcctgcaggagatagtggacgagaacagcctcatcacggtcacgcccaacaaccagcacaacccggggcagtcgctggaggaggaggcggagagcaccacatacgagatcaagtttggccagatttacctgtccaagcccacttttgtggaggcggacggcgagacggtggccatcttccccaaggaagcccgcctgcgcaacctgacctacgccgcgccgctgtacgtggacctggagaagcgggtgatcacgcgccgtccgggcctggacggcgagggggaggagagcgaggagcacgtgacgccttacgacaaggtgttcctgggggacgtccccatcatgctccgctccgactactgcaacctgcacggccgctctgagcgcgacctgagcgacctgggcgagtgcccctacgaccagggcggctacttcatcatcaacggctcggagaaggtgctcattgcccaggagcgcatggccaacaaccacgtgtacgtgttcaagaagagccagccgtccaagtacgccttccaggccgagtgccggtcggtttgcgagggcagcgtgcgcgcgagcagctccatgtcggtgcgcatgctgtcgcgggcgggggccaagaagggcgcggggcagtgcatccgcgccacgctgccctacatccgctccgacatcccgctgctcgtggtcttccgcgcgctgggcttcaccgcggaccgcgacatcctggagcacatcgtgtacgactttggcgacgacgcgatgctggaggcgctgcgccccagcatcgaggaggccttccccatcggcgaccaggaggtggcgctggactacatcggcaagcgcggcaccaccgtgggcgccacgcgcgagcgccgcgtggcctacgcccgcgacctgctggagaaggagttcctgccccacatctccatggagccggcctgcgagacgcgcaaggcctacttcctgggctacgtggtccatcgcctgctcctggtggccctggggcgtcgcgacgaggacgaccgcgaccactacggcaacaagcgcctggacctggggggcccgctgctggccaacctcttccgcgcgctgttcaggaagctgggcaaggacacgcgcgcgcacgtgcagcgctgcgtggaccgggggcgcgagatcaacctgaccgccgcggtgaacaaggacaccatcagccgcgggctgaagtacagcctggccacggggaactggggcgtgctgggggggcccggggagctgcgccccggcgtgtcccaggtgctgaaccgcctgacctacgccagcacgctatcgcacctgcgccgcatcaactcgcccatcgggcgcgagggcaagctggccaagccgcgccagctgcataacacgcagtggggcatgatctgccccgccgagacgcccgagggccaggcctgcgggctggtcaagaacctggcgctcatgacctacgtgtcggtcggctgcgccgcgggcccgctgctggagttcctggaggagtgcgccaccgaggcgctggaggacatcgcgcccggggtggtggctcgcgccaccaagatcctggtcaacggcgtgtgggttggcgtgcaccgtgaccccggggacctggtggcgcgcctgcgcgccatgcgccgccacgtggacattgagaccgaggtgggcgtggtgcacgacatccccctgcgcgagctgcgcctgaccaccgacgcggggcgctgctgccgcccgctcttcatcgtccaggatcggcgcctgcgcgtgcgcaagcgcgacgtggtggccctccaggcgcgcgacgagacgggcttctcctgggacagcctcattgaggcgggggccatcgagtacgcgggggccatcgagtacgtggacgtggaggaggaggagaccaccatgatggccatgagcatccatgacctgaaggccgcgcgagagggtgaggctgattggggggggagagcgtgtgattggtccggggtgcaaggaggcggagagggggggattggggctggaggatggggtggagcgtgggccgtgccgcgcgagtgcagggcctcctacctcggcgtgtccttcgctgcagaactgctgcgcgcctga

SEQ ID NO: 4930 - DNA, 411 bp, Chlorella protothecoides
atgtacgtgaccaactaccaggtcaggatggacacacaggggtatgtcctgtactatccccagaaacccctggtgaccacgcggtccatggagtacctgcacttccgggagctgccggcaggcatcaacaccatcgtggccatcgcctgctattccggctacaaccaggaagattctaccatgatgaaccagtccagcatcgaccgcggcatcttccggtccatcttcttccgatcctacaaggagttcatcgagcggcccagccgggagatcactgccggcatgcggcacggcacgtacgacaagttagacgacgatggcatcgcagctcctggcacccgtgtctcgggtgtgtggaattgggagaaggggcagggagcagggcacacttgtggcattcatcggtgctga

SEQ ID NO: 4931 - DNA, 198 bp, Chlorella protothecoides
atgcccaaatcccacatcgcctctgcagcggcagcagcagctcggctcaggaacctttttgatgccaaggacgtcgcagagctggtggacggcatccggcatggccagcgactggctgtcagtcgggcgatcaccctcgtagagtccactcggccccagcacaagcagtcggtgagggggacgatgcgatgtggctga

SEQ ID NO: 4932 - DNA, 381 bp, Chlorella protothecoides
gtggaggcgttgacgcgcgcggcacgccacctggcggtgcaggccgccgccgtgctgagggccgccgcgggcggcgagctggttttcgagggtgagccctggaacgggaccaacgtcgacctcatccgcctggcgaaagcccactccgccctcctcctccaccgcaacttcctggaggcggtggaggcggcggcgggggagctgaagcccgccacgacgcgcgcgctgcgcacgctgtgccagctccacggcgtcaccctcctggtggacgccgcgggggacttgctcgaagctgggtacatcaacagtgagtggtgttgtgtgggtgggaaggggcggggatggagcgggttcccaagtctggtgctggaggaggggtga

SEQ ID NO: 4933 - DNA, 489 bp, Chlorella protothecoides
atgcaccaatcaggtagtcccaccaccatttctccactggcacagacggaggagagctacatctcggctgctgagctggggcgcttgtcaggcatgcgggccgagatcgtgctggggacagagctgaccctgcttcagggcctgaagttcgacctgattgtcttctcgcccttcaacgccatagagggcttcatgcaggtgatggtcggggagcctgaggaaagcgtcattcaagaaagggcacagattccaggtgctgtggagcctgcccttcttggcttgcaagaaagcacggccgacagggcacgacgtgctgccctcgcagctgccgacgcgctgatgctgacggatgccccactcctcttcacgccaggccagctggccctggcggctctgcggtccggctttcacaaggttgtttgtgatggggcacatgatcatgctgtgggccagctggatgcgggagtatggaacagtatctggccatga

SEQ ID NO: 4934 - DNA, 606 bp, Chlorella protothecoides
atgcgggaggatctcccacaggtagtggtccctcggacatttcccgagtacacatcgcggcgagtgcttaccacctcgtggctggagggcgagaagctgagtcagagcagagagagcgatgtggggagcctcgtgaacctgggcgtcatctgctacctcaagcagctccttgagacaggcttcttccacgccgacccgcaccctggaaacctcatacggaccccagatggcaggctggccattctggactttgggttgatgacccaggtggacgaggacattcgtgtggggatgattgaggcagtcagccacctcatccacagggactacgaggccattgttcaggactttgtgacccttgggttcattccaccggggaccaacctttcccccatcctgcctgttttgagcaaaggtctgtctgctgatctggcacaaattacctttgactaccccttccgcattccaccatactttgcactcatcatccgagcaatcggtgagcagaagatgtcttttattcttgtgcacaaatgtcggattccattcggagggtggcgagctccagggatgcatctgaccttggtgctcctgggagagggatag

SEQ ID NO: 4935 - DNA, 270 bp, Chlorella protothecoides
atgccctggcaggctgctctcggtgctggcgccccagtgctggcgccccaggtcagccccgaggacgagcaaatcatgcagagcatgtcgcgggtcgtggcctacctgtctggccgcgatgcggggccgggctcgctggacctggacctgctgcgtgggctggagccgcagctggcggccgtcgcgtcccgcatggcccctgacctcggccagcgcctgctcagccgcgtggcggcccgcgcgctgcggcggggggccggctacgactga

SEQ ID NO: 4936 - DNA, 804 bp, Chlorella protothecoides
atgccccggcacgccagggcgggcggagaggagatcgacgaagcgggggagggcccctccccacgcctgttctccatcgatgtgcagatccggacggctgccatgcagcacctggcagagtacggcgtggctgtggactgctggcagggtgcggaggtggcgcaggccccgcccagcgcggagcccgctcagcccgtcgccgacctggcaagccggctctggccgctgtggggctggctgggctgggctggcgctcccgccggcgagcgccagggggcggctggcggtgcttcgggcaacggcagccgagctgggagtggagtcccggcgacaaacggcagccaagccacgaacggcagtccagcaacgaatggcagccgaccgtcggtcagcggcgctgcaaatggcaggcaggttacgacggcggcgcgtgtcgccccctggaacggctcttcgggatccgatgcaggggccctcgcctggaacggcggctccgaggccgaaggcggcggcctcatgctgcaggctcggctggatgcgggggccatgtcgcgccgcatcaactggctcaactccatacgccagtggcaggaggagttcctgggcaccctgacagggacaccgcgtcgactgcctcgcagcatcgtgttgtggagagtgatgtctgcagcagcccctgttggaagtccatccggttctcgactgctcagggccatggagtttgtgcagtgcgtgaccgatgatctgctggggcgtggcgtctttgtcttcacgccttcgggccagatcaagcgcatgccccgg

SEQ ID NO: 4937 - DNA, 1266 bp, Chlorella protothecoides
atggccttggggttccatgctgccagcccagactgtgctcaagactgcccggctttgttactggcgacgcgagctttgctcttcatggatcatgccagccgcccaggcctgctgcacgatacagtggaggactgcggggacgtggtggggctggacgagatcgggtttcacttcggcccgggggtgcggcgcattgtagagggcgagaccaagttcagcaagctgccgacgcggcccgcggaggcaggggagggcgggctgggcgccgcggccgcgctgcgcccgccggggtcgagcgggggcgattcccgtgcagaggacatgcgcttcctcttcctggccatgacggaggaggtgcgcatcatcatcgtgaagctggccgaccgcctgcacaacatgcgcaccatgcggagcatgcccgggcccaagcagacgcgcatcgcgcgcgagacgctgcaggttggaaagcaaggaggagggggggaggttgaggctggggtttggaatggtgcagatggtgtttgccccgctggcccgcctgctgggcctgtatgcggtgaaggaggagctggaggacctggccttccgctacgcctggccggagcgccacctcttcacccagcgcctggtggcgcggctgtggcgcgagcaggccgccacgctggaggccgcgcgcgacgagctggcctccgcgctggccgccgacccgctgatccgcggcgcagggctgggcgtggatgcgcgcgcgcgctgccgctcgctctactccatctggcgcaagatggaggcggaggagcaaagcgtgcacggcgtgaacgacgtctgccagctggtcgtggtgctgagccctggcccgggtcgcgaggatgcggacagagggtgaggggggaaggggttcggggagtgttggggtatgtgggggggaacagagattgtttgggggccgggatccccagagagaagggcagactgggatcctgcatgcatgcagggacctgggtgggaaatgtaagatccctgacttcattggtggaggaggatggagtgggggtgggggggcgtcaggttgctgggccgacccggcctagaatcccacatcaagcgttcctggggacccattctgtctcggtctcctccatactccatcagctcatgtaccctctccacactcacccacccatgcagtaccagcgacagcctgatgtgctaccataccctgggcctggtgcacagcatgtggatccccatccccggcacgtttcgtga

SEQ ID NO: 4938 - DNA, 1149 bp, Chlorella protothecoides
atgcctcagagggtggtcggtgcctgcaggccggggtgtgtttgtgcaggtcttgacaaacgcctgcctgctgccttatgtctcattcccgaccttactcagaccatgtcccggatcgagagcgtgctgccattcgatgcctccacgctcaacatgagctgcttgcagcagaggccaggacaaagtaatcattggggttccgttcctcctgggtgctgttcagcgagcacaagatggtattgggcgaagaaacgatcagccatccctccagcacctccctcgtcatgcccttccctccccctggattttctggtatctacacagggtgggccacgctctggaggtcctgcaggcctgtgcccggcaggtcctgcaggagatggagaccgagggcacagccctgggcctggaggtggtcgtggaggtgaggccacacccctattgggattccagggcagggagtccgtcgcggtcccttgcttcgcagtgcattcccaagcaggagaaggctggccgagtgaagagcctgtattctacttacaagaagatggtgcggaagggggtccccctcgagcaggtactggacgcccgggcactgcgcctcatcgtggacgacatggagggcagggaccggcgccaggcttggtggcatgcctgcagtggccctcatcctcgagggcaagcctcccatcctggccgcctgagtccactcagcgcccagacccttgtccctccccttccccaaaccacacacacacacaccctggccgcagccgtgaggacgaggccatcgcagtgtgctaccgtctacaggcgctcgtacaccggctgtggaagcgggtgccgggggaggatgacgactacatctctcagcccaaggtggggacagagggaaggggaggggaggggcggctggattccatgcctgtcggggcgcagcaggggaggggcgccgagggggtggtttgccagggccccccccgcccggcggcctgttgcgagggcatcaccttcccccttctcaaccccaacaaaccctcagccgtcggggtaccagtccctccacacggcggtgcggggtccggagggcgtggccatggaggtccagatccggacctccaccatgcacggccaggcagagtacggtga

SEQ ID NO: 4939 - DNA, 1002 bp, Chlorella protothecoides
atgggtctgttgctgtactcccaactcctttcccccctgcatagtccagctgatccctttcttttgctccatcaacagacaaatgctagcaagacagccaaagcagcaaagcctcgcatcaagaaggctgctgccactgtggctgacgaagtgaagcctgccgccgcagaggccaaggaggcagtgacggatgtggccaagaccgcgcagaaaaagggcaagcctgccattgacaaggctttgaagagtgctaaacctgctgcggaaaaggctgtgaagaaggccaagcctgctgtcaacaaggccatcaagaaggccaagcctgctgtcaacaaggccatcaaggacgccaagcctattgtggacgcagcggtcaagaaggccaagcctgttgtcaacaaggttgttgaggaggccaagccagttgttgacgcagctgtcaagaaggccaagcctgtagtgatcaaagctgcgaagacgacgggaaatgcggtagcaggcgcagcgaagtctgcggcccagcaggctggggcagccggcgagaagctgaagacggcagctgcgaggaagatcaagcctgccgtggatgcggcggccaagacgtctgcacccaaggccctgtctgcaaagaaggctggagtgaagaaggccaagccggctgcacccaagaaggctatccagcaacacaacagggggactagacaaagtagggagcggggtgggcaacgtcgcgtatcgcctcccactgctcggacgtcagctggtcccgcacctcgctcaggccagcctcctgtgatgcggtgtgtgtgtgtggttgagcacacgaggcggcgagaatggaagcaggggcaccaaaggcccaggcgccgtccaatgcacgtggtcatgccccccatgcgcccccctctcacacacatcatcccggcgcacctcatgcgtcctgcggaactcggcgagcgtcttcgtcaccgtcaccctgttggtgcaccgaatgggggatga

SEQ ID NO: 4940 - DNA, 447 bp, Chlorella protothecoides
atggagcgcggcgcccccgccgcgctgttcgcgtgcctggccggcaaccacgccaacctgacgggggcgggggatggggatggcaccggctccggcccggggcccatgctgggcagcaccgatgagattgtggccaagctggcggtctcctctgtgctccgcttctccgtctggccatgcggccgtgaggccgtggctgccgtccaggacggcaccttcaagccggagcacgccgcactggtgcaggccctggcgctcaccgctccggcggttctggggccgggccttcgcgccgcggtgctggaggccctggcgcgaccgcaggacgtcgaccggccggccaccgccgcggcgggggagtgcctggcggggctggtggcttcgggcgtccccttcgaggacggtgagggggaaggggaggttggggagggttgtgggggaaaatag

SEQ ID NO: 4941 - DNA, 495 bp, Chlorella protothecoides
atgcagcatgccaagcactccgtcaacgtcatcctcggctccatggcgacgctgatcacggccgcagccgctgccggggtgggtggcacgatcgccctcaactccaagccacgaatgctggctgagaggcgggaggagaggagaggcggaggacatgttaagttcccagagctactgtatggagtggatgtcagcgacagccggctgctcaacagacccaggttccaagcagctgcagagcttgcggcagaagcccatgccggacaggtggatgtgcaccctgcgtatgggttcggccgctggcatcggtgctggatgggaatgtcactcactgtggtgctggatgtgggggtcggctggaagatgagctcccctgttttgctgcaacgatcgccgcaggtgcgcaagactcgagaaccctacatcacccactgcatcgagacggcccgcatcatggaggcattgctctgcccctccgagccagatgccaggtga

SEQ ID NO: 4942 - DNA, 1077 bp, Chlorella protothecoides
ggcgcgggtgccggcgctggtgcggcggccgccggcccagaggcgctgggcacccacccgctgctgaacgcagcagggaacgcggtgttcttcggcggcgtggccgccgcctccttcttcggctactactactggcgctatgaggtggacgagctggaggcgctggtggagtccacctcccgccccgagaacgccttccccggctccggcgcctgggcggcagtcatgggctggtatgtggagcggcggcgcgcgctggagggggaggtgaagaagtacgccgacccgcccagcgacaagctgctgcccgacctgccccccgccgcgcggcacatcaagaccctggtcctggacctggaccacctgctggtacactcccactggacgcgggagcggggctggcgctgctacaagcgccccggggccgaggagttcatcgccggcatggcgcagtactacgagctggtggtgtacaccgacaagctgtgcacctacgtggaccccatcctggacaggctggacccgcagcgtctcatccagtaccgcctgtaccgcgactccaaccagtgggagaacaacgagcacgtgcgcgacctgaccaagctcaaccgcgacctggcccaggtcctcttcctcacagccgaccctgaggcgcgcttcaaccccccggagaacggcatccggtgcaccgtgccctggcagcctgtcaaccatgtacgctgcacgtccatacccacccgcctgccctcacccaacccaccctcccacaaaaccccagctgaagccgtggaggaaggagccgggggacacgggactggtggacatgctgcccttcctggaggcggtggtggccacccatgtgcccgacgtgcgtcgcaccgtggccgcctatgccgaggaggaggacatcccccaggccttcaaggcgcgcatggcagccgtgacagagcagcgcgcgcagcggcagggggtgggccgcggcctgctctctggcctggccggcggcaggtgagggcctgcccgggccggcgcacgcagaggcattgtaggacggcagccgccgagggctgccgctga

SEQ ID NO: 4943 - DNA, 717 bp, Chlorella protothecoides
  modified_base (115)..(159): a, c, t, g, unknown or other
atgaatcgtgtctgcaactcccttcccctcgcaaataatacactggcatctccaaagcggtcggcgcccccaaccgcgcccaacccccaccctcaacccgcccaccacccaccannnnnnnnnnnnnnnnnnnnnnnnnnnnnnnnnnnnnnnnnnnnnggcaagcccgtgccccacgtctactgcatcggggatgccaacggtaagtacatgctggcccacgccgcctcggcccagggcatcagcgcggtggagaacatcgtggggcggccccatgtgctcaaccaccgctcggtccccgccgcctgcttcacccaccccgaggtggcgttcgtgggcctgacggaggaagcggcgcgtgaggaggcggccgccggcggctgggccgaggccgtggccgtggccaagacctactttaagggtaactccaaggcgctggcggagggcgagtcggacggcctgggcaagctgatctaccgccgggacacgggcgagatcctgggggtgcacctgtacggcctgcacgccgccgacctcatccacgagttctccaacgcgctggcccagcgccagagcgtgcaggacctctacttcaacgtccacgcccaccccaccgtctcagaggtgggtgttgtggggtgttattactcgggaaggggggttgggggtgagaaggggatgaggtgtgttgggtgggcggaggaaaggggtcattga

SEQ ID NO: 4944 - DNA, 1992 bp, Chlorella protothecoides
  modified_base (35)..(44): a, c, t, g, unknown or other
  modified_base (437)..(446): a, c, t, g, unknown or other
  modified_base (1047)..(1056): a, c, t, g, unknown or other
  modified_base (1278)..(1287): a, c, t, g, unknown or other
  modified_base (1827)..(1836): a, c, t, g, unknown or other
atgtgccttctgtgcaatcgcaccgcgtctcccannnnnnnnnncagcagtggtgcctcgggtttgcacctcgtgggacgcgggttggtgcatgcccagtgtttccatggtagtgcttgtctttgcctggctacacttgttgcattgcactcgtcacatgcgccttctgtgcaatcgcaccgcgtctcccaaccccttcctcccaaccccaaggtcttcatcattggggaggaggtcggtgagtaccagggcgcctacaagatcacgcgcggcctgctccagaagtatggcgccaagcgtgtcaaggacacccccatcacagaggcaagctcctggtgggagggatggcttgggtgcttgagatgtggtggggatgcctggaagtcatccatgtcgttgacatacaatggccggcttcactggcattgcggtgggcnnnnnnnnnntttcatgtcgttgacatacaatggtatgccaactttccatgcaatcaagcgtagcgctgtattccctcctaggcagaaccaacccttgaaagcatttccactccccccatctgactcccctcttcccctccccctcccactccaggccggcttcactggcattgcggtgggctccgccttccagggtctgaagcccgtggtggagttcatgaccttcaacttctccatgcaggccattgaccagatcgtcaactccgcggccaagcatcactacatgtcggcagggcagatcacctgcccaatcgtcttccgcggccccaacggccccgccgccggtgtggcggcgcagcactcccaggactttgcgccatggtacgcctcggtccccggactgaaggttatcgtgccctacgatgccgaggacaaccggggcctgctcaaggccgccattcgcgaccccgacccggtggtcttcctggagaatgagatcatgtatggcgagagctttgaggtgtcggaggaggtgctggacaaggattttgtgctgcccatcggcaaggccaagcttctggcgatagtgggtgactggatgctgctgatnnnnnnnnnncctggacaaggattttgtgctgcccattggcaaggccaagggattctgaggggagatgccagccgcagatgcccggcccatgcaaagggggagattgaggttctgattgcacggcattacgtgggcctcatgcatctgcagtgtcccacccatccttcaaccccagtccccaaaccccaaaccccaaaccccgcgcccacagatccagagggaaggcaccgnnnnnnnnnnatgaggggagatgccagccgcagatgccctgcccatgcaaagggcgcgattgagattctgattgcacggcattacatgggcctcatgcatctgcagtccgctggatcgcgagacgattgcggcgagcgtgaagaaaacccaccggctgctcaccgtggaggagggctggccgcagcacggcctgggctccgagatcattgcggtggtggtggaggaggccttcgacgacctggacgcaccgccggagagggtgtgcggcgtggagatccccatgccatacgccacgccgctggaggacgccgcgctgccgcacgtctccgacatcgtgcgcgtcgcgcgccgcatgttcaacctggagtgaccaagactccggatggcagcggcggtggtgggaaggcggcggctgctgctgctgctgcaatgttggggggggaggggaccatccaccctgagattcaaggcatggcccccccatcaccctgtgtccgtgtgaacccagtgacattggcgagagtgatgggaggttgttggtgtgacgcnnnnnnnnnnggcagcggtggtgggaaggcggctgctgctgctgccgctgcaatgttgggggaggggaccatccaccctgagattcaaggcatggccctccatcaccctgtgtccgtgtgtgaacccagtgacgttgaggagagtgatgggaggttgttggtgtga

SEQ ID NO: 4945 - DNA, 1062 bp, Chlorella protothecoides
atgccctgtgcgtgcgtggcggatggggtgtgcgacaaggcgcctgcactgactcaatggtataaatatgttcaacaaatcaaccttcgccgcagtctgaatcaactccccatttcgccaagaccatccctgttcaggcaccgcgctcgacacacgatccaggacttcgtgctgagctacctgccctaccatgggctgagtctcgtcgacttcctgaagtggtgggatgtcctggtgtgggtggagggcaccatctacgccatggacgaggggaatgaggagctgacggctgacatgctgggcagtgagccgggaaacggcggcgtggtgcaggtggacccatcacatcaagtgctacgtgaaaccttggactcctcccagtctgcttctccagttgagcgcagctcctcctctttcctcggtatgactgcaggctttgccaccatcgggagtgtgctggaggggctggggttgtactcagcccatgtggccgacgagttgaaaaaggtcaatgccaaggagcgcaatgtagctgacaggaccctgccttgttctgtgggcaccatcgcatgctttgccaccattaggggtgtgctggaggggctggggctgtactcagcccatgtggccgacgagttgaaaaaggtctcctcctcgtcaccagtgctgggcccagctcgctgccccatcccccacaccccaccattcccttctggaccctcacagggcttggagtactgggagggcgagcgtcggctctgcgccgcgatggccgcgcagccctgcatccccaaaggaggatcagctatgctttccaccggccagctgcatgccgtctccgcaaagaagagctttgactaccgagtgctccaccacctgctctgcgggctgtgtggcattgagcgcaacaatgtggcccccctcttcgagttccttgcgctggacgagtggttggtggacataggggacgaccttgtggattacgaggatgatgttctgaggtcagtgggtgggagtattttaggagcatggaccggagtcagtcacttggtgtccttgtag

SEQ ID NO: 4946 - DNA, 1431 bp, Chlorella protothecoides
  modified_base (550)..(559): a, c, t, g, unknown or other
atgcacagattacaaggtagagtcgcattgcaaattgcgattgttactggaacatccattatccgagaggctgatatcactcccctaggcccccgcccttgcccgtgttggaccccttgccatcaggatggcgaccaaaggccgagggctgagggagcaggtgaagccggcgacctcgctggggtggggaggggtggcaggggctgggcggccggtcgtgcatgccaccggtccgttctccgatcgtcctctttttcctcatcccaggatctcagcacattggatgtgaccaagctaacccccctgtcccccgaggtcatttcccggcaagccaccatcaacatcggtgagggggaggggttgatacaggagacacattacaaggcccagggcccagctggcaaggcagtcccctgcatgctgtccagccagccaagcaccctttctccagcagccatcaccatctcatccccctctctccaccacctcacttcacccgcaaatccaccaggcaccatcggtcacgtggcgcacggcaagtccacggtgnnnnnnnnnncggcagtcccctgcatgctgtccatccagccaagcaccctttccccatcagccatcaccatctcatccccctctacccaccacctcacctcacccccaaatccaccaggcaccattggtcacgtggcgcacggcaagtccacggtggtcaaggccatctccggcgtgcagacggtgcgcttcaagaacgagctggagcgcaacatcaccatcaagctggggtatgccaacgccaagatctacgcctgcagcgacccggcgtgcccccgccccgccacctaccgcgcctacggctccggcaaggaggacgcgccgccctgcgaggtccccggcttcgagggcgttcccatgcagctcctgcgccacgtctccttcgtcgactgccccgggcacgacatcctcatggccaccatgctcaacggcgcggcggtgatggacggcgcgctgctcctggtggcggccaacgagccctgcccccagccccagaccagcgagcacctggccgcggtggagatcatgcgcctgcgccacatcctcatcctgcagaacaaggtggacctggtgacggagagcgcggcggtgaaccaggcggaggccatcgctcgctttgtgcagggcaccatcgcggaacctgcgcccgtggtccccgtctccgcccagctcaagtacaacgtggacgccgtctgcgagtatctggtgaagaagatcccggtccccgtcagggactttgtgtccccgccgcaggcgagctggaggtttgaggggtttgcggggggattctttggggcggggagcttgctggaggagatgaatagaagaagtgtgaaggggggaagatgggaggtatcgggaggagggcaggcgccacggtga

SEQ ID NO: 4947 - DNA, 447 bp, Chlorella protothecoides
atgatcgtcatccgatcctttgacgtgaacaagcccgggtcggaggtggacgagctcaagggtggcgtggcggggggcagtatcctgcaggttggtgtgtgtggagagggggggggctcagacaaccttgtgagtgcattgtgtgggtgtgggtggatggatggtggatggtccgtgggtcgattgccatgtgggtgcggaccggttctcaatggaggcgtttttcctgggaaagctccaggcagcggggcctttcacgtcctgcaatgctgcgccttcttaccgccgaccctcagattgtcctcctctttcccgctttttgtattgctccgctcctccctccttgctcctccttccctcctcccgcctccctttcatgttcccggacccctgcggcgaacgcacggggcgcctgacaaaaagcagagaccgcagataatggcatga

SEQ ID NO: 4948 - DNA, 423 bp, Chlorella protothecoides
atgaaggccctggctgcggccctgactcgcctggaaaggaaggaggtgtccctggcacaggcagccgccgcggggcagggcgcggacgccacgcggaagaaggccgacctcctcatggcacacgctcacctgtggtcgccgggggccacgtcgctggaggtggaggactgggatcagccggggacgacggtgacgctgcccctggacgccaaggagagcgccgtggaagccgcggagaagctgtatgcccgggcgcgcaaggtgcagcggggggcggccacggtgcagcctttgctcgaggccgcgcgctcccagatccagcagctgcgggagacgcgggtgctgctggaacagctggaggtgcctgcagatgccggggtgctcaaggaggtgcaggtgcgggtggggacctgcaggatttga

SEQ ID NO: 4949 - DNA, 303 bp, Chlorella protothecoides
atgcacgcgcgcggggcccccggcgcgcacctcctcctgcgcctgaaccggggtcagtcgccgccgaatgaggacctgggtttctgcgccgacctggcagcctggttcagcagcgcgcgggggagcaccgccgtggacgtgaccgtcgcgtgggcccgggacgtgagcaagccgcggggtgcggccaaggggcgggtgacggtgaagaaggagatggcggtgctgcagggtcggcccgaccgggaggagcgctgggcggccgcggccgaggaacgcgcggcggggcaccacgctgatgggtga

SEQ ID NO: 4950 - DNA, 1116 bp, Chlorella protothecoides
atggccatgctggcccgtgccacgcgcatcctgccccatggcttcacgagcttgagggagtggcacggctcccgcttggcctgcagggcggccccccaccccccagccccccctgcccctgccaccgactacaccctcctctccgcttgcgtgagggctctggaggctggatggaccccctcccgggtggacaccgtggtccaggtcagcggcacctccctggccctggccctgcgcaccgcggaggcccacacctggctccacctcagctggcacccgcggcacggccacctggggctgggcccgccgcccccgcgccgtggggaccccctcctggactcccacgctctgggcgccgtgttgaaggcgcagctggcgggcctggtgctgacgcgcgcggcgctggtgctggcctgggagaggctggtgcggctggacctggaggcgccgcaggggggctccgactcgcgccgacgcatctacctggagctgacgggccggcacgccaacctggcggtgactgattcagacgacgtcatcctggcggccgggcaccaggtgcgctgtggggcccatggcacgggagcgtggcatggcctggctggaggggcagtcgggcctgcgcagtcggcagcacggcccctccaggtgggggcgcgctacttgccgccccccgccgctcgcggcctggaccccgagcagtgccccggcctggcagagtggcaggccgcggtgcaggggacgctggacgtgcagcaggccccctgctcctgcgcggcggcgctggccaagaccttccggggcgtgggctccggcgtcgccggcgaggtctgggaggccgctggggaggtcgggccccagggcccgtcccgggatcagtgggccgccgcccacgccgcctggctccgctgggtctcagccgtgcgcgtgggggagctgcggggcgcccagcttcccgacggctcctggcgctggctgggggccggcgcagatgtgcagcacaccggatcggagggcacctgcgacgtgctgcacgctgtgcacgctgcgcagaccactcagctggaggaggcggccttcgagaaggtggggcagtgggatggcgggcttggctga

SEQ ID NO: 4951 - DNA, 627 bp, Chlorella protothecoides
atgtgcaagagggcgaccatcggcatcgcacccagcgtctatgtgcagaacaagacggatgcagggctgcaggaagcgctggtaaaccttctgaccaagcacgggctctccaaatcctcagagcgcaaagcaccactgaaatcctcggtctgcatcccctgcaatccaggcagcgatgctgtggaggctgtggcccggcgcctggctaaggagagggacctggatggcatcgacacctccaacatcgtgtcgggtggcaggcgccggcaaccggtgcaggcccctaggacctacaagtgcgttgttgcctcagcacttgattggaaggcatggtcgctggcactgctggggctcgaggtttgcaattatccaggagcacgcctgttccccctccagcgtccgctgctatgcagggcggcctctgacagcgaggacagctcgagctccgaggaggaccctgagtctgacagcgatggtgtgcaggggctgccttctgctatgcatttgagcatggatacgtggtgtggctgcaacactgggccagcggtgacacaggggaaacctgcaaataagacacacctgcgcatcagtcccaagccagggcaggattttgggaccccaacctga

SEQ ID NO: 4952 - DNA, 1737 bp, Chlorella protothecoides
  modified_base (417)..(426): a, c, t, g, unknown or other
atggccccacgttctgatggccgttttctgagcagtgggtatgaagctcagtccgcgacagagccactgccaggggataaccgtgacctctcagcagacgcgcagagcgcagatgaccgtcacatagttgagtggatgaactgtcgaaagtctgcattgcatcctctagcgagacatcatgcattgggggtgcggcatatcatgccagtgtggacttctcgcatgacatctcacatcaggatccttaaacgagcagcaggagcgatgaccagaaatgggcaagtgtggacgtctcgcatgatatctcacatcaggatccttcaacgagcagcaggagagagaaccagaactgggcaaggttttggcacgcaagatcctaaatacacgccgtgtcagcaaggggaagctgtgcggtcnnnnnnnnnntgttacactgctgcatcgactgcttgcaacgttttcatgtttcaggggaaactgtgcggtgcagcacatcacagtttggtccacgtgcatgattccttacgaaaggcatggaagggcggaaatgtggcatcccaaggccaacttccgccatccttggggacattcgacaccgggacattcgacaccgtaaacaccatgacaatgtcttgcaccatgcacacaacgcagtcgctatgtagccggccctccctgcgcccatggcagcctgccgtccattcatgcaagcggatgcagggcccgtcacgcctggccccagcccgacatgccaggcatctcgcacgggccatcacacaggacgaacccactgatccctcggaggctgcctcctcggcgccatcgcgcctgccgctgggagcctggggctccacggccctcatgctggccatggccccgccctcctcagcccaggagatgatctccggctcaccccccgccagcagctactacgtgagcctgggcctcttcgtgatcaccatccccgggctgtggtccctcataaagagggccccccgcgccacagtgaagcgaaaggtggacggcccggcggtagagggtgccatggccccaggggcgcgggcccgccagatcctggagtacttcatgcgctacaactacgaggtcaaggacatgggcgaggtcatcacctttgagggcaattaccgtgccagtgcagcttgcactctggctgcgcccgataaagcgatctgtggtctacgagacgccgtgtggagcctccatgagcactgccagcttgcactctggctgcgcccagtaaagcgatctgtgctctacaaggcgctgtgtggtccgcagagctatggcttacgtgtatttgaaacagtcattctgtgctgcatgcgcctgaaaccatgcgaccctgtcgacctcatcaggccaggctgcgtcgctggtggcctacacatccattggcctggccagcacctccctggtgctctccatcgccgcgccctggggaggcagctggtggtatgcgctggtcctggccagcccggctgcgggatggtactactggaagaatgctttcaggtgcttgaaaggaggaaaggtggcaaggaaaatcctgttcggttggacctgacggagcagatgcgggtgaagatggtgacggccgatgaccagtccaccaccgacatcgtggtggagggggaccaggaggagatcgagcgcttttacaaggaactgggcctgacggagaagggcaagatctatgtcaagggcgtgctggagtga

SEQ ID NO: 4953 - DNA, 627 bp, Chlorella protothecoides
atgcgtgactccatgatcgacctggccaagcgcatgacagagatcaaggaggtcctggacgcacacactgcgacggatgccgtctccgacgcggagcggctgctggaggagctgctggacatcgtggagtccatcgacgcggcccgcgacctggccaccatcggcggcctgcccacgctgactcagctgctggccagccccgcgccggggctgcgctggcgcgcggcggaggtggcggctgcctgcgtccagaataaccccgaggtgcaggccagcttcctggcggcgcccgggctgactgagcggctggtggctctgctggccgacgccgacgccgactgccggaccaaggccctgctggcgctggccagcctggtccgcggccacgagccggctatgcgctggtggctggaaagcgcggccggcacgcagacgctggtgcgcatgctgcgcaacgaccccgacgcgcgcgtgcggcgcaaggcggctcagctcctgggttattgcctgggcgtggacgccgcgcaggcgccgcttgcggcgagcgagggcctgctgggcgcgttgtgccgcgcgctgagcgacgaggcggacgcggcgacgcgcgaggcggcggccgacctgggc

SEQ ID NO: 4954 - DNA, 798 bp, Chlorella protothecoides
  modified_base (59)..(68): a, c, t, g, unknown or other
  modified_base (519)..(528): a, c, t, g, unknown or other
atggggaccctgcagcgattgccgggcattgtcgggcagggtgaggggcatcagtcttnnnnnnnnnngcaggaagtggacctggccgtcatcgccgacatgggaaccctgcagcgattgccgggcatcgtcgggcagggtgaggggcatcagtctgaggaaggccagagccttgcaggaagctcccgccgggcgcgtgagctggcgctgaccgctcgccagatcagcgggctggaggccgaaggcatgggcctcgtcagcgctacgctggcagacccagcagcgctgagtcagcacgggctggctgtcgctcgcagcatcgccgccaagccgcccgtggcagtcgccggcaccaagcacgtgctcctgtaccagcgcacggctcaagtgagaaaagctttactggtgtgggccgcttatgaggtattgcgctcttttggctcctcggatacactcggacccctcttcccccttcctgacacagagatcacagcgtggcagacgggctggactatgtgnnnnnnnnnnatcattgccaggggcatgtccactgctttgggacagcacggctcaagtgagaaagctttactagtgtgggccacttatgaggtattgcgctctttaggctcctcggatacactcgaccccctcttcccccctcctgacagagatcacagcgtggcagatgggctggactatgtatcggcatggaatgccagcatgctcaactcctccgactttgtcgaggtgttctctgccgccaaggagaagcggaaaccagtgttcagcaagctttaa

SEQ ID NO: 4955 - DNA, 870 bp, Chlorella protothecoides
atgcaggcgcctcgcgtgccatggcgagggtcggtgggcctgccatcccccatccggcccctctccttcccgaggcagcgtcgctgtcatgcgccccgccgcgccgagcccagcaagcccgcggatgtcttgctgaagctgcgtgagtcggtgcagtccaggctgacagtgtcggagctgagcgagcccgggtacgaggggctggaccccctccccgagttcaaccccccggcagccgtgggaggggccacgtacgaggtcatgcgcctggacccggctgaggggccgcgccgcctgtgcgtgaggcggcgggacctgctcagggcacaccgcctggccccccgcgacctgcgccagctggaccacgactccagcgccagcagggcgccgccgcgcgtggtgctcaaggacggctgcgtgctcatgaacctgggaggggtgaggggtgggctcgctgctgggcgggaggagcgccaggagtgccgagtgttcagaatcccgccaaaggcgccgggcgcgttcagggtcgtccaagctgctgcgcatggtggtaaggcccttggcatgaagcgtgcctcatggcgccgccaaccccaaccccggaaaccactcctttccacgcatacacgcagggccatcatcgaggcggacaggtgcctggtgttcgaccccgacacgccgcccgccacccacttcctggacatgacgctgccgaagctggagggcacgcgggtgggcctggcctctgcagcaggcaggggcgaggccaagggcggggccgccggcttcgagtccgaccaggcatccctgccctttgagctggagatcctggagggcggtctggccattgccacaggtgaggtggcgtga

SEQ ID NO: 4956 - DNA, 354 bp, Chlorella protothecoides
atggtggggtttggggtcgctgaggcgacgggcgtcctgctgcggaggcgtgcgggacaccatgaacccccagaagtgggggtgccaacgatgcgcgggcgcatcatgcaggaggaggaggagcgagagctggaggaggtggaggacctgctggagtactaccggcagagggctgcgatgacgcaggtggggggactccttcgagggcctcggctgagcattaggtctgaggcagagcggctgctggaaggcgcccgggacctggaggagtccataggggtgtccctctcggcccggcgattcgaggtggggaggcttgggctggtggggaaggacggaggagcgccgggctga

SEQ ID NO: 4957 - DNA, 735 bp, Chlorella protothecoides
atggccggagccgggctgggtgaggtcctgcccgaggttctgcagcagcaggcccgcattgacgatccccacgccgcccagaggaaggctttccaccggcgcgtaaagggctccctgccgccgctgacgccggaggagcgctaccgcttccgcatggctggagcggggccggagtgtgatccacagcctcacatcctgcgctcgccatccccatcgcccttgccaggcgcgggcctgggccacatcccgcgtctgagcctgggccgagacaggttcaacatcccccagggctccggcgcggggcaggcggaggcgcccggctctggcgcggggcaggcggcggcgcccgctcgggcgctgtcgcccgaggcggtggaggtggcgcggaggacctacgtggcgggcctacgggccctggtctacggcacgctgctgggcttcggcgcgctggcgctggcggggacctacgtggcccaggccatggagctgggccagccgggtgcggacgcagggcgcagcgtgcgcagcgcgctggagccgacgacgcggcggctgcgggacggcgcggcgcgcctgcgcgccgcgctgggcggctgggcggcgcgggagtcgggggagtgggagccgcggtccgagtttcagcagcgaatgatggctcggtataatccaggaagcctgggcgggcggggcgacggcgagttccgcgccccggggcgggagtggagggagccgtga

SEQ ID NO: 4958 - DNA, 1278 bp, Chlorella protothecoides
atgctgagggctgccacgcacagtccccaccctgccaaggcctgggagatgctctcccagtgcctgacggccgtggacgaccacatcgcggccctggacgccgcgacctcggccgtggcggcggaccccggttggcacgttaccctccgcaccctgggccggtgccggctgaacctgggcgacctggagggggcagccgccgcgctttccgcggcatgtcggggcgccgggcccagcagcgacgaggagagcagggccgacctggagcacgtgggccgcctgctgcagcgcagagtgggccacgccatcggcatcccaggcctcgtgctcgcgaatacagctggggaagggccgtccggcctcgtctgggacgcggggcgggtgctggccgcctggctcgtgcaggcctacgccccttgggtagaaagcggcggcgctgtgggggcgggttgcgggccggggggctgccgcctcgacgagatcctgcactgctgcaggcgagagaagcagggcacgctcagacctggatgtggagtcggctgcgatgcgtccttgtgcggcgatccgtctgcctcaggccatacgcaccgctccagggtgtcagaacgcagcgacccggctgactccgaccatgcgccgaagactgtggtcccaaactgcacacctacctcccccaggaacgcagcaaatttactccagcatgtcaccctgctggagctggggtccgggacaggggtggtgggcctgtcagccgcatgcctcggcgcccgcgtgacgctaacggacctccccgaggcggccgccgccctgcgcgccaatgcagccgccaacagggcgctggtcgagcgcgggggcggcagcgtggcggtacggcccctggcctggcaggaggcagagggctctgctgtggctgcggaaggctacgacctggtcctgggtgcggaccttgtgtacaacgacgccggactcggggctctcgaggcggcgctgagggcgctggcgctgttctgcggcgggccgcgggagcgccgcccgagcgccttcctgtacgcccacaaagcgcggcaccctggcctggatgccgagctggtgcgcatgctggacggggtggggctgtggcacgaggtcctggcgcggcagccccaggacaaggtcaccatctacctgtgcaccgaatgtgccgtcgtggacgatgcgagcttggagggcgcgacgaggctcggatgccttttgtttcatcgctccaagcgtactgtgtccccgttgagggccagctga

SEQ ID NO: 4959 - DNA, 597 bp, Chlorella protothecoides
atggtctcggagtacaacgcgaccatggctgccaagatgggctggtccagcacgcgctcgggcctcaatcccttcgagtatcatcctgaacgaggcatatactaccactacctgacgtcagacctgctcctgggcagccaaccgcggtcgccaggggatgtggcccaccttgcaaaggacgagggcgtggatgccatcctcaacctgcagcaggaccgtgacctgaggcactggggcgtggacctggcctcgctcaggcacgccgcctcggagcatggcgtgcagtacatgcgggctcctgcagtcgactttgacccagggagcctgcgtcacgccctgcccaccgcggtcggcatgctcctggaggccctgagccagggtcggcgggtgttcgtgcactgcaccgcgggcctgggtcgggctcccgctgcctgcatcgccgccatctactgggcgggtctgggggtcctgccggcccgagacggccttgtccgtctggaggatgcatacaagtacgtcacagacattcggccttgtggtcccaaccaggtgcggcgtgggtggggggttgcctccttcggggaagggaggctgtga

SEQ ID NO: 4960 - DNA, 375 bp, Chlorella protothecoides
atgccccctcaggaagccaccttcccaaaaccccatgcagtcgtcaagacggcgaccgcactggtgcgccacatcagcctggccgtcgagccgggggcagcgccggggtccggcccggcccgccccctcatcgtggccagggcgcagcgtgcctggctgccgtcttcgcgtctatggctcttccggccccgcctggacacccatgcctgcggcggctggagcttccgcctgagcccgcacgccgctcggcacggggtccatgcccacctgctcatcctcctcgcggcctttgagtcgctggatgctgagctggcagagcggcagccgtcgtgggggcaggccgcgaagcagcggctgttggctctcatgaagtag

SEQ ID NO: 4961 - DNA, 387 bp, Chlorella protothecoides
atgtccctccaaaccctcacaccacaggccagtgccatcgccaccgccagcgggaagggagaagcccttgccaaggccgctgcacaggctgtgtccacggggggtgcctccgccaatgccactgccaaggccatcagccagggcactggcaccaccgtcgaccctggcgccatcaccaaagtcgaggccacctcccaggctttgaacgatggccaggaaggcctcgtggaggctgtagtcgttgccaactccggcgcattcagtgaggtcaaaacatccactgcctctgccctggccacagcggtggcggatgtgtgcggagggggcagtgcatctgctgaggccaaggcaatcgcggaggcagtgtccaaggtgagtccagtctga

SEQ ID NO: 4962 - DNA, 2478 bp, Chlorella protothecoides
  modified_base (1214)..(1223): a, c, t, g, unknown or other
  modified_base (1295)..(1304): a, c, t, g, unknown or other
  modified_base (1367)..(1376): a, c, t, g, unknown or other
  modified_base (2171)..(2180): a, c, t, g, unknown or other
  modified_base (2417)..(2426): a, c, t, g, unknown or other
atgactgtcgcgagtcaagatacacgcttcaggtccctgcccgcctggttcaagcccggcgagtttgccgacccagccttcagtgcggcgacttacgtggctgatctgcagcaatatgtcccactcgaagtgctacaccaagagctccaggcccacctctccgtgctacacggggatctggtagaggtcatcaacaaagattacgaaggcttcctccacctcacctcgcgacttactagcgtccagggcgcggtcaagcgcatcgaggggcctctggccgtgatacaccgacagcccggcctcatgagccatgagctgtcagggggaaaagggtcatcgcagtgggcgcagggataccgggcaaggcgccatggtaggctccactattgctgcccctggagcctcctggaaaggaaggcgcgcgccagcgccacccgcgatgcactgctggcagagtcccacgccctcactcggggcctggccgcccgcgccgacgcggccgccagcagaggcctgctggagctgatgcaggacctgacccatgtgctgtcaaaggtcgacaagctgctggcggagctcccacccccgggcgacgccttcctcggcaagcatagcagccccgaggcggtggaggggcagtgccacgtgctgaaccgggtaacggcagaggtggcccgtctgcagtaccaggtcaagaaggggcaggatctggcctttgttcagaccctggccccacgcatcattgccgccgcagacaggctgcaggtgcctggggagggcggctgtggggttatatggttcctggcctgcagatcctgtcgcaggctggggggtttggggcgcacacttcagcacgcacgcacgatgcgagggattgagctggcgtatcctgtcgcaggctgggggggtgtggggcgcacacttgagcacgcacgcacgacgcgagggattgagctggcgtgtatgcgccatggcacgaggagccgccggccctcagtgcgctcggacaatatcaggcagaatgattgggggcctgcattcccacgcctcctccctcgacctccctggcagacatacctggacctcgcgctggaggcagccattcgccagcaggtccccactgcactgggggcctgcctcaactcctatgcgagcatcaaccgtccccaggcggctgagcaggtgccgactcagggatctggtaaagcaaggtnnnnnnnnnnctcctatgcgagcatcaaccgtccccaggccgctgagcaggtgccgactcggggatctcgtaaagcaaggannnnnnnnnngctgcaaaagcttgccctaggagggtgcgcgcgcaatcatgcaccgggggttttaccgcccgnnnnnnnnnncttgggcagtcgggtgcttgcgtgtgaacaagccgctgcccttgagcccctgcgctgctgcagggtggttgcccagcatgcatgccgagcgtgcaacgctgctgcaaaagcttgccctaggagggtgcgcacgcaatcatgcagcgggggttgtgaccgcccactcgcagtaccggtggttcgaagcaccctcacccggccactggtggagcagacgctggcggccctgagggagaccacccctggcgctgccggcgccgctgcgcctgcccagcgtcctggctcaggagcagccccggccgccgtgccacccgccgtccccctgcccgccttcctggaggccctgacgcgggggatggcggacgagctgggccccttcctcgcgcacgccatggccacctcctccggcgtgcatgcctttgagttcctgggcaacggcgtcctggccgaggtcctggaggcggtgcaggcgcggtgcggcgcggacctcagcccgggcgtcccgcacgccttccacgtcggggcgcgggcgggagacgccttcctggaggcccttgagtcccacgccaccgcccaggcccaggtggcgcgcttcagggcctgccagccctactcggccttcatgaagctctggaacctgcctgtctacttctcgctccagttccaggtgggtgctgggactggacacatggagggactcctgtggggaggggtaggattgtcgggcttggagctcgcgccgcgggcaatgcagaggcggtgttccagcccgctacccctttgcgctgtgtgtgnnnnnnnnnncatggagggactcctgtggggaggggtagggttgtcgggcttggagctcacgccgcgggcaatgccgaggcggtgttccagcccgctaccccttggcgctgtgtgtagcccgcaggacatgtgggggttgagcactgcatgggctgaggaatgtgaggctgaaacagcatggcaggcagcggcggtccctgggctcagtcggtgggccgccacgctcgaccggggcagtgtggactnnnnnnnnnngggcaacatgaggccgattttgcagaggtcacgcctcggcattgctgtgtga

SEQ ID NO: 4963 - DNA, 951 bp, Chlorella protothecoides
atgcatccaggaaaagcaactttggagggtgtgagcgaggcagcactcagtgtgcagacccagggcggcgacatgtcactgggcaaggtgaaggccagctcgctgaccgcgcggagcgggggagggaggatcttcggatcgcttgtgggccacactgtgcggattgagagcgagggtgggaacgtgaccctgggaaatctgtccggcgaagacgtcagcgtggccacccggggagggagcgtgcaggcagcggctgcctacgctgcacagctgtcagtctcatcaggtgagggttgcagtgcatggttttgcggtatcggggcactgcagctcctggaatcatgcaagacgcaccctggctgcaatggctatggtaggcacgcaattgatatggcaaacacgcattggggctgtgcaggcagcctgttgaagttgcccacgtcctttatcacaggcggtggccccatcaccgtggactccatgcggtgcgggtcagcaagcctcgagtcgggcggtggtacaatcgaggtgtcgagcttggatggcgacgcagtcatacggtcaggaggaggagccattcaggtagggacttcggctcttcgggtgcatgctcagccaaacgcgggtaatttgcgattgtacagcgaaggtgggcctgtacacctcgcctggagctcgacgctggtgggcaccgtgaccgtcgctgcctgcggaagcttgctccttcccctcggatgcgaggtggaggaggggcgcggcgggatgcgtgtgatatctccgaccggggtcaggtacttcgcgcctggggcaaaccccggatgttcctggacagactccgtcagtggtcccacacgtggctgcaccctcctggtagataccggtgggttctggtggtgtggaacaggggctagaggctgtctacgcgattctccagctttctcaatggtgtga

SEQ ID NO: 4964 - DNA, 2079 bp, Chlorella protothecoides
  modified_base (1609)..(1618): a, c, t, g, unknown or other
atggccagtatggtcgcgccccgtcttagacataccagcaagatagatatcgcccctcgttctcaccggagtgtttggcagcaaataaggaaacccaactcagcaaagcgcggccgcaggctagcctgcccccgtgggatcccaggtggttgccgagcatctcgtctcagcacaggccagcccacctcccagcccaattctgtcttctggcagcaagctgttgagatgcagcgagccttacccgtacgcggagctcagtgggccacttggggtcccaccttcgcggacagccgcgcgtctgtggcaagcacggggtcacgccatctccacgcttcgtttctcataaattgggacatgcgccggggcccaggcccgggcaacatgactgtgccggaggtcgtcattcccgaggccgcctatgagaacgtacgtaccgggtgtgccccggggctgcggcagcgcccggggtggtttaacggggcctttgaactgccatcttggaggcttgtgtcgactgcaccgcacccatgcctgcaggagccgtccacgcccagtgggcgcgccccgctgggcgggggcgagacgcccggctccgtcccgcgcagccccgctctggacggcctggcggaccacgccgaccgcttccagctggacgccttcaaccgcgcccgcctctccggctcctccggcaagggcctgggccggctgctgggcttcgcgcgcagcccacgccccgccgccgcggcggcgtcgcccggcacgcccgagcacctgacgctgtccaccgacgacctgctggtgttcagcgaggaggggctacccacctccctgctcaagcatggctccgacaacgcggggcgtgcggtgaagatgttctcctccatcctgacctaccagggtgtgcacggcgacgcgctgccccccctggccgggctggagctgatccagaagctgctgcaccaggggctgaagcgcgcggagctgcgcgacgagctctacatgcagctcatcaagcagacgcgcggcggcccgggcggcgcgcccaccctccgcgcctggcagctgctgctggtggtggccgcctccatgccccccggccgcgacttcacggggctggtgtcggagtacgtgcacaccgccagccgcgacgaggccgaggacgagggcgtgcgcgcgctggcggcccgcacctgggccgcgctcaagcgcaccaccaaggccggccagcgccgcacgctgccggagatggcggagatcgatgcgctgctcaaaggcgtgcgtggcgccaccgtggtctacttcctggacgagacctttgaggaggtggcctacgacatgagcaccaccgtggcagaggccgtggaggccatcgcctcccagatcaagctggagcactaccagaccttcagcctcttctccgtgcacaaggtgggtgggggggtgaggagggggttggtgaggaggtggttggtgaggaggtggtgggaggatgaggtgggaggggatggagccacggacctgtgccaactctgcggtggcacccccatccctgcatctgatgttgcccggccacgcccatctcaatgccccctccccccatcccctcgtnnnnnnnnnnaggatgaggtgggaggggatggagccacgggcctgtgccaactctgcggtggcacccccatgcctgcatctgatgttgcccggccatgcccatctcaatgccccctccccccctcccatcgcacgcaatctgcagagcaagggcgggcagccgcaggacacggtgggcggcggggacgagcaggtgtccctggacgacacgcgctacatcgccgacgttctgttcgacttcaaggcggccaaggccaaggagggcaccgcgccgcgcctgctcttccgcaagaagatgttccgcgagaccgacgaggccatcaccgagccgcgcttcatggccctgtcctacatccaggcccagcacgactacctggagggacagggtgggaacctgtttggcgtgggattttcgcagaggttgctaggggtcgagggtgggctggtgacgcggggatgacgggagcgcag

SEQ ID NO: 4965 - DNA, 912 bp, Chlorella protothecoides
  modified_base (645)..(654): a, c, t, g, unknown or other
atggctgctgctgctgctgctgctgctgctgggcgggctcgcgcgggggcggtcggtgcggtgccatgctcagcgacgtgctatgggccctgggatcttcaggtagctcctcgcgatagcagaagaggccagagattatctaaaagaattgtgaatatggtagtcgcgaagtggccaagctcccactgatcttccgagataccttactgcctctgtgacgagacgaggcccatcaatcgtagacgtcggtctcccgtagcaatggagatcagcgaggcacgacagctgatccgtgatctaggagccatagatgtgacgcagatcggttcaccatcctggactcgacaacacgatgctcttcaacgcctcactaccatggcccagctccaggctaggtgccaggaggatgagtgggtggtggacctcctccacgtctcagggaagatggatgtgctgatcaccgacctcctaagccatgagatgacgagggcgcaacttctgaaatgtattggcatcaacttgaactcaaccgctgcatgggtcttccatcggctcgcacccgctgcctctgcatcaaactcctcccgcccatgcctcaacaggcatggtgcactcatgtcctgccttctctgctcgaggaggctnnnnnnnnnncatttgcatcagcttgaactcaaccgctgcatcggtcttccatcggctcgcacccacagcctctgcatcaaactcctctcgcccaagcctcaacaggcatggtgcacgcatgtcctgccttctctgctcgaggaggctcaggcaagcgagtgcaacactgtaaatatcgccctttacagcctgcagtcccactctggagtactggcagccctgctggaggtcgcattcttccacgaggtgggacgggcgagggtttga

SEQ ID NO: 4966 - DNA, 210 bp, Chlorella protothecoides
atgcaggcggaccgcgatgcgctgcacaagacgctgcactcccggcacgtcatgtatgccttcaaccaccgcaagcccatgagctgccctgccatggcgcagctgctgtccaacaccctctactacaagcgcttcttcccgtattacaccttcaacatctgcgcgggcctggatgaggagggtgcgccgggagggctcagggaaagctga

SEQ ID NO: 4967 - DNA, 1350 bp, Chlorella protothecoides
  modified_base (1113)..(1122): a, c, t, g, unknown or other
atgacagcagtctggtttgcatgccgctgctgcccatcccctccgattcgcgtggagctctcatcctccacccatgcagggaggggcgcggtgtacacctacgatgccatcggctcctacgagcgtgtgggctacgggtgccagggatcagggaaggagctgatgcagccggtgctggacagccagttgaaggcggcgtcgcccctgctcttgccaccacaggtgctgggcgggtgggttctgggaactttgcaggggatagtcgtgatgcttggcgagcttgctagatcaggggaaacatgccgtcgtgcgttgggccgctgtgagctgatccatcccccccaaaccctgcagccatggttgagctcgctccctctggaggtcgccatcgacctggttaagtccgccttcacatctgctggcgagcgtgacatctacacgcacctgcccggtttgcttgccattacagggcgacgacgtggagatcctcatcatgaccaaggacggcgtggaggtgcagaccctggaactgaaacgcgactgattcatgcactggtgcaaccgcagccactagtgggtgaaaagagggaatgccctgggattggttgcggcagaggagcacagacatgggagcagaggcatggctgcgacatcttgagctccacaatgagctacgaaagccttaattcctgccagcatggcgtgaggaactcctcagcgtgctcgatccctgcacctcccgctcctgctgtctcgcctcagtggtggcccgccttgctggaccccgtgagcttgtcgaaggcgacgtacaccgcgaatgccgcgatgccgatgcccaatccgggcatcatcaccctctggttgccggtgagcaaggggtgctggcgccacttctctgctgcgcgccagttgtacgccatggctcctcgactctcttcgcccgttcccccaaattggatgtcgacagactactcgttacgtatttctaggcgatgccgtcaatggctccaaataaaaaacaactctggacatcatcattctgagattgaaagcgatgaagctgcaaggccatgcgagtgtagctgctgtagtctggcccctctccaccaggcnnnnnnnnnncgagaccaaaacagcaccctgcttgaccagacagccgtcaatggctccaaatcaaaaacaactctcgacatcatcattctgagattgaacgcgatgaagctccaaggccatgcgagtgtatctgctgtagtctggcccctctccaccaggcccagagccgcagtggcgcagggctctcgatcactgagagggtgcgagcatgcagaggcagcatcctgggagatctga

SEQ ID NO: 4968 - DNA, 1344 bp, Chlorella protothecoides
  modified_base (236)..(245): a, c, t, g, unknown or other
atgcagccatgcggtggcgccatccccatctgcatggtcgacgagttcagcctgccgcctgagatcatcgaccgccgggtgaccaagatgaagatgatctccccctccaaccgtgaggtggatgtgggcaagaccctgaacgacaaggagtggatcggcatgtgtcggcgcgaggtgaggcaggtttggcagaatcatccctgcactagcatctcccctgccactgtgatcagcgnnnnnnnnnncctgaacgacaaggagtggatcggcatgtgccggcgcgaggtgaggcgggtttgggcagaatcatccctgcttgatctggaaggaagtacggcagcaaagggccaaaccttgctccaccttgcctcaaattcgcctcaacaccctgccaccccccacgccctctctcccaaggtgctggacgactacctgcgcaaccgcgcccaggacctgggcgccaacgtgatcaacggcttgttcatgcgcatggaccaggcacccggcgacggccccttcaccctgcactacaacaagtacgatggcgtgtccaaggtgggcaagccctccacgctggaggtggacgccgtcatcggcgcggacggcgccaactcgcgcgtggccaaggagatcggagccggggactacgactttgccatcgccttccaggagcgcatccgcattcccgaggacaagatggagtactacaaggacctggccgagatgtacgtgggcgacgatgtctcccccgacttctacggctgggtgttccccaagtacgaccacgtggcggtgggcaccggcaccgtcgtgaacaagacggccatcaagcagtaccagcaggccacgcgcgaccggtcccgcgtgaagaccgagggcgggaccatcatccgcgtggaggcgcaccccatccccgagcacccgcgcccgcggcgtgtgaaggggcgcgtggcgctcgtcggcgacgcggcggggtacgtgaccaagtgctcgggggagggcatctactttgcggccaagtcggggcgcatggccgccgaggccatcgtgcaggcctcggcgcgtgggcagcgcatggttggggaggccgacctccgcgtctacctggacaagtgggacaagcagtactgggccacctacaaggtgctggacatcctgcagaaggtgttctaccgcagcaaccccgcgcgcgaggcctttgtggagatgtgcgagtccgactacgtccagaagatgaccttcgactcctacctctacaagacaggtgagggtgggtgggaatggatcctatgtttgtttgatatggtggtggggtgtttgcggaagcatgccaaggactgctga

SEQ ID NO: 4969 - DNA, 819 bp, Chlorella protothecoides
atgggagacgctgtactacgagacgtgcatcaagcagcgcctgctgcgctatgccacctcagcgctgcgcttttccatgcagggggtggaccccggcctcatcagctggaacagggtggtcctcctgcacggtccgccgggcacgggcaagacctcgctctgcaaggccctggcccagaagctgtccattcgcctcatgccgcagtgaggccggggtggaccgggttcggccggagggagcgatccatcgatgcgtgcgatgggccaaggatcagtgtgatagcagccccctgtgcgcacagggtggaaacctgccagcgggccccccgggttgcacccatggtctccctgcgtgcagccagctcacggcccagccttatgcaccccctctggttctcccagggcatcctgatcgaggtaaacgcccattccctcttctccaagtggttcagcgagtccggcaagctcatcggccgcctgtttgccaagatccaggaggtggtggaggatgcctccagcctggtgtttgtcctcatcgatgaggtggagagcctgactgcagccaggaagtctgcagtgggagggtccgaacccacagatgccatccgggcggtcaatgccatactgactcagctggatgccctgaagcgccaccccaacgtcatggtcctcaccaccagcaacatcactggtgggtcagcagtctggagggtgcatgcacggagtgaagcatcagtgatgttggtgaccagtggcagggaagatggccatgccaatatccgactgctccggtatgtccccaatgctggaaaggggtag

SEQ ID NO: 4970 - DNA, 1653 bp, Chlorella protothecoides
atgcacctgctctactcctcacacacacacaggctgtggctcgtgagggtgcccaagcccccagaggtcaccgccctggctgccctcgagcaggagctggctgcctacacgcagcaagtcaagctcctgaatgaaagcgcctcggtgaagaaggaccacttccctgggaggggtccgtaccaggctgtcacgctgcgccgtgtgatgcgccgccagcccacacacgtgcaaggaagaccccccccccccctcttctgccaggttgcacgggatgacgcgcgtaaggacacgcaggcggcgcgcgaggcgtaccggctgtgccgcgacgcgtacaatgcgtgcatggaggtggtgatccccctgcgcgaggcggcgcgcgggtctgctggcgccggcccccgccgccttcgcgagtcgtaccccgagctggaggtgtggagcgtggcggagctggacgagcggctggcggggatggagtaccgcctgcagcacgagtcggtcccgctggcggaggagaagcggctggtggcggggctgaagcgcctggcgggccagcgcgcgcgcgtggccgagtacgaggccgccgccggcgcggcgcgcgacccggcactgctggccgacgccgcgcgcgcgcgcgccgcgttggcggaggcggaggaggaggcgcgcgcgctacgcgaggagcgcgccgcgcagaaggaggtgctggacggcttctgggaggcggagcgcgccgtggacgcggaggtggaggccatcctggccgagcgcaggcgcctgaaggagctgcaggacgaggcgtacgcgcgcgtgtcggaggtgcgtcgcgcgcaccgcgagcgcaaggacgcctactactccagccggcggcacagcacgggcgtgcgcgcgctgctgcgcgagccgggcggggtcgagaaggccagggccatgtgcgtggagcaggtggaccgccagctggccgtcctgcgcgacaacgacgactacagagcaggtgcgtggggagtgtgtgtgtgtggagggatggggagggaggaatttgaaaagggggggggggacggcggcgtgcaggtgaaagggccgcacaaatccttggtcacccccaccccgatcaccaccacccacgcagagtacctcacgctgatcgagcagcagcgcgggcggcccagcacgtgggaggagggggaggaggcgggcaacggcgccaagcgcggccacagccggcagccgtcgctgccgctgactgaggaggagaccaaggagcgggcccagggggtgagccggggcacgggggggtggggtgggtctgggagggggcgctgcatgcatgcagaaccgatcagatgccccggtcgtggggccgggcgggcgtggcatcccctggggacgccccggtgccacacaaactctcgatcatcacgctccctccacctcgtcgccacgcccccacagaccatcgcagcgaccatcgcagcggtgctggagcaggcgcggtccagggtggtggacctgaagcacgccgcggcggccgccaccgcggcagcggccccgcaccccgtggcggtggaggtggccgtgccagtcgccccggccgagccccgggcgatgcccaaaaaggcgccgcgcgcggagccggcgcaccccgagccggag

SEQ ID NO: 4971 - DNA, 726 bp, Chlorella protothecoides
atgggacctgagcctctgcggggtacacgtgaaatccatcccaggcaggagctctgtgatggcaccgcctgtgcagttcccatcaacactccaaaccgtcgtgcagtcgagaaggacgtcgccgagctggcgcgctccgccacgctgcgcctgcgtggcatacgactgtgttcctccggccggggggaggcgggcgcgacgcacctggttgtgggcagggagcgtcgcaccatcaaactcctgctggcactggccaacggcgcctggctggtgaccccccagtggatcacggcgtccctcgacgccggcgagtggctacccgtgcgccagttccccgtcggcgagcgcttccgcgccgcggccgagcggtcacgctcggcccgggagcgcggcgccgcgctgctggccgggcagagactgtacatccacgccaggaccgggtccggcaccgcacggccccggaagtcagatgcgagcgtggagcggcgcgaaggcggcgccgcctccgccgcagatctgggctcgctgcgcaggctggccggtgcattgggcgcagaggtgagggggccgggggggtgctatgaccccgtggtagcagcgcacgtgacttttgccaggggggacggcgtactgcatggaggagtacgcgatgaccaaggctctgggccgctgaaatctgctgtcgggaggttgtatgtgcatggccgcgtgggagaccatgcctga

SEQ ID NO: 4972 - DNA, 474 bp, Chlorella protothecoides
atggagtcccctcgcagtcaggcggggctgggaataaaggcatctgaggccaacaagaacacaaactggctggactcgccggctgcgtgggtatactacgtcgccctcctcctcctgtcctggctcttggtctccagcttcaccgaccctggcatcgcatggacgtacgtccacatcgcgcacggcgtcctcacctacatcatattccactgggtgaagggatcccccatcgcgaacgaccagggcgtgtatgacagccaaaccttctgggagcagatcgacgacgggcagcagttcacaccggcccggaagtttctgacggcggtgcccgtggtcctcttcctcctggcctccaatggcacagactacagacggcaacccctcggcgtcaacctcatcgtcgtgatcgtgctggtgatcgccaagctggccagcatgcaccgcgtgcgcatcctcggcataaacaagtactga

SEQ ID NO: 4973 - DNA, 1608 bp, Chlorella protothecoides
atgaccctctttgggctggcctggagctccgaggacaggctggaggaggccgcagcggcgtacgcggctgccattgggctcgctgaggacgcacgagagctccacagagaacaggccaagaatggggtcagggtacggcaagttgtgatagcatgcctgcccctggcagcagtcctaggatccagcgccccagcactccaccatgcctcatatttcccgcaggagtcgatggatgtgctgaacccatccctgcaccgtgccaggcgcgacctgtcgcagatcctcctgaagatggggaggcaggacgaggccgtggcgctcctggtcacctctgcgcgccagctctgcggtctagcggccgacaccgaggcacggaccctggcggccggcgtgacgagggccgccctggcggccgcggtggcgggcgaggacggctctgccggcgagacccggccggcgcagcaggacaagctggaggtgagggcgggtgtggtgagctttgatcgtgctggccttggtgggaggccacaccccgtcgatgcctgcggccaccggggtctccaggccagccattgcaagcgtcaatccaacccctggtcaatttgccgcgaccctcagcccaccaccctccgaatcctgcagctggtgcacagtgcgcggcggtcggccatcaggagcctgtgggaggctgcggacctgctggctccacccgagggtgccgccggcgcggctgagcaggccgagcagctcctgcaggaagccatccagatggcgggcgagggctacggccggcagagcatggtgttcgtgcagtgcctggatgcgctggcgcgcttctcgcggcggcagtcgcggcttgaggaggccctgctgctctaccgccaccagctggcgatcctggacgggttcagggcctacgagctgcccatggtccagcaccgggcctggggagctggctcatgccctgggcaccgcaaagagctttcatctggacatcacaagcctcgactcgctgcatgtctagccccatctgagctcgtctcctggcactaccccgccccattgccgtccgtgcacagggcgtccgccgaagcgctggaccagctgggggagaccggcacggccgtggactacgccaaccaggccctcctccaggcgcaggccttggtgaaggtgggcagcgagcctcagcagcgcgctgcagcggcggccctggagcccctcttcacactcgttgccgagttgaaggagaaggtctgtcgtggggctgtacggtggaatgggaaatctctcatcacaatcgccccacgtgcaccgagcttatgcctcgccaaacgcgcttccaatccgacccgcatggcagacgggggacaaggagggcgccaagaaggcgcggcggagcatgctgcaagcccgcttggagaagaagctgccgacgttcacttcgccgggaaagaaggggcgcaaggcgactcgtcagaacaagctcaaggttcaggcttcatgatcgatacagccatgaccgttccatgcatagggatcaagctggtgttccaattgggagtgcgcgcttggaagacggtgcccagttcctgcccagtcgtgtaa

SEQ ID NO: 4974 - DNA, 273 bp, Chlorella protothecoides
atgcactcatgccgcgcattccctgcagaggcaattgatgtggcattcgtggacagagctgacataaaggcatacattggcccaccaaatttggaggctcggtacgccatcctcgcctcctgtctttcggagcttgatcgggccgggatcgtgcgggacatgggcagcatcccaggcttctcccatgcactccggctggggaccgtcatggacgaaggcggggcggagggcctcgcagatcatgtggccaggtgtttgggccccatcagttga

SEQ ID NO: 4975 - DNA, 1842 bp, Chlorella protothecoides
atggaggggcgcgctgcagcccacgccgcgcgtgcagggctgcgcaccctccgacgctgccgggacctggcaggcgtctggtcctggcccgccgtcctcccgctcctgcgccactcctcccccggggtcaggtgggccggcatccacctgaccgcggtgctcctcgggctggcagacgccgacgtcagaggcctcgaggcccggctgctgtcccccgaggagctggccgccgagcgcagggtctggcaggaggaggcggctgcgtttgccgtggaggccgccgccgcgctggccccctgggacaggggccgcgcccgcccggccagccgcaagcgcaaggccacacgtagcatcctcgcaggcgatggctccaactccgacacgagcagcagcgaacgcttctctggggacgagggggtctcatcctcggcatcagggggcaaggctgggccgcagccgaccctcgcggtccccggctatgtcaggattgcgggcgtggacctgcctcagtccacgggccccggccctgcgccacccatgaccctcccggcgtcccgcctggtgtccacgccgggcatgctgcgcacgctgcgcggcgtcgcgctgggcctctgcgccgcctcccccgtcctcctggagggcccccccgggtccggcaagtcgaccctactgcgccacctggaggaggtgacggggagcgcggccggcgccatccacctgcaccttgacgaccagacggacagcaaggggctcatgggagcctacgtctgcaccgcccgccccggcgagtttgtgtggcgcgcggggcccctgacccaggccgtggcgcagggcaggtggctggtggtggaggacatcaacctggccccgccggaggtgcttgccgcactcatccccttggctgagcggcggcagctccatgtcgccgcgcggggccagaccctgaccgcccaccccggcttccagctgtttgccacggtgacctccacgccgcagggggtgggggcgggtgcctacggctcgtcagccgcggtggtggacatgctgggaggactgtttcaccatgtgaagagtgaggcggggagggggtggttggagtggaggtggaggcgggcttgcatgagagggatgggtggggagattgggggacagcgaggagcacccccgctcacccttgctggcagttcttcggaaagggccctaccctgcaccgccacaagcagccttatcatcccacttcccttttaccttactcgtgcagccgatgcaccgggtgaggaggatcaggcgataatcctccgcaccctctatccggccctgggtccgaccctgctgggcactgcgctgcgcatgctgtacctggcgcgggccatgtatggccagctgccggccgacgagtgcccctcctggctgccagccgaatacggcagcctgccctccctccagggtgtgggccgacatttctcgctgcgggaccttgcgcgctgggcggcgcgcatgggcgcagtccacgcccgcgccctggcggcggcggggtccctcctcgggacgcgccaggccacgagcccggtcgcggcggggtacctggatgccgggtcggcgctgcacagcctccccgccggcctcaggctggccgcctgcatggaggcctgcgacatgttcgccggtttcctggccgacgagcacgacgccggcgccgtgcgcaccgtgctttccacgctctggtgcgtcgtgcccgccaaggtggagcacgcggcgctggccgcccggccgacgctcgcgcgcaccgccgccgcgctggcggtgggccgcgccacgctcccggcaaccgggccccccccc

SEQ ID NO: 4976 - DNA, 2124 bp, Chlorella protothecoides
atggccggcaaggtgagagcagggtccagaaggcactcctgcaccgcggacactgtgatgccaggacgcacatcagccggctacggggaggggaggaatgtgggtgaaatgtgtaatcgtgcgctggctacccatctgttcaaccacgcgtgtgccttcaacaccccgggccaccaccagcgtacacacctggagctggagcaggcggtgcacggaggacagactgccggcgggggggcatcgcaccaacaacctcttgaaatcgtctatcacatccattccagaagtatgacaacgtcaggtcgcgggtatggaccttctccgcgtgggagacgccttccgtcggcgccggcaacgcaggagtcaccctgggctctcgccgacgataagccaggatggggcaatgaagggtacagctttttgatgataaatcgcaaactcacagggcttggatccagaagtgttggtgaggggcgatggtgcaaggttcttgcatgcatggatatcgggagcacgggaactctcagggcgcgcgaaatgttcacggcagcctccggccaaagggacaggggaaggattctttgttacagaccaacctccactcagattgtgaatgcgttgcctggatccggaagcaggctgcagcgatgccaatatggattctggcatcacgatctcgcatcggctcaattgaagggggctgagtacatgttcggcgcgctcctccttactttgtccgctgagtgctgtccctggtggggtccatgtctccgacactctttcggcgctcaggaaggttgtatcaaggggacatcttttagatcagtggttttcatctcctcattgactgctgtgcaaagcgtaactcttccggaaatccagatgaccgaccgtcgtccattgcagaatccaccaccgaaacctgcaattcatggcgtccagccaccaccactgccagggcccggtcgttcggttccgacgggagttacacacgatggagcactttacatccccgttgcattgggaccgccgtcactgtacgcacagcttatgatacatactgacacagaattcttcgacacttcacaatgtacccgtccaatcagagaagcgggagccggtgggtctgagagctggcaagcacccctcaaccaggaaccctcagcgtcccagacggcgcccactgcaagtagttcccaggacacccctcgcacagcctgcatcaactggaaccttgaaaaggtgacgtcattggacatggaggagtgtcagcacagacaggcaggcacaggcctcaacaatcgctcaggatatagaggagtgcgaaagaggccatgggggaagtgggcagctgagattcgggacccacatcgccctacacgacgttggctgggcacctttgacgtccctgcagaggtgaagcctcattgcattgctctagccctgtccagggcagcccgcgcctacgatgctgctgcagtggccattcggggacccaatgcccgcactaattttatctacccattcgagctgcactccataccaccgcaacccagtcctgccaagagtgccgaagtgaagcgtgctacgagtgaacctgctgccaggacacccggcgcgagctcatcccacccccagccagtcgtcctgggagcggcaccctttggtgtcgagctgatgggcagctcccttcccttcctctttacacagcaccctgcgatacagtcctatccacagcagcatcaacccgtggctgcctggaaccagccagcagtgcctgcacatcagctgctatcctccctgccgcaagtgcttgggacaagccttcatgtggccgccccgaccctcaagcctgcaatccctgcaaccttggcccctcactcggtggggctgcaccgaggagcacagggctctgcgcatgtcatctgttgcagggactgggaagcccctgcctcccggcgatgcaccgggcttaaagaccgaatgccgtcagcaacactcaggcacatccaccttgcacccatgtcacgcagggtgcagtggcgctgcccacccctccagcacccaggcccgcatctttcacgagtcccactgcacacttcacgaacgaggatgtcctcttga

SEQ ID NO: 4977 - DNA, 1692 bp, Chlorella protothecoides
atgcgcgatgcttgctcggagctgatcgacgcagttgcacatgtgggctttctcaatgaaagcgaggctttcagttcaggtcaacctcaccacgatgtgcagatcctggaggacattgtcaaggagggaccagagagcgaccgggtgctgtcgatcatggcatatgcatacaaagacgcagacaggtgctgtcggtggtggaggcatggagctttgttgactccgatttctgggagcctgtccgctgtccctgcagcatatctgtccgagtgcttgcttgagcaggttggagggcaccctgtcggcctacatagcagctgttcgagcacatccaggggacgaggagatgctgaagggattgtttggggcgtatgtcagttgattgggctgggaatttccccgcgaggggcagcagactcaattcagggaatgcacacaccccactcattgatttccagtgcgggcgacttcaccaagcagcaagccactgccctgcagctcatcaagctgagccctgatgctgtgaactacctctggtgggcagctgtgtcagcagccatgcaggccagagcctcaatacagggccaggcgtcagcgctgcccaccgcaagcctgctcaccttggctgggcggctcatggaccgagccctagacaggaccccaccgggtgcctttacctttgagatgctgctggtggtgctggatgtgctgctggcctctggacagcatgcccgggcggcggcgctgctggagggctcccgggcgcgcaaggcatgcacctccccgactgacctctccttcctctgcgccgccgtggccgctggtgccggggagcaagaggcggcggcccggcgctgccgcgaagtgctcactgtctcccctcatgactgggcggcggcgcgcctctgcctcgactgcctcctggcccagggagggagcggcagaaccctgcgctgccggtggcctgtgtgggtggtgggtggcctgacggatacgctgctggagcgggagcctggcagtcaggaggatcaaacggcgcctgagcccctgggcgaggtgcagaggcgggtgctggcggactggtcagacgagtggggctccaatctcccgccttctgattgtagcgggagtgcaagcccaggtccacttcttcgtgccactcatttggcccttttggatggcttagcgcggggtctcacagcgagacatgcggagcaggtcagcacggaaccttccgggccggctgacaaggatttggccaagcaaatttcgtcggccttccgtacgctgagtaccctggggaatgttgtcctggatcttggtccatacttggccatacttgggggtgcagaggcccagtccctcgctgacgaggcaaaggcgattggcgaggagctctgggccaactcttctggagcagggaacacaggtacaaggacaggggcctggggactgatgactgccagagagacttgcgattcagatgagcattatgagcgccatgatgacaagaggacgcaggaagcaggactccaggcgctcagcaacggctaccaggtggggtgtggaatgttggggcctaccctgcgtggaagacaccgaaaagatgtggtcttacaggagaggcatcaatgttgcaatgctagtgcagactcgtatcatgctagcttacccactgaaatcatcaactga

SEQ ID NO: 4978 - DNA, 1335 bp, Chlorella protothecoides
atgagcatccatcgtccaagtcatgtcatgcctctcattgcacaggtggagtttgagctgggcctaccaaggcacacaagcggggaccaagctcgaggcgctgctgccgctctcttgaccacatatgccgcagctctgcccctttcaggtgagccagagtggaacggtggctgctcctgtgccatgtgcaagctccactacggccatcagacctcaagccatccccacgctgcagctgggctggacgccaagcaaaggggtcacggtgaggacctaataaccctcgcagtgacgcgcctgctccagggtcatgcgctgggcctgcatggcctgctgccgagcgccctcttcgtgttggaggcggcgcagacgacgcgcacctcatcggcacccctccggctccacgctgccgcgttgtatgccctgcttgggtgcccaagggcagctgccatgcagctggaggctctgggcgtgaagcagattttgcatgacagtatgactgcgcactggctcctgccagccctgctcgacacgggagccactgcagcagctggagagtcgctggacatgtgggtccggcttggctgtgggactgcacttgccctcgtcttattccttctgtcgcctgttgggcggaagtgtgcaaaggtatgccgggtgtcggtgagccttcgctgctccctgtcctggagtgcagcaggaaatgcacagatgctggcaatggctgcctcgtaccacacatgccagtctcgcaccaacgcgtactctggccttgatactgctgagcctctggtccttcttatgcgttgcttgttccctcaacacatcccagcagccctacccttgcaggtcgccgagtttgtgagtttcaaagagaggcttgcagcctcccatgccctccatgtggtgcgagcagaggaagctatccggaagctgaggctcctggcctcctcccctgtatcaccccacaccctcgtcaaggcggcacgacatctcgaggtgggtggcttgcccccggcacggctactgactggtgggctgtgccaccgtccctgcctgccctgcatcaatggctttttggccccccgcaaattacaccgctgcatctcaaatgcccgcaggagcaggcacctcccctgccgacatgcatcagcttcaacgaggacctgggcacacggccagcctggttcccgcccggtgcgacctccgcctccgaacttgggccggcactggctttgcgaccctgtgggctgtggtggcgagcgccatcggctgcctccagggccacctgtgccgaggctcaggcctggcggagcgcccagagggccaagctag

SEQ ID NO: 4979 - DNA, 459 bp, Chlorella protothecoides
atgctgactggtgggtatgacctctcgtcggtacccctcccagaggagaagcctttctgggccgacatcttgcttgccttcagacggctggaaagcagtgagctggccgccttcgatccaagcggtacatccgtcgatggctacggattcaccacaattgtgacacctcctcatgccttgaatttgcagggaggccagcgactctgcccctttccaccgagcagggaggggcgactttacctggtctggttgatgaagcagattgagcagctgggcggcaggcacgagcgccgtcatgtcagcagcttggatgagctggccgattacgatgccgtggtcaactgcacaggtgcgcacgtggtcgggttgcatgagccagcacggggggcgcagccctcccctgctcccgggacaggcacgccgacgccgttttgcatcatcagccgagagcctctgtga

SEQ ID NO: 4980 - DNA, 582 bp, Chlorella protothecoides
atggccccaaagctggtggacggcgaggagatgtaccccatccggggccatgtcatccgagtgcgggccccctgggtccggcagtacacgaacaaggacaaggacatctacatcatccccaacaccggtgaggctcgtgggcctcatgccaccctggcccccgccgccagcagcggcatgcggttggtgaagggggccgcatcgcctggctcggcttctaacccccctcccccgccgcccccacccatgcctgcagacacggtggtcttaggaggcacgatccagaagggggactgggacactgtcccacggcccgaggagcgcaccaggatccttgagcggtgctactccatcctgcccagcctcaggcgggcgcccatcgtgcgcgagtgggtgggcctccgccccggccgcgccgccatccggctcgaactggagcgccgcgcgctcccggcgaccgccgcgcggcggggcaccctccctgtcgtccacaactacgggcatggcgggtcggggctgacccttgcctggggttgcgccgccgacgcagtgcaactcgtgcaggcggcgctccagctctga

SEQ ID NO: 4981 - DNA, 2001 bp, Chlorella protothecoides
atgctctataactcgccgcaacgaaagtacgacttgcatctcatcccttcagttcgatcgaatatggagcacgacctgcaaatgggtgtcgcatccgcgctgatcaccacctcccggagcgcgaccgccacgtcgacattttccctcagcgggcttcaaagtttgttttgggggcagctgggagttgcgttgctgaacgccctcggatccccgctgtcctccaaattagcccctgaacagaatccactgcttggacagtggggtgtcgatcatggaagaggacgtggcggacgcccgcagcaagagacgtgtcaggcgaagtactggccatgccctccatcaattccgagcaccccaaccccacaaccccaacgcggccaggtcgaggatgatgagactccggagatgatcatggccaagttcgaggccctggatcgtatacaggccagctcacacagccctggggaggaggggaaggcaggggatgtgaatactgtcggcctggagatccttgctgcagtggaggagaggagccgagacgggtgtttgacagatgcacagctcttggaagttttcaaacaggtgtgtgaaaactgctccgtggttgtggatcattttggagagcagatggcctccttgggcaatcaaagcatggtctggctggtggagggagcatgactttgcactgcctgtacagacatcctggagaggccatgtctcatcggtgagaccatcatcaccctcctttggatgcacaggtatggatctgacgaggaagtatcagatgatgaggactggatccaaacattctggtctgcaactgcaacccacatgaaagctccgcttccgaataacaaatttgaggtacagcagcctggccgcatcccacttagctccccttccggcctcatcacagaaaacgggaaagatgcggtgaagcggtcttccacagaacccagttttgttcctctgtttctccgtccttccaatacaatcaaatgtctgacacaggcagcgaatgcctggaggcaccacaggagcacgcccatcctcacaatcccgacacagactagtgacgtcttgcaacccattctctcaggtgggtcgttgtcccacttttgcagtgccccgcaaggctttgtcgtgatgaacaagacacaagcagctgtgggctgtctcgacagatgttcatgtcgctccggccccatgtcctgcccctgccgattcctcctccatcaggcccttgtgaggaggaaagtcagggtctgcgacaaaaacgaggtcgtcaccatgcgcatcccggcagccccactgcccctctcctggggaagaacagtgaggccatacagcccagttgacccttctgctgatgctgagattgtagggtcgtcagtggatgggcaggagaagcgctgtcctccagtctcctacgagtcctggctgaaatgcaaggccgcagcagccacatatgaggctgtgctgatcaaccctgggtgggtagagagtggggacgatggggctggcctcaaggtgagcacagggaggccatgcaccagccggtgcctgagacaaggcagaaggctagagtgcacaatcccccaccaagttgaggccgtgctgccgcacgcactgctcaacgtccaatcctcacaacatgcgcagaggtttgcgacgctcccactgccagaccttgtacccgcgggaatggtcttcatgttcatcccaaaacagtacattcaatctgtctgtcaacaggtgcataggcatcagccatccaaaactatgtggaggggaggttgggtcattcagtccctctcgccaagaggtgcaaagccgttcctgatccacacttggttacaatatggtgagctggggcttcatgtatatcgaaaacctgacgtgggtttacctttccccaaatcatactgtatctcgggaggagtcgcccttctttgcctcctcccacctaactctgtacatgtttcgatgggcaggtactga

SEQ ID NO: 4982 - DNA, 795 bp, Chlorella protothecoides
atgagctacggcaagtgccttctaccttcgcaccgtagcataacaccgagacccgccgatgttgtcatgctgagatcattgcctgggaggatgatgtccacagacagcgtcggcctggctaaagccgcgctgcgcagggatgtcctccagcgcctgaagggcatgtcagtgcaagacatgcagtctgagagtgagtcgggggtgcgggagtggcgtggcattgttgagtcgcgaccatcgagtctaggaatcccactacccagtttgtgctttcttgcaaggtgctgcaattggcgagcaggtgggaagctgtacgctcttcaaaactgcccagtctgtcgcggggaaccagcacctggaagtcatcatcaaagcgcggctgagactctcccaaatcaagggccaagcaacccagcccagcctttcataccaatgcgtggtagggtgtatgtaccacgcgtgctggaccgagacagcaacatgcattttctgaggctgcaaggcttggaggagctggtgcaggttccaccttttggcatccgcgagccccctctgacggatgcggctggcgccccacggtccgacgctctccagagccctgaccccctgcagcttgtgagcatgcacagagggagattgcaagctggcggtggtgttgacagcaggcttgacctcacccctggtcgatggacacatgcttcaggggtcctgcagagtagtatttcgagtggaaagtccccactccaccggcatcgacctcaggctcttccctacgtctcgccccgcgactcgtag

SEQ ID NO: 4983 - DNA, 765 bp, Chlorella protothecoides
atgggtgtactttatgactttcatcattcattgtcgactgatggtgtgggaattgacttgcccatctttggtgtttcacacgatacccctgtccagagatctctggaaaggagctggaagactcctctccttgtggcactggccttcaatgcacaaatggtggacagcatccccgtcggtcaccatgacgtcccagtggacgtcattgtcacaccccgtggccccatcctatcaataccactgtgccccacgggttctcgtcaggtcggttcaagcacggttatgaatcctgaagtagaggcatctcgctgctgctgcaagcacacagcctgcaatgctgtgggaaggtggcatgactggtgccgcccccacaccagcatgttccgcgaacacatgctgcccgtctccgacctggccattgtcgcagacctagcgtcattcgatgtgcggctgtgcgtcaagcagcctcctgatctaatttccttccatactgatcggaagtcaccgggcatgagaccttgctgtcgctgcagatctgttcggagtttttcacgacgtgtgtcggctccacgaacaacctactttcatgccgcccgatactctgcaggcctcctccacgccggctcggcatcgcggaatgagacttcagtacctcaaagtcatgatcatgggcaccatgacatgggaaatggccgtttgcacacacgtggtgcatttgctttcaaacacgggcagctgtggttcccgttccgacaccacccgtag

SEQ ID NO: 4984 - DNA, 411 bp, Chlorella protothecoides
atggatgtgatagacgatttcaagaggttgttggtgcgatgcccccccgccggcagtctgtcctccgtgcaccgcctgctccagctccaggtgtgtacgctggtggtggcccggggtgttgaaggcacacgcgagtgccttctggaccctgctctcaccttgccggccatcaccatcctccggcggcacgtcctagccgccatcagcaccctcgtccatgctgttctgaacagccgtaacgccgcacgacccagcttggagttgtctctggcgctggcctccgtgctcgagctggccccacatgcggacaggtactggaggcctgcactcgatatgaggatgattgctgactgccatggtgataccgacgttgacaagctcttgcatctcgcgggacacacctgctattga

SEQ ID NO: 4985 - DNA, 219 bp, Chlorella protothecoides
atggagctgcgccaccagcgcaacccggacgtgctgttcgactgctgcttgcccatcgcaggatcaccctgccatgcggtgccccaggcagtgtacgacacgattgagacgctgctgcctggcgccaaggatcgcttcctagagctgtgggcggcccaggggtcggcccggcccggctggacgcaggcagcctttgcgctcgacggtgtctgcacctga

SEQ ID NO: 4986 - DNA, 906 bp, Chlorella protothecoides
atggcagctgtcacgtacaaacgtaacaaggatgggaaccagcgatttatgatacctcacatcaccatatgctcgggggttttggatgatgtattacacaagggcaaggtcctcatcaaatgcaacgatgggcaggccttaaatcgggcgcaaagctgtactgagtttgacctgatggctgaggaggatgtctccagtagcctcaagaatttagagggaaggagggacagtaatagtttgcagataaacggcgagtggagtcagcctggtacaagacctgaggatgcttgtgaatcaagcaaggagggccctgacgtcagtcggaaacttcgggtgaacgagttaagaattggaaaccccgcaatccgaacaagggctagggtttggcttttgcgaaaccctgcacagcccggcacgtgcggggccatctcgatgcggggccaatgtgctggcccaccacatggcatgtcagcctggttgcccagcgcaatgtcgcccgggggaggcaacccccgccctgttccgacggagctggtgctctacaccgacatcttctacctagggaccctggaggaatccatcggggacatccggggtgcctgcattgttgtgcggggcaacctcatcgagtgggtggggccggagaccgactgcccccccgagctccggctggaggccaccagggttgtgagcctggcggaccaggtggtcattcccggcctggtcaacacccaccatcacatgtaccagacattgacccgctgcgtcgctcaggtccgtcaccgtcccggaggcagcatgtctgacgatgctgccctggggatcaacaagggcagtgcatgcctggccacgcagcgcagccatggcccgcccaccacccagcaccccccccccccccccgggggc

SEQ ID NO: 4987 - DNA, 1407 bp, Chlorella protothecoides
atggttctgcacacactcgactcctcgcagccttggaccccgcgtgcatttcgtgagcgaggacagcgcagatgccgtttgcaagtgagtaacgctcgtgaggttgtgcaccaagccaagtgttcgcagatcaatgcgccagcccagagtaagcaccatgttgcagacctgatagctcatgaaaaatctgactggcacataccaacccagatccccatggcatgcaggcatgagggcttcagcaaggcggggaccgtccgcaccaccacccttcacatcatggggctgtcgatgtcggccgtgcgggtgagcaccctggagatcctgacacccagttccacgaagatgattgtgaatgtggagtgcctcaaagagggccagaagccttgcacggcggacagtgacggcaacattggctccggcaacaagggcaagaacaaccttggcaccaacaacgttgggaactacaacattggtaactccaatgtgggcactgccaactggggagacaacaattctggcatgagcaatccttgcttcaataagactaggcatcgcataattgtgagcgactgcagcctgctcgtattccgcaagcgtgcatgggtgcttggctttccaccgcctcccgccaagaagtctccaccgcctcccaccaagaaattaatacctccacccgccaagaagtcgccgcctccacccgccaagaagtcgccatcccctcctgccaagacgtcttcccccgctcccactaagacgtcttttccccacccgcgaagacatctccacccccaccctcaagctcaagccctcctccaccctgatcccctcctcccagccccactcctcaaccagcccccctcctcaacccagcccccctcctcaacccaacccccctcctcaacccaacccaccctgcccatcgccatcaccacctccaccaagccctccttctccgcctccaccaccaccaacgaccgccacaatccaattcgctggaactgcagatgggtttgtcgacgtcacgtttgttgttaccactggggggctggtcctctcctcaaaaaagtggtcccgctgaccctgctcaacccttcaccacccccacctgcatccctcccaccaccgccatcatcattggggtccatgactggaagcattatccgagacgattatgacttcacattcacggcggaagctgggaatgtctctccgagcagcatcaactacattttcttcacggtcggtggtgccgcgatcgatgcgacttccactcctaacagtggtagcccaaccagttgggacaagcagctggacagtgacgcagcagcattagcgtcctatgccccagttgtgggcgtacagggtggaagtgggagctcaaatgtcctgaccctgaactggtag

SEQ ID NO: 4988 - DNA, 1188 bp, Chlorella protothecoides
atgctatcttgctcttgcccgttaaatacactcttgggaatggatgctgtcctagtgaagaccatgagaatccctgcaacatgcactggtataggcgatctgaatgagggccatcacatccaaatctccacatgcagtgtggagactggatttcacagcagtggacgggcggcgagagcactgcgtagtgcatgggtacaggagagaaagagggaacgatccggccacagacatcccttcaacaagcagtccttcctgcatggaaccatcaaacaaggcaggaggaccgtctcttcttccacatttcaaacggcctttactagtcgaatggaacataagacctctggttctggcgggggtctttctgtggtgcacgatggcaaccccttggtcagtacgaaggttcattctcgacgcaggggagggtcgagccctctgcgaagggctgaggatgccgccaagggcgaaggaggactaatttctgacgagagacggcagaattatctgcctctggcgcgaggaggatttttgatggaagggggcgaaggctttcttgcaggaggtagcaggctcctcactggcggaggtggtgaggatctccttgttgaaggggatgatgccttccctttggagggtggagggggtctcctgggggctgaaggaggcttcttgatcggaggcgagggtgtggacttacgggaagggggtggggttttcttgatgggcggtggagatggcggcttgcgagaagggggtggtggcttcctgctcggaggaggtggcgatcgcctggggaagggtggtggcggcttcttggcggaaggtggcggtgatggtttgggagagggggggggggtgactttgcgggagacggcggcgatggctttggagaggggggcggtgatggcttgggagaggggggcgggggtgactttgagggagacggcagcgatggctgtggagaggggtccggtgatggcttgggaggggggggcggtaatggctctggagaggggggaggcattgatggcatgggagagggtggcggtgggctcgcaacaggggccggggatgggatggcaggtggtgggcttggcatccctgcaggtgatggtgacggtggtggatgggacaccgagggcggttccacgggtggagacaccggtgaaggtggaggggccccaggac

SEQ ID NO: 4989 - DNA, 1392 bp, Chlorella protothecoides
  modified_base (405)..(433): a, c, t, g, unknown or other
  modified_base (1290)..(1299): a, c, t, g, unknown or other
atgcctgcgcgccccgcatcgggtcagatcggggtggagatgcagccccgggagactgtgctcgaggtcttgaatgacacggatcccctgctcgcaacctcgccgcgccatgatccggcccagggccctgaacctccacccagtccccggtcgtgggtactccctactctcaggtccttcccaggtccacacggcacacatgcccacccttctactccccgcagccccaggcacctgctcctgatcacgtgcatcgccgccatcggcgggttcctgtttgggtatgacaccggcgtcatctccggcgccctgccctacatccgcgactccctcctggcccccctggccggccaccccgcccgcctggctcgcgtgcaggagaccattgtggcctcggcggtggtnnnnnnnnnnnnnnnnnnnnnnnnnnnnngggcgggcgcggcggcgggcggccgcctctccgaccactggggccgccgcggcaccctggccctcgcagacgggctcttctgcgtgggggccctggccatggctgcggcgcagggcctgcgtgtcctcatcctgggtgagaggctggggccgggggcattgcctgggtcgggtgctggtggggctgggggtgggcgtcgcatccgtcaccgtcccggtgttgatcgccgagctggcgccgccgccgctgcgggcgcgcctggtctccctcaacgtcctcgccatcactggcggccagtttgcggcgtacgtcgtcaactggggcgccgcacacctaccgggcagctggcgctggatgctgggggtagcggcgctgcccccgctagtgcagctggcggggctggccatggtgcccgccccgccatcgagaaagcgcagcggggggacgcactggggccagctggcgcggcccgccgtcctgcgccagctgcacgtcggtctgggtctgcaggccctgcagcagctgtgcggcatcaacaccgtcatgtgagggatggggcgttcgggggcgcagtccttgttgggatcgaggagggctcatgtggtggccgctcccccagccactcgacgcactgcatgccctgcccaccgatgcgtcccatcagtgaggatatctcgtcctcctacatttcgcctttccacccttttcccctctgcaaccctgcccaggtacttcactccgctgatcctggaggcggcaggggtgcggaacaagcagacggtgctcctgctctccctcttccctgctggcgtgaatgctgtgggcacgctggcaggcatgtactgcatagagaggtnnnnnnnnnncatgccctgcccaccgatgcgtcccatcagcagggatatctcgtcctcctacatttcgccttcccaccctttcccctcctgcaaccctgccca

SEQ ID NO: 4990 - DNA, 1602 bp, Chlorella protothecoides
  modified_base (343)..(352): a, c, t, g, unknown or other
  modified_base (529)..(538): a, c, t, g, unknown or other
atgcagctcttcttgaggtgtctcgaagggcgcactaccgtgctgaccctgccctccagcagcacatcggatgagctttacacgagggcctgtctcgagggcgctccggacgtgagcctgctgcactgcagccggacggtggagcctggagagctcccactatgcagcctgggcatctcgcatggatcctccctgcacattgttggccggctgcggggcggcaagggtggcttcgggtccaatctgcgtgcagcgggaaaggctaagatgaccgacaactacgacgcttgccgagatctgcagggccgccgcatcaggttcttcacaccgacagggacgccannnnnnnnnnagatggggtgccactggacctggcatggtctgggttcttcacaccgacagggacacccgctgcattgtctgcctgctcccatacccgcgggcgcaaccccgaggagagttcttgactgggcgaaccccgcccagcctgctgtgtttcatcttccctggatctttaagcttccccccnnnnnnnnnntgctcccatacccgcgggcgcaaccccgagcagaggtctcgactgggcgaaccccgcccagcctgctatgtttcatctcccctggatctttaagctttcccctctccccctcgttcaatcactccaggcagcagaccgcagccaagaagctggaggagtggcaggcgcaggccggggagcgggagctggaggtgatcgccctccgccatctcaagcagctggccaaggaggagaaggcgagccagaaggcggaggtggacgtggccactgtgcgccaggacctgcggcagagcctcctaaacgtgtcggcgggcgtcgcggcagcgctggcggccgggaagcgcgttgggtcgacgggcggcgcgcagcccggaaagcgcgggaggatagaccccctgacagccctgtccgatggcagcgactcggaggatgaggaggggcagccggcgggggaggggcgctctgcctctcctcgcaccgcggtcgacggccctgagcctgggtcgaggcctgccgccgctggtgcggatgcgagggagcaggcaggagaggaggggcgcgagcagatggcgaatggcgacggcggtggggcgcgaggcagtgacggtgctgcgttggcaggcagcgctcccgagcacgctgccagggctgtgccccccacagaagcccctgctgaggaggagcccgccctcgacctggcctggcgcagcgcgccgaccgcctcttcctgctcaagtccatggcccttgaagaggtgccgcgctcacacttggcaaagccgtgatgcgtggacagtaatcgtgtgtgaggcgtgtgcgttgcccaaagcctgtaaagagggcggagatgggagggagcccacgattgcacgaaaccaattctgtattggcaaggcgcttgatctcgcggctcgatctcacgactggtgtcgacagctggccaggcatccaagccagtctccctgtgcaagatcagcggcagagactcaacagaattggctcgtgcatcggacggatcatgtggaagagcacatgggcagccctcgcggtcagcggggctggtag

SEQ ID NO: 4991 - DNA, 258 bp, Chlorella protothecoides
atgctgccgcagggcagcgaaaccgaggcgcttgctcttggatcggacccccagtccttggcgccaccctggagactcctgctgctgagcgatggctcggtgacgcgccacctctcgctgctgacccagagcgaggtgaacgtcgactgcgtgggcatggacctacacagcgacgctgaccctttgcctgaggaggcagaggtcatgggcgaggggctcctcctgcgacaggtaggccgacgggcatgcaactcttaa

SEQ ID NO: 4992 - DNA, 210 bp, Chlorella protothecoides
atgtcccgaccagccacaatgggatatgccttttgtgagtttgtggacaccagcgtcacggatgtcgtaattcaggccctgaacggcagggcagtcgggaccaagttcctgacgggtgagctgccactggctgggttagggagggtgctggtgggtggcgtcatgggtgttaggaagggacgcagtggcttagacggtgcaaagtgttga

SEQ ID NO: 4993 - DNA, 678 bp, Chlorella protothecoides
atggggcggtgggatggggggccgtctgcccgcgggtggctgcacaccgcgcgtgggcgccgtgatgtgtcacgcatcacccacgcgcgcgcacccggccccctccccccgcaggccggcgaccacccacgaagccgagctccgacacttcatcaacaacctcatcagtcaagtgaaggggtgtgcgggtccgggctaccccatcatctcctgcaagctgttcccggtgaggtcaggggtgctggtgggtgggtggtgaggcggggagcccctggcaccgggtgtctggtcgagtccctggcgccgaggtctccttggatgctgcgaggtagctgtgccgcccaggacctgatgtgccccccggacctccacccacggcacccgcagatgcaccccggcgcctccgagggcgggctcacaggccttcacatggcccagaacaacgccgacaggacgtacgccttcctggagctgcgcagcatagaggaggcctccaacctcatggcccttgacggggtcatcttccatgccaaccccctcaaggtggggctcacggggtcagggaggctggtgcgtgggtggggaggcggggagcctccggcatcgggtgtctggtcgcgtccccggcgccgaggtctccctggctgctgcgaggtggctgtgccgcccaggacctga

SEQ ID NO: 4994 - DNA, 1008 bp, Chlorella protothecoides
atgctgtgcacattcaccaccccccggccggcaccccaccccctcctcgagcccttgcggggacgctgcccatgtcctcaagccttcaccttgtaccctaggaaccttgttacatcgagatcttattctttgcggcgatgctctcgtcaggccgccctatcctcggccgccgaagccggctcgagagcagcccaccccgaggccccgcccgccatacatttcgacaagcatgagctcgtgcttgaggttggggatcgaaaggtgtgtggtctagtgagaggcttcgtgttgcatgcttgtggccccgtggtgtgcggcttgggtctgcgcctggtgggccgacagcaccgacaagtccccaccccctcggtgttccagatcacgctcgagaccggggagatcgggaggcaggcgtccggcgcggtcatggcccgggacggggacaccatgatctacaccaccgcgtgctgcgatgccgcacctgaggagggcgcgcccggtgccaggcacggcagtcccctccaggtgcactatgccgagcgcttcagcgccgcggggcggacctccggcgggtacgtcaagcgcgacggccgcgccaaggagcacgagatcctgatctcgcgcctggtggaccgcccgctgcgcccgctgctgccggccgactggcgccgccccacccaggtcctgtcctgggtgctcagcttcgacggtgcgcgcggcactgaggcactggcggtgaccgctgccggcgcggccctggcgctgtccgccgtccccatccgcgccgcggtggcggcggtgcgggtgggcctgatcccgggcaggggcctggtgctggacccggactcggaggaggtggaggcaagcgtgctcgacctcctagtggccgggtcggcggagggcctgctcatggtggaggcgggggccgagttcgtgaccgaggcagacatgctggaggtgaggggctctggtatactgtgtagcttggacgggggggagccttcgtga

SEQ ID NO: 4995 - DNA, 504 bp, Chlorella protothecoides
atgcaactgtcaggcgtcttgtcgccgcggggtctactcaacccccttccctcacttcgcaaccatgctggcccaggcctgtatgccgccccccaaacgaccggcgaggcgctgaagggcggacgcctcgcagcagccgtcatgcagggggctgggtatggggtgacccccgcctcgggtgcttgtcggccctggtctgccatcaccgccatcagactgggttccccgcatgccatggctgcctttgcgagcgcggtgcaggcctccagtcccataggctcgtatgtgacccccaccccgggcgtgacccctgggtatgccgaccctgtggtgttcgcagatgggacttttgtggcagggagcacgtctgagctgggcgcaggtgtgggggctgggagggagagtgtggtcacgagggttgcgggttgcaatgttcttgaacaggaaggtcatgcgcctctccttgtgaatgagatgccagggggcattctcatgatgccatga

SEQ ID NO: 4996 - DNA, 1977 bp, Chlorella protothecoides
  modified_base (814)..(823): a, c, t, g, unknown or other
  modified_base (1470)..(1479): a, c, t, g, unknown or other
  modified_base (1927)..(1936): a, c, t, g, unknown or other
atgttcaccggtactagtagtctaaaacctccgcaaacaatatggttctcgtcaaagagcatccataactccaggaatggacgtcttaatgacctccatgtgcgccgaggcgagggcagagcggccaatcggtcggcgtggatgggtgcgccgccccagcatcaagttcatgaggcacccaccgggctgcacccccagacagccaagacacaagacccgccccagagcccacttaaaacggctgttcaccagccactctcctccactacagatctgggcatgcgcggaggagctgcaacccgtcttcagcgagatcgaccgcctcattgctgcaaatgtggcgcgcacgcagcgcgcctttgcgaccgccaggattgggccccaccacttcctgggctccacaggctatggtcatggcgatctgggccggggtgccctagaccaggtggggcccgtgaattcaggagggaatgtcccgaggcagtccgagcaggctgggcattggcttgtgcctggaactccacttgctgcaacccaccctcccttctggcctgcactggcctgcgtcagatcatggctgatgtgatgggcatggaggctgcggcggtgaggatccagtttgtttcgggcacgcacgccattgcctgcgccctgtttggcgtcttgaggcctggcgacgagctcctttctgtggctggaaggtgtggcgggcccgggctgtcaggagatcgtgagggtttgcctgctggacggaaatggaatcacacgaggcacacaggcttatgcccatggctgtgttgcacttgccatttcnnnnnnnnnngggatcccagcatgcattcacccatgaaaccaggcagacacccatcgcccacacccctcgccagtccatatgacacgctggaagaggtgatcggcgttcgcggcacccctggctccggttcgctcgccgagcatggggtcgggtaccgggtcctcccactggcgcccggcagcggcgccatagactggggcgcgcttgccaccgccgtgaaaccaggtgggaaactttggagagccaccaagtatcgctgctgccaggggtgggaccctggagtggcatcgagcaggcaggagagcagcgctcgtgcggctatgcggaccgccccaccctcagcctggaggacatccggcgagctgtgcaagtcatcaaggcccagagccctcgcgtcatcgtggcggtggacaactgctatggagaattcaccgacaccgctgagcccggagcggtggggcctgggagaatgtcgaaaggttttttcatgccctgtctgggtcgtggaggctggaactgtatggcaggccagcgtaccaccggatgtttcacaggccattgtgcacatggtgtgttcagctcccaacctccatctccttttccccaggtgggggccgatctgtgcatggggtcgctcattaagaatccggggggannnnnnnnnnctgtctgggtcgtggaggctggaactgtatagcaggccagcgtaccaccggctgttccacaggcgattgtgcacatggtgtgttcagctcccaacctccattttctttttcccaggtgggggccgatctctgcatggggtcgctcatcaagaacccgggggggacgctcgtacctggcgggggctatgtggccggaaagcgccacctggtggatgccgccctggcgaggctgacggcgcctggcatcgggagcgaggcgggcgccgtgaacggggagaccctgcgcctcatgtttcagggtgggtctttgggaggggtgggaggaggtgcaaagcgcgctacaagcctaccttggctgggggtctgggtagtgcatgtgggttgcatggcttttgccaacggcggctagcctggctgcgcgtgaaaaccatgttgaaaccttggaatnnnnnnnnnntagtgcatgtgggttgcatggcttttgccagcggcggctag

SEQ ID NO: 4997 - DNA, 522 bp, Chlorella protothecoides
ccccgccctcctccccatcgctgctctgcgtccttccgtgcagtacgacaaccacccccccgcgcatgtcatcctcggcgcgggcatgctttcctcctccctggcccagttcgtgtcctacccgctggcactgacgcggacgaggctgcaggcccagggggtaggcgggcaggcggtgcgatacaccggcatgatggacgtgctgcggcggacctttgccaacgagggcttccgggggctgtacaaggtgcgcagcaggggggcagcaggcaaagtttcaaggggtgtttgaggggtctgggctggcactttgaccctggtaatgtgcacagtggagagccagggtgcaggccgccatctccacttgccctccatgccggtgctgccaggccatgcacgtcgctggcccgaccagggcatgcagataattcccactcctctaccacacctcctcacacagggagcggggacgaatctctgcaagcttgcccccgccgcgggcatcagctggtttgtctttga

SEQ ID NO: 4998 - DNA, 210 bp, Chlorella protothecoides
atggcggacgttgggcaggaggcggaggcactgacagtcgtcttgacacgactggcctccaccccggacgaggccctcgagaagctcctcgtcaggttgcttcccgtcgtgattaaaaagctctctttgggagatcccaccgtacagaagcgggtgcttgccatcctctcacatgtcaacaaggcaggcaggggtggtggtgcaagttag

SEQ ID NO: 4999 - DNA, 969 bp, Chlorella protothecoides
  modified_base (431)..(440): a, c, t, g, unknown or other
atggacgcccttaaaggcgccggatacaccacttgcgtcgtgctgggccacagcaagggcggcctgaacgcgttcatgtttggcgcccaggtggccagcccgccgccgctcgtcgtctcgctggccggccgcttcaagccgcgggacggagtgctacagcgctttgggcccaacatcctggatcaattggttgccagccccgccatgcccaggaaggaggcaaacggcatggagtgggtgctcaccctcgaggagggggtggggtccgaaggaggagtggacgcgatatgcccctggaatgatgccgctccccgcaacgcacaatgccacacccctgagccaaatctctggcgaattcgtgaagcccgcgcgcgtccactccagcagaagctcggcccggttcatgcccatggtcgatcatcaggattgannnnnnnnnnccgtgaagcccgcgcgcgtccactccggcagaagccctgcccgcttcatgcccatggatgtcgaggagcgggtgaacatcgacgtggaggccctcgccacgcgctggcctgccggcacccgcctggtgctcatccacggccgggaggacaccacgatcccgtggcaggaggcggagtacctgggcgggctcctgccccacgccaggacagtctacatccctggggccaaccacaacttcaccgaccacgccgcagagctggagggcgctgttctggaggccgtcctgggcgcggccgcctgagagcggcggcgtgggcgggtgcggtgcagtgggaggctgtagacctgtgttgttgccatgagtgccactcacagttgacgggtgataccctatgcattgctcgagaacagggcgacaggcccccactgactgtccatgtgagcagagggcctggtcttggaggcattacaagtcgtggggcagaggacaggcgggcattggcatccagcagtggtcccgcctcatga

SEQ ID NO: 5000 - DNA, 768 bp, Chlorella protothecoides
  modified_base (182)..(191): a, c, t, g, unknown or other
atggggaaaaatcagcagcacaaggctgcccagatgtcccgtcatacgtcccgggacggcgatcctgcggacacaaccaacacgggagatggagttgatgtgtcattccacagcgccgcgtggcacgaagcccggctagcagcactacaagtggaacggcctaggcaagttgacttgtgtgnnnnnnnnnnattccacagcgccgcgtggcacgaagcccgactagcagcactacaagtagaacggcctagctatgaggagtggaaacagcgacaaaaggacgccgaggcaagagagttggaggcgcaagaagctcaagatgccctcatgcgggagtatagagagggcctggcagctgacagggccgcccggatgggcttgacagcacccggcattacaaagcacgattccaaacggaagtcgagcaagaaggataagaaagaaaagtcttccaagcacaaaaaagaaaagcacaaacacaaggtgagtctggaagctttgtgcactgagtctgaggtgaatcaaagatgctgctgtggtggccttgcagtctgttctcggcgtccagatggcatgccatgctgcacgggaacgctgtgtggctcttccccaccgcgcacacagaccctgacagggcctcccctcgccacccactttcgccgcagaagtccaagtcgaagaagaagcggcgcaggtcctccagcagcgacagcagcggcagcgacagcccgtcccgcgccgacgatgccccggcgtccgggccggtga

SEQ ID NO: 5001 - DNA, 381 bp, Chlorella protothecoides
atgcccaggggtcagcccgtcgctcactttaggatctcttggtcacatgcaaagcgctccacgaggctgccctcgcgttggcaaccccagcctccacccgacccctgccctgcacgtccacagcgcatccagcccctccccacgctgcgcctgccactcgctgagctggcaggggtgtacacatcccccggcgcgggccccatgtcccgcaactttgcagcagtgtacttggagagggcaggtgcccgggcgaccccggccgacgtcgcggacgtggtgagtggggggggcgcaggtctggtggaagggcatgggcccgggctgctcgggcacaacacacgtgggtgtaccttgcgatggctgtgcatccgtgtgcagtaa

SEQ ID NO: 5002 - DNA, 1221 bp, Chlorella protothecoides
atgtgccgccgtgctgagtggtcgctggacacaacattccgccagcagcagacttggaaagaagcctccttggcccaggcccccatcaccccgtcaccctgcctggtgcacagtcccttcccccccccttttcccctcccccagatcggcaacctgcaagcggtggcccagttcctgtccaaggcctccggcagcgtctccggcacggccgccgacctgctcacccccgcgcgcatggtcatcttcggcacgctgctgaccaccatcaacaagcccatgtttgcggcctcgggcgcggtgtacgccggcttcggcgcctcggcctgcctctactggatcacctttggcaagatcttcgaccgtgtgagcaagggcatccgcgaggcgcccagcaaggccctcatcggcgagctggccgccgcctcgggcgactccccagccgccgccttctccctgcgccagtccatggccaccttcggcgcgctggtgggcgccgcctcggccgccgccgcctacaagctgagcgggcaaaactacgtggccacctttgcgctggccgcactgcccgccaccctggccctggtcctggtgtccgccgccttccgcggcgtggtggtgggaccggcgcgcgacgccgctgggccacgcgcggatgcgaccgccgcagcctccgccggtgacggcccgcgcctgggcctggtgggcaaggcacgcgcgctgctgggtgccttccagcccgcctactggcaggcgctggccgtagtgggcatcctctactttgcgcgcttcgatgccagtttcgtcacgctccgcgccaaaacggtcatggaccgcgcctcgctgccggccctcacctccatcatgatggtgacccaggccgcgctggccacgcccgccggcctgcgcgccaagcgctccgtcgccgcgcgcaacgccgtggttgtgctgggcatctttgctctcatcggggccaacgcggccttcgcgctcctcccctccacaccgggcatgatgctgggcgcgctgctcatcggcgtgcacatggccatgacccacggcgtcaccatcggcatgctgtccacctacatcccctcggccaccatcccggggctgggcaaggtggcggggacggcctggtccttcaccgacatgctcctgggtgggtgtggtatggagggggagactaaggagcgggggttggggcatgggaggtgctgctga

SEQ ID NO: 5003 - DNA, 468 bp, Chlorella protothecoides
atggcttcttcgaacaaggcatccggtggcaggactctcacgattccggataacagccaggagacgctgagggtcctggacgttcgcccttccttcagctttggtacgccccgatgcgtgcagggcagtaagcctgagatcacctgggtagcatgcacgggagtctcatggcagagtgttcaccccaatggtccctcccctgaaggtggcagtgtgggcgacgaggtcatcacctgccctactcttcgctccaagctccaagccagggagagccccttcctgcggggcaactaccatggaggcgggttcacctccgacaacgaccgggtcttgctccagtctgtctactttgcagaccggcactcggctggcaacaggagccaggatcggctggaggcgctgagtgtgcagatgaagaaggcctccttcaagaatgccgccattgacgatgccaccagcgacctgtga

SEQ ID NO: 5004 - DNA, 1185 bp, Chlorella protothecoides
atgtgggccggcctactggtcatgctccgagcctaccccggcatcccgcgcgccgtcgacgtgcccaaacgcgtgcttccggtgctgtggtcctccgtgcgccacgctttctacggctcgggcaacgcctcctacccggccctgctgcccctcatgctcctgctcgcgccagaggtcgggcacgggatggcactccagcgtgggcagtttgcccgagcacctgccaagttgtccctaccccggcttttggccgacccctccaccctcgccgtgcctgcgcagggcacggaggcgatggcgatgtggtcgcaggtcctgcgctgcctgtggcaggggatggcagccacctgcagcgcctcgaccaacggcaccgaggccggccgggcggccttctgtgagtgcgctgccaggagcctgagcctcgctggggatgccgtcgtcgaggggcggggggcccacacctggagccgggagctggcagacgctgggctgggcaccctcctgcaggcgaccatcctgcccgctgcaacgggcagcggtcctgcggccgactgcgccgcgaggctggtgggccagctcatcgctgccctccagggtccctccctcgacgccgttctgcagctcaccagccggcacctgtgcgcggcgctgaagcagctgctgggcagcgtccggattcaagccgctgctccggcagcggctgcggatgtcttggcccagcctcgcgagggtgacgcctcttcgagtgacagcgccgacgtggcccctgcaacctggccaggcctcttgcatgcagtggacgtgctgggccaatatgctcccaaaacgacccatgcggaaaggctggcggggcccctgctcctcgagctggtcgatgcaggcctggacggcgacccgcacgccacccagctcgccgctgcgcttctggcgcaccagagagacagcggcggcgaggaggggagggagggccagggggccggtgcgtctggcgccctgaagtctcgggtcctggaggccctgacgcggtgcgtgggggggtcattggtgcctgggcgtatatgtgcaacgtgttggcacatggtgtgggggacgagtgagacatggcttgtaataacaatgtgctcagcctctgagcgtgcccgaagcgttgctgagctgggagggagctgggcgtcttccatgtga

SEQ ID NO: 5005 - DNA, 2211 bp, Chlorella protothecoides
atgctcaaaggctccgacccagcacacgtgtcagcattctcacttcattcccccctcctggagccctccgtccaggtggactcagtggatctggcggcggatccgccctcctacggcatcctgctgcacggcaggttccggctgacggaacgccacaggctggcaccgcgccccgagtctggcgcgcaggccatcgtccccccgcccccgttgcgctctgccaggcgggtgctcaaacgttccgtgcaggccgtctggccgctcgtcacagagcccgaagcggaggcgctggccgggatgtactgcaaactgatggcgggtctggagagggcccctgggcccgagggccagagctcaggaagccctcccgtgccgagcagcagcgactcttccagcctgacccacccgagcctggatctggcggtgctggcgcactgcccccctgcatctgaggcctgggcgctggctcgccgcgccagccgcacagcactggtgcgggagggcgacgagctggccgcgcgcctcgctgactcggccgcctgcctggcctcggcggcctgcgacgccgcagactcctcgggcatgttcacgcggcgcgacccggcccccgcgctgcagttcatcgcggtgctggagtcggaggcgccggcgcgccgcagcgcgcgcgtcgcgcgtgcgctggcggccgtcgaggccgaccgggagcagaccgcggcggccgtggcgcacaccctgggcgcccgcgccggcccgctcctgcaggccgcggcgctatgcgaggtcgtgggattcgatgtgccgggagctgcgcccgccctggagcaggccgtgcgactgggcacgctgctgggcgcagcgtgggccctcatgcctggcgccgaggaggccatcctgagcaggacggatgcgggtcccactcgtgaagccctggccctgctgcgcgccctcacgctggcgggtcttgccgaggagggggccacggagcgcgcgcagcgcgcggccgacgcggccgcggaggccgtgggcctcggcacggtggactgcctgctggcgctggcgctgccgagggctaccgggcgggccgcacccgagccgctggcccgcctggccatgcagctgctgctccgcttcccggccatgctgtgttcgctgcgcggcgaggaggacgaggaggaggacgaggaggagtacggaggggtcccagccggccaggacggctcgctgcggctggtggaggtgcgctgggtagtggtgtgttttggtgtgggagctgggcctttcatcgagccgggcacactgggtggacgcatgtcgacatgtccacggcacggggcaccagacaccgcgcctgcgccgtcaccctctgcctaccacggcactcaatcccccgcacaaaccccacatccacccccaaaccccccgcacaacccctcgcagctcggcctgccgctctcgctggccaccgccctgctgggcagcccggcctcgcccgccttcctccccgcctgggcgctgctcgccgggcaccttgacgcctgtggcccctctgaccctggcaggctccgcctggcgcgccacctgcacggcctgcccgccgcgaccggcgcggccttcgacgcgctgctcccgggcctgcccctggacgagcggcgcgggcggggggcccagcggcgcggcccgggcccagcgccgcgcgccggcaccgtggcggagcaggtgctggccgcgctggaggccagagctcccgaggtcctgaatgttaccggaggggactcgccgccggcagcgccaggagccggccccgacctcgatccaacagccgtccaggactcccagctggcgtacgcggtgtacgccggcatgttgcgcacgctgcccgcctgcgcccggcagtggtttgtcatgctgagcgaccgtgggaagagtggcgcggtggaggccttcacggcgcaggccgtgagcgggcctctgctggcccgggagtttgaggcgctggaggggctgaggagtaccagcagcggcaagttcaccgtgcgctgcaacgcccccgcacgccaggcctgggcaggtgggtggtgtttgggaggtggggggtggcccggtgtccccgtcggcagctcccatggcgtgtctagcccatggctggtctattggcggaacagcgtgccgcttccccttccttatcgccttcttcccttctacttgatatag

SEQ ID NO: 5006 - DNA, 306 bp, Chlorella protothecoides
atgagtgaagaagagaagctgaagtggagggaagagaaggcggttcgcgtgggggctcgaaagcagaccacccaagagaagaaggcgcgcctggaacaggccctggtgaaggggcagcggctgattgtggacctgtcatttgaggataagatgaccgacgctgagctcaagtcgctgtgccagcagctcgcctactgctactcggccaacgcccggtccagcaaacccatgcacctgatcttcacaggggtgcaggtgggtgcatggaggatgtgcagtgggttgccagggcagtgcacatcttga

SEQ ID NO: 5007 - DNA, 273 bp, Chlorella protothecoides
atgggcgtcctggaaatcttgtgggggcaggggggcaggcgtgccagcgtgcatgcaaggagtgcacaaccatcagcccctgagtgggtggctgtctggaggcttggtggaaagggtcctttgccgggactggtcgatgggatgatgcgtgggtcgctggacccctccaagatctacattgttggaggaatcgtggatcggaaccggtacaagaacctgtgtgccggaaaggccgaggaagaggtcagcgtctatccggggcaggcgggttga

SEQ ID NO: 5008 - DNA, 1335 bp, Chlorella protothecoides
atgccattcccctccgatagtctgctgtccgtacccaagtatgccatccgggcgggggcgcgcaagcgcatctactttgaccccaaggagacccgcatggccattgtcaccgccggcgccatctgccccggccagaatgacatcatccgcgccatcgtcaccaaggtcaactggacaccgggtcccctcgtcagcactccccaccctgaccttctcagcgaccactcgtcgctcgctcccccttccacaaccccctctcaagcgaaagagccgacgcaccttctcccggcgcaggcctttgactacggcgtgcccgagggtcacatcctgggcattcgcaatggcttccgcggcttcaccaatcgcacccgccgccccatggtgctgacccactcgatggtcaaggattgccacctggagggcggcacgctgctgggcacctccaacgaccccgccgacatccgggagatcataaagcgcctggacctgtggaagatcgaccagctgttcgtcatcggcggcacgggcggcaacgcggcggcctacgccatccagcgcgagtgcgagcgctgcaacgtgcccaccgcggtggtgggcgtgcccaagtccatcgacaacgacatgctgctcttcgacaagtgcttcggcttcgacaccgcggtggagggcgcgcaggccgcgctgatggccgccaaggtggaggcggcctcgggctaccgcggcatcggcatcgtgaagctgatggggcggcgctccgggttcatcgccgtgcaggcctcgctggcctcgggcgtggtggacgcggtgctcatccctgaggtccccttccgcctggagggggagaaggggctgctggcgtacgtcgagaagatcatggcgcgcgaggggcacgccgtcatctgcgtggcggaggccgctgcccaggacctgatgcatggcgaggggccgcggcggctggatgccgcggggaaccccgtgctgtcggacgtggggccctggctgaaggccaagttcaaggcccacttccaggacgcggacatcaagtacatcgacccctcctgcctcatccgctccatccccgcctcctcccaggacaggatatactgccgcatgctgggccacggcgccgtgcacgccgccttcgcggggtacacgggcgtgaccgtgggtctcatcaacacccactactgctacatccccatccccatggtcatccaggtggggccggcgccacgcacggttgacccgcatggcgagctctgggcgcgcctgcgctcagccatcggccagccatcgtttgtggacgacgaggatgaggagttctgccccgagtaa

SEQ ID NO: 5009 - DNA, 270 bp, Chlorella protothecoides
atgtgcacaaaccacgtagtcgaaatcatgattcggcagcaggagctgggagactggcgggctgcgtttgaggccgtcataccaacccgcaaacgcaaggcaggggacacctccgacgcagtcccagaggacaacgttcctgcagtgaaggaggagccctgcgcgccggcatctgcacctgccccacagaagcagaagaaggacaaagctgctgtgaaaggtgcagctgcaacgaagcctcgcaaggagacagcttcagttggcaaatag

SEQ ID NO: 5010 - DNA, 723 bp, Chlorella protothecoides
  modified_base (222)..(231): a, c, t, g, unknown or other
  modified_base (459)..(468): a, c, t, g, unknown or other
cgtcttccccctcaggtagtggcatgcttgggagcggagggaggggagcagacttcagaggcgttgggctcaaggaaagtcgaggctagagacgggtggcagggtgctgttccggctcacaccagcaccagcccaaggtcccccatcagaacaccaaactttctgtacactcaactgtacctgtcccatgacgcacaggcctacactgacgccaagagcctnnnnnnnnnngccagcccaaggttccccattagaacatcaaactttttgtacactcaactgcacttgtcccatggcgcacaggcctacactgacgccaagagcctgcggtatgggcacctcatgatcatgaccgatcaggatcatgatggctctcacatcaagattgcagagcacgtgccatgctgttgtcctcctctggtctcagtattgccctcccttcctcccatccccccctgnnnnnnnnnncatggggatcccagcgatataaaccctagattgcggagcgggtgccatgctgttgtcctcctccggtctcagcattgccctcccttcctcccatccccccctgcagggtctgatcatgaactatttccaccatttctacccaagcctcctcaaggtcccggggttcctcgtggagttcatcacgcccatcatcaaggtgggcatggagtgagagcctggcggatgggtggggtggagctgctgcccttgatgtga

SEQ ID NO: 5011 - DNA, 576 bp, Chlorella protothecoides
  modified_base (202)..(211): a, c, t, g, unknown or other
  modified_base (387)..(396): a, c, t, g, unknown or other
atggtggacggcctcaagcccggccagcgcaagatcctctacgcctgcttcaagcgtaacctgaaatccgacatcaaggtgcggagggttgacgcgggtttgaactgcttggctgtgatgtcacatgaccctgcaacccactctgtgccctggactccgcctgcgtggcatggcacttcccatcttcgtgctcagtttgtcnnnnnnnnnncgtcacatgaccctgctacccaatctgtgccctggactccgcctgcgtggcaaggcacttcccatcttcgtgctcagtttgtcacacagcctcctccaaccaccccttgccccctcccctccctccctggcaggtggcccaactggcgggctacgtcgccgagcactcggcctacnnnnnnnnnnactcctccaaccacccttgcccccttccctccctccctggcaggtggcccaactcgcgggctacgtcgccgagcactcggcctaccaccacggagaggcctcattgcagggcaccatcgtgggcctggcccaggatttcatcggctccaacaacatcaacctgcttgtgccccagggtga

SEQ ID NO: 5012 - DNA, 1782 bp, Chlorella protothecoides
  modified_base (670)..(679): a, c, t, g, unknown or other
  modified_base (901)..(910): a, c, t, g, unknown or other
  modified_base (1596)..(1605): a, c, t, g, unknown or other
atgccaaactggcgcgccacatcacctaatctcatcatgcccactgccccgccaggtggacaacctgaggcgcctgctggagggcacccccactcaatttcatcctttcctcccccgactctttatcaccagcatctttcaccccctccccccccttcccccccccaaccaactaaccccgtaggtccccggcaagacaagcggcaagtcctaccaggtgacaggcacgatcaggcagctggacgagaccacgctggagatcacggagctgcccatccgcaagtggacccaggactacaaggagttcctggaggagctggtgaagccggaggaccgcgcggcggtgcccttcatcaccgactaccgcgagcaccacaccgacaccagcgtgcggttcgtggtgacgctgaccgaggccaagatgcgcgaggcgctggccgtgggcctggagaccaagttcaagctgaccaccaagatctcctgcggcaacatgatgctgttcaaccccgacggcgtcatccaaaagtacgactcgccggagcacatccttcgagacttcttcgacctgcgcctggagtactactcccgccgccgcgcggccctgctcaaggccatcggccagatccttccagacgctggatcctcacaagtgcccaacagcgcggccgcnnnnnnnnnnaaagggggctgagggtcgatcaaggtcaggaaggaaggccattggccagatccttcgagacgctgaatcctcacaagtgcccaacagcgcggccgcttcggccaacatggggcggggcctggctctcagcccggctctgcgcccagtggttttgtccatctccacacacaaaccaacctccactacaggcagcggaggccgacctgctgcgcatctccaacnnnnnnnnnncggttttgtccatctccacacgcacaaaccaacctccactacaggccgcggaggccgacctgctgcgcatctccaacaaggtccgcttcatcctggcggtggttggcggcgagctcaagctgtccaacagaaagcgcggcgacattgaggctgagctggagcgcgaggggtacgaccgcctgccctcggccaagaaggcgctggcggtggccgccacaatgggagaggaggaggaggacgaggagggcagcgcggcggcaggcagctacgagtacctgctgtccatgcccctggccagtctgacgcacgagaaggtggaggccctgcaggaaggtggggaagaggagttttggggggatggctgtgcaccttttcatggaaacagggtgtcttcaaaggtgatgtgtgcggggcctggttgcccagggttctcatcccctcgcccgcctcccacagagaccgaggagaaccgggccaccgtcgcccgcctgcacgccaccagcaaccgcgagatgtgggctgcagacctcgaggcctttgtcgaggtgagctgccctgacaatgtgggaggagagggtggcgcaccggccgaggcgcatcagccaccggcagctggcggggggggcatcgctactctcgactccgcctgccctcaccccacccatgcagctctggagggcgctgannnnnnnnnntggccaccggcagctggcggatggggtagtcgcaactctcgactccgcctgccctcacccccacccatgcagctctggagggcgctgatcgacgaggacacgcggcgtacagccgtgctggtcaagcagcaggcccaggcccgcaaaaattccaaggtgcgccagcggtggggatga

SEQ ID NO: 5013 - DNA, 1083 bp, Chlorella protothecoides
  modified_base (176)..(185): a, c, t, g, unknown or other
atggagagggcagtgggcctacgagcggtggcatgtcaggcatgggagacttcctgccgagaccctgcggcaatgctttggaccatctgcagtccgggcggtgcgggctgcacacagcttccaagaccttgccggagcaaccacaccagcaggcgatgctctgctcccagtacctnnnnnnnnnnccagcttccaggaccttgccggagcgaccatgccagcaggcgatgctctgctcccagtacctgctgcacacgctcacatcctcacagccgtgccgctacaccctcccctttctccccacccagctcctccgacgacagcgagacggagctggtgaggggacaggggcccaaccgtccccggctcacactctccaccttcggcctgctcttcacccacctggaagcctgggtgggcgaagccacgctggagctcctgggttccggcccaggcgcgggacctgccagccacgcccccgcgcatgacaggccggccgctgaggcgctgctgcgtctgctgcaggctgtgacccccggcatctgtgccgagctggcgattgcccagctggcgcaagtgcaggccgccctgacccagctcgtggcctcctttggcgtgcgaggggcgctgccctccttcaaggtgccgtgtgtgtgctggtgtgcatttctgtgttgtgtgcatgcttgtgttctgagcgccgggtgcaggcaacccccagcaccttgttggcgtggcgctcattcacaccatctggggaaacaagagcgcccagttcccatggctgggcccatccccgaccgatcccctccctgcaccccgaatccaacagacggggcagtggcagctgctgctcatcatcctgctcaaggcactgtccatgcagcgggcgcccttcctacggccggctttcgagtcgcgcgagggcatcagcaggctgaacgctgccctagccaaccgtctgttcaccatcgaggagttttatgccgtgctggagctggtggtggtggaggagacgcagtgacccatttgctggcgtgcccttggcggccattcccgcctgaattcatgctgcaggcatga

SEQ ID NO: 5014 - DNA, 981 bp, Chlorella protothecoides
atgtcgaggttgcgatcggctttgccggccttgcgccagctggccctgctcggtggcccaggcatcacaggtggggattttttggtgtcgggatgcgtgcatgtcggcgacaagcactcgaatgagctcaccccagcttgtgatacaatatgcaggccctggcgcattgcaagggtgcgctggccaggcgggcaaggcccttgcccagctgcccagcgcagccggggccacccttccggcattcgtcggcctggagctggcacggtctttcgccacagccccggcgggaggacggcggcaacgccctggtcgtcaggctggatcacaggtgggaggcagatgagtggaagtactgcttctcacccagcatcggggtgctgggaaccgggtgctgagtccgccagcctgccccaccccccaggagctcgtgagcgccgaggaggagttcagtgccatcaccgacaagatcccccagcgacctgtgggtgtggtggagggcaccagctacaccgtcatcatcctcgcagccctgggggtgagttggctgactgggttcttgggcacggtgaggtggcaggcggcatgttgtggtgtttccaaaacagccctgctgggcgctggatgcttgacgacttcccccatgcctcccagttcgcggcggccgtgctgtatgccgctgtgaacgagctgctgctgcagcccgccgagtacacgtgctacaacaagacgctggacctgatccgcgacgacccccgcgtgactgtgcgcctgggcgagccggtgcacgcctacggcacggagagcaggaatcggtcggcgcggcagcgcatcccacaccgcgagtaccaggacgtggagggcaggcagcacatccaggtgtgtgtgtgtgttcgggggagcatgtcctcagcagctcctgcgccccctgcagcgcccacggggctgctactgctgccggaagggagcgcactctcgccgtag

SEQ ID NO: 5015 - DNA, 378 bp, Chlorella protothecoides
atgccgctccctgtcacatgcttccgcctggagctccagcatcccctcccccaccccttgcagatccagttccacctcagcggccccagcggccgggccactgtgaacgccgacatgtacctagagagtggggcctggaaacacaatttcctgtacctcgacgtgcaagagcccatccggcagcaggtggggctgcggagcgggccaggcagctacttgatggtgtgcctggggctggccagggttgggacagatgcgatgcgtccaaaatctggagcgcacgggagggcggctccctttcttgcacccaaccagccgccacctgcctcgcaggtggtgctggtgaggcctgaggtccagatggtgccagctgcttga

SEQ ID NO: 5016 - DNA, 942 bp, Chlorella protothecoides
atgaacgacaccctgggcccgccgccccccgcacctggctacaaggtgggtcatgctgtcctaccgttacgcgtatctgctttcacgcacgccgagccgcgggggagcccatcagggttgtccgggaggtgcatgaccaccgatgttaacattcgccagccccccttcctcggccctccccagatcactctgggcacggacccggacaccaatgcctgccagaacagcaccagccccatctgcttcaacacagcagtcagtgggcagaacatcatcacgggactctggttcaatgccatcattggcatcgtcatgctgggcctgtttatcgcctggcgcgggaccttctccttctaccaggcccggctggtgagtgccctgctggtttggatttttgtgaatcggactggggagagctacccgcgtggcgccctcgctgggaatgggaggcccgggcgcctgcctgtggggcgggcggcccttgctgctttgttggggtgtttctgtgcggcacactcggaccccacacggcgccagagtttccacacccacagccgcacgcacgcgcactcctcttcacgccctcccacccccacgcatcaggactcgccccacgtcacgcgcaagccgccgcgcatgaagctgacagggcaccaccgcatctggtcctggctggtcccggtcttcaccatctcggacgaggagctcgtgcgcagcgctggcctggacgcgctggtgggtccctgggtggagggaacatgtggtgaggtgctgggggttggcgcagggggggcagggctggaattgcgagctgcatggtgcagccaggcgtggcaggaggcacacaatgcaggggaccctttggcccagtttctccctccaccctccccctccaacctcatcgcatgcaggtcgcgacgcgcatcatcggctttggcgtga

SEQ ID NO: 5017 - DNA, 3663 bp, Chlorella protothecoides
  modified_base (302)..(311): a, c, t, g, unknown or other
  modified_base (431)..(440): a, c, t, g, unknown or other
  modified_base (1045)..(1054): a, c, t, g, unknown or other
  modified_base (2095)..(2104): a, c, t, g, unknown or other
  modified_base (3326)..(3335): a, c, t, g, unknown or other
atgctccctgccgacgagactgctttgggtacgggtgattttattgagcaatctagctcccaagagcgtgtcttccgtcgagtacaggggggtccatgtgaatccaaggcgggttgtagggttatatcaccacccagagcagcagcaacagttccccgggaaacgccgggtttgagcacagatctcgatggatccaaatgctatactatcgatgcaagccatcccatgagcggggtaacggcgaccgcccccatccgcccccatggccggcattggtggcctgctggacagcctacgtgccnnnnnnnnnngtctcatgagcggggtaacggcggccgcccccatccgccaccatggccggcatcggcttctggagaccatcctgaaccagttgctagaccggagtgtcccaggggcctgtccggatcacnnnnnnnnnnggggacccggcccgcagcggggcaggagggagatgaagaaacgtacattaccgtcgtctgggatgcgctgtgcaggcatcggcatctggagaccatcctgagccagttgctagatcggagtgtcccaggggcctgtccggatcacgagcgcgccctgcgccacaaggacgccggcaactccttcttcaaggctgggctgtacgaggacgcaacgaaagagtatgaagagtgcctgcactggctggacgctcgggcctggcccgtccaggccgcccaggcctactccaacagggccctttgctggctgaggcgggggcaggccacggcggccgaggaggatgccggccaggccctcatcctggacccagccaatgccaaggcggccttccgccggtccagcgcccgcatggcccttgaggactggccgggggcactggtggatgcgctggcagcacaggcatctgcgcccgggccggatgtcgaggcggccgtggccagatgcagggcggctgtcggaggggtagaccaattggccagtggtggtgctccggcctgcgctgagcgtgctgcgggtcctgacactgatgggagcctgaggcaagcannnnnnnnnnaaggcacagtgggggaaagaggagatggtgctccggcctgcgctgagcgtgcttcggggcctgacactgatgggagcctgaggcaagcagcgccccgtcccgtcccgtcccagcctgctgtcgggggcaggcaggcgcaggaccctcgccttggccgagagctggtcgccacgaggcaagtgtcccgtggggagtgcgtactgcgtgaggcaccagtagcctgggtgctgggtcgtgctgccagccaggagcctggagtcgccactccctcgtctccacaaagaggcaggacgtcaccctccccaaccccagtcctcacccaccagggagcatgcatgaccgctcctccctcctcttctttccgtccgtctgcagcgctgcgcacgctgcggcacgctgctcgggcacccccccaggcgcgccgtccacccctgcctcgcatgccccctggccctgttctgcagccccgcctgccgcactggccaccctttccaccaggcgggcgggcgggagtgcggccgcgcgtggtcccgcctgctgcccgccaactccctcctggcgctcaggctggtgctgacgcagcgggggctgcccgcgccgcaggccagcgcgctggccggcctggcctgcggcacgcacctgttcagcgccgaggagaggctggtggcggctgcgacggcctgcctggccgcgctgtgctgggccgggcccgagcgcgtgagcctgagggccgaggacgaggctccactcctcggcctggcgaccgcagtgttccgcgcctcgggccaggtgcggctgaatgcctttgggctgcacccaccctggaactcggggcgggacacggcctatgcccaggcggtctaccccaccgccacccagatgaggtccgtgcacactccagtctttggcgagggagcgccggatctcactcatctccggtaccggtgctgggtgcacgcattactcgcttgggaatccggtgcagcagcaccatgctgtttgctgaccaggggtctctccccctggacccccctgccttcnnnnnnnnnnacgtttcaaaagcccagatgaggtccgtgcacgctccagtctttggcgagggagcgccggatctcactcatctccggaaccggtgctgggtgcatgcattactcgcttgggaattcggtgcagcagcaccacgctgtttgcttacaagggtctctccccctggacccccctgccttccatcccagggactgactctctgcatgaatgcagtggctgctacctcagctggcacgccgctctggcactgctatggcgccagcgcggcagccatgagccggccgcagcgccgggccatcctggagggcacctacggcttccgctgcgcctgccgggactgcgtgaatggcagcgaagaggaggacgccgagctcacggggctgcgctgccccttcacccccggctgcacagggtccgtgctggttcccacccgcctgcccgcacgcctgacctccgcgtgggaggttcctgccgggagcggaatttgcagccgatgcaggaaggatggcaccgatccagctcaccggaccagcctcgagcgggcagtcggggcgctggcgggcgtggcccgccaggtggaggcactggagctccacatggcggggctggcggagagaggggcctggaatcaccccgaggtggatgaggcggtccagtcgctgcgcgagggattgcaggtgggcgggaaacaggtggctgcgggggatgttgtgggaggtgagtgctccgcttgcacgcctcaacacccatggccaatgactggcatctgcgctgagccagccgccagggctctcataaccctgcaaggcacgtgcactggcgatgcctcccccgccgcagcctcgccagcgtgcccctgctcaagtacctggcgcgcttccacctggcccgcgggcgccgctgccacggccgaggcggcggcggcgctggaggcggtgcgtgtcgccacgggggccggcccgacatcacccgcgctcaggcgccacgcctacctggagggcacgggcctcggcggccgggcagccgaggccctgctccatgagctggaagacgctcgcaggctccctgatgcgacgtcggagctggcggtgtggtttggagaagggggggcaggggccctgctggaccacatccgcgccctggtggggctctctcctcatgctcaagccacacgcagagctggagactttaccgtggaacgcgatatcacagccgaggccggtannnnnnnnnntttgcagagtgaccaccgcagaccctggaacgcgatatcacagccgaggccggtatcccccatgcgtagacatgcacagcgaggcacagtgaagaacagcaaggcatgcacacaaccacttggatcacgcgccgtcgcaaaactcctccagtgtggcccgcagctccgccgcgtcaaactccgaggtgattacgcagccgccgagggggcccttgagcaggatgaggcgcagcgtgccgtccaccaccttcttgtccacgcccatgaagcccatgaacacctcgggcgtcatgccctgcggcggtggggatggtgttgtgctgggtga

SEQ ID NO: 5018 - DNA, 405 bp, Chlorella protothecoides
atgccccggattcgccgaacccggcacccggcgcaggagaagcgcaccaatgccgtgctggaggccgtggaggcggagctggcggccggccagcccctcacccccgcggacatccaggctcggtgcgcgggcgtggaggctttgaccctggacgaccctggcgtggaggcggccaccctggcctttgaccgcggcgactggcaggtggtccagcagcgggcgggggtcgcgtcgggcgcgtcggggtgccgcctggcctgggtcaacggcctgcgccccggcctgcgccacgatgcctatgagccggaggaggacgcggctctggcagatgccgtggcccgcctcggggtccaccaggtgcgggcgactggctgtggcttgaggagggggaggcgttgcttgtga

SEQ ID NO: 5019 - DNA, 936 bp, Chlorella protothecoides
atggagacggtggagaagggcgccctgctgcgccagcacatcgcaggctcctccgccctggtggtcaccaacgacacggtggccaaggagtacctggagcccacgttggccgcgctgcatggcggggacagcgggatccgggtggagcacgttgtgctgcccgatggcgagcagtacaagagcatcgaggagtacctggagcccacgctggccgcgctgcgcggcggggacagcgggatccgggtggagcatgttgtgctgcccgacggcgagcagtacaagaccgtcgaggtgctgcagaaggtgtgggacaaggcactccagtccaggtgggtcggacaggggcatggagtcaatggctgcttggggtcgtcgtcccattgtgcccgagagtgcgagccgggcgtgcctgtgctgcccgcgcctcgaatgcccaggcgctgcactgcagtgggcagcatcgcctgcgaggattcgtcacgctgtgcgcgctgtgtttgccgtcttctcaagtcgtccacccctcacctcggtgtcaggctggaccgcaacaccacctttgtcgcccttggaggcggcgtgatcggcgacatgacgggcttcgcggcggccgcctaccagcgaggcgtcgcctttgtccaggtgcgctggcggtgctgcgtctgtgcgatcgcatgcactagcgtgtgccttgtgaggcacttcacccacccccgtactctcctcggcctgcagattcccacgacggtgatggcccaggtcgattcgtcagtgggtggaaagaccggcgtgaaccaccccctgggaaagaacatgatcggcgccttccaccagccacagtgcgtcctcatcgacacaaaagcgctggacaccctgcccgcccgggagctggcctctggcatctcaggttcagggatgattgtgaacgacgggtga

SEQ ID NO: 5020 - DNA, 558 bp, Chlorella protothecoides
atgcagagctgtttgagtggctggaggccaacatgcctcgcctcctggccagggacccccaggtgccttcgaagggtggggggggtcagttttggggcgggttggaggacacggggcgaaggccacaccctccgacgggcacctcttgccgcaacacgcttctgcctcgggcaggcacaaggatgcgcacaggctgcacctgctgaccatgcatcacttgccgccccacaatcccaaccccctctacaggcgtggacacatgccatccggcgctcctgcgagaacaaagccgaggtggtggccgccgacgagcgggagggcggcgtgcgtgccacgctcaacctgggccacacgtttgggcacgccatcgaggcggccgccggctacggcgcgtggctgcacggggaggcggtggcagccggcacggtgatggcagcggacctgagccggcggctgggctggatagacgccgcgctggagggcaggacaacggcgctcattgccgcggcggggctgcccaccaggccaccaaaggtgggtggcctggggctgtgttga

SEQ ID NO: 5021 - DNA, 699 bp, Chlorella protothecoides
gccgccgcatacgccgccggtcccggaccggtgccctacggatccggggccggtgcggcgccctacggcacgggtccggcagcagcgccgtatgcattgggggccggagcagcgccgtatgcggcgggggctggagcagcgtcgtacggctccggaccgggcgcagcgccctatgctgctgggctcggaacgacagcgccgtacgccgcggcgcccggtgcagcagcgccgtacgcctcggcacccgggcccacgtactcgacgggcgcggtggcgcgcctgccgccctccctccaggcccagctcgcggcgctggtggccaaatccggcggcttcctgcgtgtagaccacttcaacgacgggcttgtggacatgctgctggcaagtagctgtgcagtgcggcgaggggggaggcagccgtgggtgtttgtactgcgtctccagcctggagctggggcggtcgcctcagagcaggccggcaggcgctgctccggcgctgcgacggacatgggcgaggcgtctgcagcgggggtgctgtcccgcctgggcatgagggacctgagcatggtgcggaacatgccgggctacatttacggcgccctgcgccagcctccgacagacgccccccccaccggggccccgagcagggggttggaggcggggggcaggggcggcggggtgcggtaccgaccctactga

SEQ ID NO: 5022 - DNA, 1173 bp, Chlorella protothecoides
atgttgctccggccccggcatagtcttgcacagacattggatattgttggagcagggcacaatgctgctctgcccggcattctccctgccgccgtcatcctcacaagccctaaatatacacctccacaaccaccctgcagcgagcgttggtgtcctgcccaaaagcgcgccgcccatcctcagccgcaccgtgaagtccgagtgtgccctgtacctgactgctggccggcacctgaccgtggtgggacccctcccagaccttgcctcctggctggagacgtctgcgcctgccttcatccaggtgctgaagcgcatggagaggggggtctggattggcgagctcaggcattgcagcacacatggtcatccaaacaatgctcctcatgtttactcgagtggctggctgccctccccagagatcgcggggcgcagcagcatgatgcggaccttgctgctgagcaggaacctgcccattgtggcagtcgccgtccctccagcccttcaacaacacttgcccctggccccgtacacaaaacccaggacgggaactggggactgctgcaactggcgctgcaggcctccaaggcgagggcggtgcgcagactgaccaaggtgtacaccaccatcgcgtttgagaaggctgcagagctggctttagctcctcgtgcctgcttcaacgctgcgcgctccttgacagtgtctggaaaggatcagtttctgtcaaggatggtggactctggggagctgactgccagcattgaccaagaacatgggacagtaagatttggcgacgcgtccacttcgcaagtcgattccttaaagcaactggagggtgtgctggagcgatgtatggctgcatcccggcgtctttctgccatgaaccaggccgtgagtgtcgtggatgtttttgaaggagttgttctggtatgggtgatgagtcattttacagcgtaccgcgcagccaggaattctgtgccctggctacagtacccttctcctgtatcacaccacccttgctctcagaatagatggtggccatctgatctgtgccatctgtgcatcccacatatgacccaccattctgcgtgtttgattgcaggtgcaattggagcaggcttatatgggcaggactgcggctggtgggggcgccgcagtgggtccatcggcccctga

SEQ ID NO: 5023 - DNA, 318 bp, Chlorella protothecoides
cgattgggcacccagcgctcgctggtggtgcactccatggggctggacgagctgaccccgctgggccctgcctcggtggtggaggtgacgcaggccgggaagcgggagtactccctggagccgcgggacctgggcatcccccgggccacggtggaggacctcaaaggcggggacgcgaggttgaacgccgccatactcgaggtggaaagggggtccgagtgggtgggaggggggagaacgaagcctctgcaggatcactcgggggcgtccaccggtcgcacggtgctcgatgccctcctcaaaatcatagacatgact

SEQ ID NO: 5024 - DNA, 1182 bp, Chlorella protothecoides
  modified_base (874)..(883): a, c, t, g, unknown or other
cagcccgccgcccgcgcagcgaggccgcggggacgcgcgcggcgcgccgccccccgccggggtccgggccgtgtccgccagcgggcacaccaaccgtgggcgggtgaagcagaagagccacaagtcggcagagctggtggacgtcggcgtcctgtgccagcgccaccctcctcacctccctctctccaatccaatccaaaccatctgaccatgtctgccaggccggagcgcggttggcacaacgcgggctacattttccccctaggcttcgtgtcgcgcaccctcttccgctcctcggtggccctagaccagctctgcgtgcacgactgctatgtgcagggcgagggtggcgagcactggcccgggcccaccttccgcgtggtggcgcgggaccgtcccgacgagccgctggtggccaagtcctgcacggggtgctggacgggggtgctcaagcgcatcaacgccgagatcgaggcgcgacgcgcggcgggggaggacctgccgcccccgcccaagaccgccatcgccgggccagagtactttggcctcaaccagaccaacgtgagtgtgcctgtgtgtggagggaagggggggtgggtgataggcagggtagaacctgagaggctcggtgaatgggagcgaggacatgcacgagccaggcgctgggcagcatcgcggcgagaccctcggcctgcgtgggcattgtcgcggcatgaaaaggctgtgaactgtgatggcagacgcagggcagaactctgtcgctgtcatcccctgcaaaggtatgaaaacactgtacccctctacaaccctcgcacaaccagccccctccccggatacccaaatggtgcagatccaggaggcggtggaggcgctnnnnnnnnnnccccccctacaaccctcgcacaaccagcctcctccccggattcccaaacggtgcagatccaggaggcggtggaggcgctggacccgcaccatctttgcgtcgagtactgggcgggcaaggaacagcgctgccgcgcggcagccgggctgcccgcccagcccggcccgccgcccgcccgtgctggccgcgccgcgggcccccggccggcgcagcacgggcggcggcgggccgggcgtgaggacccggacggcaccgcggacgacgaggcggaggaggaggcggggtacgccagcaagtga

SEQ ID NO: 5025 - DNA, 1314 bp, Chlorella protothecoides
  modified_base (433)..(442): a, c, t, g, unknown or other
atgggatggggcaggcagcctctgtggcggcaaggccgcgccgtgccagggtgtcactcgggcccagcgggcctcatgcattccgagtcgcaatctgctggcagtgtgcatccggaacaccaaggttcaccgtcccgactcgtgtctgagaggcaaggcctcctggggcgctggccaccgggctgccctctgaccaccttgccccacctcatgcatgcagacgaggacaacccgctgccagacctgctggaccccatcaccctggagccggtggtgcgccccgccatctcgccctacggccacgtcatggggatggcgacgtggaaggtgggtggatgtgtgtggggcttgggttggcgctgctgctgggcgggggcgtggcggggcgtgccggtgggcacagcgtgcaggcaaggcagccacgaccccgaannnnnnnnnngcttggggtggcgctgctgctgggcgggggcggggcggggcgtgcccgtgggcacggcgtgcaggcaaggcagccacgaccccgaagcctgcagcgcagtgacagggcgcccagccgtgcagagccccaggcccgcctcttctggcccagggtgcccgccctcccaggccctgcgcctcgtcccacccaccctccccatcctcgcaggctccgctgacctgggagtcgtgcaaggtgctcaccaagcacaacatccacctgcacgccgaccgcatcatccgctgagcttgtcgttgagggcggcctgtttgcagagccaacctccttgccatccctgcctggatggacaccctcgaaaagtcctcagtgcgacgcgttcactcggtggccggggcaggggcgctgccgccgccgcggccgaagccgccggagcggaactcggggcggtactcgccgggggcaccggtcttgtcggagcggtagccgccgcggtcgccgccgccaaagcggtcgggcctgtcgccgccgaagcgggggcggtccccgccgaagcggtcgccgcgggggggcctgtcgccgccgaagcccttctccaaggggcgggtggacttcatgagcgtggcggggaccacctcggcgggcaggttcaggtactcgcgcaggtactcgatgccggagtcggtgaggaaccagtagaagtggcgccaggcgtaccgctcggtgaccagctccttggagcgcagggactggagcagcttgatgacctccaggttggacacgccctccaggtccttctcggggtgctgcttcaggttgaagtccttctcggcgtacatcacgccatctgtggtggggtgggtgggcgtggatga

SEQ ID NO: 5026 - DNA, 2379 bp, Chlorella protothecoides
  modified_base (54)..(63): a, c, t, g, unknown or other
  modified_base (1336)..(1490): a, c, t, g, unknown or other
atgcaccctgcccagtccccctcctctccagtactttcccccttcactccaagnnnnnnnnnngtttttgatgggggctggtcttgctcaatgcaaaggagtccttgcccaatgagcgagccgtggcttccacccagccaagcaccatgcccagtcccccttctctccagtactttcccccttcactccaaggaccaacccattcaccacacccatccattgcagcgggtgctgctgctggaccacgaccgcgccagcgggcgcatccgcctgcgccagtactccatcgtggtgcagccctcgggcgtgaccaagaacctcaaagccctgctggggcggcgcgcggtccccgacctgggcgagtgcaaggatgtgtctgagttcctgacacgcagcggctacggctcggagagcgagggggacgaccccgacaccacacgcgtcgaattggcagaggacctgggcaagggcaaccagaaggctcgccagtcgcgcattaggctgcacgaggtgggtgggtttgtttgtgtgtgtggggggggggtttgcgataatggaggggggggaggttggaagggcgggggagtgaggcagttgggtaggtgtccgcggttgcggcggtgcacggcttggcagtctggaatttcaaacccagggtgggagcagctgcggatctactcctttatgacgggttgtgtgaaggcaacgtgctctaccatgcctacatccagaaggacccggcggagattgcggagcgcaagaccaaggaagaggagcgggaggcgctgcgacgccagcggcgagccgaacaggtgtggaggatggcgtcgggtgattggtgatgggatggcactctctgtgagccagggttcccggctgggccagaggccgggggtgtgcggggaggggttgagcccagtggctgcggtgcacggctcttggcgggtggaggggctgcaggccatgtgcagatcacgcatcttgcctccatgccatcctgcagcccacacatgtgcgcctcggtcagcctctggtgagtcaattcccgacctcgcggcccttcccatcgcaggaggagaacgtgaggaagaaggagagcgaggcgaagcgccgccggcggccgcaggacgatgcgcgcggagccaagcgcccccggcccgaggtggacggtccctccgaggacgacgacgacgccgagtacttccgccaggaggtcggggaggagccggaggagggcatgctggcagcgggccacagcggcggcggcagcggcggcttccgtgggcgcgggaggggccggtttgggcgagggcgggggacccgtggcggcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccgtgggggtgaggggggcggcaggggccgtggtggctcccagaggggaagctttggcggcggtggcgggtctggacgaggcgggtctggatggggatcttccagccgcggcggggctggacgaggcggcgggcgcggacgcgggggtcgtcgatgatgttgacggccactcgacactcccacctgcgacgtcactacccctaatacacttcacatggcttctgtaccctgatgtaaccctatacaacgtttgtgcgattggcaaatgggggggccatggctcaagcggctggggatggctagcagcggaactggcgagagtgcaagggcccaatcctctacatcgccaatctcagccgccgcatcgctccccgcccaactcatccctcatcccagggccaggcctgcctgggccacaaagccgccgcgtcgccccccgcccaactcacccctcatcccagggccaggcccgcctgggccacaaaggtggtgacccacagggtgacgggcagcgtgcccagcgcgtacagcttgagcagggtgcgggcgaagcgcggcgcgtcctggcgcgtgccccgcgacagctgcagcaggatgaccaggttctgggcggggggcatggtggactgcaggagcaggaccaggagcggcagggggccgaccccgggcaggggcaccgcgcgcagggccagggtcgtggccaggggcaggaagaggaagcgcgtcaggccgacggcggccagcgtccgcgcctccagcgcgtcctcaggccggagcagggccgccgcgcggcgcacgaggcccaccacggggccggggccctcgccggggtccgcctgcgcgtcgtcgtcgccgtcgccgccgtcaccgccgccgccagccgagcg

SEQ ID NO: 5027 - DNA, 282 bp, Chlorella protothecoides
atgatgcaggagagccgcaagaacgtgctcaaggactttgtccaggtggcgggcccactgggcgtgacccacttcctcatgctaagcgccacgcagcgggcaggctacctgcgcgtggcgaagacgccgcgcgggcccacgctgacgctgcgtgtgctggagtactccctaatgcgcgatgtgcagtcggcgcagcagcgcccgcgctgcccccaggtgtgcggcacatgttaccttccggaaacaagggacgcctcgatgcgcggtgcggacttgtactga

SEQ ID NO: 5028 - DNA, 537 bp, Chlorella protothecoides
atgccccgccgcgcatgggtcccggcgcggcccccgcccccctcatccacgcccacccaccccaccacagatggcgtgatgtacgccgagaaggacttcaacctgaagcagcaccccgagaaggacctggagggcgtgtccaacctggaggtcatcaagctgctccagtccctgcgctccaaggagctggtcaccgagcggtacgcctggcgccacttctactggttcctcaccgactccggcatcgagtacctgcgcgagtacctgaacctgcccgccgaggtggtccccgccacgctcatgaagtccacccgccccttggagaagggcttcggcggcgacaggcccccccgcggcgaccgcttcggcggggaccgcccccgcttcggcggcgacaggcccgaccgctttggcggcggcgaccgcggcggctaccgctccgacaagaccggtgcccccggcgagtaccgccccgagttccgctccggcggcttcggccgcggcggcggcagcgcccctgccccggccaccgagtga

SEQ ID NO: 5029 - DNA, 453 bp, Chlorella protothecoides
atgccgatcgtagtctgccgtcaatggcccggaggctcggcgagggttcgagggctaacgcgacgtttttctgactcggcccccggaggccacggacgctccatccagccccccaccgcccctacccccagtgcaatccttcccgttgcttctgcgtttgccacgaccggcgcggtgctgggtatcatcgtcgccctggtggttggcgcgaccaatgtctacacatgccggctgctcatccggggggcccagtataccgggacgcgggactacgagagctttgcccacgcggtcggcggcccatggttcaagggcctcgatctccccccggcacgatctccctctggacgtggagcgggattcgtacggcgggcggtcccctccgggcggcatgcccctcctcacgggattgcgcacagcaccctcggtcatgaaacgtctgaaatggtttga

SEQ ID NO: 5030 - DNA, 270 bp, Chlorella protothecoides
atgggttcctccctggcatacaaggacatgtctggccaggaccttcgcaaggccaagtacaacaaggccgacctgaggggggccgacttctccgggtccaaccttgcgggggtgcccatgtttggcgccatctgcgtcgatgccaaatttgtgggcaccgacctcagcgccgccgatctggaaagcgctgacctggagggggcagaccttaccaatgccgtgctgcagggcaccctggtgaggtcgctggtgccagggttggttgcatag

SEQ ID NO: 5031 - DNA, 900 bp, Chlorella protothecoides
atgcacctggagcactacaaccgccccgcgctccagatccgggtggtgcgcatcctgtggatggtgcccatctacgccgtggacgcgtggctgagcctgcgcttctccgacgcgcgcacctacattgacccgctgcgcgagtgctacgaggcctttgtcatctacaacttctactgctacctcatggcctacctggaggaggagtatggcgacgtggacgcctactacgcgacgcgtccccccgtgccccaccccgcgcccatggaccgcctgctccgcccctgggcccccggcgccgacttcttctgggaaaccaagcgcggcgtgctggcctacgtcatcacccgcccgctcaccaccgcggtgggggtggtgaccaacctggcgggcgtctatggcgacggcgagttccggcacgaccgcgcctacccctggctggccacggtcggctcgctgtcccagacctgggcgctgtactgcctcatcctcatgtaccgcgccacgcgccaggagctggcccccatccgcccgctggccaagttcctggtcatcaaggccgtcgtcttcctcaccttctggcagtcggtgggcatcaacctggcctccaagtttgacctgctcaagcccgcctcctggtccacctacgacgacgacgacatcgccgccgggctgcagaacttcctcatctgcctggagatgtttgccgccgccatcgcgcatgcccacgccttcccgcccagggtgagggagggggggggtgggcgctctttgggggcggggaatggcggggaaaggaggaagaatgtgggggtcaggttgggctggggaggctttggagaggggggagtggaggtcagcgctttgttgatggggaggggaaggggagctggggcgagctag

SEQ ID NO: 5032 - DNA, 378 bp, Chlorella protothecoides
cctggcgccgcgccctcgctgctggagggcgcggtggccagcggggacagggaggcgctgcgcacgctgtgcgcgcgccgcgccgccgagctggccggcacgcccgaggcggagacctgggccttcctgggcacgcactatgcgcccgacgcgcggcgctacctgctggagcgcctcggtttcggggatgacctgccaccggtggaggaggcggagccggcggcggtccaggccgcggcggacgacgtcgcgcggttgagcctgggcgccgcgtcctcggacgcggccccccatcctcctccggaaccccaggaggtggacccctttagcactgacggtgagcgcttgttcgagtcagggatggggttgaagggctga

SEQ ID NO: 5033 - DNA, 480 bp, Chlorella protothecoides
cccagttatgtggagtactgcatgtcgcgtgtggagctcctcctctccgccggcctggtgcccgtcatggtgtttgacggagggcgcctgcccaacaagggcgaggaagaggcgagccggggccggtcccgtgccgccgcgcgagagagggcgcgcgcgctggcggccgcggggaacgtggcgggcgcctacgaggcgtaccagcgcgccgtggacgtgacgccgcgtcacgctttccagctcatccgcgcgctgcgccgacgcggcgtggactacgtggtggcgccctacgaggccgacgcccagatggcccacatggccaccacggggcaggtggagctggtggtcagcgaggacagcgacatgctggcctatggctgcccactggtgagctctgaatgcgcacgggtggggacaggggtagggtgggcgaacatgcagcgccatgctgcagccaggttcccctggtaccgggagtga

SEQ ID NO: 5034 - DNA, 699 bp, Chlorella protothecoides
  modified_base (213)..(222): a, c, t, g, unknown or other
  modified_base (275)..(284): a, c, t, g, unknown or other
  modified_base (364)..(373): a, c, t, g, unknown or other
  modified_base (536)..(565): a, c, t, g, unknown or other
atggcaaaatccggtaaacggaagaatgcgggggtcggcatcgacttcaagcgtgccaagcacaaggttgggcgcaagctgcccgccgccgcgaacgccaccgacacgaccatcaagtccgccaccatctcgctggggcagcagagcatggccgtggaccgtgcggggcaggctgtcaccgcacgaaacctgacgctcaaggtgcgacgacgnnnnnnnnnnaaatgcgggggtcggcatcgatttcaagcgtgccaagcacaaggttgggcgcnnnnnnnnnntcgctgctgggtggggaaggctattgtggaaggatggggtggggtcgagggaggttttagctttggcctgggtcaccgtnnnnnnnnnngcgctgctggattgggctcgcgcatcaccagctgggatattgtccctcagcctgcagaagccaggccatgcctgtgttgctgtttgtctacaccgagtacatcacctgccgcactccccaactccccctccacaggagacgctggcccagtgctcgcactacnnnnnnnnnnnnnnnnnnnnnnnnnnnnnntccgagaaagtacggcgggacgcgctggagggcctggcccagctggcgcacgccgacgcgcgcgcctttcggcgcggcgcctcggccgtggtggacgccgtcgcggcgcggctgggcgacgccgaagccagcgt

SEQ ID NO: 5035 - DNA, 837 bp, Chlorella protothecoides
atgcgggcggtggtgtgcacccggctgggggacgccagcaaacccttcggcacccccgatgccccgctggccctcgtggatgaccagccgcgccagcagctgcccagcaagggcgtgcgcatccgggtgtcggccggggccctcaactttgcagatgccctgatggtcaaggggacctaccaggagaagccacccctgcccttcatcccgggcagcgagtgcagcggcaccgtcatcgaggtgggcagcggggtgcggagcgtggcggttggggacaaggtgtgcgccctcacccccagccaagcgctgtgcgaggaggcggtggcggacgaggcgtcggtggtccgcctggaccccagcaccagcgaggcgcggctggaggaggcggcgggcctccccgtcacatatggcacggcctacctcgcgctggtggaccgcgcccgcctggcgcccggccagaccctgctcgtcctgggcgccggcggcggcgtcggcctggcggccgtgcagctcgggcgcgcgctgggcgcgcgcgtggtggccgtcgcgcgcggtccggagaagggcgtggtgctgcgcgcggccggcgccgacgccgtgatcgactcggcggccgccgggaagctgcgcgacgccattaaggccgccgcgccgcgcggcgtggatgtggtgctggaccccgtgggcggcgaccacttcttcgaggccttcaagtgcgtggcctggggagcgcacatgctcgtcatcggcttcgcgggcggggtgcccaatatccccgccaacatcgcgctggtcaagaacaccaccatacacggtgagcctgttgttttcttttga

SEQ ID NO: 5036 - DNA, 1833 bp, Chlorella protothecoides
  modified_base (219)..(228): a, c, t, g, unknown or other
  modified_base (644)..(653): a, c, t, g, unknown or other
atgttcggggctggcagcctggcagccgcggggcgggggtccctgcccccgctccccagcactcccccaaaaccgatcggcttcgcctacaacgagagggtggcagcggccctgctccccagtctcattatcctggccggatttgatggagggtccatggcttccatcctcatgggactctcccactgcacctctcccccgagttacgcgaggtcccannnnnnnnnnaccctactggcatggggttggggacctgacggaagggactctcccactgcacccctcccccaacttgtgcgagttcccttgctcaaccaccgtgcaggtggggggcatggcggtgtacatcctggacaccctgaggcagaaggagatggcctttggcgcggcctgggccaccctgggcctcgccctcctggccgccgcgtcggggaaactcttcctggccagcgaaatgccgggcatcctcgccgccctcgtcttgctcatcactgcagcgtgcctggccctcacgggtgcgaggttaacgggggacattcgaccctgcactcgttcctgcgccacctctgccgcgccacgctttccccctccatccccaagcccctcgctcctcaacacacacacacacacacacgcgcgcactnnnnnnnnnnagcgtgcctggccctcacgggtgcgaggtttgcgggggacattccaccctgcactcgtttctgcgccacctctgccgcgccacgctttcccctccaaccccaagcccctcgctcctcaaacacacacacacacacacacgcccgcactgatcccctgacaggcctctggatctccatccagttccgctggatccagctgcagtaccccgtggtggtcgccggctttgagaagacgctcattggcggcagcttccccgtggcggccgcagtgcagtcctgggcgctgaccgtcgcggcgggggtggatgctgcgcccttcctccttgtggccctgctgtgcacgctgtaccacctgctggccctgcccctggagcccagcctggcgccgcgcgggcgaggtgggtggggggtttcgtggtttggtggattcctgggggtggaaggggtggggggggccgaggccgggcaccgccggccccccctcctccgccggcacggtgcaggagccgggggagggcgcggcggccttcttcctggtggccacgctgcctgcgggcatgtacgcagtggcggaggcggcggacctggcgcactgggtgcacgcctggagcctgctgctcctggcctcgctcccgctcctggcggtggcctgcatgccgcgcggcctctggtggctgggcgccggcgagcgcgtacgccgcctgcgcgccgggctgctcctcgcctcactggcggcggcgctggcggggctggaggcgcgcgtggtcttccgctcctacgcgcagtacctgcgcctgcccccgccctggagctacctggcgcgcgcgatggcggggccggtgctggtggtgggcgcggcggtcggcgcactggcgctgggcctgccgctctgggtcatgcccgcgccgctggctgcggcggcggggctggcagggtgggccgagacgcggcgggcgggcgactacggggtgttcgtcctgggcacgctcctggccgcggcctggttcctgcaccaccacttctggttcctggaggttcgtgtggcagggtacgcgctgcgcaccctgtgcctggccctgggcgccggcctggccctggccctgctcctcgctggcggcctgcacgcgccgggggcggggcggcgcgccggctggctccgcgtcggcctggtcgcgcaagc

SEQ ID NO: 5037 - DNA, 1470 bp, Chlorella protothecoides
  modified_base (287)..(323): a, c, t, g, unknown or other
  modified_base (794)..(803): a, c, t, g, unknown or other
  modified_base (1039)..(1048): a, c, t, g, unknown or other
  modified_base (1116)..(1125): a, c, t, g, unknown or other
  modified_base (1183)..(1192): a, c, t, g, unknown or other
atgaagactgagggcttccactctttccagcatgcgcggtcaccaccccccatgcactccacacgcaccgcagacgagtctgcacggggtccccctgatccggctgcgcacagacccccaccagggcgacatcaacccgacctacttccagtacatccagggcctgatgaacatcaccgggcccatggcatcaggcaggcagcgggttgctggaggggtgggcaagcgtgtcttctggggtcatttgactgcgtggggaggaatgatgcactctcagggatgctccnnnnnnnnnnnnnnnnnnnnnnnnnnnnnnnnnnnnncggggccgcccctcttcctctccatgccacactactgcggtgccgacccggcgctggcggcgggggtggtgggcctcaagtgcgaccctgcgcgccacaagctgcacctcgacgtcggtgggttgcatggcctggtggtcaggagctgccgttgcacagattgcccacagcccttgttcaccccttcctctccgtagaaccacacaccgggatcacggtgcggggcgcccgcaggatccagctcagctcctggtttgggcccaggtggaagccgatcgatggcggtgtgacacccacctacctgcccatattctgggcggacgaggcatcagagctgcgccaggggtgcagctgcgccagggtccggagctcagtgtacgaggtagagcacggacaagtaaacagccccagctaccacccaacgcatgcacaggcaagcgaggagcagatgcaactcttcaagcccctgcnnnnnnnnnnggttcccttcatgcgtgatgttgcacatgcaactcggtgccaaggccctgctcatccactggcactggcacctggtggcggcgctgacgacggcaggcgcggcactgctggtcttggccgccacccttacgccgccagaagaggcaggggtgaccagggccggcgccctgccgtctcgcgtgacgacgggggaggtggacatggaagccgttcctctgctggaccaagggccagannnnnnnnnntgcccggccaaatttggagccgagagagaatcgattcgacgggcgccccactggggcgggaagtggtnnnnnnnnnnttgggtggccggatgtacattatggaggggtgcctgatggttctgggagctcaaaacnnnnnnnnnnctgggtggctggatgtacattatgaagggtgcctgatggttctgggagctcaaaactccttgtttcattctcagttgtatgtacgaatcaatcacgatccgttgcccaagcccgcccaaatttggagccaagaaagaatcgattggacgggcgccccactggggcgggaagtggtgcatatcgcgcccctgcatcctgcctgccagggcacagctcctgtgtgcttcgcttcccagtacagtaacacgacgaaaatgggtgctgcgtggatgctgtag

SEQ ID NO: 5038 - DNA, 438 bp, Chlorella protothecoides
atgggggggagcgaccgtgccacctccttgcgggccagggtgcaggccgatccatacgaccaggatgcatgggacgatctcttagatgaactcaagacacagaaggatgtcacagcagtgcgcgaagcatacgaggccttgcttgcagagttcccgacagcggtgagggtggcacgatggacccatcagggcagcagggatcttgatatgttcgcggatctcacagcgatgtcactgagccaggcacagacgattcgcgggcgccccacactcggcgcaggccctgtactggaaggactttgccgagttcgaggttggccacggcggaaacaacgccgccaaagtggtgtacagccgctgcctgctgcagtgccccaacaccgatctgtggcggtcgtacctccagctcgtccgtcgggtgcgtgggtgggtgtgtag

SEQ ID NO: 5039 - DNA, 648 bp, Chlorella protothecoides
atggatggagcgcctgcccccctctgcaacaacgccattccccttttccaactccacccaggtgaacgagaagcgcggcgctgccgggctgggcgaggtgcgccaggccttcgagtacaccctggatcgcctgggccaggacgtggggtctggcgccatctggcaggactacgtggccttcctgcaggtgggggtgctgttggtcttgtttggttcttgggagagatgactggagtggggctgatgctcccacgcactggtcgcctcgcgggtgtgggaaggggtcatggttcaagcccccctccaccacgaagacccaacccaagtctcggcgcacctctgacaccccaggccccacgccttggctcgcccgagctggcggcgctgttcggcggcgccgacgcctcgcaagaggacagcgcgcggatggtggccctgcgccgtgccttccagaaggccatcctggtgcccggccccgcctcggacgcgctgtgggccgcctacgaggcctttgagcttgcgggcgccaacaaggcgctggggcggcgtgcggtggacgagtggcgcccgcgctggcaggccgcgcgcgcgctttccacgcagcgcgcgacgctggcggggcggctggcgcaccacgcgctccccgcg

SEQ ID NO: 5040 - DNA, 1884 bp, Chlorella protothecoides
  modified_base (1664)..(1673): a, c, t, g, unknown or other
ggcgcggcggccgcgggcgcggccgccgccaccgccgagctggccgagctgcgcgagctgcgcgccgacgtggagcgccgcgagcgccagcaggccgaggtggtggccagccaggccaagcgcctggaggagctggaccggctgtaccgcgaggagagcctggcgcgcaagaaggcgcacaacgcgctggaggacgccaagggcaagatccgggtgtactgtcgcgtgcgcccgctgctgcccttcgagcgcgagcgcgggcaggagatggctgtgcagctccccgacgagctcaccatctcgctgacctacctggagaagaagcgggagtacgccttcgacgccgtgttcccgggggggacgccccaggagcgcgtgtttgaagacacacgccacctcatccagtccgcggtggacgggtacaacgtctgcatcttcgcctacggccagacagggtcggggaagaccttcaccatctacggcaacgaggagctgccagggctgaccccgcgcggcgtcaccgagctcttcgacatcatcgaccgcgacgcgggcaagttctccttccgcgtcgaggtctccctcctcgagctctactgcgacgacctccaggacctgctggccgagaacaaggccggcgagaagcgggaggcatggccgggagatgagcgggaccactccacccttgcacttcccatgcatcacttcccgggaacccggcccccccacctcctctcaccccccttccccaattcaaatcccccaacagttcaagcagcccaagctggacatcaagaaggaccccaagggcgtggtgacggtgcccggggccacgattgtggaggccacctccgcgcgcggcctgctggccacgatcgaggcgggactggcgaggcgccacgtcagcagcacggccatgaaccgggagtcgtcgcggtcgcacctcatcatcaccatcggcgtggaggccaccaacctgcagacgcagtccgtgtcgcgcggcaagctgtcctttgtggacctggccggcagcgagcgcgtgaagaagtccaagtcggagggcgcgcagctgaaggaggcccaggccatcaacaagtcgctgtcggcgctgggcaacgtcatcgccgcgctggccaccgagcaggggcacgtaccctatcgcgaccacaagctgaccatgctcatgtccgactccatcggcgggaccgccaagacgctcatgttcgtcaacgtgtcgcccgtggacgccaacctggacgagaccaacaactcgctgcagtacgccacgcgcgtgtccaccatccgcaacgaggtgggcaagaacgaggccaacaaggacgtgctgcgcctgcagcgccaggtcgcgcactggaaggagcaggcggggctggcgccccacctccgggactacgtggacctggtggagatcaaggatgccgtccagaacggggaggagtgaggaggggacaggcgtgtgtggagggctgggatgagagagtcgcgcacagggggggggaggagggcagtcgcttctgcggcccaggtccgcgccccgtgccaggggcccccgcgcctggcagcccctcccacccctgtgttgggtcccagcccccttgccttcccccccccgtatcccccaactcctccagatcctacagccctgnnnnnnnnnncggaggactggggcgagagagacgcgcacaggtgggggcggaggagggcagtcgcttctgcggcccaggcccgcgccccgtgccaggggcccccgcgcctggcagcccctcccacccccgtgttgggtcccagccccttgcctttccccccgaccccccccaactcctccagatcctacagccctgcgccgtgggcatgcctgattcgtga

SEQ ID NO: 5041 - DNA, 1035 bp, Chlorella protothecoides
atgccgctcgcccacttccacggcatcagcgacttccagctggagaggagcggcctcttcgttgcgctgaccgagatgcgcgtcttcaagctggacatggaggtggagatcatgcgctactgcgcacgcgtggctgcaagtgcccacatcagggtcatgcaagcggtcaggggagctggatactgtccggctggccgctgctcttgtggccccaccttgcctcggtgtaggagagtgcgacttccctgcatccccgcaccccactacttcccccttccgaaatccaaacaccccaggcccggcatgtacgagtaccagctggagtcccttttcctgcacgacatctacagcgagggcgggtgccgcttctcgccctacacccccatcttcgggtcgggccccaacagcgcggtcctgcactacggccactccggcgcgccccacgaccgccgcatcgcggacggcgacctggtgctggccgacgccggcgccgagtactaccgctatggctccgacctcacggtcaccttccccgccaacgggcggttctcccctcgccagcgggtggtgtatgaagcggtgctggatgcgcggcgcgcggtgctggcggccatgcgccccgaggtctgctggaccgacctgcacctggtggcggaggagcggatcctggcggcgctgacgcgcgcgggcctgctggtgggcgacccagcggagcaggtcgcggcgcgcctgggcgcactcttcatgccccatggtctgggccacttcctgggcaagcagacgcacgatgtcggcgggtacgtggccggccgcttccgcgagcgccctacgcagccggggctggaccgcctgcgcaccgcgcgcatcctggagccgcacatggtgctgaccgtggagccagggtgctacttcatcccggccctgctggagccggcgctggagggggggcccctgcaccgcttcctggtgccggaggagatccggtgctacatggtgggcggggggggcaggatttgggtggctgctggtcgatga

SEQ ID NO: 5042 - DNA, 1221 bp, Chlorella protothecoides
atgcccacaccgacacaggcaatttcgtggctgctgggggtcccaggtgcctcccggacagtcctggatgtgcaggtgccatactcccccaccgccctgaagtccctgctgggcggccaggccttcgcctctgcctccagcccggacagcgtcgccgccctgtcccaggcggcattccagagggcagccagcctgacggccctcggcacacccgtggcagggttggcgtgcagcgccgccctcggcaccgaccgcgtgaggcgcggggaggaccggagcgtgccggggcgcgcgatccgatgcccgcatgcccagcctccccgtccacgctgccgccaggtgtacatcgccgcgcatggcaccggcggccgcgccagcttcagcctggttctggacaaggccgcgccccgcccacgctgggctcaggatgcggtggcctcccgcctgctcatccacgccgcggctctttcctgcggcctgcccgtccccgagggcgacctggcgcggcgctggctccggctggaaccgggggatgtgctcgagagcgggcggccgcagccgcccccgaccctgcggcaggcacttcagagcctgggccgcggtgaaatcacatctgtagaggcgggtctgggaccggtcactgccggggctccgagggggggcaggctgtaccttcctggcagcttcaatccgctgcatgcggggcacacggccatgctccaggcggcgcagagcctctgccctgagctggaggggtgctacgagctgtcgacggggaacgccgacaagggcctcctgctcgtggaggaggtggaacgccgcgtgaggcactttgaggaggcacgcctgccagtggtcctgacccaggcgcccctctacgcccaaaaggcccggctcttccccggcagcgtctttgtcatcggctacgacactgcaatccgtctgctggaccccaagtattatggctctcgcgaggacatgctgctccagggtagggaccggtggcgcacgatcctctggcgtcgtcaccactcccagctagaggtagtgtgcactcacatctccaacgcagctcgaccgcctgggcaccagcggctgctcgttcctcgtggcaggccggctggacacccagacccagcagttcatgcggccggaggacctggccgtcccgtcccagctcaaggtgtggcgtcggtggtgggaccgcccgcctgggcatga

SEQ ID NO: 5043 - DNA, 1527 bp, Chlorella protothecoides
  modified_base (138)..(147): a, c, t, g, unknown or other
  modified_base (223)..(232): a, c, t, g, unknown or other
  modified_base (504)..(513): a, c, t, g, unknown or other
  modified_base (1364)..(1373): a, c, t, g, unknown or other
atgagctcagctttcctggctcacatccaccgccttccccatcacgcacagctgttcaatgagatcaactcgcgcaagatccgggacgagctcaacgtcttcaagggcttcctctcctccattgtattcaccgtggtnnnnnnnnnnttacgagggaactcaaaccctcgttcctcccggcataaagctgcattggccatggagaccctacccaagctcagtnnnnnnnnnngctcgcactcaccgtcgggttccaggtgcgtgcctgtgcggggtgggcggcgccgtgtgtggggccagggagagaggtggccagccgaggggcatgagccactgggggatttggtcatcaggcgaaatgggatggatctcgacccttcagatggggtattggtgcgaacggggagggatcagacggccttgaaacctttgtcccgtcaaggtgctccctacacacctcactccaccccaaacccacgtgcccatgcaggtaatcatcatgtnnnnnnnnnnatcccgtcaaggtgctcccctacactcctcaccccaccccaaccccacgtgcccatgcaggtaatcatcatgttcttcctcaacggcatcttcaagaccacgcggctgtcgggcctggaatgggccctgtccatcatcatcggctcgagcgtgctgctggtcagcctgctgaccaagctcatctccaggtgggtagttctggggtatcaacaaggggattcaacccctctttcctcctggcataaagctgcgttggccatggagaccctacccaagctcagtggcccaatgcaccaccctttgtcggtgcaggcgctttttcccgccccaagaaccaacagaggaggaggaggaggagaggcgccgctctttccacgcacccgaggatctgtaccgcctgcactggtggcagtggctgcgtcccccgccccccgcccacgtcaagagcgcctggaaggagcagaagcaggaggccaaggctgcgcggcgccggcagcgctctgggaatgcccaggtggcggtcatgaccgcctgagtgtggcctgtcgcctggaactgacgctctccgaattgctaaccttgctcgatgctgccatcaggccgtgcaaagccggtctgtgccttgtgtaccctgtaccactccttctttatgccacatcagcacaacaacatgtaaagcaggcatgcatatcagacagggtgtgcaaccatttgcaaggagccctaggcttgggaggagcctggggttcactaaggaagaatatttgccatggtccacaccaatccactgatgcaaaaagtgctcgtgacccatcagtctatagcatcatcgatcaggcggggcatccccnnnnnnnnnngagaatatttgccgtggtccacagcaatccactgatgcaaaaagtgctcgtaatccatcagtccatagcatcatcgatcaggcggggcatccccttcactcggtgtcctgggtggaagtggcagaggcctcgtccgcactctcctccaggctga

SEQ ID NO: 5044 - DNA, 918 bp, Chlorella protothecoides
  modified_base (707)..(716): a, c, t, g, unknown or other
atgcgtggtggcagcctcgggcaagacctggcattcactgcaccgcatccctcgattgatatctatcccccaaacacaaagcctcaccccgtttccccccttttctcacgatccataacacagcgcgtggaggtggtggccgacgaggcggccaagcgcgcctggctgcgtcagcacctccccaccctggtggatgcaggggaggtcctcctcttcgccggcaccaaggccagggtggacgagctggcggccgagctcgccgcccagggcgtccgcgccggcgccatccacggcgacctggacgccggctcacgcgctgcggtgctggccagcttccgggcaggtaccacccacgtcctggtggccacagacgtcgcagcgcggggcctggacatcaagaccctgaagacggtgagacgtggggtttgtggccatcctggccccaaaaccctcaccaccaccgctcttcccacccttccacctgaacatcgcactcaggtggtgaactacgatgcagggaggagcattgactcctacatccaccggattgggcgcacaggcagggctggggacaaggagggtgtcgcatacacccttctcctacccagcgaggggcagatggcagacaacacatatggttggaacgcccctcatacctaccatcacaagcgttgcgaccctgactcccatgccctcacaatcaaacnnnnnnnnnngcttctagacaacacatatggcgagctcgtggggtgtttggaagctgccgggcagccggtgtccgctgagctgcgtgccgtcgcctccaaagaccctcgctggagacggggggcgggtcgaggcaaaggctctggcggccgaggaggcaggggaggcaggggcggccgccgctcgacggtgcgtgcttgtgggaggttgtga

SEQ ID NO: 5045 - DNA, 1968 bp, Chlorella protothecoides
  modified_base (1744)..(1753): a, c, t, g, unknown or other
  modified_base (1833)..(1842): a, c, t, g, unknown or other
atgtcgaagcgcccattcccttatgccactggcgttccggagtttgttgtgggtcgaacgcgcccaacaagcaatcctaccagagagtacgaggagcctcgtgtgtttcaggccaagcagcctggagcctttgttgattacgatggccttgtggatggtccggtgggcacagacttccagggatggactgaagaagagcttcgcgctttcctggatcaacgaggagaggatttcgaggcatccgacgacaaggcggcgctggtcaaagcggcggtgcgctgcgaggaagcaactgggcctgcagtcacagcggctgtgcgctgcgaggaagcaactgggcatgcagtgcgccccgattgcaagggtggtgcaggcaacagcatggcacctgcagacgaggaggaggtggaccctctggatgccttcatggcagagatgaaggagctggagaaggctagcgatgcccaggccccaagtgcacgagcagctggcaagcccgctgcagaacgtttcgacgatctcgaccctgctgctgatttcctggaggttggtatggggacagccttgtgtggtgggctgacggcaaagaaggccggggcgctgcccccctcagccgtcacggcggcggccatgcagtctggtgcggcaggcgctgacggctcggacgaggaggtgtatgccgctgcagccgccgccctagagtcagacgccgtcggcgtgggtgggggcaagctggagaattcttcaggtaggtggattttgcaaggtgcaaaggattgtgatcccaataggcatgtccaagttctgccttggactctctgtgacatgaagattgactcacttcccggcttcaagcaggctgtgggctctctggcgcccctggaccaccccaacctgacctacgaggattttgacaaggacttttatgtagaagctcctgcgttgacagcgatgtcccaggcagaggtgggtgctgggagcacagcggctgggtcaagacatttcaggacagtggggagtcaggggcgtgcccggagaataatccaggtgagtgcgcgacggaggtccctgggcctcaccgtctcgggcttcgacgccccacggcccatcgccacattcacccaagctggctttgatgcccccctcctgacggctatcgtgagggcggggtacaaggagcccaccgcgatccaggcccaggcgctccctgccatcctgtctgggaggtgggctgggcagtttgcattgcctgggctgccagtggcacggtgcatgcatggatcctgggtctggagttcccaattcctcgtcccgcaggaacatgcattgagtccccgccggagggtgctctccctgtccagcatggtccccctcaccctaaaaaagcgttgcagggatgtcctcggcattgccaagaccggcagcggcaagacggcggcctttgtcctgccagccatggtccacatcatggatcagcgggagctagaaaaggggaagggtcccatcgccattattgtgggccccactcatgagctggccgagcagatccaccgcgaaacccgtgagtcccgggcctgctcctgtgtagggtatgggaggtttgtttggtttgccagtctcaaagggggaggtgtttgcctgttgaccactgctacttcattggacggctgcatctcactccttgagccacatccattcgcagatcgctttgccaagggctacaagctgcgggtgtgtgctgccnnnnnnnnnncggctgcatctcactccttgagccacatccgtccgcagatcgctttgccaagggctataagctgcgggtgtgtgctgcgnnnnnnnnnntcaaaggtccgcaggcttgctgtagtaggaatgctggcctggatggcaaagacgggggcggccggtgttgcaatcatgcttgtgccaggcctgcgtactgatcagggagaggtgtttgcctgttga

SEQ ID NO: 5046 - DNA, 705 bp, Chlorella protothecoides
  modified_base (238)..(247): a, c, t, g, unknown or other
atgcgcgcaagtcgcgtgggctcgcgtgcattcgtcgagttccaaccgtgccagcagcaccgggcaacggtactccgggcaaccccgctcggattcagtaggcactggacctgcaggacccctgtggctttaataagagcacacggtggtcacagaagattcatgcaatctattcatgcaactcctgcacaacacacttcagcatctctcctcgtggccgttcaatcttcagtgtcgnnnnnnnnnnacaggacccctatagctttaataagagcacacggtggtcacaagatatccatgcaatctattcatgtaactcctgcacagcacacttcagcgtcgctcctcgtggccgttcaatcttcagtgtcggctgcgagcggcgttccaccagaggttgccaccgtgttgaagaccgctgacgccatctgctttgatgtagacagcacattctgtgaggatgagtctatcgatgagctggccgccttcattggcgtcggggaggccattgccaccatgacagcccaggccatgggaggggtggtaacgtttcaggagtccttagcagcccgcctcggcatcatgagcccatctgcccagatcgtggaggagttcctgagcagccatcccccccggataagcccaggtactgcaagatttcaatatatccccaacatttctggggcctggaaaagggatgcctga

SEQ ID NO: 5047 - DNA, 1671 bp, Chlorella protothecoides
  modified_base (109)..(118): a, c, t, g, unknown or other
atgggtgccaaagggaagaccgtgaaacgccgaacccccaagcggggaaagaaggcttggcgcagcatcgacacagacgacgtcactgcagctgcggcagaaaagtctnnnnnnnnnngcggggaaagaaggcttggcgcagcatcgatacagacgatgtgggttttaggagaggcgcatggtgggggttcctgctcacggtgcatgggttgtattagcataccctgccaaatccatgatgatgtgcaggtcactgcagctgcagcagaaaaatccaggcaggagcggcaggggctggacttcgaccgtgtcccagatgcagacttgttctttgtcgacaagggtgatgcgagtgctggcccctcgacctccgacgtggaggcccctgctgccgaggaacccgccaagctcagcaagaaggaggcggcccgcgcccgacccctccgctcccaggccatcctggcggctgcccacactgccaccccggtgcaccagatccgcggcggcgtgaagaaagcgcagaagaacggcattgccggtgtggtggcagcctccggagggaacaccgggctcgcccgccagggaaagaaagacgcaacaaggctgtacgacctgtgggacgacgggccctccgcgctcagtcgtgccgcccggaagaaagcggcgacacgcagcctgcacagggacgccgtgcgtgctgtagaggttgacgcaccggggtgctccttcaaccccgaccccgaggagcagcaggaggccatcgccgtggccgtggcggcggagatgaagaagattcaccagcaggtggggcagcctagatcctgggctgtctgcccagtgcaccctgatgccatgccgacggcgccgcccaagaaggtggattatgacgtggaggaggatgagctggcgctgctccaggtggacgagccagagtcagaggaggaagacatcatagatggggcaggggagcctggggcggcatcgaagaccgggccaataaagaggaagaagacaaaggtggacaggaatcgcgcagccaggcggaaggcggccgaggtggcacaggcggcagcccgggctgccaaggcgaagcgtgccgccctcgcaaacctgcccaccctgttgaaggagattgatgcagagaaggaggagcttgcgagccgccagctgaggcgcaaggagattgatgcagagcaggaggagcttgcaagccgccggctgaggcgcaaggtgggtggggagttggagaggattctcgaggcatgctgcccgttggggcccagacggggtgcagaacaacctgcgcctggtatcccttacgctgactggacccaccccccccaccttcattgtacgaagctggacaaggcggagaccacagcgggtctcccgccccggctgggcaagaccaagtttgagggcatgcccctgcagctgctgacgacagacgaggtgaatggcagcctgaggaaactcaagcccacagcgtctctggccaaggacagatttcctgtctacgccccattgggattcctggaaaccggtcatgtcactgatcatgtccctgctttttgctctgatgctatggcgttggatctggcaccaggtagcacgcttgaaaggatatttcaactgctgacgcaagagtcatgtttcccctggctcggctga

SEQ ID NO: 5048 - DNA, 1122 bp, Chlorella protothecoides
  modified_base (221)..(230): a, c, t, g, unknown or other
  modified_base (521)..(530): a, c, t, g, unknown or other
  modified_base (923)..(932): a, c, t, g, unknown or other
atgtttggtgctgggcacattggagaccgcgtggacctgcgatacttcctcaccggtagggtggtcggcgcgtgcatggcgcaactgcggctgcagaggctctttgtgtgcgtccgaggcggctggcacagggtggcgcaagccctgcatgcccgaccctgcccccctcccatccatgcccacagggggaatgatcggcagcggcacctgcgtcatcctcnnnnnnnnnncgcatggcgcaacggcggctgcagaggctcgctgtgtgcgtccgaggcggctggcacagggtggcgcaggccctgcatgcccgaccccgccccccccccacccatgcccacaggggggatgatcggcagcggcacctgcgtcatcctcatgggcgcagcctacttcctcaacatccacacgctcggctacttcatcgccgtgcagatcgtgggagggagagctgtcgctcagcctgcgcccagctcagcacgcgtctggggcgcaagctcaccaaaagcgcgtggcgcccnnnnnnnnnnagggggacacttggggccctttccagtgtgtggtggtgtcttctgggagggagagctgtcactcagcatgcgcccagctcagcacgcgtctggagcgcaagctcaccaaaagcgcgtggcgccccatccgacacaggcttgctgcaggccaccggctggcccagcgtggtcagcgtcatggccaactggtttgggaaaggaaagcgtggcctcatcatgggcctctggaacgcgcacacctccgtggtggactttccctgggccatgtgaggttgctgctgccttgggagacaggcgaggcatgtctggcgccgcagggaacccaaccccaggtctcccctcaccctccaggaaacatccttggctcgctgctggcggcatacatgctgcagnnnnnnnnnnaggggacccaaacccaggactcccctcaccctccaggaaacatcctgggctcgctgctggcggcatacatgctgcagtacggctggggctggtccttcatcgtccccggcatcgtcatagtcgtgatgggtgcgctgggccagcgctgggagcatgcgggatgccgtgcgggcgccctgctcgcatgtga

SEQ ID NO: 5049 - DNA, 1182 bp, Chlorella protothecoides
atgggtcctggcagtcgtctcccaccctcgccacaacgagctcagcaacctcccatcctcgcaccacgtgcttcccagtgcgcgaactccagcactccagcccagctggatgggctacgagtgctcttctgtacccaggacatggactctgccttccagaggaccagggctgtgcttgcgagcacgctgcccggcgtcgaggtcaggcagtgccaccgcctggaggcgggggccgcgttgcagcacgtggacgtagtggtccccatcgccgtgcccatcacggccgggatgctgggggcatcaccccgcctcaagctggtcatccaattcggggtgggggtggacgccatcgacatccccgccgccacccgcctgggcatcaccgtggccaacatcccgtccctcggcaccggcaacgcgctcagcgtggcggagcacgccatcttcctcacgctggccagcctgaggcaccatggcgccatgcgccgcgctctggaggcccagaggctgggtgtgccagaggggctgaccctctggggcagcacggtgctcgtcgtgggctatggcaacatcgcccaggagctggtaaccaggtgggtcggtggttgggggtctggagggatgggctgggggaggggcccttggtggtcctggcggcgcacagtgcagggaggagcgtgggggaggaagccaacctgtgggaacctcctccttccccttcccttcaccccccctcaccctcccaaattccctgattccatcctcaggctgcaaccctttggctgccgcgtgctctgcctccgtcgcagcgcctggccagagcccagaaccggcgccgccgcggatctggaggatgtgggaaccttcccagacgacgtcccgcggctggcagcgcaggccgacgtcgtcatcctgacctgtgccctgaacccctccagcgtcggcctggtgggcgccagcttcctggcggcctgcaagccgggcgttcacatcatcaacatcgctcggggtgcgggaggggaagggagtggtgggagttcttgcatgtcgagcagggcgctgtggaatttgaggcagggcaccggcgctgtagaatttgaggcagggcaccgtgcacgcccgcgggctggcctcaccattgctgccagtctcatcaggactgtacctgagtggaactcttga

SEQ ID NO: 5050 - DNA, 264 bp, Chlorella protothecoides
atgcgctgccgccgccctaggcccccatacacgaccaagaccatgtccattcccccaaatctgaattccgcacaggtggtcatctgctcggcgtgctcaggtcacggcttcaagtttggcagcgtgatcggggaggtcctcaaggatcttgctctgatgggcggcacacccctggacatagacttcctgaggctgagcagccttcggaagggccaggctgcggtgctcgaggagtttggcaagcaggagcccgcctcggcatga

SEQ ID NO: 5051 - DNA, 1056 bp, Chlorella protothecoides
atgtatgagccagcagcggctgtgctgcagccagagggctgcattcgtgcctccctcactctcgccctctcagcgggagctgagctggtctgcggggcagcggtgacagggtggcgggtggacgatcaggggactgtccatgtccacaccagcaagggggagtacgagggcaggaagctcatcctggcgcctggggcatggcttcccaagctggtccccgagctgcaggtgcgcgtcggctgcatgctttgccacgctgtgcttcccctggcatggcatcgtccccttacatgcccatgttccaccccaccaacacagagcctgctcagcgtggaacggcaggtggtgggctggtttgaggtcttgaacgggtctgcagactttgatgctgaccgattccccatgtttgtcatggacaacagggacggccattcgggcgtcaacaaagcttcgcgacacttccgagggcgcacagtgtatgtgtcccagggtcacagacctcgccagagcccaggtccatgctcgctgcctgcctgtgcagggtttcccaaagacgcccgcggtttcaagtttggtaagatccaccatctgggagagattgtcgaccctgacagggtggcacgtcacatcactagcctcgacgaggccaccctacgccgggcggtgcacaagtacttccccggcgcgtcgggcgccctgaaccatgccgccgtctgcctgtacaccaacacaccagatgagcacttcctggtcgaccagcaccccaaccatccccaggtggggggattgacgagggctggaggaggaggccgcctctgcatctgcctgggcatggcccacggcggcacaggggtcatcctctgctccgcgtgctcgggccagggcttcaagtttgccagcgtgattggcgaggtgctcaaggacctggccgccagcggcgccactcgccacgacatcgccttcatgcgcctggatcgcaagcgcccaggccacgcccaggttctcgacagcttccaggagagcgcacagggtctgcagccctcctctcggctctag

SEQ ID NO: 5052 - DNA, 306 bp, Chlorella protothecoides
atggccacggtcaagctcttcctcaaccacacggccgccttcccggaccagcagtcccaggtcctgggtcgcgtgcgggacgccctcttgaccctggtgtccggcagggagcacgaggtggtgtacgctgcgctttctaacacgctggtgctcgccaagcgccaccctgacgcctttgcgccggtgggtcctgggatggattccgatggtcaccttgagcctcgttggggatcctcaagtcgtagagggtccaccatcagtgctggcgtcctggaccctcatggaggtgctgacagcgtggtatga

SEQ ID NO: 5053 - DNA, 969 bp, Chlorella protothecoides
atgttgagtttgatatatgcttatgacctcgacaccccacccgaaccctcctttcgtgttcatgcctggcaccctttgccccgggcctacgatgagggcgccggcgccctcggccaggggactgtgagcgctgcgagggcgatcacaagcctggcgagcctgcccggcgatggcacccgccccgatgccctgctggtgggccatgcggacggcgaggtgtcgtgcctgcagggtctgaacggcgaggccgccgcccctctccagcctgccgccagcgggagcggggagggggtgcgaagcgtgcacctcgtgcccgggtcgggtgagcccacagtcgtgacggtgtcggccggcggctgtgtgcgcggctttgcccggcagcctgacgacggggcctgggcggaggcctggcggtggcaggcggcctgcaaggaggtggagtgctccggggttgaccccaccggccgcctgctggcggtcgggggcaggggttgcgaactgcgcctgcacgccctcgcagacggcggcgtcgcgtttgccgggcgggggggcaaacccagccgcgtaggcctcgtggaccggccctggaacaccgcactggcctttctgcccccctcccccgcgccggcgggcgaggaggaacccgccggcgcccggctggtggtgggcacgggccaccaccgggtgcggctgtacgacacggccgccggccggcgcccgcagctggacgtgggctggggcgaggcaaaaatcacggcactggcgtctgagcccagcggcgcgcgttgctgggtcgctaacggccaggggcagattgcggtgctggagctgcccagcggcctcgtggtggggggtatcaaaggggccgcaggtgcgatggtggggtttcctgggaggcgatgcaggagtgggtgttctcctcgcctggggcttttgctctctaggtctcgacttggagacgggcgataa

SEQ ID NO: 5054 - DNA, 792 bp, Chlorella protothecoides
atgggccactacgacgtcatcgtggttggcgcgggaggcacgatgggttcgagtgccatgtaccacctggcaaagtctgggtccaaggcaagcaggctggggagtcaagggccaggcctggccacgtggtgttcccttcagcagctgtgctctgatgatcctcccattcaacaggtgctgggtctggaggcccagccacaggctcctcacaccgccggctcacaccatgggctgacacggatcatccgcctggcctacgcggagcacccttgctacgtccccctcctgaagcgtgccttcgagctctggcgccagctggaggtggagagtgggcaggacctgctcaaggagacggggtgcataaacatgtcacccaagtcgctgccagactcttgtttcaagggggcgcaggcctcagcccaactgcacggcctgacgcacgaggtcctgacgcctgccgagctgcaaggaagatgccctgggtacgcgccgcccgaggacttccagatcatcttggagccggtgggcggcgtgctctgtcccgagcgatgcatcgcagcccacctcgcgggcgccgcggccgccggggcggaggtgctgtacggcgccgccgtcacgcgatggggtgtagaacccggcggccaggtcagcgtccaggcagggcccgacgctcagacccacacggccgacaggctcatcctggcccccggcgcctggcttcccaggctcgtccctgagctcaaggcaaggcgggtgttactgcgcggccccttctgtttctcgatgccttga

SEQ ID NO: 5055 - DNA, 228 bp, Chlorella protothecoides
atggtcaggactcagctcgccgagcagtatgagctgtatgtcaaccgctttgggcctggcatggtcatctactggcacggctatgtggagggcctcctggagcatcccggcgtgttggtcgtggatgacttccctgccaagtcaagcatcctgcaactgccctgcctctccgttgaacttgtgcgaccctctgaggcccccttccggccggccgtacaggccgcctga

SEQ ID NO: 5056 - DNA, 237 bp, Chlorella protothecoides
atggggtccagtgccctgcatcacttggccaagtctggtgtgaaggtcttggggttggaggctcaagccgaggcgcctcactcaaacggctcccaccatgggcacactcgggtgatccgtacagcctacgtggaacatccttcctatttgccccttcttggtcgcgcccaccagctctggcaggagttgcagcaggcatcggggcaggtgagcgacggagcagagacaggtgggtaa

SEQ ID NO: 5057 - DNA, 348 bp, Chlorella protothecoides
atgtacctcccgggtgagacgcccatctgcgtcacgtatccagagggtggctgcaccatcaccgagccgagccagacggggttctgcagtggcgaggagacgggctgcagccgctacaccagcatgcagagtgcttacgacgccgcaggtagggtgatcatgccagtcgaggagtgggcggggagagaggctgggctgcaccgcctcagagtggagtgggcgcaagaccctgtgggattgtcagcgtcagtatatctgaatgtcacactccatgataaagccacctggcctcccctctacgtgcagagagtggcttcacctccactgaggagacagccaagcggctga

SEQ ID NO: 5058 - DNA, 585 bp, Chlorella protothecoides
atgccggtgcgccatgctgtgcttgtttcggggccccacggaaatgcacccggccgtccatgcatctgcttcatcttcggagatactccacactcccgtgtccctttctccacacaggcgatgctgaggtctcttccccacacctctgtggccccatttagtagagggcccctgcggagccgaccgaaggccacccgcatcagcgccaagctgacactcgttcccaatggcgatggcagcaaggaccatctgaagggggaggatgatctggtccagcctgggcccatctcgttgaggtccggcacgctggagctgggtcgcagcagtaatgccgacatccgactcgacatccccaccgtgtcggggaagcatgctcggatcaaggtggagagcagcaagatcctggtgaccgacctgggctccaccaatggaacgtttgtagacggcaaggagctgcccgcgaatgaggagagggaagtcctgccaggcggggaggtgacctttggcgacgtctacctggcaaagttcagcctggaggagagtgcggacgaggcctctgccacttccacccaggacaccgagtga

SEQ ID NO: 5059 - DNA, 621 bp, Chlorella protothecoides
atgcagacgctggcgggcccggacgagcgggctgcatacatctgggtgctgggggagcacgggcagcgcgtgcagtccgcgccctacctcctggaggccctggtggagggcttcgcggacgaggcggccaaggtgaggctggcactgctggcggcggtgccccgcctcttcttccgccgcgcgccggagtgccgcggcgcgctgggcgcgctactggccgccggcgccgccgacgccgacgtggaggtccgggaccgcgcgctgtttgcgctgcgcctgctgcgccacgacgtgcatgccgcgcgagaggtcctgggtgcgccgctgcccctcatctcccggccgggggaggagcaggccgcggaggtggaggtgagccccgctgggtttcgagtttgtgggcatggggcgagcacgcgactctcggctcggccacgattgtccctgctccccatccctggaaccctcctcgcgccgcaggaccgcatcttcgacgagatgaacaccctgtcggtgctttaccgtgcaccggcctacaccttcatcgaccccaccatcaccagcgtcggtgggtggcggggggtggtgaggtgtggtatcggcggcatcgggagtccctga

SEQ ID NO: 5060 - DNA, 2520 bp, Chlorella protothecoides
  modified_base (1238)..(1247): a, c, t, g, unknown or other
  modified_base (1305)..(1314): a, c, t, g, unknown or other
  modified_base (1592)..(1601): a, c, t, g, unknown or other
  modified_base (1817)..(1826): a, c, t, g, unknown or other
atgtctcctgaagaagtcccggactcagaggatgccgtcgatgggaggacttccctcctaaccccgtcggaggccccagcggaacctgaagggagcatcaaaggggcccctcactcgcccagggatacccatgatgcagataaaccacatatccacactggagggcgtcgtcggagggatgctccggggtgtcaggtctgcggatgcgcactcgggaacttaaggtcttactaccaggtttgcaccgggtttggggggtgttcctgtttcgcgggtagtcctggttgccgtgcccttggtttctacgcaacgcaccgcgatgccccatccgggcggctccgtcttaccccccaatcccatgcttcctcgctgaatttggtagagcatggattccagccacccaaaggcttagcagacatggccacagtccaagcagaagagcctgtgcgagggtgtgatttgaatggtagtcaacctgccactgcctgctcaggctctcaaccttgcacctgcctgcccacattggatagtgaaagccgctctctcacacggaagcacctcccccattgccctgttcctcgcgaggctggcccatcttgcccagatgttcaaccgtcgatccccaccccccttgcgccatcactgcagtgcggcaggttccaggagctggccgccttcgagggcctcatgcggacttgccgggcgcggctggacaagcacgccgcacgccgccgccgcgccaaccagcttccgcacgctaaccctgatcccgactatcggctgcccaagtcccagcgcatcacctactctgccctcacagcgcccagctctggcgggtccccggaccgccggcctccactcagcgcagagggcgccgtcagggacgagggggacgccgtggaggtgaggatggcgacggccgccgcgcgggaggccagcgacaccgtaccgccccttatcatctccaggccactgcacatccagctgaccacggcgggacaggaggctcctgctgaggcgtgttgcgaggtagctctcccccccccgccatcgggcaatgccatgcacgtgtatcatcttacaggccattgcgcgtgcctccagaggtggcaaacctctgcacctcaagaatgggctctggtaccccgccccgcccccctcccccactcatttgttcctcgacaatccacaggtgccggacccggcacccttccagccctggcagagccctcggcacnnnnnnnnnngaggctggggatggcaggcgtgttgcgaggcagctctcccccctgccatcagtcaacnnnnnnnnnnaaacctctgcacctcaagaatgggctctggcaccccgccccaccccccctaccccactcatttgctcctccaccctccacaggtgccggacccggcgcccttccagccctggcagagcgctcggcaggaggttcccaaggacgagctgtacctgtcggccatctctcgcctggcccagatggccgccgagcacggatccacgcatgcaaaggaggtggcggcggcggagctggctgcgcacggcgtggaggtgtcggagggtcgcggcagccatcccnnnnnnnnnnggaggtggcggcggcggagctggctgcgcatggcgtggaggcctcggagggtcacggcagccatccaacagcggtgccctacctcgactctcaggtgagatttgtggggtggaagttggtcggtggcggtggtgggaaccatccagtccgagacctgtgccgccctgcaagaacccctgtgcggcaccctgacactcgactgcctccatcacccgnnnnnnnnnngagatttgttgggtggaagttggtcggtggtggtggggggaaccatccagtccgagtcctatgccgccctgcaagaacccctgcgcggcaccctgacactcggctgcctccatcaccctccccgcagacggtggtggcgctgctcgccgcagcagcaggggtggacgtcgggcccggcggcgccccgcggcccgcagaggcgcccccccgcgcgtcctcgcccggccccagccaggccctgcataggcccctgtcctcgctggatcagctggtccggcggctgcggcgggagcgcagctggggcgcggcgcgcgagggctccacgccctccggcacctcccagcacctggcggcgggggagattggcggccgcggccctcaccgctcctggccctgcccctcctaccagcagcggccgccacagcagcagcagcgggtggggtcgggcccagggtccgagccccagcccgttcgaggcttccagcgcatcctgtcgatgcaggggtccagcgaccctgcgcgcaaccccatgccctctcccttcaagaacccagaggtgcaggtggggacgctgggccggggccccgagtcgcgccccggccccgcgcgacgcagcagcgacgggtcgccccacgctccggtggctcaccaggcctcgccctcctgggagctgtcgcgcgcgcacggcagcggc

SEQ ID NO: 5061 - DNA, 681 bp, Chlorella protothecoides
atggcctcctggacagctgtgtggagggctggaagctacccagctcgggcgggagcaccatctgggagaggatctgccggtgaggagctggatgctgggtggagtgggaggcggggaggcatatgcaacaggagccggcacaaggcgccggtggtggagcctcgcgactctgcccagtttgtgctggcggtccaggatttccaggccaaactggatggcccagggacaggcggggctgtcctctttgccgtctgccggtggggcgaggtggtggtgaggagcagggttttggggtgctccagaggctccccagctgcagatggggatcctgggtggcgtgcagtgcatgctgtgcacatgcagacccctccaccaaccccggtcttggcatgcaggggcaaggccagcgagggaatcgatttctcggatcgcgcgggacgggccgtcatcatcaccggcatcccatacgccaacaaggcagatgccaaggtgtttgtttcaccctggaggaagcagggtgctggggcaggccaggcagacgcacgggcgggaggggctagggggggttgcctgaacaggattttgcatgagtcgaagccccgtgtcgtgggatttctgatgagatcagggcatgggaactcctggcagcgccctcttcccctccttgacatcctcccttga

SEQ ID NO: 5062 - DNA, 471 bp, Chlorella protothecoides
atgcgtgagctgcgcacctctggctacagagctgttgtggaggacgtgagtgcacgcgcggccctgggagtcctgctgatctgcgcagcccgggaatcccccctccctccctccacgatcacattctcacagggtgcgctccgccgttctttcttcgcgcgcccacacgtgcctgcacccggtggtctccacgctgcacggtcaggcggcgaaccgcgcctgccgctccctcatcagccgccgcggctgcaagtggtggggtggcggtcgggcgggcagggcaccctcggccagcactctctgaccttttcccgggatctgccgatcactcccccctttccccccaggcagcacgacgtggagcgctttgccaagggcaacccggacgccagcctggaggtgctggacatcgaggacctagtgcgactgggcacccagcgccagctctgccccttcctcctcagcaagtag

SEQ ID NO: 5063 - DNA, 468 bp, Chlorella protothecoides
atgcccgggcccgatggtcgtgcgacggttggtgccccaacaacagggcctcgctcctcggccaggcctcgggtggccctggccaacgcgaccaacgcggccagaccgggactgggaagtggcactgccgccgggtgtaaggcggccctggccaacgtgaccaacgcggccagaccgggactgggaaatggcactgccgccgggtgcaaggtgccggcgtggtctggcggggcggggcctgcacccggccgagcagcccccgctcgacgccctgttggcgcaggcgcgcccgcgccaactcccccttgctctatttgcggcaaggtccccatgagctcggcctacgaggcctcctgcggccacctggcctgctatgcctgctggctaggggccctggccaagttcaagtgccccacgtgcggcaagggggtgcgcaagtcgcacctgctcccgaaacactttgtctga

SEQ ID NO: 5064 - DNA, 357 bp, Chlorella protothecoides
atgcacatgtcgccgcgctgtcagtatgtgccacacctgaacgatccagtgggtgacggcatcgcggagtcagggtgcagaaaaaccatgtacatgcatgcatgcagcactgagtgttgccggggtcaaaactcgacagcaaaacacactcatgcgcagggctggtttgacgaccgggtggagtgccgcgctgcattgggcaggctgccgtccctggaaaagctaaaggacctggacaggtccttcctgccctggaccaggtgcgatgagtgtgtggtgggagggggagagagggaagtagaagggtcaagcagtccactgaatgatctgtccatggtggcagcagactggtggtga

SEQ ID NO: 5065 - DNA, 3072 bp, Chlorella protothecoides
  modified_base (673)..(682): a, c, t, g, unknown or other
  modified_base (743)..(849): a, c, t, g, unknown or other
  modified_base (914)..(923): a, c, t, g, unknown or other
  modified_base (2062)..(2071): a, c, t, g, unknown or other
atgttttccgcgcgcgatcaccggaacgcactagcacgatcgtcctgcctcattgccacagcaatgcacaggcgatctgcgtttcctcacgtatcaaaagttcatgctgtaaatatgacgtcggatcaggccccagcatcgggccgtggcatccagtggacgggagacggcgactctccggcacaggacgagtcagtgctgcagcaggaaagagaaaagcatcgaagaagagctgagaagttcggggtggacttcgtcgagcctgggcatcggcaagaactgaggctggcgtcaaagaaggaaaggttgcagcgccccggctttgccacaggcgttgatctcttcaccgaggtaaagcggagggtggggcgtagaatgcccatgagagccaagctggccatgcgcgattttcccagcatacctgcacggccctgcccggcatcgaccgccctccccatgcaacaggaggagattgccaagcgggagcaacgggcaggtcggttcgggatgtctgacacgggcctgaagtgggagccccccgccaaggacgaggcagaggagaagcgggcgcagcgcgccgcacgatttggcaccgagtacaagcccgccgatgccctcatggacgtcggtgggtatgggcggcagggaggtgtgccgtgccagccctgggcannnnnnnnnncgccctcatggacgtcggtgggtacggggtcagggaggtgtgccgtgccagccctgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgcctcgcaacttctcctcggcaccttcatgtatcaccaaagccctccccacgttccacccnnnnnnnnnngcgggagcgaatgaatggacacaggccgctgttgccgcctttccattcccagaatctgcggcaaacttgtgctgtcgttaccccgtattgcctcgttttactccgtactgcctcgaaacttctcctcggcacctccatatatcaccaaagccctccccacgttccacccctgtgccttcacccccccttctcctcagacctgctggaggttcgggcagagccatcgctccacaccgccctgcgacgagaggctgtgtatgtgtacggcgtggacctgctgtccaccgctgacatcctgcggcactttgcagactatggccccacctttgtggagtggatcaacgactcctcttgcaacgtcctcttcgccgacgggccgagcgcgaagcgagccctggcaggcctcgggaaggccctcccccccgctgaaggctctgagctccaaggtgagatgggtggggagtggttctttgctgtggcagagcaggggcagggctgggttttcgcttcgtgggtagatgcattggtgggtggagaaggtgctgcgcaggcccagtcacagcttgcccggctgcacctgctggtgcatgggtgctgctcaggcccggtcacagcttgcccggctgcacctgctgctgcatgggtgtgcatgggtcagactccagcccctcgttgctcccgcctcggcggctggcaccttggtatcccaagcctcctctgcacacacacaggtctggacgccgcagacccctccaacatggaatacttgtggcacaagaccgcggaggaggtgcgcggcgccacctccgacctcctcatgcgcatcgccaacgtggacgacgtgcggccggagggcaaggtgcagtcgcgcaggctgtggcaggcaggccagcgcggcaggggccagggcgggcggggcgcccaggcccggaagcggcagagggacggcgacgaggaaatggcggacgctggggagggggccgagcagggggtgagtcacggctggggcgtggctgaagaggtggggggatgtctggtgcaggagaggagcgtgaatgatggatgtggcactggagatcggggaggaggcaaaggggaggtgtctgggcactgcgctgcacagcaaggcatgcctccannnnnnnnnntgctagggaggggggcgagcaggggggggggggggtgtctggacactgcgctgcacagcaaggcatgcctccatagaaatgaacgccccagctcacaacaacctccctgcaggacccggggcggcgacggggaagggacaggaggccgcgtgccgtgccggcgggcatccccgcagccatcttctccaaggcgctgggaggcatcgcggcggaagccgcggagcgaaaaccagccacggcgcatgcccccgcgccggcccgggaggcggtcacctacggcgacgtctagtggggcttgggcgtgtgatcagctgcaaggacggcgtggggcatgccgctccccacctcggcatctgacgccgctggccgggcaggcgcaggcgtatgcgcgctgcctgggtcgccgaatcaccgagcggaatgggcgacgagaggtggagccatgtgcacagccagcaagccactccctcgagggtgtggcagactgcagggcagggcaaagagggataggccgatgtcttgagacaatgttttcgaaaggccctgctctcacgctgggggacagccgaccctttacattgccatgcttttctgtgactacccaaaactgccaccagtatggctacagacatgcctggtccaggcaaaggaagcctggttgtattgtattggaagcatgcactcccgagcccgctctctgccgagttctcaggggactatctgccattcctcgatgtggaagaggtaaaagagggcgtgagaaatgcccgcagccagggtatcacccgtggtgtcttgatcgtcttgcaggtatctcaatgcggattgccactccgagatgcccttggatgacggcggcgcgagatccaaggtggcgagtccttatatcacacaatgcacgggataaaagtcctccagagccgagcgagagtgaactggtggcgagtccctatatcacacagtgcacgggatacaagtcctccagagccgagcgacagtga

SEQ ID NO: 5066 - DNA, 1104 bp, Chlorella protothecoides
  modified_base (303)..(312): a, c, t, g, unknown or other
  modified_base (780)..(789): a, c, t, g, unknown or other
  modified_base (908)..(1034): a, c, t, g, unknown or other
aacgcctccgccgccgcgccggacggcggcgcgcacctcatcgccggcgcggccgactcggccagcgtggagagcgggctggccgcgcagcgtgcccgtcgtggcgccgcgctccaggccgggccggggtctcccttccgcggcaggctgcgggcgcgggtggtggtcgcggacctcaacgcggcggggggtaaggactatgtcgtctaccaggtgcgcgtcggcgacgacgtcggcgagtggacggtggcgcggcggtaccgtaacttcgaggggggagaagggggaagagggctgaaagtnnnnnnnnnntcgagggggggagaaggggtaagaaggctgaaagggggagaacggagtgggagtgtgtgggcatgtagggcagtgcaagtctccgtgccctcctggggtcgcaagggtgccctccttgggatcttggctgggcccgggctgtcgcacctggtgctgcctcctgcaatccccctcggcgcttcaagtccacaccctccccctcatccctccacacctctcccaaaggctcaagctgccacccaagcgcgtgtttgtgcactcccagaacgtggactttgtggaggagcggcgcgtcgcgctcgacgcctaccttcagacggtgctggcgcacccagtgctgcagggcaagctggggttggggggaaagggaggagaagtggggtggttcagtgcggggactggagcggcaacagtggacaatgctcccggcaccaactgcttgcagccaggctgggcgggcttgcggtnnnnnnnnnngactttgtggaggagcggcgcgtcgcgctcaacgcctacctccagacggtgctggcgcacccggtgctgcagggcaagctggggctgggggaaatgggaggagaagtggggtggttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggcggccggactcgcacatgctgccctcctgccagccaccaggttgcagcctgacgggcaatttgtga

SEQ ID NO: 5067 - DNA, 738 bp, Chlorella protothecoides
atggcccctccgtgcagtccctcgaccaccctggcgggggctccctctcccccccgccccccgactcccccgcccgatgacggcctcagcgtctccgccccgctctacgagctggtggactgcgtgttccagctggccacccgcggcttcttccggcgccaggtcttcgccgtggcgcgccaggtgctgtccctcgtggccggcaccaccatcgacgagtacctgaccgcgcgcctgcgctccctgcgctccgagcacaccatcggccgggccatcgccggcatccaggccgcgctctggccggggggtgtgtggtaccaggccacgccgcagtaccgcgcggcgcagggagtggggttgggagcgggaatcggggtgctgggcgctgggggtcccgggtctcgcgcgcggccccccgccgcgcgcgccgacagcttcctgaccccaaacgggcccccgccgctggacgctgaggaggtgcgggaagccgtggcgcagctgctgctcacgtgcgcgcccgccaccctcgtcgggctggtgggcaagtctgcgtacaccagtggcatggaggacgtgatcgagatgatgcagagcgagacgctgatcctgcagctagggtacggtgcgctggagatcctggctgtgcacctcatgcccgagctgaagcccttgttcctgagcctcaagcatggcggcctgggcaggccagatgctgatgaggacgggccagacatgtaa

SEQ ID NO: 5068 - DNA, 291 bp, Chlorella protothecoides
atggcatgcgcacggctcactgttctcccctaccccccaaccaccctcatccatatcctcccataccaacagctcttcccgcgcctggagccggcgggcgtggacctgatgaaggccatgttcgagtacgaccccgtcaagcgcatcacggccaaggacgccctcctgcacccctactttgacgacctggacaaggcgttggtggacagcatggaggacgaggaggtgggggagcagctggccgcctccatcgccgccctggcggcccagcgggcaggggagacggcgtag

SEQ ID NO: 5069 - DNA, 585 bp, Chlorella protothecoides
atgatgtaccagctgctcaagggcgtagcccacatgcaccgacatggtgtcatgcaccgcgacctgaagccccagaacctgctggtggaggaagggccccatccagaccatcccctgctcaaggtggccgacttgggcctgggccgcgccttctccatccccatcaagtgctacacgcacgagatcgtgaccctgtggtaccgcgcccccgaggtactgctgggcatcagctgctatgcgccggcggtggacatgtggagcgtcgcctgcatctttgccgagctggtccgcaagcactggccaggcatgcatcctccagccgcgctggccacccgagagcccaccccaccccaccaccacccctccgcgcagcaagccatcttccccggcgacagcgagctgcagcagctgctgcacatcttcaagctgctgggcacccccagcgaggccacctggccgggcgtgggcaagctgcgcgactggcacgagttcccgcagtggaagatgcaggacctggacctggtgagggctgggatctcaagagtcctgctttcttgtcatggcatggcgatgatgcggggatga

SEQ ID NO: 5070 - DNA, 222 bp, Chlorella protothecoides
atgaaggccaacctggtggtgcaccccgacaaggtgcggcagaagggcggggacgtggaggctgttgcgcgcgcagacatggtgttcgacatcctcaaggccgcctggggaaagttcgaggccgcccgtgcgcgccgaggcagcgtggaaggagccggcctgcacttgctttcatcctctccccgccatccccactccactgggcattgcttggtcggttga

SEQ ID NO: 5071 - DNA, 1203 bp, Chlorella protothecoides
  modified_base (1044)..(1053): a, c, t, g, unknown or other
atgccccgatcgcgagccctccctctcggtttcgcccggccaggtgtcgtatttctacgaccccgacatcggacagttttactacggccaggggcacccgatgaagccccaccgcgtggccatggcgcacagcctcgtgctccagtatggccttcacacccagatggaggtggggcccggaggggggtgccggcgagaccgaggcctgccctcaggcctcaagggagcctggacctggcttcgggcatcggcaggatacctttggcgccttcctggcatgtgcaggaagatgttgcaggggtgttgcgtgttgctcaccatcgagccatgttccggccccgtcgcgcagaggcggaggacatgcaccagttccacaccgaggactacgtgtccttcctgcgcaccgtcacccccgacaacgtgggcgcgcaccaggccgcactccgcgagtacaacatgtacgaggactgccccgtcttctccgggctgtgggagtactgccgcatctccgccggcgggtccatcgccgccgccgcacagctcaacgccggcgcctccgacatcgccatcaactgggccggcggcctgcaccacgccaagaagttcgaggcctccggcttctgctacgtcaacgacatcgtcctcgccatcctggagctgctcaagtaccactcgaggtgtgggcgggtggagtggaggggcaggggaaattggagtcgatgctgggctccgcccgaccccacgccgcggcggcatgcgctcctgctcataggcggcgtgccccccagcatgcatgccacaccgcccacccctatgttgaatcctatgtccagggtgttgtacgtggacatcgatgtgcaccacggcgacggcgtggaggaggccttcctgaccacggaccgcgtgatgaccctgtccttccacaagtttggggacggcttcttcccaggcaccggcgacgtggtgaacgtggggcatggtgagtgtgccgtgactggatcgaggggcgtgcggggagcctggacgttggccgtggaggagagnnnnnnnnnngatgaggccggaaagcgaatcccggggggaaggaagcggggagggggcgcgtcggtgagagtgtgccgtcactggatcgaggggcgtgccgggagcctggacattggccgcggagaagaatgcgcgtcgggttgcctggagattctgtag

SEQ ID NO: 5072 - DNA, 264 bp, Chlorella protothecoides
atgctccccgcgccccctgccgcccatcatcccccaggccagggcaagtactacgcgttgaacgtgccgctgcgggacggcatcaccgacgagacctaccaggccctgttccggcccatcctggccaaggtcatggaggtgtaccgcccggaggccgtggtactgcagtgtggtacgctgttctgggctgggtgcggggctgcggtgcctccagggccgggaggggtggggctgcagggcctccagggccgggagggtgggtga

SEQ ID NO: 5073 - DNA, 1419 bp, Chlorella protothecoides
  modified_base (32)..(41): a, c, t, g, unknown or other
tcgggagcggggatcctcctctcaccatatgnnnnnnnnnnccaaggtggttgtcgagccccacaggcatgcgggcgtcttcatcgcgcgcggcaaggaggacgcgctggtgaccaagaacatggtgcccggcgagtcggtgtacggcgagaaacgcatctccgtcgaggtggtgagttggttgggtggtgtgtagtgtgtgtgcgcggtgaatcaaggggctgtcagggccgggagcggggatcctcctctcaccatatgctaatcagtggtcacagatggctgttgaccggctcacactcgatgtctctgtcatcgacacacccacacccaaacactgtaccacctcctccccccttgccctcaacaggaggctggggagaagacggagaggccggggagaagacagagtaccgcgtgtggaaccccttccgctccaagctggccgccgccgtgctggcgggcgtggacaacatccacatccgccccggcgcgcgtgtgctgtacctgggcgcggcctcgggcacctctgtctcgcacgtctccgacatcgtgggccccgaaggcgtggtctacgccgtggagttctcccaccgctccggccgcgacctggtcaacatggccaagaagcggcccaacgtggtgcccatcattgaggatgcgcgccacccgcagaagtaccgcatgctggtgcccatggtggacaccgtgtttgccgacgtcgcgcagcccgaccaggtgggcggctggatgggggttggcggtgcagtgactgggaggccgctgcgtggagggtgggggaggggttgtttcaggggttactgcctgatggactgcacggtgttgacatgcaaagccctgcatcaatccacccagtctcctgaatgcgctatcagcctgcgcctgcggtactctgacccggcaacatggtactgccacccctaccctcacgacaacacgaaagccaagccctcctccgcacattctcaacccccttcccccgaccctactcccgcacaggcccgtatcgtgggcctgaactcccagtacttcttgaaaaacgggggcaactttgtcatctccatcaaggcgtcctgcatcgactccaccgcgccccccgaggccgtgtttgcgcgcgaggtcaagaagctgcaggagcagcaactcaagcccaaggagcaggtgcgcaagggtcgggacggggggcgccactggcgcgtggcggcccgcggctgggcaaccgggcggtcagggggcctgggtgacgaaaccttacacacgctgacgcggccgagcacgccgggacgggcgcggccgccgggcgggggccctgagccgcccgccccgtgcgcgccgtttggcccggcccggcgcggccgcacgtggaccttcttccatgactccgacagccccccctga

SEQ ID NO: 5074 - DNA, 2136 bp, Chlorella protothecoides
  modified_base (516)..(525): a, c, t, g, unknown or other
  modified_base (789)..(812): a, c, t, g, unknown or other
  modified_base (1020)..(1029): a, c, t, g, unknown or other
atggagactcaagccgaaatcatggacatcgatgcccagctggatgcgctcgtggaggtgatgcgacctgccgggccggggttgggcgggctcggcttgtcgagatctcgtgaggagttgaaatctgtgatgcctcccattgttaactattcacaggagcttgggcccggagatgacgacagccagtttccggaagataccctaaaggcagagaaagacgctggggcaggaaaggagtttccggtgggagagctcggtggaacgggatctgcaacttccgacggcgtccacgagcagggcatggacgcagcggacgatctgaacaaagatcatggagagccaccacgagacgctgcgccacccctcgagccgtccttgacgttggatgttcctgtactgatataccactgccaaaacctgcttgcacatctcgtcccatctcttatccagtttaatggtgtggatacaacagctgcgccgagccccaccgaggagcctgagccgttgggggaggtnnnnnnnnnnctgttcctcattgacatgcccacagccacgacagacacatgtcctatatcatgcttgatcccgggcgctgatgccctgaacgcctgtcatcctacaggagaccatgcggcagccaaagccggccaaaaagcccgcttttgggaagcccatcctgctggccaagaagacaccggtaggatgatgagagaaatgcaaaatgtgcccatttacctagttggatgttcctgtactggtataccactgccaaaacctgcttgcacatcnnnnnnnnnnnnnnnnnnnnnnnncaactcaggtggcgacatgcctccaccccctcggcgcgagccgctcgtgaacaagaagcgcatcctggccagggctgcaccagcctcccgctccgtcacaggcacagacgcaacggcaggaggactggcctcgcctaacgagaaggttctggtacgtcagcatcagttctgcatgtattcatggaattgctcggagccaaggagcgcnnnnnnnnnncctcgcctaatgagaaggttctgggcttggcagccgacaaacctggcaagcatgcagcgagcacagggtcatcacacaaggtggtcaagactgcgtaccagcctcaacatgctacgtcctgggccagcagcacagcaatgcaatttctctgtgccccatccaccttccccccagctgttctgtgaggagctgcgccccactctggtggccgaaaaccccaaggcctcgatgcccgagctctcccgtctgctcgcatcagcctggcgggcgacgagcgtggaggacaaggctgcctatgctgccatgcgtgcggacctgatggcagctgccggtgatccggcgatctctgggatcccggcaaccgctgagggcaggaaggagctgaagaagagagtccgatctgagggaggcaaacaggcttccaaaaccaagggtgggtgtgcatcctctcaagcttgcatttgctttggcgatacctgtggctgctggtatttatccagacgcacaccactcgtcacctgcccttcgggcactcacgcagatgaggctgcatctgatggagagagcgagaaaccctgccctccaccgagcagcaaaaggttgagggcggcggctgcaacagaggcgcacgacagcggtgaagaaaccgaggacgacgacaagctgcgcatggtgaggcacttgtttatgaaaggaccgatggtgatatgcaaagttggcacctgcgtcagaacaaggcctcacgtccaatggcttgtccgcccaattccttcccattactatcctgcacaccttctcacctttcaggagtgtgactggaccaagcaccctgccgcattcatcatttctgagaatgtcaagaaaggtgtgcctgtcttggtggcggcatgtgcatttggctcctggcttgggagggggctcgggtctgtctcgcggcgggcagaatcaccatgcaaacaagagccctgtgtgttcatggcagggcgcatattccactcccatgctgaaacattggttgtgggcttgggttggctggagcacacattccctgcgtcacacacccaaacacaggtcattatctcgtggccaggaagggactccctctga

SEQ ID NO: 5075 - DNA, 2904 bp, Chlorella protothecoides
  modified_base (1277)..(1323): a, c, t, g, unknown or other
  modified_base (1996)..(2005): a, c, t, g, unknown or other
  modified_base (2501)..(2510): a, c, t, g, unknown or other
  modified_base (2650)..(2659): a, c, t, g, unknown or other
atgcgctgctttgcgcggcatcggagcccatctcccctcattcctcccagccttgccaccatgcgtgctttcgccccatcggcatgtgctccctgtggtgcatcccctcgttctgggacccggggagcgctcgccctgcgtgccccagcgccggcattctcaccaaggagggcccagggcaggagttttgcatcctcatggccggcgccacccatggatcatgggacggtggctggagccgtcgcgacgcaggcgcccccatgccccgcgacggttgtacccgccagcaagcctggcctgatcagccatgatgaagttcgggcattggagtcctccctggaccatggccactccgtacgggcactgtaccgcttcgacgccgccctgcgtgcgctgtccttggatgagtttggtgaggcggggccggcacccctggcagagtgtgtgggatgtgtcatgaggccaccccggccccgcacgagggagttttgcgtcccctcggaccacgaggccgccacagggcaatcccatcggcgctgctggcgtgcaactaaaatggcctgtcatcccccaccccaggtaccctccaccctgcacccccacttttccctttgcctccctttctcagccgccaagctgcgccccgtcatgctggagctggccttcaacctggagtctttcaaccccgccttcaccgccgttctgctcaaggttcagagcaccatcggcctgagcgggtaccacgcgcgcgacgaggcgctgaagcgcctgatcctgcccctggcgggggaatacgggctgcacgccgaccagccccagggatgcggcggccctcgcgccagtcgcaggcgggatgtgggcattgatgcaagggggtgcggagggcggtgccgtggcgattggggcgcgccgctcctgctcggccgacccgcccacctagtaagtttccatcgccctctcacacgccctttgtcccacgaccaccccgcaggcgcgacacaccgcgcgctgtttgccgagttctacgaggacctgctgggcgaggcgctggagccggcgatgcgcgccgcggcgacgagcttcccccccgccgcggcgatcctctactcccagatgatgcgcgatgttctggggggtggcgggcgcaccggggacgcccaggagcaggtgggtcttggtgatttggggagggtggatggtatgcgtgcaatggcgagacctggcggcgctcggcacctccgcttcacggcgcgacagtctgttcccttccccccaannnnnnnnnnnnnnnnnnnnnnnnnnnnnnnnnnnnnnnnnnnnnnncccccccccccccccccccccccttccaacaaggcgtcgtacgcgctgggctacaacctggccatcgagtacctggcggacgtggagaagcggctggagctggaggccttccgccacctggacgagcgcgtgctggcgccggcggggcgccgtctgtgtgcctgggagttcctggaggtgcacgccgagggcgaggccgaacacgcggccatcggccacgcggccgcctgcggcctggtccccgccgaccacgcaggcctactgcacgccgcggccgcagaccatgatcgcgactttgccgcattctacgacgcgctggcggccatgctggagcggcgacgcggtggtggtagggggtgtgaggagggcgaggcggcgtggggcgctggggttgggactttctgctcactcaggcgcaggctgctccccccgtcccctgcctgcctcgggggctggatcaccggtctcggtggtgtgatcactctgggtgatgtcaagtgcaagtgggtctttccagacgagggcattttctctccaagaggccatcaccgatgccccgcactcggtgcgcggcggtgctcaggtggtggacaggtggacatcgcgccgtgtccgaggggcgcgccgcagccctccacacctgccctcactcctccgtctgctgcgacaggcnnnnnnnnnngcatgcagggggctggatcaccggtctcggcggtgtggtcactctgggtgatgtcaggtgcaagtgggtctttccagacgaggctgttttctctccgagaggccacccccgatgccccgcactcggtgcgcggcggtcctcaggtggtgggcagctgcggcagtgtgggcaggggtgaggggcgaggatgcggatggggttgggtgtcgatctcccatggcgacgcagggcacaagcatgcgcacaaccatgtcacgagggcccagacacggctggcacttgtcactggaacaggcccccctctccctcgccaccctccagcataccttcatccagatgtcactcctgccacgcgacgccagctcgtacccgggctcacgcagctttccctgcatcccagtggagggtgcaggagcttgggggtcatgacccggcacgcattgcgtgccgagggcgggcgtgcttgctgcggtcagtcatggcggccaggccggcnnnnnnnnnncatggttgtgcgcatgcttgtgccctgcgttgccatggaagatcgccatccaaccccatgcgcatcctcgcccctgagcccctcaccctgcccacactgccgcagctgcccctgctggccacctgccgcctgctgcagcnnnnnnnnnnagtggagggtgcaggagcttgggggtcatggcccggcacgcatcgcgtgccgggggcgggcgtgctgcggtcagttatggcggccaggccggggcaggcctccccatcctcccctggggctctcaccagcaaggcacacatctccagggtcgagccggggggcaggtcctccaggtccagctcgttgtcatctgacaagaaagagtggagggcggtgtgctgcatgccccggcccagcgatgtga

SEQ ID NO: 5076 - DNA, 1545 bp, Chlorella protothecoides
  modified_base (483)..(492): a, c, t, g, unknown or other
  modified_base (548)..(557): a, c, t, g, unknown or other
  modified_base (802)..(811): a, c, t, g, unknown or other
atgtgtttcacggtcgccgtggccagcttaccgtatggggggagcgtgccgccgtgcgagcccttggatgagatggcgagggagtttcaccgtggcttgaaaggcaacttcagccagtggaacaccgaaacgggccggacgaagcgccgcatgccctcgcacccggggggggacgttccgttttcaggcccggaaggagatcgacctactccggacgagacaaggtccagccactgcattgggcaagatggattgtatgaaggcatatgcgggacgtcaaccgtacacgactcgcagggttggggacgcccgcgagaagcgactcttgaggagcaggcacttccgcgagccgcgttcagcgtccagagacacagaaatgcggtgcctgagtgtgtacctttgaatctcgcacctcggagtgtttgtactgcgcctgcccacgatgcagccaaacacaacaaaatgtatgaagattttctgtcnnnnnnnnnncccactgtcaacaagaggtggtaccccggagcacacgagccaggaagccgagaatnnnnnnnnnncccactgtcaacaagaggtggtaccccggaacacacgagccaggtagccgagtactgggcggctcggatatgtacttcgatcctcgatgcggtgggtttcgacaaccacgagtgtactgctgccaccacaagtgatagggcgctgccgcatgtgtacctatacattgtatatcttcaatgtgagcgagaattccaggggtttccagcaggtacggatgtcatcatgtgcgctctgccgcgtgatnnnnnnnnnntgtacctatacattgtatatcttcaatgtggacgagaattccagggggttctagcagggacggatgtcagcatgtgcgctctgccacgtgacatgctcttcgcacgagccgcagcatgcgcaatcttgacctcgtttagaaactgcccacttccgctctcctcagctggcgcagccctacttcttccacgctattcgccggccatcttatctcgacttgagtccgccatggctcctgatcaggtgagggcctcgcatttgctggtgaagcaccgcgactctcgtcgcccgtccagttggaaggaggcccaggtcaccaggagcagggaggaagcggagtcaatgattgcagaattccaccgccagctgacgtctggtcaggcagactttgccgagctcgcccgcaaagaaagccattgcagcaggtatttacattctgggcgggcggattgggacgctccgcggcctgctgatcgtccgagtgcccgggccggaggtgatctgggcctcttccctcgaggcgcaatgcagcgtccctttgaggatgctgcctttgcgctgccagtgggagggctgagcggtcctgtgtttacggattccggggtgcacctcatcctgcagccgctcaacctgagcagtccacacacgcttgatctatcagatagcaaagattctgcagtgtatgacgctgagagccgtctcccaatcatgaacacggaatggccagcactttag

SEQ ID NO: 5077 - DNA, 1731 bp, Chlorella protothecoides
  modified_base (204)..(213): a, c, t, g, unknown or other
  modified_base (297)..(306): a, c, t, g, unknown or other
  modified_base (772)..(781): a, c, t, g, unknown or other
  modified_base (1580)..(1589): a, c, t, g, unknown or other
atgctgcgtttgctcgacagatccagccccgcactcagtcacggcggcctttatcgcgcaggtgcacccccacaacctcgaacctgggtatggtgtgaggtgcgcggagatgagcaacgagcccgggtgcccggagaggtctccggcgcattctcgtggctctcatggcaccacacccgccacccccagcactggcctccttcnnnnnnnnnnaatcgcgcaggtgcacccccacaacctcgagcctgggtatggtgtgaggtacacggagatgagcaacgagcccgggtgcccggnnnnnnnnnncctgattggttgagctgcctcttctccctctcgatgttccacccctgcccccgccacccgggtgtcaagcgcaacgagtgcaacttcttctgtgcccgttgctcaccgcgagaggggcaggcctactgccgcatgtgcctggattcgcacggcgactgcccggggcccgtctttcagatcaggaaatacatgtaccagacgtgcgtgcacgtggaggacatcgccccgctccacgacgtcaccggcatccaggcctacctgatcaactccaagcgggcactgctcatccactccaagatctccgccctggcctctgccaactccgccctggatgagatctgcaggtgccccctgtgcctcgtgttactgggactgccggggttgggagggcacgatattggatccagatggatgggctgtcccctgcaccctccgctttctagggctgggtgccgtctatgtgacnnnnnnnnnntgggttgggagggcacgagattggatccagacggatgggctgtcccctgcaccctcccctttctagggctgggtgccgtctatgtgactgttcgtgcccagatcaggccggcggcccctgattccggccccccaactgccgacgctggtgcccctcgtcccttgactacccaccctggcccaacatcttctcgatccgccctgccacccccctcaccttcctcgagtgcccctccctcagcccccccttccccaaccctgccactcccacagaggctgtcagcgtccccttcgctcggactgccagtactgttcgctgcactgcaagaatgtcgccaacagcaacagggagtccaaaccccctacccattccgccaggcaccttccgccggcttctccgaccccggcctcgccccaccccgccgcgcccccgtcctctgcggccctcccctcccgtcagaccgccttccgccccgtgccgcgacgggagcccacgggggggtccccgcccgtgctgcgcccggtccccctccgccgcggggtcgtgctggacctgccctccccaaactccaggccatcgctgctggtgctgcggcgggacggcgccgcgccgccccagccctgggcggagcgccgcgatgcgctcgcccaccccgccctgccccggggccccatggccttctcgggcttgccccagcagatgtacgatcctgggtgtcagggccaccattgctcaggggaggagccttgtggggattgcttctatgcaagtggctcatgatccgctgcgtcggcactcnnnnnnnnnnagccattgctcaggggagggggcttgtggggattgcttctatgccagtggctcatgatccgctgcgtcggcactccctgccaggcgcgggaggggcaggcgcgggaggggccgatcgggctgttgcgccacgcagcctttga

SEQ ID NO: 5078 - DNA, 2712 bp, Chlorella protothecoides
  modified_base (396)..(422): a, c, t, g, unknown or other
  modified_base (1424)..(1433): a, c, t, g, unknown or other
  modified_base (2518)..(2527): a, c, t, g, unknown or other
gtacggcgccgacgcttccagcgagggcgtgcagcgcgacctgctgcccatcatcgagggcagcgtggtctccaccaagcacggcaacgtgtccaccgaccacatgctgttcatcgcgtcgggggccttccactcctgcaagccctccgacatgatggcggagctgcagggccgcctgcccgtgcgcgtggagctcaagggcctcacgtgagtgaagatgtgtgttactgggagctgggggggagaggaaggggggccaacggtatgctgtggagtgaagcgaggggggtggggcgagggagtgacttgcggggaggggaggaaaggggcgcgtttgaaaacgtgtgtgggtccactgggcctgcttccactccttccttatccctctctatcaannnnnnnnnnnnnnnnnnnnnnnnnnnatcaacccccacccccccaccccaccccacccccgctcgccacaggcaggatgacttccaccgtatcctgacagagccggagagtaacatgctgcgccagcaggcggcgctgctggccacggagggcatctcgctgcgcttcaccgacgcggcagtgcgcgagatcgcgcgcaccgcggaggaggtcaacgccagcgtggacaacatcggggcgcggcgcctgcacaccatcatcgagcgcatcgtggaggacgtatcgttcgaggccccggagctggtgcgcgcgggttgggtgggtggagggaaatgcgcgagggatgccctcgatggggtggggggggctcgtgtggttgggcccccagagaggagggaggtcagggcggcagggtggctccatgcttccatcatgagcaggggatctggcacagagatcccctccctctcctaccctctctccgtgcagacggactccgggagtagaccgatggaagtggtggtggaccgggaggacatcgtgaagaagctggaggacctgctgaagaaacaggacctcagtcgatatgtcttatcgcagggacctggaccacgaacaaccagcgcgaaatcctgccagcccgagcgcggggcgcacctagcctgcaatgcaggcgggtgctcgacgtgccggcctactactgtgcaagccatgtgcagatcatgtctggctctaccgggctctcgtgacggggcaggggtgcatggagtgccacctggccatgcaacgggccccggaggtgactgggtcctgcagcacctgcatcattgcacatcgagggctgcagagccgggcatcggggcaaccatggcagcatggacgttctctgttcacatcaggagggtcgtggagtccctcaacatcggaacgaccgcggcaacccccgggcagggagcagcagccggagtggctggatctcctccctacgaaccccggcaccaaggtggtactgtacaagggcccggggnnnnnnnnnngcagcagccggagtggctggatctcctccccacgacccccggcaccaaggtggtgctgtacaagggcccgggcatgctcctctttcgcatactggtcaggttcaaggtggctcagatgtgtggcgtgggtgccacaggagctctactagccacccttctgcggcaggaggtatgtcggcgaactggccatactccccccgtcggccgggaacatgcccccacgcctcctcttcagcaccatggacttttggggcaatcgagaggtgtggcgggtttggagagaagcagcatcggatggttgcgtgtagtacctgtcaccctgcccatactccatgcacggcgattgacagagcctgaagcccacatcctcacctcgccagcccagtgggcaagacacaatatgtttggttcctttgaactttccaactcaacaggacagggcggtggaccttggacggctgctcctaccccaccacggcagctggctgggtgctgctcaaggggttgctgcgtggagaaatgcatgcacgcctggctcctatgccagatggcacctggggctgggaaggtggtgctgaggcccttcaagaaccatgtgctcacgcatgaagcagttactgcagttcatcttgtgcaatcagacagtttgggtaaaaggagctgtgtatgcatgggcccaacaggaggtgtgggacagctcaagcttgccactgtggacgtgttggccagacaagggaggcacgaggccgctgccagtcaggtcctgaaacaggttgctatcacggcaggagctgccatgtctccctgtttggaggctgaccagtggcaagggctgccccttgcagctcctgcttgcttgtctgtgcaagcgggatgcagcactcaggctgggtactggaggcggggagagagcaagagaggagtgcatccggagcaagccgacactgaaggtgaggaaggcggggcatctgtgcggcggccattgcaggcggcggccggctcccggcaagatgaagggctcggactcgggccgccgcgatgcaggcatcagtactggcgcggcgccaacatgaaacccgcctctnnnnnnnnnnctgcaagtgaggcaggggagagagcaagagtggagtgcatccggagcaagccgacgctgaaggtgaggaagggggggcacctgtgcggcggccattgcaggcggcagccggctcccggcaagataaagggctcggactcgggctgccacgacgcaggcatcagtactggcgcggcgctgacatga

SEQ ID NO: 5079 - DNA, 1785 bp, Chlorella protothecoides
atgggcgagtgccgggagcctgcggagtcaagggcggggtgcatggccgcaatctgctgcacctttgccagtaatactcacccgttcattatcccacgctttatcgcagaggcagccatggggaagatcccggtcaagttcagggaggtggtctacaccctgtccccgtacgagcagaacgtcatgggtgggctgtggagggacatccctcacaaggtctctcactactccaccaaggtatgggacgtgaggggtcccatcatcacatcggcatcggaggcctcgggctgggtggttcgggacgccgtgatcttcgctgtgcttcccctctggggcattggctgggtgtgggggtatgtgggtggtggatctgagagggcgctgggcagggtgggtggggctccaactgtggtccgcagatcacattcactccagagtctcaatagcgctgggccatccaaagctcaagcttcggcaccttgctgttccagcactgtgtgtctgtcctcccgctgtacgcttccttactgtaacccagccaaacgagtgtgtcgcagagtgtaccaggcttcacacgagatcccttatcggtccctgcatcctgccagtcctgctaaggcgaggtgtgctgtcaccttccccctcgggtgccaggcaggctggcgacgtgggatgcaaaccggtttgcggcacttcgacggtgtgggtgccgacccggcgccgtcgactccctcggacacgatcgagcaccaactggcagcatgcgtgcgtgaatacctaggcaattacctgtacgacaccgcgacattcctctgcgagcgtctggtcgctgaaacgccatccacggtgtgttggcatgctggtggtgggcccctgacgatggtcccatcttccggtttcaaccctcacagcctcggcctgcccgttccacaggcacacacgctccttctggcacgatgttactacctctcgaatcaaccataccgcacctaccatctgctgaaaggtggagaaggagttgcgcccccacccatctgcatgtcagctggccctgggtgcttgtctgcctccgacccccgcattccatcgcctcaggcttcgcctccctcacagggcgtggcccacggcgcggcgggtcacttcctgctggccaaggtccacacgctcatgaaccggcacgacagcgcggcctcccaccaccgcgcggccctgtccctggaccccatgctgtggggggccttcgaggggctgtgcaccctgggcgccgagaccgaggcccaggcctacctggagggcagcgggtgggcggcgcagcatggccatgcgcccggtgggggccgagcggaggcttgcacctcggagcagacacctggtgccagccccagtcaggaggccgacgtgggccccacgcccgggtcatcgcaggtgggccccccccccacagactcaatcgccgaccaggccttctccttccccagccccgcacccatggccgacggcggggcgctgctcggcgtgaccccgggctctggaggtgggccggggtactccggcatgcagtcctacgtcaccccttccccaaccgggctcctggcaggtgcgtggtggggtgctcagaggatgcgagcgtgtcattcccgggctgacggatggacatcactgcatgctcgggtgcaatctgcgcaacaggggtccttgctgcggatgcgatccgggcacattccctgcgggccacccttcggcaccccagcaagcacccccaccatgcaccgcgcagcccccccg

SEQ ID NO: 5080 - DNA, 501 bp, Chlorella protothecoides
atggggtgtggagacacagaaaaggtacgagtgttcgatctgagctggtctagatcggatggacggcatcttcgagaccggcagtgcgccaccacggcatcacatcctcctcgcaggctgagctccgccaaggtcctcatcgtcgggtgcacgggccttggagccgaggtgagacttgaagtggccgctggggtggacctggaggacacgatgtcttccatgtggcgaggtgtccctggtgccagcaccccacgcagtgtccaccctcccgtcctccccatgtcccaggtggccaagaacattgtgctggccggtgtggggtcggtgaccctcgtggacgacacgccatgcgcgcagcgcgacccaggcaacttcctcgtggccaagaacattgtgctggccggtgtggggtcggtgaccctcgtggatgacacaccatgcgcacagcgtgacccaggcaacttcctcgtcctggcagacgctgacggcagccagacgtga

SEQ ID NO: 5081 - DNA, 654 bp, Chlorella protothecoides
atgaatcccctggtggatgtgcaagcccaggccggcccgccggcggggtctgggctagaaagggaggcgcacggcctggtgctggacctgacgggggacccggccagcgtgtcggcctccagcgtagcgtgccgggcggcaggcctccctttcttcgcggggggcagccgcggcacgatcggctgggcctttgccgacctgggcgagcaccggtttgtggtcgagcggcggggcccgggccccgacggcgccacgcaggcggaggcgtgcagcaccagctacccctcctgggctcgcgccatggctgcggacgtgggtggccgcagcatgaagcgcgtgcaccccgtctacctcatgctcagagcccaggcgctcagcccgagcggggctggcgagggagcaggcgccgccgctgccgacgccatcgcgcgactggacgaggagctggggaggcccagcggcctgcaggccgaggccctggaaagcatgacctgcaccgcgcatggcctgcccgcggtgtccgccgtagtgggcggcatcctggcgaacgacgtgctcaaggccgtctcggggcggggcaggcccatggacaacttcttcctgtactccatcgccgacggcgcgggggtcgtggaccgatggggggatgcctga

SEQ ID NO: 5082 - DNA, 453 bp, Chlorella protothecoides
atgtttggcaccaaccctccctcttccaccccctgctgccctctatggtcacctttccccttgtcttcatgcaaccccgcatccccccccacacacacaccagggtacgacgaggaggcgcgatactttgaccccgacgtcagcgccgccaagcgcgcgggcctgacctccgacctgctggacctggtgcggcccgcctacgtggcgcagctggacgcgctgcgcggcatggcactggcgggcttctccgcgcagctggcggacccgcaggcgcccgagggcgaggcctgggtggaccgcgtggcgcggctggaggccgaggcgctggccatgtttgacagcacggcgcccgacctggcggtgggccccgcggcggaggcctgggcggggctggaggccggggcgcgggagggcctgcgctcggcgctgggcgccgaggccgccgccacgcgc

SEQ ID NO: 5083 - DNA, 606 bp, Chlorella protothecoides
atggcggtggacctgagccgcgcgtggcgcgtgtcggccgccgtcttctacgaccgcccgaccccggccctccggcccgcgaagatcgaggagacgcacgccctgctgcagcgcctgcgccccgacctggcgcgccccctgcacccgggggactggctggcggcggagctggcgggcacggccagcagcgccacgccgctgaccgtgcgcacggccccgggccaggcgccggcgcgccgcggcggtcgccccgccctcgtgctcagcagcaccagctggaccgcggacgaggactttgggctgctcctacgcgccgccgatctgtacgacgcaagggtgagggtgcagggagtttccttttggtttgtttgggggagaaggggtgaggagggctccttgcggcagtggggtctagctaggagggagggagggtggctgaacagaatgcagggacggggcctgaaccgtaatccacgggctacgagaggggctggatcgcggcagggagaatgtgaagaggcccatgcgcatgagacaccgaccaagagcccaatgcgcatgagacaccgaccaaggggcccagcgacagatgcgaggttcgcatga

SEQ ID NO: 5084 - DNA, 486 bp, Chlorella protothecoides
atggacatcaacctcctgcgccagcccgggctggatgtggccagcgggcgccccgccgccgtcgccaacctacgcctgcagctggaggaggccgccaagcccagcgtggcggcggtgaccggaagctgcctgggcggcggcctggagctggcgctggcctgcaccgcgcgcccggcgctgcgcctcatcctgtccggggcggccattggggcggcggaggccgcgaccctgggcctggtggacgaggtggcggcggccggggagggcccgctggctgccgcgccggaccacccgctgcgtggccgggggtcgctgctggagcgggacgaccgcctgccgccccccgccgaggcggaggagctgtttgccgcggcgcgggacaagaccgcgcggcagtgggtcaacctgcgctccacgctgctctgcctcgacgccgtgcagtacggcgtcgcccacggtggccgcgcgggggaggacaaggtttga

SEQ ID NO: 5085 - DNA, 396 bp, Chlorella protothecoides
atgcgaacgcatgccaatgacttcagtccatacattgccgaggtgagtctgtgtgaaaagttggctcggtgggttgagagcctcgtgctggcctggcatgggaccctcggtgctgtgcgctgctcacgtcgcaaacactctgtttcatgttggggtgatgtgtggccatcaaacaaagatgatgtaaccgggcctgtggaggatggggaggtgtttgaggcctactgcaaggaggtggaaagcacagcggcctggggcggccacctggagctacaggccctgtcacaagccctgggcaagccgatcaaggtgtgggctgctgctgccgcaccacagctgttgggcgacgaacacccagcttgggcaacgatctacgagaccctctcctatgcttga

SEQ ID NO: 5086 - DNA, 750 bp, Chlorella protothecoides
  modified_base (126)..(135): a, c, t, g, unknown or other
atgggcgtggaaggggttctcgtgtgtatccgctgcgtcttcctccaggggtcaagcattaatattgaccatgcctcaactcctcgcttctccccctcaaccaccgccaggtgcatgccggggtcnnnnnnnnnnagtcaagcactgatattggccatgcctcaactcctcgctcctcccactcaaccaccgccaggtgcatgccggggtcagagccgactatggctcagcctggggggagcgagacgtgattgggtgcctgctcgtcctcccccccccgccggcctccaggacaggtgtgcagccgggctgcctgcaacgttgcggcggtcagcatcgccctgcatgccccgtattgtcatgtttggggccagaaacgtctcgatccagcaccaccaatccctcaagcgatcccttccccatcctccctctcgctcagaggcaggcgaggaggctgtggcatccgcgtccgggtcggtcttctttttcaagaatggcgaggcccagggggaggccttctccggtatccctctggcgacctactaccccgctgtctccctgtacacccacgcctcccagccaactcccgctcgcgtctctgtcaactttggcgcaacgcccctggccatctgcggtgggcgggacagctccgaggccctcgccgctgccgtgcaggtcccggccgtcgaatccgtcgcggccctgtccctggcagtgagcgcacctccgcgtgcccttggcgcagcctga

SEQ ID NO: 5087 - DNA, 363 bp, Chlorella protothecoides
  modified_base (110)..(119): a, c, t, g, unknown or other
atgtacgaagagggagcttgcgactcacacacctcacaccacctcctccaggctgccatccctcgccttctccttcaatggtggcaaggattccacggtcctgctgcacnnnnnnnnnncacgaagagggagcttgcgactcacatacctcacaccacctcctccaggctgtcatccctcgccttctccttcaacggtggcaaggattccacggtcctgctgcacatcatcagagctgcggtggcgatgcacgagcaggcgtcgccctccggcgccgcacaggcaaagggtgagcctgggtttcggcccctggagaccgaggggctgccagtgggtggcagggctgacaatgctgagcgctga

SEQ ID NO: 5088 - DNA, 1086 bp, Chlorella protothecoides
  modified_base (260)..(269): a, c, t, g, unknown or other
  modified_base (736)..(745): a, c, t, g, unknown or other
atgctgcccgacacgcggctggagcgggcgggccgtagcgatcccgcccgccacgcctccgtcctgtcggacgcctgcgagaccgcgggcgtgatcatcgtcggggacgagatcctggccgccaaggtggaggacgtcaacacccgcttcctgtgcaaggagctgcgcgccgccggctggcgggtctgcaagcacactgcccaccttgggtacatgggagcgctccacaccgtctgctgctccggcgtgagtacgactcnnnnnnnnnncggagggtgtagtatctctgaggcaccagatcatgggaattccaagtgtccagcccccaaacacaccgcccactttgggtacatgggagcgctccacgccgtctgctgctccggcgtgagtacgactcgattccgcaccctgcaggttgcggtggtgagggacgacgtgaaggccatcgcggcggagatcaaaaccatgagcgctgcgttcaatgtcgtactgacggccgggggggtggggccaaccgtggacgacatgactctggaggccctggcaggtgaggagggtgggagggtgttctatgcgtgtgatggggtggggtggcggaggcagggggtgggggtgaccgctaggggggggtggctgggagagaatggctgggacgagaaggaggagggtgaaggtaacacatcgtttacccgacccccagcaaatgcaagaggggcgatggctgatcctgcacacnnnnnnnnnntggaggagggtgaaggcaacacatcattcacccaacccccagcaaaggcaagaggggcgatggctgatcctgcacaccaactgtcattctacccaccctcctctcctgcagaggcatgcgacacccacatctctcggaacccggagctggagcggcggatccgggcctattttgggagtgatgtcaccaacgcacacctcaagatggctgagattcctgaaggcaagggtgacaccttgggctggcgggaggggcttgccggccacatgaccatggccttctggctcaaaaatcaggtccagattgagcatttgcaccttgccacacacctcgtctggtga

SEQ ID NO: 5089 - DNA, 483 bp, Chlorella protothecoides
atggaggctggtatctgtcgtcccacgcccgtgccatcaccaacagcccacgcacccctgtcctgcgcaggcagcgccctggctgcacccttccggcggagcaagaagcaaagaacaagcggagagagtgatggcgtgtctccggggacctgtgctcttcctggcgaagatgtgaagccggccctcccagcccctgtgaagctgtcacccacagatcgagctccccaaaccagcatcaccaacgacctcaccctctccagctcccgcggctaccgtaccgtgcgtgccacacatggcgtgagctctggggcatggtactatgaagtgaccgtggagtccctcggtcagaccggcgcagcccgaatcggatgggccactgctgtggccgaactccaggggcctgtgggtggggatgccaagggttactcctaccgctccctggaagggtccaaggtatgctgcgtgtgtcattgccgaggctga

SEQ ID NO: 5090 - DNA, 1269 bp, Chlorella protothecoides
atgcacgtgggaatctgccagggcagctgggtacagactgggctagcccaccccctgggagcgggtgctgtgcatgatgcgcaaggtcctgtcgcacaatcgctccgcgcggccatcctgctcgcgctggcaacgttgatcactcctgccgtcgaggcgggacccgatgtccgcggggtgacgccagatctcctccccaggtacagcatcccctcggatgccgatttcgagtgtctggatgggcgaggcagtgtgcccgcctcacggatcaatgacgaatactgcgactgcacggacggcagtgacgagcctggtgggtgctgggagggaccagtacgaggatgggattgcctcgagcccatgcacaggctgtctcgtcgatgcaatcgcaatgcagtcgctgttcccctcgattccctggtccccaccgcgcgtgcgagtgcaggcacctccgcctgcccgggggggtccttctactgtgccaatgtgggcttcgagcccaggacactcaaggccgcattggtggatgacggatatggaggaaaccacaccacatcccgactcgaggtgcccctccttggccccgcagactgctgcgacggctccgacgagccggtaggctcctgcgcaaacacctgccaagcccgcggcctggccaggaaggccgagctggctgagcgcttgcacgcggcgcgagccgggctgcagcgccgggcgcagtacgtgcaggaggccgcatccaagctgaccggctggaaggccgagctggcgcgtctccgggacgatctgtcgcgccaggaggttgagcaaaatgcggcagaaggtgtgtggggatggctggccagtgggcgggggatgttgcgagctacgacatggaggtgcccagggttccagggactggcactcaccccctacggaatgaacgacctccttcacccagctcccaaagttttcactctttcctccatcgcaaacgtcccccaagcagccctgagggactcccttcaggccaaggaggatgagctgaaggctgccgcggaggctgccgagaaggcgcctgcctcgggaggggacaccaacaaggagcatcagggaagcaccgggacccccgacgccgaccaggctgctccagaggccatctctgccgatgaagtggtggcggcggaccaagtccatgaacatgtgctgctgccggaggaggtaaggatcgagggtgagagcccgctgtcagcttggcttggaggaacaacgcggacgcgccccacgtga

SEQ ID NO: 5091 - DNA, 1326 bp, Chlorella protothecoides
atggctgaggctcaaggagacggcaccgctcagcctgcaacacagacagacaaggacatggctgctgcagcggccgcggtctccgtccctcccggagtcctgggcagggcaaagacgggtgcgattggtgcggggcaatggctatggaagaaatgcttggcagctggctgggtgcgggtgggtgggcgagctgcgcatcaccaagggcaatggctatggaaggaatgcttggcagctggctgggtgcgggtgtgtgggcgagctgcacatcaccaaggtgcttggttgcgagccgggtttccctggcgtgatgtccatcttcgaccaggagtgttccaaggcccactcctcgcgttgttcacagccctggctgacgtgtggagcgccgcactgtccctgctcccaggctcccggagccgctctgccccggccgtgctaaagagcaaggagtgcaaactgactatcaaacttcccgcctgggcctgcactggccgcccacttggaccccataatagcgttgcattctcgctttccatcccacaccaccccttcctgtgcccagtcctggcccagctgaaggccgacttggacgcagccaagtcccccctctcccacgcgcgcaccacggcgtcggccgcggcgacggccgtgcgggagaccaagaaggccatcgccgagctggagaccaagctggagaacaccgggaagggcgcctatggcgaggacagcgcctgggcggcgctggacggccgctgcttctcggcgcaggtggacaagtacacctacgagctctgcccctttggcgccgccaagcaggtggagggcagcggcggcggcacaaacctgggccgctgggagggcctcctggacgacggggcgcgcctcgctttccagcgcggccagcagtgctggaacgggccggcgcgcagcctgcaggtgccggtgcctgatggtcgcagagctggctcacgtgatgttgggtctggggacagggaaggggtggttgtgcaccgtatccatggggacatccagcacattgcggacattgcccgtcctccaatgagcctgcacacgccagcccggcccgcagtcagcctgccgccgatcagcttcccgaccagcaatcacagcaatgtctccccactgctcctgcaggcgacgacgctctgcggcccgaccgagcgcctgtttgacgtcagcgagccctcccgctgcgaatacgccgccaggttcgagacccccgcggcctgccgcgccgtcgatgtcgccgccctagagcgcgagctggcacggtatgggggggcgccagtgcatgaagagctctga

SEQ ID NO: 5092 - DNA, 450 bp, Chlorella protothecoides
atggagtgctaccgggaggagatcttcggccccgtcctggtctgcttggaggtggactcgctggaggcggcgctggacctggtcaacgccaacccgcacggcaacggcaccgccgtgttcaccagccacggcgccaccgcccgcaagttccagagcgaggtggatgtgggcatggtgggcgtcaacatccccatcccggtgccgctcccctacttctccttcactggtaggggtcatttggggggaagagaggggaggggaggaggtggttgcggatgtgggacctcgtacacagaagggagggtcatgctgctgggtggagcgggagggaggaggcccagcgatgcgcgaggaggtcttaatagcgggacccgtgttgcagaccctggcgcctctcgacctacactacccggccatagaccccctcccaccgcaacccgcacgccctcc

SEQ ID NO: 5093 - DNA, 108 bp, Chlorella protothecoides
atggacaggcttgccggcgcccgcgtcttctcaaagctggacctgcgcagcggctaccaccaggtccgggtggctgaggaggacatccccaagaccgcgttcaccacg

SEQ ID NO: 5094 - DNA, 1489 bp, Chlorella protothecoides
atggaggtcttcctcaaggccatcgacgccgccagcaccatgaacggccacgggtttgtggccatcaagctcaccgcgctggggctgccggagctgctggagcgcgtgtcgaacgcgctcaccgccatccgcggcctcttccagcagtttgacgacgacggcaacgggtcggtgagcatcgaggagttcaagcgcgtgtacaaggagtttttcatcgacgacgccgacgatgtgcccaagggggtgcgtaaattggggaggggggtgctgggtttctggagaggggtgggggccggccatgtgagggcggccgggtggcgggccggccttggcgcggcgcccacagccatcgccagccccagtgcatcgtggtttgagcagctggacgtgaccaaggacggccaggtcgactacatcgactggacggggcaggtgagtgcggggcggtcaggcaggggtggggccttcaccatccggtggaaggaagggtgcgagacccagtctcgaaacccgccgcaatttcgtcggcaggcatttcctgggcgcttggcttcggccccgccccgcctcccctgccaccgtcccagagggcgcctccccacctgtatacaccctcactccccgccccctcccacccttggcgccaagtacaactcctccccccctcgataccccccccctttgctcaagatctcgctgttcgacaccaacagcatcgcgaagcggtgccgcagccgcggccccttctccgacgcggcgctgaacgaggaggagaacgagctgctgcgcaagatgcttgggcgggtggaccgcctggcggcggcggccgcggcggcgggggtgcgcctgatggtggacgcggagcactcctggttccagcccgcggtggaccacgccaccgcgcagctgcaggcggagcacaaccgggagcgccccatcgtgttcggcacctaccagtgctacctgaaggacgcgctgccgcggctcgccttcgacctggagcgcgcgcggcgcggcggctaccgcttcggcgccaagctcgtgcgtggcgcctacatggtggtggagcggcggcgcgccgcggagctgggcgtgccctcccccatccacgacagcctggccgcgacgcacgagtcctacgacgcctgcgtggccgaggtgatggcccacgtggcggacgagggcgcgggcatgatggtggcgacgcacaaccaggcctccatcgaggccgcggtggcggccatggaggagcgtggcctggggccgcaggccggggtctactttggccagctcctgggcatggccgacaacctgaccttcgtgctgggccagcacggctacggcgcctacaagtacgtgcccttcggctccgtggacgaggccatgccctacctcatccgccgcgcgcaggagaactccgacatgctgggcggggtgggcaaggagatggccatgatgcgacgggagctgcgccgcaggctgctgggct

SEQ ID NO: 5095 - DNA, 492 bp, Chlorella protothecoides
atggcggctgaggcccccccgcccgaacccctggcccctcacctccacaggtacggccgagccgggcactcgccccgcaatttcggcgggcccccgctcctcgtccgcgagcaggaggatggtccggtggagtacaagctgaggctggactccgtcagccatgtgcgcttccagcagctggtgggtgcaaggggttgcgacagcaggaggcgtgaggggggcgtctgccgcccgccctgcatcggtcaccctcacccctcaattttcgcccccaccattcttgggcaggtcactcagctgcagtaccggctgtcagagggcgagggcgcctgcgtgtactacctgggcgtggaggacaacggccacccccagggcctggagccggcgcagctggaggccacgctgcgcacgctgcaccgcatggcggccgaggtcggcgcgcgcgtggcctccgcgcggcccctgcccgcgcgcggcgggcgcgcctgcgcg

SEQ ID NO: 5096 - DNA, 1308 bp, Chlorella protothecoides
ggccgccgcgctggccgcgctggcgctgccggagacgctgggcgcgacgcaggaggggcggggcgcgcgggcgggaaggggaaggccagcgcgggcgggaaggggatggcctgccccccggcggcgagtagagcaggggtgggtgtgagagccctggggctttcagacatccacagggaccgagggcgagggtgcaaaggccgtgccgtatggtgcgcccagcgctgctccagcccgacgccaaacccccatcgcatgaggcctgcccgtgtcaccatctcaacgccacccgtcagcattccttgtacccctacatgccgccttcagggtggctgctctgtaccatgtcgttgtctcttcccccatcctcttgtgattccggcacatcagctacatccgcaaggtgaagaacttatcctgtacccgatcgcgcggtgcctctctgtggacgacgagggccgcattgcaaaccctttgtttcccatcacgaacccacgaccgggcagggatggcggcgagtgcgggactcaccccggccctgacggtgccggcggcagcacggttgcgcctcgccctcccacgccgtgcgcgaggccgacgcaccatctgctgcgccgcgccgatacccagggaaaccctgctcgaggtcgctcggaatgccgccaaggcaggggccgcggtgcgtggggaggggcctcggcgtggtggggagtggcaagatcacttcgccggcacccacacacacaccctgcaccccacccgcccccgcaggtggtcctcgccaatgctgacaagccccgcatcatcaagcacaaggggacgacggacctggtgacagacaccgacagcgcgagtgaggaggccgtgctccagaccgccgtgctgcatcttgcacagtccccacccccaaccccgcaggccatcacccgggcctacccggaccatggcatcctgggggaggaggggggtgtcatgggggacgtcacctcagactacctctggtgtgtggacccactggacggcaccaccaacttcgcgcacggctacccctccttcgccgtgtccgtaggcgtgttgcgccacgccgtgcccgtagcgggtgtggtgatcgagttcaccggcggccccggcggctggatcacgcgcacttacgaggcagcgcgtgacatgggggccacctgcgacggccgccccatctccgtcagccgggtgaaggtcctggagcagagcctgctggtgagcgttttggtctttggggcaaagaaaggggagcgtccgcagcttggtgctgcgctggcggcaggctag

SEQ ID NO: 5097 - DNA, 1005 bp, Chlorella protothecoides
  modified_base (840)..(849): a, c, t, g, unknown or other
atggacctgttccgggcgctgacggacgtgacccagggcgtgcggcgggagggggcggccgccgtggacttgtgccacctggcggcggggctggtggacgggtactgggagttccgcctgaagccctgggatatggccgccgggctgctcatcgccgaggaggcgggcgccacggccaccaccatgggcaacggcgcgctgtcaggaaaagggacaggcggaggggctcctgcgattgattactcaaggggtgaggcgattgttcccacaactcagagtgtagcaaggctgggcaccctctcagtcggtatcagctctcccctgcccgccatcactgagcctgatcactcccacgacttgcatgcagtgttcgaccgcagcctgttggtgaccaacggcttcgtgcacgagcagctgctggcgctcacggatcccaaggtcagcgccctgctggaggcaggggtggacctgagccagtggcctcccgtgtgtcatagggttgcgttcgtggtggcagggtggtggggaccagagatggctgcagaactggcagtatatgtaagtggtgaggcaaatttgttggagggggtggtcaggggccagtctgcacgccgacgaagaagacgatgccggcggtccctgggatggtggtggcgccggcgttgcgcagctgcaccgccacctgcaaggagtgagggcgtggcatttgtgaggcaggaggctggcactggccagtcccagcgcgcaaaccaaagtcccctcgccggcccccctggcctggccacgcaccatcatcttggggttgctcttgacggagaagccgacgcagacgatgcccgnnnnnnnnnnccccctcgccggggtccactggcctggccacacaccatcatcttggggttgctcctgacggagaagccgacgcagacgatgcccgggttgtaccagcggccgtactcgcaggacagcttggcaccggtgatccccgtccccgcaaactcggagtag

SEQ ID NO: 5098 - DNA, 2310 bp, Chlorella protothecoides
atgaaaaactgcctgaaagaagccgcaagggggcagccaccatatcaggaacagaatgaattctgctttgtcaccaaagggcggggagaagagggttggggtggcattattgcttcttgcaggccggcctcagcatcacctggcgagggccggcagcggcgggtgggccccccccccgcgcgtccaagcctaggcccccaccaggggggcactgatcgcgtcggcgggggggctgcccttggcggcggccgcgtcgcgcctgtacgcctccagctcggcgggcttgacgaagcgccccttgatgcgagggcgggcgtccgcgtacaccttgcggcactggtagcggaccaccttgttgaagttgcggcggcggcgcttggagaggtagcgctctacgcgatcgcggcgggtgagggggacttccagggacaacgactcattggaagtgggcgtgtggatgggggcaggaggcgcctgggggaccatctgcatgtcgtccgcataggcggcagagaactggtacgcctgcacgcgatcctgatggtggtggtggttggggagaagatcagtcctcagatcattctctacaaactcttgtttgaggctcaccacaagctggacctcagacttgaccttaggtcccagcagatccttcttggtgtcggtctcccagtcccagtcgctcttcaggggctcgaggtcgcccatgaggcagttgaagtcatcctgggactccgggatcccgaagccatcgaacagcgcatccgcggcccccgggaacatgctgtcctcgcgagggaaagaggcgtcgaactggggaacgaccgccaggctcccgttgtcccagctctcgctcccggaaaaggtgggcgagccggggctggactcgagggcggtgcggtggtggctcgccatcagcagggtgttgtgctccgaagtatcgcacgcctggcacaggtgcacgccatcattgtggcagtacaatacggccggacgaggacagatcgcgcaggacgtcatgtctgcagggaatggggtgggggggccgggcactcctgttccaaggtgctgggaggcgtcctggtcgcagttgccccttcgcatgcggttctgccgtgggctcacctaatctcggatataggcgtcgaattggtaatgggttgcgctccgcgagggttgtcgaagaccgccgctttattaccttccttggtagaaaagtgttgtatgagtgatgtagtgcaacggggaatcaactgcggaggtctggcaaccagctctacgcccaagcccactgctggctgcgcaccatcggtccctggcccagccccggcacccaccatggcgatggggatgccgtatggcatgcagtccatgttgaaggacgggcataaaattatgtctgggctggaggaggcggtgctcagaaacatcgaggcgtgcaagggcctgacacagatcactcggaccagcctgggccccaacggcatgaacaaggtggtgatcaaccacctcgacaagctgttcgtgaccagcgacgcctccaccatcgccggcgagctggagatccagcaccccgccgcccgtctcatcgtcctggccgcccaggcccagcacgcggaggtcggggacgggtgcaacttcgtgctcacctttgccggggagctgctgggccacgccgaggccctgctccgggacggcctgcacccagtggagatcgcggacggctacgccaaggccggcaaggctgccctggcggccctggagtccctcgtcgtccccggctccgtcgacctggacctgaccagcgccgacgccgtggctcggcgcctgctgggcccgctgtcctccaagcagtacggcgtggaggccacgctggccgcgctggtggcgcgcgcctgcgtcgcggtgctgccccccaaccctgccaactttgccgtggacaacgtgcgcgtggtcaagatccggggcggcaccctctccgactcctacgtggagcggggcctggtgctgcgtcgcggcgtggagggccgcgtcgcctccgccgccaacgcgcgcgtcgcggtgtacgcgcagggcttcgacacctcgtccaccgagaccaagggcacggtgctcatccggtcggcgggggagctggagggctacgccaagggcgaggaggccaagctcgagcaggtcgtcaaggctgtggcaggtgggtgctgtgtggttttgtgggggtggaggggagattgggtgtctccaagtgatccggacgccgtgctccccacccctttacacgtccgccccaatgcaccggcccacccatga

SEQ ID NO: 5099 - DNA, 1257 bp, Chlorella protothecoides
  modified_base (301)..(310): a, c, t, g, unknown or other
  modified_base (1134)..(1143): a, c, t, g, unknown or other
atgtacaggagggggcggaagcctcggtgcagtggatgtcagcgactcgcacgcatccgtcggctactcagtgcctcgcaagcgatgcgtctgttcacgggctcagcccccttgccgccccttccacctaccctggtgcagaccccggactgcaccaagctggtggagcagtgggtgtacgagatggcgacccacctcaagtccctggatcaaaaccaccttgtcaccatcggggcggaaggtgcgtgtgggaggcgcgttgacgaatgtgcgggggtcctttcagggaaggccggtgttnnnnnnnnnntcggggcggaaggtgcgtgtgggaggcgcgctgacgaatgtgcgggggtccttcagggaaggtcggtgtcgatggtcctgtggcaggatggaggctgccatggaggacatacaggggaccgaaattgggcttcatttggcgcatgtgattgtgtcacgggtgccgtgcccttcttgtcggtgcacgcaaggcgcaatcccccccgctctgtcgtgtcgacctccctcccatcgccccccagccatttcccaaccacatcgcccctcgctgagagtagggttctggggggtgcacgacaagatgcagatcgccaaccccggcgcggcggagggctcggactgggccgccaaggcggggcaagactttgtgcatcaccacaacatgcccgtggtggactttgccaccatgcacctctggccggacaactggctgaccaagaacaccagctttgtggccgagtggatccacaagcacatcgaggacagcaccaaggtgctcaagaagcccgtcctgctcgaggagtgagtggtcggcgggggtggtgcaatggcggtagggggcagcagtcggtggaggtggtagtggcgcggggccatggatgtgatgcatggcggcatgtgagtggtgttcccaactccggcaacgatgccgggctagaatcccgtgatcctttgaacgagtgcccctgcaagcgtcgtccctgcttggcggcttgtgatgctgggtgtgttgctggcatggctcaatcaacactgaacagccacccattccgcaatcagcattgtccatcaactaacttcaaccattgccacatcgataccttnnnnnnnnnnccctgcaagcgtcgtccctgcttggcggctcgtgatgcggggtgtgttgctggcatggctccaatcgacactgaacagccacccagtccgcaatcagcattgtccatcaactaa

SEQ ID NO: 5100 - DNA, 1167 bp, Chlorella protothecoides
  modified_base (52)..(61): a, c, t, g, unknown or other
  modified_base (761)..(770): a, c, t, g, unknown or other
atgctggcgtggtcgccgtcccgtgccggggccgctggcacggccgtggggnnnnnnnnnnggaggccatgctggcgtggtcgccgtcccgggccggagccgctggcacggcggtgggagctgctgccattgtcaacgtgctcaaccaggccgcagcagcgggcctcaacaccgtccgcacctgggcccacaccacaaatcccaaacaacctttccaggcgagttggagcggtggttccgcagattgtcagtctcagcgtttgtgtgcctggacaattagcatggagggctgtgcagatgtgggcgccgttgcctgtggcctttacccctgctccttgttcgagtcttggaaatggcgaggaagcttgctctccattctccatccctccccccctgccctgtctcatgcaggtgagccctggcgcgtacgacgagaacgccttccaggcgctggacctggtgatcgccgaggcagagaagaaggggctgcgtgtcattctgagcctggtggacaactggaagtatgagggcggcgttgatgagtttgtggactgggccaagacggtcccggcccgcgacaagaagtacccagtggcgacgggcggcgacggcgacgtgaacgatatggtagggtggtcaaggcagagctgtgttgatgggtggggctgcactgtggggcttttgtccagggttgtgtggctccaccgtcctcggttcctgcactatgtcggcattcagctcaaatcccggcctgctgtcannnnnnnnnngatgcaagtggaacatcatctcatcacactcattccagcatccgccactccaaattcacatcgtcaggagtggagcgaggaccgcaagcagtacgaggccttgcgcaaggtgctcttcttcaccgacgccggggtcaagacgctgtaccgcaaccacatccgtgcggtgagtgcccctgcagtctgggatggcgatgtggcaggaatggagcttgcaccgggcgcgatggactgccgtatgggccctgccatctcagaccccgtgtggcaccgccccctcccccatgccgcacgtaccatcacccccgccgctctttcatcctgcccagatcctggagcgcgtgaacactgtgagcggcaaggtgtaccgcgaggaccccaccatcatggcctttga

SEQ ID NO: 5101 - DNA, 420 bp, Chlorella protothecoides
atgcacctcaaacaagagtttgtagagaatgatctgaggactgatcttctccccaaccaccaccaccatcaggatcgcgtgcaggcgtaccagttctctgccgcctatgcggacgacatgcagatggtcccccaggcgcctcctgcccccatccacacgcccacttccaatgagtcgttgtccctggaagtccccctcacccgccgcgatcgcgtagagcgctacctctccaagcgccgccgccgcaacttcaacaaggtggtccgctaccagtgccgcaaggtgtacgcggacgcccgccctcgcatcaaggggcgcttcgtcaagcccgccgagctggaggcgtacaggcgcgacgcggccgccgccaagggcagcccccccgccgacgcgatcagtgcccccctggtgggggcctag

SEQ ID NO: 5102 - DNA, 420 bp, Chlorella protothecoides
atgtcgctccagaggggagtgctgctcctcctggcgctgagcgcctgtgtggccgcccagtcctgctccgacatcagcgccatctccaacggcgccaaggccgacggcaagaccaacgatgccgcagtgtttgccgccatgaactccaagtccagcatcgggctcatctacatgcccaaggggacgtacctcatcggcaccagcatcacgatcagcaagcccatcctggccgactatggcgcgatcttcaagctgtcctccggcgtcaccctgagcatctccaaccagccagagcactccatcgacaccttcttctcaggtgcaggatcaggaggtttggggttgccttcgagacgtctcaaactgcatgcttgccttcgctcatccccgggacacaggggcgacactccctgtggctga

SEQ ID NO: 5103 - DNA, 453 bp, Chlorella protothecoides
atgacgtcctgcgcgatctgtcctcgtccggccgtattgtactgccacaatgatggcgtgcacctgtgccaggcgtgcgatacttcggagcacaacaccctgctgatggcgagccaccaccgcaccgccctcgagtccagccccggctcgcccaccttttccgggagcgagagctgggacaacgggagcctggcggtcgttccccagttcgacgcctctttccctcgcgaggacagcatgttcccgggggccgcggatgcgctgttcgatggcttcgggatcccggagtcccaggatgacttcaactgcctcatgggcgacctcgagcccctgaagagcgactgggactgggagaccgacaccaagaaggatctgctgggacctaaggtcaagtctgaggtccagcttgtggtgagcctacggcttggaggtgatggtgttggagtgtcttga

SEQ ID NO: 5104 - DNA, 1113 bp, Chlorella protothecoides
atggagcctttccccggagcgaggcccaggaagaccccctccgacgcatgcacacgccatccaggcgatcaatcgaacagcgagaagcccatgtcctcctcctcctcctcctcctcctcggccggggcggcggcggcagcggcggcggcgggcgccggtggggtcggccaggtaggccttgaccttctcggccagggggaaggtgtagtcggtctccaccgcgatggccagcgcgttcttgtagccgttgatgagggagtggggcgcggaggccatggtggggaagtcgagggccagagaggcggcggccacgttgcggatgccggcggtgagcaggtcgcccagggtctcgtcggtgatgtccaggaccttggggtcgtagagcgagccgttgtcgtacacctgcttgaccaccaggccgtaagtgaagggcttgatgcccagcttggccaggagggtggcctgggaggcgcccaccttctcgcccggcttgatcaggtgcacgtccgacacgatctccacggtgcccttgttgatcttggtggagatgttcagggcctggaagaaggaggtctgggacgggtccatgcccgtgttcccagcgtacaccgtcacatcgttaggggccaccaggcccacgcgtgccggggcgccaaccttgaactcctggatcttgtcgcggacctcgttcaggtcgccctgggtgaagatcaggcccacgttgcccaccagatggtccagcagcaccagccactgctcgttgccagtgcgctccacgtacagacgcaggcagcgccggatcagggtgttcttccccatcagcaccgtggagttctcgcgcagaccctgggagttcgtgagtggaggggaggggagggggaatcagtggggcgagaggaggaggaaggggagaccgcgactcgcaggagcccgggcgagtccagccaacgtcttccaactcaccgcgcggatgttcatcatctgcatggacccgacattgtcggcgtgcaccaggaaggccttggtgtgcgtgtccagcagctcgcacagcttggcgtcatactgcggggggagggggcggggggcaagcagggtgcgtcatgtgcgcgttga

SEQ ID NO: 5105 - DNA, 963 bp, Chlorella protothecoides
atgggtcttagagccctcagcctgtacctgctggccaccgcggggctggtcgcgggctacgtcccactccagcaggacggcatagcgtccgccaaccccacccgggaggcctacctcgccgacctggcggccatccgcgcctccacgagccccccctccccaccccgtgccccttcctcttccatcaacgacaccgacacggggccagtgctgagttacactgtgaaccagatctcgcgcatcgtggcggtggacatcctgcaggccaccatgagcgacacgctgcgagccctggaaagcatgcccaaggccaccgcaggggcagggttgacgcagggcagcgaggctattggatatgggcgccggcgcagctcgccgtcagacgatgtgaaccatttcaaagcggctgtccgcagagtgtcaccctctccacctggccgccaactcagggtgaccgctgcatccatggaggacgccgctttcagccagtccagctcgggcgagggtctcagcatgccagacgagacactggcccccagcagcgctgcggcctcccctccccagccccggtccccgcccccgcccgagtatgtggcggcctccccgccgcccccacccaccacctatacgcccctgggccgggccacgctgagtcagctgccagctggcctggtgccacgtgtgaagaccatggccggggtgggcaagggctgccccggcacacgcagcgcgcgcatctacggcgccaggggggacggcacaaccgacgactcggccgccctgctcgccaccgccgctgcccagtcctacgtctacctccccgtgggcacctacctcatcgccaagagcatcaccctcaccaagcccatcctagcaggtgcatgtgattcttatattttgtgggggaaaaggggaactgaaaaggccagatcccgatggtgtaagcagaaccgttcgcggtga

SEQ ID NO: 5106 - DNA, 756 bp, Chlorella protothecoides
atggcgctgcacttcctggacaagtacggcctgatggcggtcaaggtgccgtccaagttcgatctgcgccgcgtgtgccgtgccacaggcgcagtggcgctgatgggcaccgccgcgcccacggccgccgagctgggccatgcgggctgtgtggagctgcgcgaggtgggctccacccccgccgtcctgtttggcggccaggcctcccgcgccggcattgccaccatcgtcctgcgcggcgccacggaccagttgttggacgacgtggagcgcgcggtggacggcggcgtcaacgccttccgtgcgttgacgaaagacgcgcgcgcgctgccggccggcggcgcggtggagatcgagctggcgcgccgcctcgccgacatggcgcgcaaggtggctggcgcaggggggggaggcgggtcgcggtctggcgcgtacgccatcgcgcgctttgcggacgcgctggaggtagtcccgcgcacgctggccgagtccagcgggctgcccgccgaggagagcctggccgcgctgcacgcggcgcacgccgcagggcaggcccgcgcggggctggacgtggagacgggcgcgccgcgcgacctgggcgaggacgggcacctggacctctttgccgcgcggtggtggggcctgcgcctggccgtggaggccgccaccaccgtcctgcgcgtggaccagatcatcatggccaagacggcgggcgggcccaagccgcgccagggcgccggcgacgacgacgactga

SEQ ID NO: 5107 - DNA, 894 bp, Chlorella protothecoides
  modified_base (820)..(829): a, c, t, g, unknown or other
atgctggacgacaagcgaagtgcgtgtaatgctgtgggagccatttccagttcctggcttgtggcggggcatcagaccaaaaaaggacgctcccattgcttccgcttccctcctgcagagatcggcgtggccctcacaggcctaggcatagcggtgcagttcctcggggtcatcttcctctttgacagaggtctcctggccattggaaattccaccttacgaggcttccctcctgcgcgatccatgccaagtgtatctccctcccaggttctcttcctttctggtgtggccctgacgataggattctgggccaccctgaggttcttcatgcgccgcaagaactacaaggtgggtgttaggtgtgctccttgggcaattgggatggagtggcatgcagatcactgggtcgcaatccaagtctggaatccagaaggcattgagggcatgtctcactgccctgcacctctgcagggctctgcattcttcctcgttggatttgccctcgtcgtctacggctggtccataccagtagctcatgaggctgcttcagcaaggtttggacggggcagtacatccaagtgtcatcgggagctccccaaaggtctcagcatctgcccccttcctcccaggcttcctcctggagctgtacggcttctggcggctcttctctgctttcttccccaccgtattgtccttcctgcggagaatgccgttcctgcggggcatcctggacctgcctgccttcaaaggggtgcgtggagactttggatgattttgccgggccagggaggttggggctgggctgcagcctgcagccgcnnnnnnnnnngacctgcctgccttcaaaggggtgcgtggatagtttggatgtgcttgccgggccagggaggttga

SEQ ID NO: 5108 - DNA, 540 bp, Chlorella protothecoides
atcgagacgcggcgcgaggcggaggggcgcgcgcgcgcgctggccgcctggagcgacgatgaggtgcggctgctgcagaaggcgctggacaagtggccggcggggacggccaagcgctgggaggtggtgcagggctacgtccgcacccgcaccaccgacgagatcctggacatggtcaagcacgggctgaaggcccacgctgcgcgcgctgtgccccagacctacgaggtggcggccaagcgccagggcaacaccgtcatccgcagcgaggccacggagcggcacaccagcttcactgacgtcgacgttccggcagtcaacggcagcaagcctgcgacggcctcccccgaggcagctgcccccgtgcagtggaccgaggcgcaggagctggcgctgatcaaggcactcaaggtggtgcggaaagaggtccccgaccgctgggaggtggtcagcagccttgtccccggccggaccaaggccgactgcttcacgcgcttcaagcagatgaaggcggcgcacaaggctaagaccgggaaatga

SEQ ID NO: 5109 - DNA, 1137 bp, Chlorella protothecoides
atgggcccagcactggaggaaagcagcgtgatacctactgtggcggtgggccccgacaccgacgatggcgcggacatacagatcgatgataaactgcgccgggctgctgagagggagatgcgtcgaagctcaaatcccagtgccaagcgtgtgaggacagaggccagcattggccgcttcgactacgccgcgccagggctcatggaggagggtctcacaggcttcctcctcacatctacctttgacagggagaagagcgccttgaaggaggctgtggcgctcctcgagggtgccctggtgagccagcctaacccaatccaggcccttcccccactctctagcatcaagcttgcagcgaggggcttgtccgccctccgcctcatgcccagcagtgctgcggctgaggtcgccggggacctaccttcccccaacagggatctggcgctcctggccgcctccctggccgtctccattgtgacgggaggcagctcagcgcgttttctccagcgactgacccccattcagaccacctgcaccgctgatgcgacagctgtacgaggtgcagcctcggatctggccacccgctctgagcactggcagtactgctggcctggaggtactgcgccagacagggaagacgaagcccagctgcttacttttgcagttgcgttcaagccacgtgggaatcaaggaccgtgtgtcggcgaggcggtgaagagcagggaccaagcagctgagccatcaactgcggttgcctctggacagggagcaaatgccctccctgccggtgggttggacaaggaggccagccctcccagcacggatgccagtggatcagcgcaggatgctgtgcagacatcaagaccaaagggcgaccagggtgctgctggagctacccagagcttgcgtcaggagcttacggcggcggcggcagcaggcctccaggctggcattaaaacatggctacctcactgcacagtcagggtggatctggcagaaccatcgctggtggtcttgctggagatgctgcccgtgggcggtagcaaagtgtttgcgggcctgtccctcctgtctggggaggcgtgcaccatgaagccccgcttggccatcaaggccctggagaaggcccacaaatga

SEQ ID NO: 5110 - DNA, 1899 bp, Chlorella protothecoides
  modified_base (300)..(309): a, c, t, g, unknown or other
  modified_base (510)..(519): a, c, t, g, unknown or other
atgagcacgggacaggcaggaatgggcggggactggggagcctctgctgctccgtcgcaaggctgtcacgggcgtgaggcggcggctgccgggaaggggtccttcgcgtgggcctggatgctggatgagcgccccgaggaaagggcgcgcggcgtgacggtggaggtggccatgaccaggctgacgccgcgctcctggtcgtggactgctccgtcggtgtgcgggggagccggggagggtgggaggtgtggtggccaggggcgtgtcactggaatcccaagcattcctttggccccttgnnnnnnnnnncgcggcggagccggggagggtgggagtcgtggtgatcaggggcgtgtcattggaatcccaagcattcctttggccccttgctggatcatggcctcgatgttccatctctcaacccccctctcacccacccaggcggcttcgaggcgggcttcgcgccgccctccggcccagggtcaatcgggggccagacgcgggagcacnnnnnnnnnncctcttaaaccccctctcacccacccaggcggctttgaggcgggcttcgcgccgccctccggcccggggtcaatcgggggccagacgcgggagcacgcccagctggcccgcagcctgggcatcagccagttggcggtggtgggcaccaagctggatgccatctcgggcgacccggaggagcaggccgcgcgctttgcggcggtgcgtggatctctggagccctttttgaagtcctgcggctttgccagcagggcggtgcagtggctgcccgcctccggggtcacgggcgacaacctgcgcgggcgcggggacggcaccgggttgggcgcctggtggcgcggcggcacgctggaagacgccatcgacgccttccggcctggtagtggcggcgagagtgagcgggaaagggcgctccgcctgccgctgcgcctggtcgtgcacgaggcggccgccgcgggctccaagggagccgcgcagctgggcggcaagctcgaggcgggggcgctgctgccgggcagtcgcgtgctggtcatgccctcgggccaggccgccacggtgcgcacgctgggcgccgagggcgccggcggcgtggcggcgggaggtagcagtcccgccgcgctgctggccggcagcggcgcgtcgctgacgctggcagggctggacgacccggggtcggtcggaccggggtcaatcgtgtgcgaccccgcctggccagtgcccgccgcgtcggctttccgggcacgagtgctggtgctgcaagtgccgggacccatcctgccaggccagcagggtgtccgagagtatagaggccagacaggttctgttgcagggatggccggagtggtcgaactgaggggcgatgctgatgtgctggaccaggaggcccaggcaatggactggttgtcatgcgagcagcaaggtgtcggtgtactgccacgccgccaaggagagcgggacgctgaggaggcttcagcaggacgggccctcgccccgaccggcgcgctttcttgtgtccggccagcgggcgctggtggaggtggcgctggcgaggccgctggcgctggagacggctgccgaccttcccgcgctgggcagggtggtgctgcgggacgggggaaggacactggccgtgggcctcattatcgagctcctgtagcgtgggagagcctggccgctctgctgccgataacccaagctgttgttggccaaccccagacacgtggctaccgttcttgcgtgatcgcgacgtgtatcatgcgagggggtcctgtcgcacggccacagggtctcatcaccacccgggttggcgggcgtgcccgatcatcgactctccgtcccacgggagctgcagcacaattacgaggggggcagtaccgctaa

SEQ ID NO: 5111 - DNA, 1014 bp, Chlorella protothecoides
  modified_base (944)..(953): a, c, t, g, unknown or other
atggtgctgggcgacacctgcacccgcggctgccgcttctgtgcggtggccacctcgcgcgcgccgccgccgcccaaccctcgcgagccggaggacaccgcccgagccgtcgccagctggggcgtgggctacatcgtgctaacctcggtggaccgcgacgacttgcccgacggcggcgccgaccactttgcgcagaccgtgcgcagcatcaaggccctccgccccgacatcctggtcgagtgcctcaccccagacttccggagctgccctgtgcctcgtcggcgccgtgctgagaggcacgtcaccacccttcctccccaggggcgacctcggcgccgtgcgccacctggcacgctcggggctggacgtctttgcgcacaacatcgagacggtggcctcgctgcagcggcgcgtgcgagatccgcgcgccggctacttccagtccctggacgtgctgcgggctgcgagaagggagggcgtgcacaccaaatcctccatcatgctgggcctgggggaggcggacgaggaggtcgtggacaccatgctggacctgagggacgcgggtgtggacattttgaccctggggcagtacctgcagcccacgccgcagcacctggcagtgcgcgaatttgtcacgcccgagaagttcgagtactgccctgcaccccacctcacatgcccaccacccacccactccccacgcacacacatctgcaggcggaaatttggcgaggaggaggtcgggttccggtacgttgcctccgggccgctggtgcggtcctcgtaccgcgcgggcgagttctacgtggcggccatgctgcgccaggaccgtgcagaaagcgcggccgccgtcaagctgcaggggttggacctcgtggcgcccgagttctgagatgctgcagctcactgatgggtggaacacgtgactcatgtgtggcgacctnnnnnnnnnnggcaaacagcgcggccgccgtcaagctgcagggggtggacctcgtggcgcccgacttctga

SEQ ID NO: 5112 - DNA, 1989 bp, Chlorella protothecoides
  modified_base (1083)..(1092): a, c, t, g, unknown or other
  modified_base (1199)..(1208): a, c, t, g, unknown or other
atggctacagcttccaagtgtaggcgcaatgtatgtaaaggtggtctgcacacttccaaaacaactctgaagtgtagcggcctcttctcacacggctccccacagatcatgcacgtcaggcatgagcgcacgggggaggtcttgcctgcagtctgggtgtgtcgttggggccccatggcagccctcacgacccccttcctggctcccacagcctgccacgcccagtctccattcactcatagaaaaagcgcaactgtaggtagttctaggcgatgcttcacggtgtgccgagcggctctgcagcccagcctaaggagcacggagaccctgcggccagtgcggggcgaggtggccgcgagtgcccctgccaccgtggcaaacctcggcccaggctttgactggctggggtgtgcggtggagcgctccgcgctgcatgcattctggtccaaggctccacagggagacctgagagcagccccatccaggatcaagtgcaagccctccagctccacctttccaacacccctcccagggcccgggggacacggtggtggcagtgcccctgcccaccgcccgccccggcgagatcgtgatccagcgcgtgacgggagagggcgggcgcctgtcgctcgaccccgtgaagaactgcgcgggcatcgcggcggccgctacgctgcgcgccatgggcgcgccgctcgcctgtggcgtcggcctgaccctgcacaagggcctccccctgggcagcggcctcggctccagcgccgcctcggccgccgcggctgcggtggcggtgaacgagctgtttggcgcccccctgagccccatggacctggtcctgccggggctggagtcggaggccgcggcgccagcctggagctccacagtgttgaagctgtggccagctggatccctgaggccactgtcacatgccgacaggggaggcatctgacgcgagactccctgtcgtcccccctctctgctgcctcaccccctccccctgtcccctccttcctctctgcaacaggagctgcgagccgctggacctgcagcgcctcgccttcccgggcggcgatgtgtggttcnnnnnnnnnngcggcttcgtcctcatcaggtgggggagcatatttcgggtgttgggtgggtgggtcatttcagtggtgggtggatgggaaggaagaagcccaggtctggcgtgggannnnnnnnnngcggcttcgtcctcatcaggagctgcgagcctctggacgtgcagcgcctcgctttcccgggcggcgatgtgtggtttgcgctggtcaacccctgcttcgaggcccccaccgccgagatgcgggccgcgctgcgcagcgaggtgcccatggcggagctgacgcgcaactgcgcggcgggcgccagcctggtggccggcatcctgctgggcgatgccggcctgctcggccgcagcctggacgccgacgtggtggtcgagcccgtgcgtgggcctttgatcccgggattcgcggcggtgaaggcggcggcgcggggcgccggcgcctacggctgcaccatcagtggtgcgggaccgaccgccgtggcggtggtgccggacccggacacgggggcgcgcgtggcggaggccatgtccgccgccttcaagcgcgcggggaacctggacaccaactccgcccaggtggtgcgcctgaaccagcagggcgcgcgcaaggtctgacagggcgagtttgtggaggctgtgtgggaagcgagggctgcgacgggtgccagccggatggagagaggtcccaggtgccgcgcggcctgcctggaccatgtcgagccccatgcagcgtgactgccgccctcctccatcactcgggagtgcgtcgacgagacacatgccgcgactgcggccacaagcacccctcgcgccagacgtcgtgtaaaaacagaagattccacagacacttgcattgcggcagaggtcagagggcgcgcgtggcaggtcgccacacatga

SEQ ID NO: 5113 - DNA, 660 bp, Chlorella protothecoides
atgaaaagcgctcgtatcaatgctgaatgccaggaccatgaatgcaacctgtatccgtccgttcacagcagtgaccccccggcgaggaacccacaccccacgccttcatgtgtctcgaagagtgagtcacggccttccttggcgggatgcctgattgccatccctgatcggaaggcttgcacctcccagttgcaggcacgagggactgcgccaacggcatcgggcacctccaccgccctgccgcccgccctggagtctatagtccagtcctttcaagctgtaccagaccccatgtcggtgcgtgatggtcatcttcacgcgcgccccgcaccgaatggtggaaaccatgatcgatgttctccaaagcccgtgactcccccactgctgtactcccccgcagcagcccatgtaatggcccccacccctcaccaccccttgccaccccttgctccacagcgatacaagcagctcctgcactttgcgtcgaggctggacccgttgcccgccgagttccacaccccggagcacaaggtggagggctgcgtgtcgcaggtgtgggtggccgcccagctcgaccgcgcggccaacacgctctcctggcgcgcggactccgactcccagctgaccaaggtcgggcctgcgtgctgggggagggggtga

SEQ ID NO: 5114 - DNA, 3180 bp, Chlorella protothecoides
  modified_base (42)..(51): a, c, t, g, unknown or other
  modified_base (399)..(408): a, c, t, g, unknown or other
  modified_base (2445)..(2454): a, c, t, g, unknown or other
  modified_base (2790)..(2799): a, c, t, g, unknown or other
atgcgtgcagcatatgcattgtacggcttgcaagctctccannnnnnnnnngctcttccattggcggtgacgcgaggcgtccacgaggctgggcaagaaggcctccttgagatgcctaccgctgggcctcccgtgagggaagtcatggtgcattacagcgtgtcacgcgcatgccaccgagcagcaagtgatgggagagcggaaagggatgaggctggtgtgggaaggggcagtccattcagacaggggggggggcgagggtgtggcgccgcgcggaacagggtcaccagaggatctggagggtcgggaggggccaccaatggcgcatgggctcttggacagctccggagtccggaggccacggaaggggcacatgcgggcgccgcggtctggcgagcnnnnnnnnnnttggagggtcgggaggggctaccaatggcgcatgggcacttgggcagctccggagtccggagcccacggaagaggcacatgcgggcgccgcggtctggcgagccgtctccttgccgcatcgcccgtcggcttgggagtgcctgctgccacggcgccctcccacccctcgacctcccatgccctccagcccccgcgcgcgcaaagctggggcgcgctctagaagccgccgcccatgccgcccatgccgcccatgccgcccggcatggccgggctcgccccctcaggcttgggcgcctcggcgatcacggcctcggcggtggtgagcaaggaggcgaccgacgcggcgtcggtgagcgcgacgcgcacgaccttgatggggtcgatcacccccgccttgaccaggtcctcgaactcgcccgtggccgcgttgtagcccacgtcggcgtcggcctcggggcgctccagcagcttgcccacgatgacagcgccctcctgccccgcgttggcggcgatggtggcggccggctggcggatggcgcgctggatgatgctgacccccgtgcgctggtcgaagttggcgcaggcgtccttgaccgactccagactgcgcgaggcgtagaccagcgcgaccagcgcggtgccgccccccggcacgatgccctccgccacggcggccttggtcgcgttcagcgcgtccacgatgcggtccttgcgctcgcccacctcgaactcggagtggccgccgaccttgagcacggccacgccgccggacagcttggccagccgctcctccagcttctcgcggtcgtagtcggaggtggaggcggcgatcgcctcccggatcatgtcgcagcggtcggccagcgcggcgcggtcgccgccgccgttgagcagcacggtgtcgtccttggacacggtcaccttcttggccgtgcccaggtggctcaggtccacgttctccagcttcatgcccaggtcctcggagatgacctggccgccggtcagcgccgcgatgtcggccaggttggccttgcggttgtcgccgaagccgggggccttgaccgcgcagaccttgaccccggcgcgaagacggttgacgatgagcgtggccagggcctcgctctccacgtcctcggagatgatgagcagcgggcgctgcgtcttcagcgccgcctccagcacggggatgatggactggatgccggagatcttcttctccacgatcaggatgtaggcgtcctccaactccacgcgcatcgtcttgttgtcggtgacaaagtagggcgagatgtagccgcggtcgaagcgcatgccctccaccacctccagctccgtctccagcgtcttgccgtcctgcaccgtgatcacgccctccttgcccacacgctccatggcgcgcgccagcagctcacccacctcgcgctcgccgttggccgagatggtgcccacctgcgcgatctcctccgtggtgctgatctggcgcgcgcggcgcttcagctcgctcaccacgtggtccaccgccaggttgatgccgcggcgcaggtccatggggttcatccccgccgccaccgacttgcacccctccaccaggatcgcgcgggtcagcactgtggccgtggtcgtgccatcgcctgccgcatcgttggtggcgccggccacctgcttcacgagcgccgcgcccaggttgtggaagcggtcggaaaactccaccgccttggccacagtcacgccgtccttggtgatcttgggcccgccatacggctgctcgatcaccacgttccggccctgttggtgggtgtgaatgcaagtgggtgggggcacatttgggtagggtttcgcggttgcgtctgtcatcccacggtcaggccaccaggcatgtgctcatggcgcgggccggcagcctgtcatgcaccaggcccggctttccacagacaaggattgggctgcagtgccgtggcaggggaggcacaatccaattccccactccagacccttatgcgccttccaggtgactcaccacccctcccagcgatgacnnnnnnnnnncccacaggcaaggtttgggctgcagtgccgtggcaggggaagcacaacaaaattccccactccagacccttaggcgctttccaaggtgactcaccacccctcccagcgatgacccctggaaactccaaccggctacccagacactcctccactatacaagcctaccttggggcccagggtgacctggacggcgtcagccagcttctccacgccctgcagcatggaggcgcggcaggcgtcgccaaacaggatgtccttggcggcatacccgcgggactgggagggacccctgcaccaccccaggcacatgctccccgacaccccgtgcacggccannnnnnnnnnaatggatcgatgatgtggtgcaaggaacccctgcaccactccaggtacatgctccccgacaccccgtgcacggccatcaccgaccccacgcaccgacttgcggccagaccgggcggcctgagtcaggaggctccgtgctccctgcatgatgccagatcaggggatgattcgcagtccagcgcgtgtggtgcagatcacaaaggggtcctcccattgacccgcggtgcacttctagaatttccgagtcacccccttcccgccgtgctgcggtgcccggggggaggaaaggagcgaatctttcgagggtggagggacacaatcgcggggcgttgcacccccgtcctgccacatgcggcactgcaaggatcatttaagcggtga

SEQ ID NO: 5115 - DNA, 804 bp, Chlorella protothecoides
  modified_base (418)..(427): a, c, t, g, unknown or other
atggcgcatggtgagcgagaattggggccgaggaaccgcttgcgcgcggtgcgatcccccgtgatgctgattttgccgcctgtggctgctggagctcttgaatcctgccccgtgcccttgccctttgctggacccgcactcactcttcctttggaccgacccctacttgccagggtgcacgtcgacgcggcctacgccggggtctttgcttgcctgcccgaccagcatgacctctacttccaggggctggagggcgtggactccttcagcactaacccccacaagggcatgctggtcacatttgactggtgcggtgggcgtgtgaggtgtttcatacatggggccgcgaaagtattctctcgagacagtgtctcgcagtcgaggctacagacatcttctcatgaaaggaggacccctnnnnnnnnnntgactggtgcgtcgaggctgcagacatcttctcatgaaaggaggaccccagtcctcctagctccctctcatccccacctgccctccatccccacacccatacagctcggccctgtgggttcagaactcgttctggctgcgcaccgcgctctccctggagccgcagttccagtttgcggggctgcggcatgctgccgagcacctcgactacaaggactggcaggtgcccctgggtcggcggttccgcgccctcaagctctggtttgtgctccgcatgtatgggacagagcgtctccaggcctacctccgccaccagtgagttcgtttgggggaatgcgtagttgttgggcgtacgtgcccggagggatgttgcgctga

SEQ ID NO: 5116 - DNA, 534 bp, Chlorella protothecoides
  modified_base (394)..(403): a, c, t, g, unknown or other
atgaatctggttgcatatggaatccactcgcatgcagcgcactatcgcctggagagaggggtactgtttgatgacgtcatggttccacctccactcttatctttctccaccatacagttccggcagctaggctacaagatgatagatgccattgtagactatagatcaaatattgaaaagcaccctgttcgttcagaagtcgcccctgggtacctggccgagaagctcccagaatctgcccccacccagccggaagggctggatgccatcctgtcagacgtgcagacgcacatcatgcctggtatcacccactggcagcaccccagcttcttctcatggtatccagcgaattcttcgtaccctgccctccttggtgacatgctgagctcggccnnnnnnnnnncccccgccgcgacagagcttgaaacggtgggtttccttggtgttttgaaaccatttgtgggagctgggaggagttttgtaggacattcagaccgtgctcctggcagcaagcacggtcatgaggcagcgtga

SEQ ID NO: 5117 - DNA, 285 bp, Chlorella protothecoides
atggccaaggcgctggcgcaattggtcgaggccgaccccgcctttgacatcatcaccaccccccgtttcggcctggtctgcttcgccccccgcggcgctagcgaggaggaaagcacggcgctgctggagcgcgtcaacgcgtcggggcgcaccttcatggtgcacacccggctcggcgggcgccacgtctggcgcctggccgtgggtggagtgcacacccagtggcggcacgtggaggaggtctgggcgctcgtgcagaaggtcgtgggcggcggcgaggcctag

SEQ ID NO: 5118 - DNA, 528 bp, Chlorella protothecoides
atgtccttcatcatgggctcccaccgcaagcacgagccgcttgacgccgccgtccacctcctcctcttctactccatgctcctggtcaccgccgcgctcctggccgagctggcgcgcccctcgtccccggcgctgggcctggcccgcgcctgggccgccgtcttcctgggcgcctggctgtgcgaggtgggggtcatcgagttcgacggcctgccgcagtggtccacagaatacgcagggtccgccatgtttgcgcccgtggtctgggccatgatcggcctactggtggcctccgccctcctggccctcttcgccagcctggcggcgctccaacgccgggggctgctgccggcgctgccgccgcgggtcgcgggctccggcgcggacggcgactgcccctggcagggcctggaccccaaggtggagccgcgccagacatccatgggccccgacgccggcgcggggcaaacatacacgcccgtctccgacggccagcgctggcccgccgccttccacatcgacgtctag

SEQ ID NO: 5119 - DNA, 963 bp, Chlorella protothecoides
atggacgccgagacgggcatgatctactccttcatgccctccgtcctcttcaccatcaccgcctccatcgacgccgcgctgcgccctgccaccaggctcgcgcttcagggctttggcatcaccgaccccgcgcaggtggatgctgcggtaacctcggcggtggcctcgcagtgggcggcctgcggcaccctgctcgccgccatgagcaacccggcctcaggcgtgacctcccccttcctgtccagcctggggcccttcccctaccccccggaattctgcgcctacctccccggcgccatggcgccctacctgggcttccagcctgacccctcccagttcggcgccctcgggctggccctggacaccggcgcggcggccgccttcctggcggcggcaaagggcgccaccaacgccacggccatggaccctgcaggggcggccttcctcggcgccttcctgaccaccccccgcgcggcgctgcttgcgggcctggcggccgcgccggccacccaggccctggcgcaggcgctgacccccatcaccgccacgcagtggggcctgctccagggctacctcgtctctctggtgcccacctgggggacgctggtctatcgcggcttcctccaaagtttcgccggcagggccggcctggtcctcaccaagaccgtggaccagtggctgaatgggtatgaggatccgatcctgctgctggccgccaagcagctgcaccccaccacctggcagctcatgccctggacctacacgccacaactggcactggccttccccacggaggacgcccccttgcgcttcttccagcagaccacaggggcgccgatggcggtccaggatctgagctaccgcgcctcagacataggcaggtacctcccgctcattcaacagcgggccctctccacgggccaggcggccaacagcacgctgttgggggtgcgttggctctga

SEQ ID NO: 5120 - DNA, 186 bp, Chlorella protothecoides
atgggcaaggcgggccagaagggcgagacccacttcgcactcagcatcgtgtcgccgcgattccagggcctgtccaccctgaagcggcaccggctcgtgtatgcgtccctggcggaggagctggcggggtcggtgcatgcgctgcagatgaacacgcagacgccggaggaggcgggcgtggtgtga

SEQ ID NO: 5121 - DNA, 480 bp, Chlorella protothecoides
atgccctccaatcccctgcatcacctcctgctgcaggtgacgctggactggttggcccggttcctgcgcctcccaaacgccttcctctccaccggcaccacgggcggcggcggcgtgatccagggcaccgcctccgaggcggccctggtggcgctgctggccgcgcgcgcgcgggcgctggacggccgtaaccccggcgcggacggccctcgccttgtcgcctacaccaccgaccaggctcactcctgtgtgaagaaagcgtgcgcggtggcgggcatccagcacctgcgcctgctccccaccagcgccgagcggggttgggcgctggaccccgcgaccttggaggccgccatgaccgccgacgagggccatgggctgatgcctttcttcctcaccaccctcatcggcaccacctcctccgcggccgtggaccccgtggccgagctggcggcggtcgccaggaggcatggcgcatggtga

SEQ ID NO: 5122 - DNA, 1095 bp, Chlorella protothecoides
atggcctggctggtgaaggactggtcctggggcgcggtgctggtggcctcctacttcatctccggcaccgccaaccagaacctgttctccgcccaacatgagatcagccacttcctggccttccgccgccccctgtacaacaagatcctggccttggcctccaacatggtgctggtggttcccgtcgcggtcaagttccgcgagtaccaccacgaccaccacctcttcctgggcatcgacggcggggacgtggacctgcccaccgtgctggaggtgggcgcggtgggcagcctggccgccaagctggcctggggcctggtctacctctgcatctacggcctgcgcccgctgatcgtgcgccccaagccgccctccgccgccgacgccgtcaactgggccaccacgctcggcttcgacctggccttgctctatttctggggcctgaagcctgtggcctacctgctgatcgggtcgctgatcgggggcagcctgctgcaccccatgggcgggcacctgctggcggagcactacatgtttgagaaggggcaggagacgtacagctactacggccccatgaacgcgctcacctacaacgtgggttaccacaacgagcaccacgacttcccccagatcccgcacacccgcctgcacaagctgcgccgcatcgcgcccgagttctacgagcccatgtaccagcaccactcctggtgctgggtgctctgggccttcttcgccgacgagaaggtggggccctggctccgcgtgcaccgcctgaggaaggagggcgcggcgcccaccaacacacgcttctccgagtacggcggcctgtacgccgtgtggcggcggctggcctgctccgaccccgagccctttgcccccggggtggccggcgaggcggggccgggggcgcccgcaggcaccccggtcgccgaaaagctcacgcccgcgcccgtgctcaaggagcggccgacggcggcgcagcccgtcctgggcggcctcgcggagaagccggcgctgacccggcgctcggcagccatggcccacggccgcaacgggagcagcgaggagaacacgccgccccccacctcccgatag

SEQ ID NO: 5123 - DNA, 1632 bp, Chlorella protothecoides
atgtgcctacccccacccacttgcattcacacccaccaacagggccggaacgtggtgatcgagcagccgtatggcgggcccaagatcaccaaggacggcgtgactgtggccaaggcggtggagttttccgaccgcttccacaacctgggcgcggcgctcgtgaagcaggtggccggcgccaccaacgatgcggcaggcgatggcacgaccacggccacagtgctgacccgcgcgatcctggtggaggggtgcaagtcggtggcggcggggatgaaccccatggacctgcgccgcggcatcaacctggcggtggaccacgtggtgagcgagctgaagcgccgcgcgcgccagatcagcaccacggaggagatcgcgcaggtgggcaccatctcggccaacggcgagcgcgaggtgggtgagctgctggcgcgcgccatggagcgtgtgggcaaggagggcgtgatcacggtgcaggacggcaagacgctggagacggagctggaggtggtggagggcatgcgcttcgaccgcggctacatctcgccctactttgtcaccgacaacaagacgatgcgcgtggagttggaggacgcctacatcctgatcgtggagaagaagatctccggcatccagtccatcatccccgtgctggaggcggcgctgaagacgcagcgcccgctgctcatcatctccgaggacgtggagagcgaggccctggccacgctcatcgtcaaccgtcttcgcgccggggtcaaggtctgcgcggtcaaggcccccggcttcggcgacaaccgcaaggccaacctggccgacatcgcggcgctgaccggcggccaggtcatctccgaggacctgggcatgaagctggagaacgtggacctgagccacctgggcacggccaagaaggtgaccgtgtccaaggacgacaccgtgctgctcaacggcggcggcgaccgcgccgcgctggccgaccgctgcgacatgatccgggaggcgatcgccgcctccacctccgactacgaccgcgagaagctggaggagcggctggccaagctgtccggcggcgtggccgtgctcaaggtcggcggccactccgagttcgaggtgggcgagcgcaaggaccgcatcgtggacgcgctgaacgcgaccaaggccgccgtggcggagggcatcgtgccggggggcggcaccgcgctgggcatcgtgcccgggggcggcaccgcgctggtctacgcctcgcgcagtctggagtcggtcaaggacgcctgcgccaacttcgaccagcgcacgggggtcagcatcatccagcgcgccatccgccagccggccgccaccatcgccgccaacgcggggcaggagggcgctgtcatcgtgggcaagctgctggagcgccccgaggccgacgccgacgtgggctacaacgcggccacgggcgagttcgaggacctggtcaaggcgggggtgatcgaccccatcaaggtcgtgcgcgtcgcgctcaccgacgccgcgtcggtcgcctccttgctcaccaccgccgaggccgtgatcgccgaggcgcccaagcctgagggggcgagcccggccatgccgggcggcatgggcggcatgggcggcatgggcggcggcttctag

SEQ ID NO: 5124 - DNA, 804 bp, Chlorella protothecoides
atgccggtggatggcagtcctccagctcaagaacatcgtgctgcgacactggcgcagtattcttccaggcttgccgtccaagtggcagttgtgatctccaagattgcacgggtggactaccccaaagcctggccggacctcttccaaacgctgctggcgctcctgtctgaggccacctccaggcacacaggtgggaaagggagaatttatgcgctgctggggggccgtcggcttgttgggccatctgtggagatgcgcctgggtgggtgctgtagcacaaaccgcccggacccactcggggcagagggggcacactctgcctcccggccacccaagcacacgtggcccatgtcccccccgactcccccgcctcgacacacccctcctgcagagcagcgcacgctgctggtcctgcatcatgtgctcaaggagctggcctccaagcggctccagtccgaccagcgtgcctttgaggcggtggcagccctcctactcggccccctggcgtcccgctggtcggcagacaccgctgccctcctggccctgctgtccaacccggggggcggcccggcccccatctacggctcgtggctgctgggcctcaagtgtctccgccggctgctggcctacggcttcccctcggacgcccggacattgacctgctcgagcgaggtggtggcggcgctgccagcgctgctgagcgcactgcgcgcgctgggcttgctgcagcgggacgaggcccaggaaggcaccctgaagctgctcaaggccctgctccacctccaggagctgcacccttggtga

SEQ ID NO: 5125 - DNA, 432 bp, Chlorella protothecoides
atgaacacgggcgaggagcagcaccacttccggttccaggagccgtgccgcgcggtcaagttttccgtcggcgaggccttcgccgcggtgtcctccgaccccttcatgcaggccgtgtcggcggtgcgcatcctgcccatcgcagccgaccccgcagagcagggggaggaggcggtgcagacgctgcgaggcccccgtggccgcatcgcacgcgtggagtggaccgatcagaaccggaccctgatcaccgccagcgaggacggcttcgtgcgccgctgggacgtggaggtgcatggatgggtgtggggggaaaatgtggctgggcgtcctcggatgggaagggcgacagccctaataccaggaagtcaggctggagccctgtggagatttcccacagcccagggtctgggctggcgggacagacagctgtga

SEQ ID NO: 5126 - DNA, 282 bp, Chlorella protothecoides
atgtggggggcctggtgggcgtacaacgtctgcctggcggtgctgaaggccaatcattcccggccctacgcggcgcagccttggttcaggatgggcctgaagcgcttctactggatggaacccctgctgaagatcatattgccacccctggccgtgtctgtggagctctactttgatcacaccgccttcaggtgggtggacgggcgtgccagtgtgcccgggccataccagccatgcgtgggagtgtatgcttgcatctcaggtggatatcctggggtttag

SEQ ID NO: 5127 - DNA, 618 bp, Chlorella protothecoides
atggtttcaggggaggagggtccccttcccacccatgcttggggctcgcatagggtctccctccatctcccccaaaattccgagagcaaacgtccagcttccccctctcgcaggagcttctggccctcctgcgtcctgctcccgctgctggaatggtgtgtggactggctggcgggccctgggcgcggcgcggccgccggcgccgccgcgcgcctgcccatgctcctgcttcaccagaccctgcgctgcccgtcctaccgaggcgccagcgcggccctgaccctgaacctgtcggcgcggcgccaggtggagcagcagtcctccatggcggccgaggtccgagccgggctggaggagttctggggcgcggaggaccggcgcccacgcctcctccgcagcctggtcctgcgctacatcccgctgacctcggaggacctggaggagtgggccgtggggccggaggccttccaccacgccctgatgaacgtggcctgggaggagagcgtgcgcgggtgcgccgagaacctggccctggccctcttcgaggtggaggatggtcgtcagcgccgtcaccagctcgtcctggctggccggggctcggcgctctcaagctcgtga

SEQ ID NO: 5128 - DNA, 1032 bp, Chlorella protothecoides
atggcccccagcaaacccacccagtgggcgaatgccctttttgtactggccgcccttgccaccctcacagcactgcccaccacggccgcccgcgccctgctcgctgaccaggtaagcaattataatgtggattgtggccatgacagcctgtttcatgggtgctgcgagcttgctcgagccctggtcgagttgggcatggcggggcgcgtgcacctcggccgcacgcccccgctcagacagactgacaatgcgacaaccccaaccagcgaagactcacttgtctcaaggttcgacggtgtggacttcctggaccccctccagctcgccgacaaggtcccccagatcgggagcgactccttccatggggacggcaccgccttctccgacgctgttaacaacacgggggccgccttcgcctgcagcttccgctacctgaacaactgggccagccagtactttgtggccatgaacgaggaacagtggaacgatggcctggtctgcggctcctgcgttcgcgcccgctgcgtcgaccccaagtgccccgtccagaacgtcgacatcgtggccatggtggtggaccgttgccccgagtgctcctacggcgaccttgacttctcctaccccgcctactccgcggtcaccggctcctggcccaaccgcctgaaggtgtcctgggagaaggtggactgctccgccttcatcgacggcaccatccgcatgtggcccaaggacggcgtcaaccccttctggcaggccttctactttgccaactccaagtaccagatccagaacgtcaccctcaacggcgtgcccctcacccgccagacctttggcttctggatccacccgggcaccgcccccaccgggccctcctccctcgtcttcaccgcggtgaacggggccaccgtcaatgccacgctcaacagcgtgtgggatgcccaggacctggacgtccagttcccagaggacctgaacgtccagttcccagaggtagccgacgccgcccccgtggccacggcgggccgccggtga

SEQ ID NO: 5129 - DNA, 1527 bp, Chlorella protothecoides
atgtaccggtcagctggagccctggggccctccacctctgcccccagcctgcccgcgcgggcgtctgtaccatctgcacgacagtgcgcacgccgtgcatcggtatgcacccgtgcatccgcctccaccgctccaggagacatccgctccaacgccgtcctgagggctcgcgcggagggcacgttccgcgcagagtacgtcccctttgccgacatcgcctccggcaccgtgggcaaggagacctactccttggatgacgtggtctaccgcgccaaggacggaggcctgctagacgtcaagcacgacttcgaggccctggccaagtacgatgccaagtactggaagaccctgtttgacgggcgggtgggcaccgccagatggccccacggctccggtgtctggtccaagaaggagtgggtactgccgcaaatctccgacgacgacatcgtcagcatgttcgaggggaacagcaacctgttctgggcggagcgcttcggccgccagattggaatgagcgatctgtgggtgaagcagtgcggcaactcccacaccggctccttcaaggacctgggcatgacggtgctggtgagccaggtgaaccgcctgtccaagctgcgcccggagtcggtgcaggcagtggggtgcgccagcactggcgacacctccgccgcgctgtccgcctactgcgcggcggcgggcatcccctccatcgtcttcctgcccgccgacaagatctcgctggcccagctggtgcagcccatcgccaacggcgcgctggtgctgtccatcgacaccgactttgacggctgcatgcgcctgatccaggaggtcaccgccgccagccccatctacctggccaactccatgaacagcctgcggctggaggggcagaaaacggcggccatcgagatcctgcagcagtttgactgggaggtccccgactggctcatcatcccgggcggcaacctgggcaacgtctacgccttctacaagggcttcaagctggcccgcgacctgggcctcaccgaccgcctcccgcgcctggtagtggcccaggcgcgcaacgccaacccgctgtaccgcgcgtaccgcgacggctggggcacctttgcccccgtcaaggcgcagaccacctttgccagcgccatccagattggggacccggtgtcggtgcaccgcgccatcctggcgctggaggcctgcgatggcatcgtggaggaggccagcgaggaggagctgatggacgccgccgcgcgcgccgacctcaccggcatgttcaactgcccccacaccggggtcgcgctggccgcgctgctcaagctgcgcgagcgcggcgtcatcgccccctccgaccgcaccgtcgtcgtgtccaccgcgcacggcctcaagttcacgcagtccaagaccgcctaccacgccgccgagatacaggggctgagcagcaggtacgccaacccccccgtcacggtgcgggaggacctgggctccgtcatggacgccatccgcaccaagtttgccaagctgtga

SEQ ID NO: 5130 - DNA, 513 bp, Chlorella protothecoides
atgaacatgacgggcatctccgagggtctattggtgctggacaccaacaaccccgccacccagcccatcatctttgaggcaggcctcctccggcccctgcagacgcggcagaggggcttggcacgtgacacaggagtgaccagtccccaccgcgcatgcacgtctgccctgcatcctgcaccacccccatcttatgccaacccctctcttccaacaaactacccgctcaactgcccagggacaaaaagctcggtgaagaagatccacacggtgcagttcacgatcgaccccgtcagcctggcctcctgcaatgccagcgcctatgctgcgtgggcgcaggccactcagtttgaccagggcaagttccagacggccattggagctctgacggcagccagcaattactgggacctcgtgcagaatgacatggccctgactactttcttcgaggggaccacttttggatcgctggggttctactttgggacagaggacccacaacgcgacaggtag

SEQ ID NO: 5131 - DNA, 192 bp, Chlorella protothecoides
atgccctccctggcccccgccccaccacaggtcctggcctactcccagtcccgcgggtatgccgccaaggacatcctgtttggcgacgcctgccgcgcctccatgctgcagggcgtggagaagctggctgacgccgtccaggtcaccctgggccccaaggtaggcttgtatagtggaggagtgtctgggtag

SEQ ID NO: 5132 - DNA, 600 bp, Chlorella protothecoides
atgcccagccccctgtacgtcaaacctggacccgttgagaacttcaacgccccctcgtggctggatctccccctgaagcacgtgatcgagagccaacagttcaaccaggcctccctgaacaccatcttcgaggtggctaggcaaatggaggatgttcggccagggacccccgaatcccgcgcgctggacggcgccgtgatgtccaccctgttctatgagccctccacgcgcacccgcctctccttcgaggctgccatggcgcgcctgggcggcaccgtgctgtccactgagagcgcgggcgaattctcctccgccgccaagggcgagacgctggaggacaccattcgcacggtggagggctacgcagactgcatcgtgctgcgtcactttcaggcaggcagcgccaagaaggcggccagcgcggcctccgtgcccatcctgaacgctggtgacgggccggggcagcaccccacccaggccctgatcgacgtctacaccatccagcgggagattgggcgcctcgaaaacttcaccgtcgggctggtgggagatttaggtgggcaagtggagggctggtgggtgggttgtggctcagagtga

SEQ ID NO: 5133 - DNA, 543 bp, Chlorella protothecoides
atgggaggtcgattcccctaccctcccaccgttctcccacacatacacatacacccactcccactccaaccccctctcaccccatccacaactcagacggggaaggagctggccgccgagcacgtgcacgagaagaacatccaggacttgcagatgtcggtggacggcacccacttcatcaccgcctccgtggactgctcctccaagctggtggacacccagaccctggccgtgctcaagacctaccagtccaacgtccccgtcaactccgcagccctctcacccgtctacgaccacgtcatcttggggggcgggcaggacgcgtcccaggtgaccaccaccagctcgcgggcggggcgtttcgagtcccgcttcttccacaaggtgttccaagaggagtttggtaacgtgcgcggccactttgggcccatcaacgccgtctccttcagccccgacggcaccggctttgccagcggcggcgaggagggctacgtccggctgcacaaattcgacgccgactacttcaccaccaagttcttctga

SEQ ID NO: 5134 - DNA, 276 bp, Chlorella protothecoides
atgatgcagcacccgcaccacgccaaggtcacccccaagttctgcaagcagtatgcggcggtgggggaggtgatccagggcgcactgtcggccttccaggcggaggtgagccagcgcaccttccccgggccgcgccactcgccctacgcgctgggggcggggcaggaggagcggctggggcaggcgctgcggggggcggggctggacgccgcggccgcggccgcggaggagctcatcgccaggcaggggctggccacggcgcagaacggggcgtga

SEQ ID NO: 5135 - DNA, 1110 bp, Chlorella protothecoides
atgccgatggtggggatggagagctgctgcgtgatggccgcgcccaccagctccggcacgcactccaccaccaccatcacacaccccgcctcttccaaagcctgcgcggatgagagggggagggggggagcaggagatgactgggtcagccagcggggccgtccctggttcagcgctgggcgtcaacgtcccgcctggagaggggtgcggcagcaaggcccggggtggcgccgccgtggccgcggagtcaccccccacaaacacaccatccccccgcaccttggcctcggcgacgacgcgcgcggcgtcgtcggcgtggaggcccgcgggccgaaacccgcccagcagcgagaccgactgcggggtcaggcccacatgcccgatcaccgcgatgccggcgcccaccacggcgcggatggtctccaccctggcgggcgcgccgcctggcgagggaagggcggcagggtggggtggggggatcggtgcgcgcgccaggtggggctgccgacgtcatgcggtgccacgcccacgcgacgcaccctcgatcttgacggcgtccgcgccgccctccttgagcatgcgcaccgcggcgcgcacagccgccgtcggcccctcctcgaaggagccgaatgggaggtcggcgacgatgaaggggcggcgcgcgccgcgcgacaccgcgcggcagtgcgtcagcatctcctccagcgtgatgggcagcgtggtgtcgtgcccgtgcaccaccatggccgccgagtcgcccaccagcagcatctcgatgccggacagctccacctgcacggcggtcgggaagggaagggaggggaggagggggtcattggggggggaacctcgtcgggcctggttccaggcggcacagggatcgccccgggcgtgcatgcgccgcagcgtgcgcagcgtgacgcggctgggggagggcgctacggggcccgagtagacggtgtcggccggcttgctggagtggcagcaccagtgccgggccaggccccgggcggtgggttgcgaggtgatgacaggtgccctgaaggcaggagctgtgtggcctgggaacatgagatgagtggtggggtggctggggagcaagggttctga

SEQ ID NO: 5136 - DNA, 681 bp, Chlorella protothecoides
atgaaggacgacatcaaggagtacctcaccggtgtgggcgtgcagtgggaggaggtcgatgacctcggcggcagccctgggcaccagtggagtgtgggagtctgcaggctgtcacacgacacctggttgctcaccaagaatgccagatcccaagtacctcatttccccaatgccccacgcgcacaatccttgctcgatcaggcggtggctgccgaggtggacgtgctgtaccagacccggatccagaaggagcggttccaggaccggcccgacgactatgagctggcaaagggcaggtacatcgtggatgccaagctcatggccctgatgaagcagaagtcggtcgtcatgcacccgctcccccgggtggacgagaagtcagtggtcatgcacccactcccgcgggtcgacgaggtaggcgtgtccatgaggtcgagatgcggccctggggggggggtgagagtgtcgatgcggggcctggcgcccagtgccccctccaaggacgggcccatcggaggtgccacctgcagcgcacccatccctccaatcacatccacacccggacagatctcccccgaggtggactctgacccgcgcgccgggtacttccgccaggcaaagaacgggctgtttgtgaggatggccctgctcaagctgtgcttgcaggatcgcctgcgatag

SEQ ID NO: 5137 - DNA, 582 bp, Chlorella protothecoides
atgtgggtgcctgcggaggcctccgatgctgtcgatgcggcactctgcacggctcgatgccccctcctcccgctgcctgcccgcccacgacctcccccctgccgcccccgcaccccgatcttgcagggcctggcagcgctgctggtggtgggcctgagcgggttgagcccgcaggagacggtccagatctcgcccgacttcatcacctccctgggcttccagcaggccctcacgccctcccgcaacaacggcttcctcaacatgttccggctcatgcagcgaaaggcgctggacctgtgcctgctgcagggaggcaaggcaggggcctcgcccggcgaggcggggggctcgcccggccatggcgctggcgcggctaccaccggcgcagcagccggggaggaggccgccggacctggccggcccaggggcgggggggaggctgcaccccagcctggggatgcagctgcggagccatcggcctcagagcagcagcacatgggccccgtggcggcaagcatgcgcaggaagctgcaggacgccttccagcctctgaggtggggaggcgacgttcaggagggctga

SEQ ID NO: 5138 - DNA, 1119 bp, Chlorella protothecoides
atgggggtgcgcatcagggctggcatgtcgaggtgccagccttcatgtcgctcgcccccctgcctctgcatcgtctgcatgttttccaggcgcacagcgtgccctccccagcaggtcagtatcctgatcaccccttgctcatgctgcgcagcacccccggcgattcaccatgtcacggctggtgagggacgtgctggagtgcctggcggcgctggggcacacacgatgcaccctggtcgcccacgactggggtggcatggtggcttggcatgttgcggctgcccacccggaggcggtgcagcgcatggtcgtccttgcctcgccacacccccgagcgtacctggatccggcctgcttcaccccccagcagtccctgaggcaggcagtgtatttcgtccaactcccagccctttagcacaatctcctgcacaatgcaacgctctgcaaccctcccaggtcatggtacttcatcttgttccaagctccacgccttgcggctgtctacatgtcccattcagacttcaaggaagtggactctatgctccgaaaagcacccaggggggtgatagtggacggcaccatcacagaccagagcaggtgggtcagagtgggcacgtcaagcttcaactgaaggactccaatcagcaagaagtcctttcatgttcatcacaggatgtggaccgcaccaaggcattgttgggtagaccaggtgcactcagagctgccctgaactattacgttgccagcttcgacaatcagtcacgccggcctgaccagatactcaaaacgcacagtgagcagtctgaaacaacaggaaagcgcactccctgctacctttgcaggcccctggagtcgactatatctgtgcctctcctggtcctgtatgggcaacaagacgccgccttccttccttccatgttccaggtgcaacgctgggtaccctcttctgtaaagtgcatgaagatgcacagctcattgaaactcttttggtacaagaagatcttcacaggactgtgcgtcacctctctgcaggattatggccggttctgcgcagatgtcaccactctgatggtcgagggatgcagccactggatgcagcaagataggtgccgtggttaa

SEQ ID NO: 5139 - DNA, 603 bp, Chlorella protothecoides
atgtccaaccaggacaagttcgacgtgctactcgagggcctcgaagcccatcagactgacacatcactcctcaaaacaggagattctgtcgagttacagcacagagatggtgcattgcattgctcaagctccgccggcattatcgggagagtacccgaaggcaacagcggccctctcctcgaaggcgactggcggggatctgtgcgaagcttgaaaaggaacgcggagacaaagtccttgacacaagtgctggtcagtgtagtccccgcttcatacagcaagaaatgcagcaatctcaccgtacatgcagctgctccaggacacaaggtggaagaggcagatgatgtagagttcctcagtgcagcgcagtacgagttgttaggtgagagcagatatgatgtgatcgtgtctgtatgctcgcgtgtcgattcctctacatgctgcgcagagggtgagccttcaagttcctcaccaccccgttgtcctccagcaaatcagcctgagatgcagcaactcttgagtaatcccgaactgcaatctgtggtgaggagcgtggacagtgcagcagatcgagagaaggtgggactcttgtgtggggtatga

SEQ ID NO: 5140 - DNA, 1626 bp, Chlorella protothecoides
atgggcgtcaacccggtgcgcgagaagaagctgagcaacatgcgcagcgccggcgccgacgagaaggtgcacctcacccccccacgcctcatgaccctggaggacgtcattgggtacgtcgccggggacgagctgatcgaggtcacccccaccaagctccgcctgcgcaagcgcctgctcaacgcctcggcccgcaagtcggccagcagggcggggtcaaggctccatctccgcgtcgcccgccggaccagagggatcctcgccgctagccgcctggcttccgggggcgggagacccactgcccgccctctcgtcgccattcggtccggtgcgaggcgagtccgcctcgtcccccctcggtcctctgccccccccgatctggccgtcctcgctcgctgtctctgggccggcctcgccctccgcaacagcacccagcagccccgcgtcggcgtccgacctgccctcctcgccatcgccggcgtcgctcgcagccaggcccccgcccgcgctggggctggcgacgggagcggcggaagcctccgccatctccacgtcctcctgcttgccgccctcctgcgcctccccgctggaagcagtgcccgcccctgccggttctgggcatcggtttgggtacatgatccgggccgcaacctggaggtcgcccttggcctggacggacgccacaaacgcctgaggagcgaggggcgtgctggagctcgatcatcgtgctgcgggtgcacatgctgcagggggcagcggggcagccagccctgccaccccgagcaaccccagaccgtgcacgcacgacccacacctcccagctcgcaccctgaggggcagggggtggatgaggcgggcgtcatggccgggagtcaccacggacagatgtccccgtcttgggccctgtcacggtccctccacccacatcggcaaccggtgcacatgccagccaagctccgtggccccggcccagggcctgtctcccctcccccattcacacaccaggctgggggcctcggggtccgtcatctcctccagcaccggctccatgagctggctgaccgtcttgaagccacctcggtcctccgcagccagacctgcgaggacaggggcggaggcacgcaggctgagagaccaccaacatgcatgcaggctgagagaccacacacatgcacgcaccccatgccggcgcggctccgccccacactggtgcccatccccaagccagggcgtgaatcaccgctcaagttgtcctcggtcagattccacagcctgtccagctcctctgtgcccaagccgcaggcggcgcggcagcaggccgttcaaacgcttccttgggacagcttgcctgaggcagcatggcggaatggtgtcagggcctgcaatgccacgctggcatgccacgatgcgctgcgccaaccccgctgcgatctttcccgcccaacgaagcctgccaaacacacctgcttccaagccgcccaggaggactcgtccaggagcagctggcggatagtggctgcgaactcggggcctcgctctggcacagaagccagtgactcgtacacgctctcctggagggcctgtgttggggtggggaatgcactcggatctcaggatcagtcttga

SEQ ID NO: 5141 - DNA, 309 bp, Chlorella protothecoides
atggagtacaagctcagcagcgctgcaaaagtgccgtcgctgcgcctcttgctggatgcctcgctgtccctggcgctgcagggtgtcacccatggaggcatccctgcagccctgctggagcaggtgtttgacagcctgacggttgcagagtgcgaggtcccctttgcttacctcgaggagcgactgtcagacttcaagcagccagctgtgcgtgcccgtgctgccctcaccctgcagagggcctgcaaccttctcatccacagactcagcaaggtgggtattgcgagagcgtacggcgtggccctgtaa

SEQ ID NO: 5142 - DNA, 477 bp, Chlorella protothecoides
atgctgcctcaggcaagctgtcccaaggaagcgtttgaacggcctgctgccgcgccgcctgcggctgccaagaccacggacccgctggggccccccttcaagcggcgtaagccgagccgggacgctgtgttcggagtgaccttgggcacagaggagctggacaggctgtggaatctgaccgaggacaacttgagcggtgattcacgccctggcttggggatgggcaccagtgtggggcggagccgcgccggcatgggcctgcgtgcctccgcccctgtcctcgcaggtctggctgcggaggaccgaggtggcttcaagacggtcagccagctcatggagccggtgctggaggagatgacggaccccgaggcccccagcctggtgtgtgaatgggggaggggagacaggccctgggccggggccacggagcttggctggcatgtgcaccggttgccgatgtgggtggagggaccgtga

SEQ ID NO: 5143 - DNA, 594 bp, Chlorella protothecoides
atgctgacagacaccttcaccctttatgatcagggtgcccttgacagcctcggcaagaccgtggacgcagaattctacggcacgttctggtcgctgcaggctgccttctcgaaccctcctcaggcagggattgagtggagtgagacagcacgtgccgtcaagatcgttctggagcgtctgaagaaggacccggtgaccctaactgaggccgcatcaggcagcagcatcagtgcaaaatacctgagcggcagtcggttgctgtccctacaactacgggacgcaaccttccggcggcacttcctcgtccagtgtctcatcctgttccaatttcttgaggctccccatgccgccaaacaggcctggccagtcctcaagggccgtcagattgaagagctcaaggccctccaggagagcgtgtacgagtcactggcttctgtgccagagcgaggccccgagttcgcagccactatccgccagctgctcctggacgagtcctcctgggcggcttggaagcaggcttcgttgggcgggaaagatcgcagcggggttggcgcagcgcatcgtggcatgccagcgtggcattgcaggccctga

SEQ ID NO: 5144 - DNA, 453 bp, Chlorella protothecoides
atgaagcgaggacatgtcaaaaccgcttccaacgcaccctccaatcccccttcagatctgctgagcacggtgaaggcggtgatgtctgcaccgctaccccgcgtctacgaagaggttgggggtggcaaggtcatccccatgacggccagcaccgcgtctggtgtggtgggggccccaaatggaccaatcgtccccatcgggggggccgattacaatgcagaggagatgtcgcgcgtcgtcaagtctgctgggaagcttgtggagtccgaggtgctagcccccatggagcgatggatgaatgcctttgtgctcatccagcagcgaatgaagaggttggagagcctgcgcctggaggtggattcccgtcgccgcaccgtggccaagctcggcaagaaggtgggttgtgacgctgctggttgtgagtacattgcctcagaccatgatggaccttga

SEQ ID NO: 5145 - DNA, 555 bp, Chlorella protothecoides
atggagaacaccatcaagatcctgcagcacaaggaatccaagctgtcaggtgcgagaagagtgaagacagctgggtgcaacccatgctccgcccgtgcagtcctgcgcatccagtcagaggcgctccgcagcgccaacaccgcgctgggcgagcagaaggcccgcgtgccgggatcacgcggctaccccttgccggtggaggccaattccggggccagcacgccgctccagtctctgcctccggccggcatgccagaggtcatcgccgcacgccgggacgagcgcgagaacgtgccccgactccagaacggacagcaggtgcgggagaagggggcatgggcatggagtggacctcgaggtggcattcgcgccaaggtgggccgcaaccactcagcgggcgcctctgtgggcctgggacactccaaggactcactgtacacgctggacgacgcgccggccgcccccacacaccgcatccctgccacccaggtgcctacggcgtacgacgcttacaatgaggcagcatacagccgcaatgctgtgcctgcctggtag

SEQ ID NO: 5146 - DNA, 573 bp, Chlorella protothecoides
gccgccggtcgcgccggccccggccccgcgccgccctacacgctggccgcgctgcgcgcgctgggcggcaaggccggcgccccccccgccatgccctttgagctgcgcgcgctggaggcggtgctggacacggtcagcgcgcacctggagcgcgcgacgggggagctggaggcggccgcgcatcccgccctggacgcgctgaccggggccatcaccacgccgcacctggagcgggtgcgccgcatcaagaatcgcatggtgcgcctgaccacgcgcgtggagacgctgcgggaggtgctggagaagttcctggacgacgactcagacatgcacgatatgaacctcaccgccaaggtccatgagggggtgattgtggggggaaggggggcggggcccttgggggcggggaggtgggtgcgtgatacaccggtggcggggtgggagactcgcaggacgcaacgacaatcttccccatgctttggcactctccttcacgaaactccagagcatggagcgggagcagctgctgcagcgcacctccctgcgcggctcggtggcgggcacgccctttga

SEQ ID NO: 5147 - DNA, 555 bp, Chlorella protothecoides
atgtcaccacgcactcggcgctcggcctccagcgcctccaccgactcttccatcgtggacgaggaggtggccgcggtggagatgctgctggagccctacttcatgcaggtggacaacacctacaacaagctgcagacgctgtgcgaatacatcgacgacaccgaggactacatcaacatcgagctggactcccatcgcaacgaactcatcaggctggcgattgacctgagggcccctcaccgcctttcccccatatcactacagttggacctggtgctgacggcgctgaccgcttcggtggcgctgatcaccgccatcaccagcctgtttgccatgaatctggagctgtcgccgggcgtgcagggccaggcaagtcgtgaagtaggggtatggcgccgggcggtggatcagtggtttggagcaggggtttgcctcgtgctagaactcggcagccccgacaggggcagtggcccggactgcttgccaaaatcccagagctccgagctgcatccaagggcaaatccaggcgcggtgccggggcgtaatttgaggtga

SEQ ID NO: 5148 - DNA, 726 bp, Chlorella protothecoides
atggctcacgtgcaggtggaggcctccgtgactcgaccggagcacgcgctcactaccatcaccaacaccttcaacttccagttcacgtttgacttgaggaaggggccggggggtgcctgcctcccaccccggatcatcctgccaaccacaggtgtggaggtgcggccccatggggtgcacctggtggatcaatgtctgctcgggatctgcaggcaccgctccaggcgctcgatgctgtgcattcccatcgggaagacaaaatgttcgtgccaatgcagcggcgcagggcctctcctcaacactgcttgccacctcctcaaccttccccactatgcgcagaggaacaggcgttggaggtggccagattcttcggccccggcgcatctcccgagcgcttctacaagatgctgtgacgtgctgtacgctgtgcgcgctgcgcagtgtgcggatgttgttccccggcatgcacctggtccctgctggaacattacactggaccaggcagggaggagagagcagggagagagaataatgcaaagtggctccgccagggccagctccgaccagatgctttcaggcaaagcatcctcagatcaggcgcttccaccggcagtagaccatgacgccggtgaagatgaatgccgcggcgaggcagcacacgaccgacacgacgatgaactgccagtaggggccctgcacaatccatggacggggagcgggggttag

SEQ ID NO: 5149 - DNA, 1065 bp, Chlorella protothecoides
atgcagggactgcatgatcttgtcctggacaggttggtggtccatcactggccccagcccgatcggctcactgtgcacccctgcagcaaggtggatgacccagcggcacgaccccccctctgcgtgacggcggcggtggaagccatcgagctacgcaccaagcgcatagacctgacggaggacatgcaggtggggtcggcacagcgggttcctgctgagcagaggcaggcccatgtgcctgcacccgaggcccccactgggattctggcgctcgacctcatcggcccgggcagccccacgaccacgactcctccctccctcgccgcagatgagcggcagagtggcctggacgggatcctcctccatggatgtgtgcatggagctgctccaggtgcggtctgcctgtggccctgcctgcacctggtcattgggccaggcttcgattctcaggtctgcaggcccatgtccgcctccctctgttccccccttccccaccagagtgggaccaagcagctggtggccctcttcacttttgtggcgcgcgacgcgctgaccaacgccgcccagcgcatcagccccgtcgtgccggagacggcgcaggacagggccctgtttgcgcggcgccagcagatctccgacgccaggcggaccgcccgggcccgctcctccgccgccgccacggggctgcacagccaaggtgggggaaaggacggcgagagggggatgagtcatggttgggtcatgcacacccctgatcacccatgctggagcgagagaggcatgtttccacctggctgccctgagagtcgactgccaccacagcgcaatcccccccattcccccgcaaggtttgaccccggaggcgcagcgctgggcggccgcgctactggcggatgcaaagctgctggcgacggcgccggcgctggcggaccctcaggcgctgctggcctcggccactcgcctggacagcagcttcatctgcatgccgcagcagcgcaacacatacggccgtgtgtttggcggcttcctcatgaggtgcgctggcttgggaggaggaagggatga

SEQ ID NO: 5150 - DNA, 1086 bp, Chlorella protothecoides
atgcccccgcagctctcgctcctggactccctggagtactccgatggcaagcccagccgtccacgtatgggtcgcggcagccgcggcccacgcccgcggctcttcgcgaagggcaagtgccaggctgatggctgctccgtgaacctgagcaagctgccgttctactaccagcgcaaccacgtgtgcacggagcacaacaagtgcccttcgttcaggcgtcaggcgccagctggagcgccacaacgccaggaggtgggcggggccggacatgcatgcaggattcgggtcgcgccgagtcaatggatgtccgggcgccatggaccaaacccttgcacccgtgcaagcggcgccccgccgcctcctgatcccacctcgcacgcacgtcactcccttggcaacacctcccccgcttcccgcatatgcagacgacgcctggccctggccgccgccgccacgccccgctcgcgctcccccgccggcgagcgctgggcggcgccgtcggagcccgggccgctgcccctggcgccggtggtggcccccagcgcgtcgtacgccgtgccggcgctgtcccccgccgcctccgcagcggccgccggccccgtcgacgagcgcgtttgtcgcggcgacgagtgtgtttgtgggccctgttgtccccccgctgccttgggatgtgggcgaggaggagtccccgctgccgctctgggcggagctgggtcgggcgccgcctccgcccgctccccaccggcccctgcccagcccctttgccggcccagcggcagcctggctggcagcagcaacgactccgccgccagctgcgctgggcccgctgaggccgtctcgacggccgacgggcccgccgccgccggcctgcctgctcatggtcccgctggcggccgtgagcgtgcagtgagccgctcgggcgcggcggccgccgcgaccgaggcggcgctcggcgtgctgcagcggcagcacgccgacgcctacggcttcctggtgcagcaccagctggagctggcggggctactactggccgccgcgcgcgtcgccgccagtgccgcgcccggccggcgcgccgcctgccactga

SEQ ID NO: 5151 - DNA, 513 bp, Chlorella protothecoides
  modified_base (28)..(37): a, c, t, g, unknown or other
  modified_base (229)..(238): a, c, t, g, unknown or other
atggttgggaatcgcttggtcaagctgnnnnnnnnnngggatgcgatgcaagtggatggggtcgacgtacgaggcggggtaaggtgtcttgaaaatgaatggttgggaatcgcttggtcaagctgcacgcatcctcaatgggagctctggacgtccatcacgccgggaacattcgcaccaaagctccccctacccccgtgccacaacaggacaccgaggtgttctacgnnnnnnnnnnggggggggtggcgctcagggcaagagaagacgaatgagccacagatgggccatcacaagtctcagtcagacgtccatcacgctgggaacattcgcaccaacgctcccccgaccctcctgccacaacaggacaccgaggtgttctacgacttcaagaagttcctggaggacaacaatgcccccgttcccgcggcgctggcttcgcacgaggcggccaaggccaaaccgggggcggtggacacgcgcaggagcgcagtccagtatgccaagaagtag

SEQ ID NO: 5152 - DNA, 3117 bp, Chlorella protothecoides
  modified_base (582)..(591): a, c, t, g, unknown or other
  modified_base (2998)..(3007): a, c, t, g, unknown or other
atgcgtttcgggagctcgggtacgattgatggacggtgcttcttaaggcaatgtgcacccccaccaggagccttgcatggatcaggtccaaagactcagcatgtatgggccatggagcttgcattgctggagtggccactaccatccgcaccatcccctccctggcgctacaggacaacaaggtccaaagactcagcatgtgtgggccatggagcttgcattgctggactggccactaccatccgcgccatccccgccctggcgctacaggtgctgggagggcaggtgaacctgtacatgccatactgcagaaactgcccaggccgcacagggcatgcactgccgcaaagggcatgcactgtgaattgccagggcagtgtgaaaagagacccagttgtttcctggcgggtgcggccccttaacaaggacgacagcgacgagatttaccggattgcctacatccaagtgcgctgtcattgtgtgggcgcctggagttgctttatggaccgcattgtgccggttttgaaggtgcatcaatctaccgtgcctcaaaggtctttgccatgcacactgtgtggagcnnnnnnnnnnttgtcattgtgtgggcgcctggagttgctgtatggaccacattgtgccatgttgaagttgcatcaatctaccgtgcctcgaaggtctttgccatgcacactgtgtggagctgccgcctgcagtccaaatatgcagcacttgtacgctgccgataccccccccctcacctcccctaacacacacaacaacaacaatccaccgcaggcttcctgcttccagacctcccggcacgtccccctcgtgggccccttgctgtaccgcaacttcgccgccgaggtgctgagcgagatgaggaagaaagcgcggaccccgccggactaccccttcgcctcgctggtgctagaggagcggcgctcgcgggaggtggtgggcgtggtggaggtgtcgcgggcccgcctgcaggagctgcagcgcagcaaggaccgcgccttcttccaagcctacatctccagcatggcggtggaggacgcgtggcggcgccgcggcggcgccaccgcgctgctggaggccgcggagggcgtggcgcgggagtggggccaggcggaggccgcgctgcacgtctacgccgacaacggcgccgggattgcgctgtacaccgcccgcggctacgcgcgcgcggccgccgacgccacctggctggcggccgtggggctgcccagcagcgcctgtcttgccgggctttacaggtcgagctctgtgaatgacatccgtgtcaaatctgggcactgcagggaggaagggagagcggacacgcacacagactcagggcgccgccggtccgatgggtcggtgcgccgccttcctcccccgcgccacgcgggcctgcatggactggcgcttggagcgctgcgccaggaggtccgcgtcgctcacaaagtccaccacgccgggccggggaggcaggactgggcgcggggcctggcccggcctgcgatccgggcgcgctgctgcctcagactccgagcctgcacgggggcctttcctcgggccggcactcttgccctcctccttgttgcccttgctcgtcctgtcatgctgcggtgcgggggcttctgccccgccccggagctcctccgcctctttcgtccttcttgcctttgtcgccttcgtggcccttgtcccctcccccgcctcccccgcctccggctccgtccgccgtttcttcgccttgcgcagcgcggccgctgctttcatcgcctctcgctccgccgcgtgctgcgcagcgagctccgtggggctcagcatggccgtcaggcaggtcagcctcgcccgggtgtccacctccgccagcggctgcggcgcggcgccccccgcccccgcccggatgtcctccaggttccagagccgcagggtgccgtcgctcgacgccgtgcccaccagcctgggaagggcgtgtgctgtgctagggctcttgctggcctggatcgaagaggacgcatccgaggcagacgactggggcgcaacggccaggccccggatgcggctgccatgcgcctcggggatggtcaggatctccgcctcgtcctggggatggtgtcagggtgggggggtgggcgagacgaggcagatgagcaaggggacagggtcaagccagaccgcagagcgacccgacacccgtcgcccacaatgatgtatcgccaccccgccaaggctcagtcgccggccccgcaccggtttcctcccagactccagccggatctgttcaacctcgcaccctgcggcatgcagcgagccgtcgtcgcaccctgtcagcagcacgtcctcgccgtggaaagcgtggcacagcacccggcgctcgtggctcagcgtggccagcgcggtgctggactctgccgccacgctgtgcatgctgagcacggccccggccagcagcgcgtacacgtcgccgctggggctgaaggtgatggcctccgcggcctgcggcagcttggtggcgaacgtgctgcggcccttcaccaggtcccagatgcgcagcgtaccgtccctggagatggaaagcgcgacgcggccggaggggtgcaccgccacgcccgtcacctccttggtgtgcgccttgaaggtcttcaggcatgtccactccccgcccacgccccagatggacagcgagccgtcggcggagccggtgaggaggtgcgtgggggtgctgcgccccgtgggggtgtggaacacagccgccgtcaccgcgccctcgccaggggccatcaggaagcccaggtccttgttggtgcgcaggttgtagatgtgaatggtgtcctccgacccgccacatgccaggaatgggcccgcggcagcgatgctccggatggcgcccttgtgggctggatgcgtgaaggattttgtcagcgaggaggtggcctgttggctcaagccatgcatattctcgagaaggcaattcagaaggcgcaannnnnnnnnngatgtgggagggcttgtgattctctcccgagtgggtggatgcccacagtagctcaagccatgcaaattctcgagaaggcaattcagaaggcgcaattcgaagcccaatga

SEQ ID NO: 5153 - DNA, 375 bp, Chlorella protothecoides
  modified_base (82)..(113): a, c, t, g, unknown or other
atgccagacggtgctgttataccctaccgagtgttccgaggcctctgccaagtagcgccggggggggggggggggggggggnnnnnnnnnnnnnnnnnnnnnnnnnnnnnnnnagcagcagcgcccgagagtcctcgccctggcaactggggcagtcgcgaatgccagactcctccgcgaatccgagaccacgcacggagaggggaacatgtggaacgaattcacaggctgaacatcggccacctggacgagaacggtgtgtacaacggctccttctccaccctggccctgcacggccaagtccgcgccaagggcaacgccgacagcgctgtggacatcctgtggaagcggaagcaggctgagattggtcagtga

SEQ ID NO: 5154 - DNA, 2364 bp, Chlorella protothecoides
  modified_base (1991)..(2000): a, c, t, g, unknown or other
atgtgggccattaacaccgcgcattacatgccttcaatcatcatttcacctgggatgcatccccccgctcacccgcgatggtcggcgaccctcgcaaacttgccgtgccccgggtgtgttatggctgccaccggtcgcgaccgaagcttaggacagtcgaaattgagcttgagcgcatgggccacggcgcacgatggcccggcgggcagttccgatggtccctggatcggggtgtgtcttcctgccctgctggcacgatcctgtcagcgggcatcagaggggaaatcggctacccctgcatggaagaggcagaggctgcccaatcatcgacccggggaaagctgtccctcccggaaaccccactccggagcgagtgatctgcccttccaccatccggcacgaggcattcaaaaggtatgtttaagccacgctcgcggccgagcatcgtgcgctccgtgcccagccctgtccctccctgactcccagctcgcacctcatctcgcagggcctgcgctctgcagccctccgatttccacacctcccacgccaaggatcttgagtttgagcctcgatgtgcgcagcgttggggaccagggaagcgctgcggccagagctgcaccctcggtcggcaactctgggccacccgccggagatgcgcccacattggccctggaccctcctgtccctccctcgtttgaccccggcacctcgcctgcagacatgacagccatgggctgcgtggcacgcaaggatggcgccccgctgctccgccgccgagtggtctccaccgccgcgctctacttccgctggttctacgcggacgacggcttcgcggggacagacccgcgcgcactctccctggccgccctcttcctcgcgtccaaggtggaggagatgccggtgcatgccaaggggctgatgcacactgcaacgacgctggggtccagcgggcgatggcacgcgcccgccgccctggccgccgtgttggccgccgaggcccagctggtgtatatatccatcgagttgacaaagatggaggagagaaatgcttgcatgagagagcctgaagatattccgaggggcgcccgcagacactctcatggcaaggagaccttccccctgcagctgataccatggccggcgcatgcttggggtctgttgcatgctgcacggtatcagcagcgaggtcttagtgcacctcattctcctccccatgcacaggccaaggtcaacgtggcgctgcttgtattcgatcccataccctcgctgctggagggccttcacttgccgctgcaaggagacaagacgcatgcgagagcggggaggggttggggcgcgcaggcctttgtccaagaaccgctcttgacggaaccccgccaccctcaaggtacccagaagccgcccgccaaccatcgactccattctccatcccgtgatcctcacagggcgttgctgaacgactcgtacctgagccgctgccacctgctgcaccccccgcacaccattgccctggcatgcatcgtcttggcggccggcgcgcacggcatcgacatcgaggagtgggtggcgggcctgcaggccgaccacgcgcaggtgggatgctgcctgggagcggcaatccggccttgcaatcgaattcgtacctgctgcgctcaaaccacgcctcgaccgccatgctgtgcccctgcatgggcgccgcataccccaagaggaccccaactccctcatcacccgcaaggtctacgaggtggggaggagcctgctgggcacgctggccgagtgcagcgccaccatcaccccggacacctgcctccggtacctcgccctattgcgcctcccggtctcgccatgatgggccgcgccgaggcatgcatgacagggaacggggccatggcgtcaccctggactgggcctggcttgagcggcgacatgctctattggggggccacttgcaagacgcttcattcgtcactcaggtaccaatggagacnnnnnnnnnnagcggcgacatgctctattggggggccactcgcaagacgcttcatttgtcactcgggtaaccatggaggttggccttccccattgacgtgtcgatttcaagcgtgtgccatgcgacaaggaaagaagcctattcttgcaggcacccacggccgcccacccatgggccctgcgcttgctcacccaagaggctttgtgattctgccgggctacaccagccactttgatagtcctcctcgccgcctgcaatccctttctgccccttcgtccacgcactgcctcccaagcactccgtccccatgtaaacctcgttccctcttccggaagctgatcccaggacagttacatcacgctgtgcaacgatag

SEQ ID NO: 5155 - DNA, 714 bp, Chlorella protothecoides
atgtggtatggtttactccatcgtcgcctgctggccctgtaccgccctcccggaggtgatcgcggcaccgacgggcggcagggcaatgtcactcccctgacatctgccatggaagacccagcggcctctcccgcgccgccggcgccaccagcccaacccccccttgaggcgatcacgcccgcgggagagcagcagcctgccccgccgccggcaggcccagacacggccacaccctcggctggtccctcagccgccgagccccagtcggggggcgggacgtactacacctcctccggccagcgcgcgcgcccccagaagacgccgttccagaaggagacgctggaggcggcctttgagatgaatcggcaccccacggaggagatgcggcgggtgctggcggagcgcattgacctcaccgagcagcaagtcgggacctggttccagcaccggcgccagcgtaagcgcaaggagcaggtgcagcaggccgtggcccaggccgtgctgcctggcgcccccgcctacatggcggggaagcccggcgacggcgggccggaagaggacgggaagggggctgaggaccccgccgcggtccaagagctggcggccttgctggagctggctgcggcgcacctccccgtgcccttccgccccgacggaccgcccttggcgctggagttcgacgcgccgcccgccgcggcgcccatcggcgcggcg

SEQ ID NO: 5156 - DNA, 1041 bp, Chlorella protothecoides
atgctgggcaacccggaggtggaggcggagggcccctacgccgtggtcctggcccccacccgcgagctggcgcagcagattgaggaggagacgcggagtctggcgcacttcaccgacttccgcgtggtgtcggtggtgggcgggcaaagcatcgaggagcagggctttgccctgcgcaagggctgcgagatcgtggtggccacgcccgggcgcctggtggactgcatccagcgcgcctacgccgtgctgaaccagtgcaactacgtggtgctggacgaggcggaccgcatgatcgacctgggattcgagccgcaggtcatgggcgtgctggacgccatgccctccaccaacctgaagccggagggggaggaggaggtggtgctggaggcggaccgcgtgtaccgcaccacctacatgttctccgccaccatgcccctggccgtggagcgcctggcgcggcgctaccttcgcaggcccaccgtggtgaacatcggcaccgcgggcaaggccaccgacctggtgacccagcgcgtggtcatggtcaaggagaacgagaagcctcacaccttggagcaggagctggaggtgttgtcggacgaccagcgcatcatcgtgtttgtcaacaccaagcggcagtgcgacgccgtggcgcgccagctggacgggctggagtaccgctgcaccctgctgcatggcggcaagacccaagaccagcgcgaggagtccatcaaggtttgtagtgccgctgggcgagcctgcagagaggggcaatgggatgggggcttccgcgaggacaagtacaacgtgctggtcgccaccgatgtagcagggcgcggcattgacgtccccaacgtcgcgctggtggtcaactacgacatgcccaacaacatcgaggcgtacacgcaccgcattgggcggacggggcgagctgggcggaagggcatcgccgtcaccttcctgaccctgtcggtgagcggtggtgaggggggggagaggtggtggggctgggattttggatgcgatgcaagtggatggggttga

SEQ ID NO: 5157 - DNA, 300 bp, Chlorella protothecoides
atgccctgcagcgctcagggctcgactacaccatcatccgtccaggttggctcaggaaaattggccggaagtaacttggaggatgctggggatgactacaagctggagaacaacgtgagaatctctgactcccgcagtgccctcgggaagaaggtctcccgcctgcaggtggcagaggtggtggcagccagcatcgacatctctgcctccagcaacaaggtactcgaggtggatgccgcacgggatgcccccaaggaggacatccggtcgctgctggcagctctggatgagggccggtaa

SEQ ID NO: 5158 - DNA, 1191 bp, Chlorella protothecoides
atggagcgaggggaggaggacgagggtggccccagcggcccccatccccggccggctgctgccaaggcggagccgctgagcctggaggagctgctgcggaagaaggaggcggagcgcgcggcccaggcgcgcccggtgttcatgagcaagaaagcgcgggaggaggcggcgctggcccggcgcgctgaggaggcggccgctgtccgcgccaggaatgccgctgtgcgcgctgcgctggccggtcctgcgcacgacgacgggcctcggccggaggatcgcgagcgcgagcgccggccgctgagtaacaaggagcgagaggcccaggcccacaaggaggtgcgtggggttgcattgaatttgggaatgagtcctccagtgtgctcagccctgccagcccgacgctcaacagctcacgtccctgttgcaggagcgggagagagaaagggagctggagctgatcaagcagcagtatctgggcacgaacaagcaggtgcggtgggggaagcacatttgtggtgcttgcttgtcatcatcgatgcaggaagtttgccagcaaatgtaggctccgacagtatctctaaagcagtctcccgccctccccaccttgcaattctgcagaagaaaaaggtgctgaaggccacggagcgcttcaagtttgtgtttgactgggatgccaaggaggacacgtcacgggacctgaaccccctgtaccagaacctgcatggtgaggaggggcgagggttgcttggggaggccaacctgctgttcgggcgcgggttccgcgccggcatcgaccggcgggagcagaagaaggctgcagcaggccaggaggcggagcttctgcgctccctgcgcagccgcacgggcgcccgggaaagcgtggcggaccgggagcgggacgagacgcgcgccgccgacgcggatcggtacgagggccgcgacatggcggtggactcgcactggtcagagaagagtcgggaggagatgacggagcgcgactggcgcatcttccgcgaggacttcagcatcgggtacaagggcaccaatgtacccatgcccctgcgcaactgggaggaggcaaacttcccggagcccttgagaaaggtgggaggggttggaggggtggggctggggttggaggggtggggtggaggatgggggagggaggcagtgtcagtgcctggaagttga

SEQ ID NO: 5159 - DNA, 813 bp, Chlorella protothecoides
atgccaccagggtccctcaatgttgtcggttatctcagcaagccagtgacatcacctcacgcttgctctctcgctgcttcgtccccaggcttcagcctgccaggcttcaaaggcaaggaacctgaggcccaggcagaggaaagtgtcaggtcaaccacaaagaaggttgctcaggagtctcagcagattggcttgtccttgctcaagaattttggaaggcgggacaccaatacggtttttgttgccggagccactgggagattgggagcgcgcatcgtgcgtgagctgctgaatgcagggaagaaagtgagggccggagcacggaacatcgaagaggccgagaagtatgccgatctggcggctgcctacggcctgctggcccccgatgcagtgcgccgtctacagatagtgccttttgacttgcgcgatgacgtggatgctctacagcgcgccattggcaacgcaaacacggtgagaagggccgtggccttgcctggtcgtgctcgggtcgtgtcggctgcaagatccacgggcaacgacgcccgctccattgacggcgagggaaccgtcagactggtccaggctgcggccgaggcaggagtcggcaaattcaccctggtgtcttcggcaggtgtaggctccggaggcttccttgcaggtggggctggagatggcaatgggggaggcgctggaacgacgtattcagctgttcttgtcctgagcattgtgctgggagttgagggaggtggggactgcatcaccatgggtatggtgcgacctcccaaactcgacccatgcccgctacagtcttag

SEQ ID NO: 5160 - DNA, 1380 bp, Chlorella protothecoides
atggcccctggcgagggcgcggtgacggcggctgtgttccacacccccacggggcgcagcacccccacgcacctcctcaccggctccgccgacggctcgctgtccatctggggcgtgggcggggagtggacatgcctgaagaccttcaaggcgcacaccaaggaggtgacgggcgtggcggtgcacccctccggccgcgtcgcgctttccatctccagggacggtacgctgcgcatctgggacctggtgaagggccgcagcacgttcgccaccaagctgccgcaggccgcggaggccatcaccttcagccccagcggcgacgtgtacgcgctgctggccggggccgtgctcagcatgcacagcgtggcggcagagtccagcaccgcgctggccacgctgagccacgagcgccgggtgctgtgccacgctttccacggcgaggacgtgctgctgacagggtgcgacgacggctcgctgcatgcctggagcatcccgggaaaggtagggaataccgcagggtgcgaggttgaacagatccggctggagtctgggaggaaaccggtgcggggccggcgactgagccttggcggggtggcgatacatcattgtgggcgacgggacgaggcggagatcctgaccatccccgaggcgcatggcagccgcatccggggcctggccgttgcgccccagtcgtctgcctcggatgcgtcctcttcgatccaggccagcaagagccctagcacagcacacgcccttcccaggctggtgggcacggcgtcgagcgacggcaccctgcggctctggaacctggaggacatccgggcgggggcggggggcgccgcgccgcagccgctggcggaggtggacacccgggcgaggctgacctgcctgacggccatgctgagccccacggagctcgctgcgcagcacgcggcggagcgagaggcgatgaaagcagcggccgcgctgcgcaaggcgaagaaacggcggacggagccggaggcgggggaggcgggggaggggacaagggccacgaaggcgacaaaggcaagaaggacgaaagaggcggaggagctccggggcggggcagaagcccccgcaccgcagcatgacaggacgagcaagggcaacaaggaggagggcaagagtgccggcccgaggaaaggcccccgtgcaggctcggagtctgaggcagcagcgcgcccggatcgcaggccgggccaggccccgcgcccagtcctgcctccccggcccggcgtggtggactttgtgagcgacgcggacctcctggcgcagcgctccaagcgccagtccatgcaggcccgcgtggcgcgggggaggaaggcggcgcaccgacccatcggaccggcggcgccctga

SEQ ID NO: 5161 - DNA, 219 bp, Chlorella protothecoides
atggggagggaacgaggtggcgcccgaccgaaaggtccaccccatgtttctccaaagcaaagccctgcggtccaggagatctcaggtcgggacctattcactgtgaccgaagttctgagcagcaaggaggcgtcatgcatcgtggagtatgccgagtcgctgggcttgacacaccagtccagccggggaccaaagttcggcgaggtgcgaggggactga

SEQ ID NO: 5162 - DNA, 330 bp, Chlorella protothecoides
atgcggcacctgctcaccgcccgcgccgaccacaccccctttgccgacatggtcggcctggtggtgagccagctggaggcggaggtgggcaccgcgtcgcctgcgcgcccggtgtacctcctgggggaatcctttggcggcctcctggccctcgccgtggccgcagctgcgccccacctcgtcgacaggctggtgggctgggaaggggaggatgtcgttcctgagatatttcgaaagggcgaggggggcagggcccgagagggcccgagaggtgtggagcaaccctcagccctgcatgcttgtgccttgaggagtgcgaaggaatcatga

SEQ ID NO: 5163 - DNA, 1578 bp, Chlorella protothecoides
  modified_base (720)..(729): a, c, t, g, unknown or other
atggtgggatggaaattgttgggtagtgaagcagagttttgcatggcaatgtgcagcagtcagccgaacgaccagtgcacgctgtggcgcagcatgtgcttgatgcgcatatgtttgcatggatcgcaccaatcattgtcccgcctcatacttcctgacaggcctggtgctctcactgcacatctcatctccccagcggtcaaggccaactttgccatgttctttgccaaactgggcctgaactccacaggcacatccccagcgaccggggtcgagagcgaccggggtcgagaggtaattatgacggctgacaatgcagtgctctccatgtggaatgaccgcgggccacatcaataccatctgtatggtttgtctggctcggtgctgggccggccagccacgctcagcctggaagttgtgccaaaatcaaccagtcgccttctgcaggtgagcgggacagttgtgcccaaggaatcaccacaatgtgctggtggatgtatgaaccatgtagatgtgggaggtgcacactcagtcgccggatactccattcccacccctccctcttcccccctcattacgcacagcctgtcaacatccagtgaggccagcctcctggtctttgagcggcgctatgcagggcagtgtgctggacattgctgtgatcatgtgcgctgctggcagtcttcctcacaggtcatagggcgcccaacatcacctgtnnnnnnnnnntttgagcggcgctatgcagggcagggcgcccaacatcacctggcattgtccccagtctctcggcccccttcacctgcccccaacacatcacagggctcgcctgacttcgtgcatgggcacaccgaggactcgcccctgctcccagtgccgggcgaggtgttccgtctgcgcaagctggtgccccagacccccgcgtacgacttcaacatccacatcatggacttttcgccgggcgagcacctgaacgtcaaggagatgcactacaaccagcacggcctcctgctgctggcgggaaagggcatctaccgcctcaacgaggactggcacgccgtccaggtgtgtgttgggggacagggtggcgggcatgcgggggctggatcgctagccccccccgggaagcgtctctgcagctgggcaaagggggcgatcgccaaacctcgtcctgcgatccagccccagtctgggtatgcagatgcttccagctcgccgtcccctccgacagcctggcgtgggcgcgtgaaaggtttcgaggatgacatgcttcggtgtgcctggcgtgggcacgtgaaaggtttcgaggatgatatgcctcggtgtggtatgctcacagtcaccaaccccaccccccaccgctcctccccaggctggggacgtaatctggatggcgccctacgtgccccagtggtatgcggcgctgggcacgcagcccacgcgctacctcatctacaaggacaccaccctagacccgctggagacgccgtggctaggccagggcgccgccgcgtcggcctgcggctgcgccgcgcgcagctgcaacgcggcatgactccgctgctgcgctcagcgtaa

SEQ ID NO: 5164 - DNA, 114 bp, Chlorella protothecoides
atggtgtgctcagctttcgtagtgcctcatttctcccaggtggtgagggaggtccagctcttggtgtacgatgagatccactacctgagagacaaggagcgaggagttgtttgg

SEQ ID NO: 5165 - DNA, 1785 bp, Chlorella protothecoides
  modified_base (431)..(440): a, c, t, g, unknown or other
  modified_base (949)..(958): a, c, t, g, unknown or other
  modified_base (1442)..(1451): a, c, t, g, unknown or other
atgcagcgtccggcacgcccaccgctggactccatccagcacttccccccgcatcaccttgcctcttcctatgagcatctgcccacccccccttcccccccaccccaaccagtcccggagcaaggcagacctactcgatggcgtgctggccctcttccccccccgcctccaccgctggctgctgaacaagttccccgagccctccgcctggctggccgcccgcctcgctttcacgcgcaccgccgctgtctggtccatggtggggcacctggggctgaccctggagaagccggaggtcgtgcccttcaggccagtccgaggaagagggggggggaggggttgttttatgtatgggggaaagaggacggcacgtggcttccgcgtaagggcatcggcctttgtgccaacatccccgccctcaaaccctaccnnnnnnnnnntgggggaaggaggacggcgcgtggcttccgcgtaagggcatcggcattcgtgccaacatccccgccctcaaaccctaccccctccccaagcaggctgacgcagaacgtcgtggacgggtgtggcgtgacgggcgtggagggcgtctttgtggccgtctgcgagctgacgctgacgtcgccagagcgtcgtcaaacccaagctcacgcgggcatactctcttcatgttcgctcgccaccgcaggtgctgcggcggcaccagggcaccatcctgagcgtgatggacacctttgtgcacgaccccttggtggaggagggtcagtaggaggtcgggccctccggggttcttgcgtggcgggccagtgtggagcagtccgacttgagagcaggcttgcaaccagggtgggcggggctcaatggggcactcaggttttgatccgggccgcgctcggcacagtgtgggacatattgtcaacgaaaccaagttcattcgcccctgccatcactacannnnnnnnnngaggaggtcgggcactccggggttcttgcgtggcgggccagcatggagcagtccgacttgagaggagggcttgcaagcagggtgggcggtgctcaatggcgcactcaggttctgatccgggccgcgctcggcacagtgtggggcatgttgtcgacgaatccaagttcattcgcccctgccatcactacaggccggctgcagggaacgctgctgggtgtgagctccaccccctgcctcccgctgtcctgtcagggccaggctcggcacctcatcgaggaggccagcaacaaggagaacctggggcagatgtacatctggtggatggcctggttctgactggtcactggtggaaagggcggcggtgtgtggctggcaaagatctctgcgtggtagtgcgctcgtggagggaggggcccatgccatcggacgagcgctcctgcctcagggctcgacatctcgtccatcctctggctcgctgcctgcnnnnnnnnnntagggcggcggtgcgtggctggcagaggtctctgcgtggcagtgcgctcgtggagggaggggcccacgccatcgaatgggcgctcctgcctcagggctcgagatctcgtccatcctctggctcgctgcctgcctgcttctctgcaaatgggtacagaatgtacagtgcgatgctgccgtccctcgaccctgtcgccagcaggccagaggcaggggtgccaaatgccaggcatgtggcggactcggtgtggtactgcatacgtggggcaggtgggcaggagtgcgatttgaagtgcgcggaggatagagagagggttgtggtgccttggtcatga

SEQ ID NO: 5166 - DNA, 1077 bp, Chlorella protothecoides
atgagcgatggcaccctgcggagggtgaaggctcaattccaagtatccctgcatcctgcgctgtcagagacgagcctggccggagtagaagagctgctcaatactttgctgctcagggttcaagtttaccgagctgggggccccttgtacagattcgtgacgatattccgaggatttggggggcatcgtgttggcctatgggagcaccacactcgcctcccaccatggcctcattcaaccatactttccttacacccatgtggacgtgggggcgaccgtgacgctgttcaaccccaagcccgggtgccgattgggtgcgcattgcgtgtgggtttgcagactcatgagtggatctctatcttcctgtatcccatgcctgagtctgcctcgacgcctcccctccacaccctgcaagtcctgcccaccattcctccattcctaacagtgggcgttgtcaacaaggtgggccgcgacttcattggtctgctggtcgcaggaatcgtgaatgcgtccatcggcgccgacgcgatccgtgctgacctggcatcccgcccagcccagtctgcctgggtgtccctgtgcaacccccgccatgtcatcagcatagggaccactgtggtcttcgatgtcctcaggggaggggcttgcgagagcactaccacagctaatgctgaattgaactttagtggccatttaatttcaactggatttctgacaaggacatccgccgcagcacaccatgccgacaacactcacaccagcctcttcacccttgatgtttttcaaccaccctcgtcgcgcagtgtcacacagacgggtcagtttgtgagtctcaagggagccctccgagagcccgacaccggtgccgtggaggtcgtgggataccccgggcagccgaggaaggaggtggcggtggcggaggaggcgcataaagaggagaacggcaagagtaccgcgaagcgcaagcggcgggagagcgctggagatgcggctggtgaggaagcccgggaaaatgggacgaagaagaaaaagaaaaaggagaagacgaagacgaagaaacgcagcaaggacgagtga

SEQ ID NO: 5167 - DNA, 456 bp, Chlorella protothecoides
atgtttcgccgtgcatcacttggtgtatcgtgctggcggcaccggggccggcagcagcctggtgtcgccaggctgggggtgacatgcgtattacaacagctctctgcctcccccccccggccctcgcagctggcaggtggcgtggctgccatccaactgcagaacaaggagtatgatggtcgccagacctcatgcttccacctcatccgcccggatggcagcgtggaggatgtctcctacaggaaatgcattgccagcttggacgccaccgtggcaaccctgctggccaaggaggatgggaagaaggcatcgccagccaaggcgggagacgccaggtccggcgcagccaggagctcaaccaggagcggcccaaccaggagcggcagcggcggccgcggcaagccccgtgggggcaggtctggcgggcgcgggaggggccgtggcagcaggcggtga

SEQ ID NO: 5168 - DNA, 2043 bp, Chlorella protothecoides
atgcctgcacccacctaccattcccctccttcgtcaccccaggccggcgaccagcgcctgaccgacacccgcgccgacgagcaggagcgtggcatcaccatcaagtccaccggtatctccctgtactacgtcatggaggacgaggacctgaagggtttcaccggcgcgcgcgacggcaaccacttcctgatcaacctgattgactcccccggccacgtcgacttctcctctgaggtgacagccgcgctgcgcatcaccgacggcgcgctggtggtggtggactgcattgagggcgtgtgtgtgcagaccgagacggtgctgcgccaggccctgggcgagcgcatccgccccgtgctgaccatcaacaagatcgaccgctgtttcctggagctgatgctggacccagaggaggcctacctgtcctaccgccgcgtgatcgagaacgccaacgtcatcatggccacctacgccgacgacgacctgggcgacacccaggttggtccttggtgtgggtctgtgggtgggggagggagggaggaggggaaggctggccctggcgacacgctcctgcctggtgtgcaccccgaggcgggcaccgtctccttctccgccggcctgcacggctgggccttcaccctgacggtgtttgccaacctgtatgccaagaagtttggcacggacaccaagaagatgatggagaagctgtggggcgacaacttcttcgaccccaagaccaagaagtggaccaagaaggagacggggtcggcctcctgcaagcgcggcttctgccagttcatttacgagcccatccgcaccgtgatcgacgcggccatgaccgactccaaggacaagctgtgggcgctgctggagaagctggaggtgctgcacctgctcaagtccgaggacaaggagctggtgggcaagccgctgatgaagcgcgtgatgcagacctggctccccgcccactccgcgctgctggagatgatgatctggcacctgccctcgcccgcccgcgcccagaagtaccgcgtggacgtgctgtacgagggccccctggacgacgcctacgccagtgccatgcgcgcctgcgaccccgagggccccctcatgatgtacgtgtccaagatgatcccggcggcggacaagggccgcttcttcgccttcggccgcgtcttctccggccgcatcgccacggggcgcaaggtgcgcatcatgggccccaactacgtccccggcaccaagaaggacctgtacgtgaagacggtgcagcgcacggtcatgtgcatgggccgtcgccaggaggcggtggaggacgtgccctgcggcaacaccgtggccctggtggggctggaccagttcatcaccaagaacgcgacgctgacggacgagaagtgcgaggatgcacacaccatcaaggccatgaagttcagcgtgagccccgtggtgcgcgtagcggtggagcccaagcacgcctccgacctgcccaagctggtggaggggctgaagcggctggccaagtcggaccccatggtgcagtgctccatcgaggagacgggggagcacatcatcgccggcgcgggggagctgcacctggagatctgcctcaaggacctgcaggacgacttcatgggcggcgcggagatccgggtgtcagagcccgtggtcgccttccgcgagaccgtgaacattatgtccgaccatgtggtcatgtccaagtcgcccaacaagcacaaccgcatctacctccaggcccggcccatggaggagggcctggccgaggccatcgacgagggcaaggtggggccccgcgacgaccccaagatccgctccaagatcctgtcggaggagtttggctgggacaaggagctggccaagaagatctggtgcttcggccccgacaccaccggccccaacatgctcaccgacgtgaccaagggcgtgcagtacctgaacgagatcaaggactcctgcgtggcagccttccagtgggcctccaaggagggcgtgctggccgaggagaacatgcgcgccatcgtgtttgag

SEQ ID NO: 5169 - DNA, 1149 bp, Chlorella protothecoides
atgcgccccgtgaacagtcttgccctccatgaccctctctctgggatccttggactgatcggagatccaggaggcaagtggatcgtgtcgcagggccgcagtggcccagcccaagtgcacagggcggacgacttgcttcccggggcaggaggagtcggcgagaccaggagcaatccggtacacattcaaagggaaggcgactcctttgccgccccagccctcattctgccgcccagccccgaccaggcagccgcccccctgccaggcctccgccccggcgtcccggccctggtcctgccgcatgccgagggttttgcagtggcatgcacgggctccgggcggcgtgttgtcgatgtcccctcccccaaaggagcaggcatgctcacctcgctcctggccttttgtgcttggagcacgagagacggcccgcacgtcctggcagggtacgagtctgggatgctggccctgtggcggctggcgcagccgccggccccgctggcgagctgcgcgctgtccaagcagcccctgctggcgctggcccgttgcccagcgagggggaggggcgtggctgccggcccgcgggctgccctgctccccttcaggctggagcttggaggaaagcgtgaatcggagcgtgaaacggagcatgaggtggatcaaaggacatctgccccgacgtcggacggcagttcccacaacgacgaccatcaatgggccgaggctgcgccccggatcagcaggggcacgagggttcctctgtccagtgccggggtcaactgcctggccctgcgctccgacggcaggctcctcgccctcggtggctgggacgggcgggtcagggtctttgccttcccctccctacggccgctggcgtcgctcgcgggaggaagacctcagcatgccgttcatgaccaaggcaccacaaccctctctctatcctccgcgcacttcaaatcgcactcctgcccacctgccccacgtatgcagtaccacaccgagtccgccacatgcctggcatttggcacccctgcctctggcctgctggcgacagggtcgagggacggcagcatcgcactgtacattctgtacccatttgcagagaagcaggcaggcagcgagccagaggatggacgagatctcgagccctga

SEQ ID NO: 5170 - DNA, 393 bp, Chlorella protothecoides
atgactgaggccggggtggacgaggcctccaaaaggcccttggaggagcctgaggtggaaggtgtggatgccaagaagcaacgtaccgacgaggggaacgacgctgatgagggcagcgacgccatggaggtcgagccaccatccaccagccagccggtcactgttgggtaccgtacatttgagaacggggcggccctccacgagtactaccagggtctacactccaagctgaggagctaccagaacctcaacgattacgagtttcacatggtcctggagctgatcaagaaagggcaccccgatgctgagcgcaaggtgcctggtagtgacatgtggctgcctggggtgatgccgctggggctcaaacaggttgtttcgccgtgcatcagttga

SEQ ID NO: 5171 - DNA, 744 bp, Chlorella protothecoides
atggatctagagccttcgaacgttcaatctgattcgcaatgcaatgctcgactcctgacccggtactcaggggctgaagcattgctatcggcagggtgggttcagtctcggcttaaagtgctgcatagcacgcggggcacgcttcgaatctggacgaaaccatatcactcccccgacatgctttcatgcaggacgctgacgatgagtgatttttttggaaaaacgaccgtgagaacgtttcgagattggtgtcttggcgatccccacgccacgctgcctcgcggcggtggtggggcgtcgggtgctgtcctgcggccctgccagggcctgcgccagactccacgcgccatctggctccgcctgccatgccgacatcgaccgcctgctggaccgggactggctcctgcccagcaacccacccctccctcacacatgaacgacgacgagcccacctcccagatcacggagtgcggcagctttgacgtgctgcgggacgacctggctcacccctacgtcaatgggaacaagctgaggaagctggacgcggtgtggcccgcactgcgggccggccccgcccggcacgtggtcacctgcggcggcgcgcagagcgcgcacctcgtggcagtggccgcgctggcggccggcacgcgcggcgcgctggcctcgcacctgcttgtccgcggcgaggcgcccgccgcgcccacgggccacgcgctgtacatgcgcttgctgggcgggaacgtg

SEQ ID NO: 5172 - DNA, 858 bp, Chlorella protothecoides
  modified_base (495)..(504): a, c, t, g, unknown or other
  modified_base (574)..(600): a, c, t, g, unknown or other
atgacggcgtccatgggagggtgttcgtgccatgccagccccagccggctgcagggccgcatgaaggcacccgggccatgcctagtatccccaagcctctccaagagaaggaagtttcgcctcagagcaggagctcaccccctccaagcctccatggccccgctcaggcagtgcctcatgccggtggcggccttcgtcatggccatgcacctccatgccggggcatgctcagcggcggaggtgctgatcggcaccccccgggtcatagacggcgacacgctggaggtgtggatggttgctgttcaattgcatgttgagtgccgggccagagtcaccagacctccccctgtcctgcaagctcctctctgtccaactccgttccccccaaaaatcaggtggctggcacccgcgtgcgcctcttcggcatcgacgcgcccgagaagaagcaggcttgcctggacggcaggggcgagtcctacctctgcggccaggccnnnnnnnnnncctcctccccccccccccccccccccccccaatcaggtagctggcacccgcgtgcgcctcttcggcattnnnnnnnnnnnnnnnnnnnnnnnnnnngcctgcacggtcaagaccaaggacatgtaccggcgctccgtggcggtgtgcaccgtggtccgcccgggcgagcgtccgctggacctgaacgcctggctggtggaggaggggcacgccgtcgcctaccgccgctacagcaaggactttgtgcccgcagagctgcgagcccaggaggccaagcgcggcatctgggccggccgctttgagctgccggagggctggcggcacaaggaaaccatgccgcagtggttccagtga

SEQ ID NO: 5173 - DNA, 1077 bp, Chlorella protothecoides
  modified_base (717)..(726): a, c, t, g, unknown or other
atgtccacattacaagtcctgatgtgtgctctccaccttcctcatgccagtgttcgggcacatctccgctttcctcaacccagcggcctgtctgttccagtgggtggcggggaacctctcagtgtgagtttcagagggggagtctgtgaaggtggttggaatcacaacagaatgcaggggggcatgtcgtcggggtcatccattctgccccatgtgcctgatcgcactgtgtgttactttccaaccgtcttcggctgcagctatgagttccttttgccgttgccaatgtcccgctgtcactcagccccgcgcggcagtgtcctcccccgcaccgcctgcccaacgctgccccagcacactcacgccacagcaccgagttcctggcgctgtccttcagtgagctggcgggcgccttcctgggcgccatcctcctgtggctcatctacctgccccacttcaacgtcgtccccgagccgccctccgtcaccgaggccgaccccttcctcgccgaccctttgcttggtgggggcgccaaccgcaccttctccccatccgacctggcggtggggggctataacaacgaccccaaggaccagcaccgccgtgtgcgccccggcgaggccatccaggggaccatgcgggagatcgggacggtgctggggctgttcaatctcccgtgcgcatgctggatgccctggacaggtccagacactcttnnnnnnnnnngcagactatgctctgctccgtggacctgggcatagtttaatctcccatgcgcatgctggatgccctggacaggtccggacactctcaccgacccactccccagtgaccctgcctctgctgcggcccgcctgtcgacgacgccatcatccccgctttccacttcccccaagaatcaatggtccacctcaccccggccccccagtcgctccgctgcgcaacggtgaccaacaaggaggagattcagcggcggctagacctgctggaggagcgctcacgcacgctcagcgagcacgagcagcgcacgcggcaggtggaagacaccctggagtcggtgatgggacgcgagggtga

SEQ ID NO: 5174 - DNA, 954 bp, Chlorella protothecoides
  modified_base (763)..(772): a, c, t, g, unknown or other
atggggccaattgagagggttgccttgcggtttaggagacctgctgcttcaatcacgtgtcaaactggtatggaatgcacagtccatgccggaccctcagtgccccgcaactcagcccaattgcccatgcaccgcagtgttcgatcatgtctctgcctacctcaatcccgctgcttgcctcttccaatgggttgtcggcaacatcaatggggatgtaactctcctccccaatgccaaacgtttcctcctagtgtccttcagaacacccccatccccccatccaactccccgctcagcaccgagtttctggcactcgccttcagtgagctggcaggcgccttcctgggcgccatcctcctgtggctcatctacctgccccacttcaacgtcgtccccgagccgccctccgtcaccgaacaggaccccttcttcgccgacccgctgctgggcgcaggggccaaccgcaccttttcccccaccgacctggcggtgggcgggtacaacaacgaccccctggaccgccacatgcgcatgaacccgggccaggccatccaggggaccatgcgcgacatcggggccgtgctggggatcgtgcatgatgacatcaagcagcgcaaggaggagctgctcaaggtgaggtggcggacgtgtgtgttgtggggggaacagggaggcgtcaagcccttgggggggacgcctgctccctgctcagtggttgctgggcagaccctcctcctcagccacctgcagatccagaatgcannnnnnnnnngggggacgcctgctccctgctcagtggttgttgggcagcccctcctcctcagccacctccaaatccagaatgcaccccccccgctcaccccctccccatccatggcccctctcttccccctcaaaaacccctccacctgcgccacagtccctgggccgtgcctcggtcgtcaacaaggatga

SEQ ID NO: 5175 - DNA, 612 bp, Chlorella protothecoides
  modified_base (439)..(448): a, c, t, g, unknown or other
atggcgactttggtggtcgttccagctatagctccatatagcctggccgcaaaatgcgggagcgagatcatcgctacctgcatcacgatctatatcggagagagtatccttgcaaatgaattgttggccaagaccaaggtgacttgggtggtggggcgggcatggcccctcgtcgagggtttcaatgcggctctgaaagggacgagcgcgccttggggtagacgccgctgcaacaccgcccccgctgcatcctcgcagggcaatcggatgggctggggttttgtggcctttggatttggcatgtcgtttggcatcgccatcacaccggttggagtccatgctccccctcaggttgcccaggcccctgcgctggttccatgcccccagcacagcaccattcttctcagcggtgcgttggtggcccctcacgccgacacgnnnnnnnnnngttccatgcccccagcacagcaccattcttttcagcggtgcgttcgtagcccctcacaccgacacacaaccctgtcaccgcagtgttcaactacatctctgcccacctcaacccggccagctgcctggcgctgtggatcatcggcaagatcaatgggtgggtga

SEQ ID NO: 5176 - DNA, 1383 bp, Chlorella protothecoides
  modified_base (784)..(793): a, c, t, g, unknown or other
  modified_base (1039)..(1048): a, c, t, g, unknown or other
atgccgagactgggggctatcattttgcaggcttcccaaagcacattatcaacattgaaccacagggcgaggcgttattcagagcgagaaggtggaacggggcatgatggcggtcgatcgcggcaatttcgccagcatcccgcaggcaagtcctcgatggcatacatggatgcaccgtcccccatcggtcacggcgcaaccatctcggcacctcacatgcatgcatactgtttggaagctctgagcccttggctgactccaggtgccaaggtgctggatgtcggctcagggagcggatacctggcggctgtcatggccaccctggtacaggacagaggttcaaaggcccctggcctcgtcatcggcgtggagtacattcccaccctggtggaggctgccctccagagtgcggagcgggaccccacctcgcggtctttgctggatgcagggaagacctgcagggtgtgttgctggtcactgccactccctgtggcgcccacaggcatcctgcagctcagggtgggggatgggtggcagggctggcccgagtctgccccatacgacgcaatccatgtgggggcggcagccgccacggtgccacaggccctggtgcgccagctggcaccaggtggcagactggtgttgccggtgggccttgatgggcaggagcaggtgggtggtgatgggggttggtcgtcaatgctgggaataagcagtggaatagagcaggattgtataggattgatggccaccttggatagcacgagtcctcaaaagtctgaannnnnnnnnnttggtcggttcgggggtggtagctgcagtgcccgcctgacgggaggagcaagtgacagaatccctacaccccattcgccacataccctgtctacccaggtgctcactgtggtcgacaaggattatacaggccacgtcaagacaaagggcctgttcaggttcgggggtggtagcagtgcccgcctgacgggagtagcaagtgacaaaatccctaccccccattcgccacataccctgtctacccagnnnnnnnnnnatctgttctcaggagcgcagttccttgtgccaggaggttgcaacattggcaaccttggcgggcgtaaaggtgtttttatacgcagaggagcgcggttccttgtgccagcaggttgcaacattggcaatcttggcggacgtagaagtgttttcatacgcagaggttttgaagttgactttgacagcgaaggcatcatgtcctttcatagccgggcagaatgcactcccagaggcctggatgatcccggcgcgccggaggatcctcgagataaagcgcgaggggcgagggggctagccgggtgggtcgcgagccctggaagtttccaaagttactga

SEQ ID NO: 5177 - DNA, 1383 bp, Chlorella protothecoides
atgtgtctggaggagaggatagcgcgctcacgcctcctaacagtctgccacccatttaaagaagcaaaattatcaatcactcatcaccttgtcctcggtggagacctccatgccctcctcctccccgaggccggccacgctcgggagtgtactcaactcgtgggcgcacctgggctgggacctggagcacctgtcggggttgtttcggggatggacatcgcgcgcgcccacatcccggtagagggacaccctgatgcagggtggatgctctacggcagcaaaacacaggagacagaagtcttgcagcgccttatccacgcgcgttctacgagattactgaactgctcgtcttgtgcacctcatcgaaggagctggcagcgccatggatgtcgaggtacccaaggacgtcgaggcacagctcagtcgcttggaggcgtcattggatcagctgagcacggggatggagggactgggctccctctccctcaaggacatcgccggctccgcccttgcctcccgcgaccaggcccaagccctcctggcgctagccatgggggcgaaccccctgcttctaaaagattctgcaagtttagcagtgctgcacactgcttccctaccattgttcacactcagctttgggccctggtgcggtcctccctgacatcgtgggtccatcggtccaacacctgctcagacccattaatccaccaggcacgattggaccagtatgtggagaaagtgaggaaagcggtgcggacgcatgagctggcaacctccaggcgaaccttggagatggatgtagccgcagtgaaccgattcatatcaaatgccgtgtccgacaaggacgtcaaatggaagctgcagcagcctccgagcgagaaatggccgccgggcacagatgatacacctgcctctgccataccgatggacaagcagacattcctacaagaaaccttgagcagcattgcccaagagatttacaagcttgagacactgctctggatgtatactgaaacattgatgatcgaaaagcagtaccacgatggggtcagccctggctttgaccgctggccatgctctgacactcagaaacacgggagctcgcacacatctggccgtgctggagtccccacgccatgctcccaaattaagccaggaaaccaagcttctctccgcacggatgagtcagtgcttggcgggccatctcacaatgccctttatgtaaggcctgcccaagtggacagcgctgggcttgatgcactaggcaaggaggcaagccggcacacctgctcccagcacatcatgcacaatccaacccaaatgcttcccaggtcaccctaccttgcgaatggagagagatggccttgccacggagctggttaa

SEQ ID NO: 5178 - DNA, 603 bp, Chlorella protothecoides
atgcggaagctgacgctgaaggccaggccgaagctcatcacactgccggcgcggaaggagaagcagctgaagcgcaaggaggccaaggcggaaaccgcagcgcagctggacaagtccatcgagaaggagctgctggcgcgcctgcaagccgggacctacggcgacatctacaactttccctccaagcagtacaacaaggtgctggagggggagactgtttcagacgacgccaaggaaattgaaaaggaaattgaggaggaggaggaactggaggagtatgtggagggagatgaggataccagcgatgaggaagatgacgaggaggaggaggaggaggtggaggaggtggagtatctggatgacggcgactttgatgaggaggaggatgacatggaggactgggagggtgtctccggcagcgacgaggacgccgctgctgcggcgcccgcacccaccgcacggcaaaaacggcaggcggctccctcggcgcttgcctcccgggccgcagatggcggtgcgcagaagaggaggaaggggcggcgcggggtggagattgagtacgaggaggagcgggagacggggctgcaggggcggagatcataa

SEQ ID NO: 5179 - DNA, 1389 bp, Chlorella protothecoides
atggacctggaggtgggttcatcctgtgggccccccaaagggagggggcggtttcgtaccgagtacctgctcgctgcctactccccccgtcgccgaggccagtcagtccggtcttggacccctctgcacccccgcagctcgccattcctggtcgccaatctcaccccacccccgcccctctgcgttcccctccgcacagaacttccaggcactgctgcgcgtgcccaacgtgggcgcgggacagccgctgccgccctcccagtacgccagcgagatggcgctggaggtggaccgcgcctcggtcaagcgcgcgcgcagcgtctcggcgctggagcgggaggacgagaaactgggcgggggcacgcccgtggacggcgcgccgacgcccgagccggcgaaggccgggaggacgataagctgggcgggggcacgcctgtggacggcgcgccgacgtccgagccggggaaggcgtaccgcgcccccgccaggccgggggcgggcagggtcgagcccgaggccagcaagccccgcacggcgcgcggcgcggaggccgaggcggggcccaccgagcggctgatggaggcgaggcgtgcgcgtggcgacgccctgttcaaggcagccatcgtggccgaccagaacgccaagctgtccatcttcgccacccggcccgccatcctctcgccggtgggtgggggtgggtgctgtcgcgggtctggcgcgcgatgggccgtcgctgtgtgtgtacaggtctcctgcgagccctgggtgtgcccagccggcgacaagacagcaatgccgcacagcccacaacccgcgccgcgccggccccccgcgcaggcattcaacgcgttgtgcgaggtcatgtgcacggccacgctcatcctcctgtacctgctgctcgtggagcgaggcaacatgctgtacgagccctggtgggtcggcgtagggaggtgcaccagcctgtgcgcctgcgctgtgcccccggccggcctcttcagagtgacccgagggccaggcatgcgcatcgttcggctgcggtacgtcaggacacccctgctgagggacgccaggccccgctgtttccagccctccccatcgctccctacccccactgcctgtcaaacagtgggaatgtgggccggcttcctcatcttcgtgctcatcctgggactgggaggccccaccggcatcgccgccaaccccgcccgcgactttggaccccgtgtcgcccactggatcctacccatcccgggcaagggccccagcgagttctactacggctggatcccgctggtggcctgcttcgcggggggcgcggtggcgggggcgctcttcaaggccatcgagcacctgaaccactccaatgtgcctgccggcctggccctctag

SEQ ID NO: 5180 - DNA, 393 bp, Chlorella protothecoides
atggcaggggatgccaagtcgctgacacaactctccggctcccgtcccatcaccggcatatactcctgcttcggtctgcagatcatcccaggacctgcagagaccctcaggtcctgggctgccagcctggcaccaggcggcaccctggcagtcacctactggcccgaaatcgcggagcaggagggaccgtggcgcacactcatctccctgacaccacccgccgacaggccggctgactgggaggtcggcatccccggtgaagccctgaaagagcccggagtggagctcgtagccgacaagggactggactttagcatggagtggcccagtgcaggggccttctttgatgtgaggccatggagcagggtgcaagaggtccctgtgtctggttga

SEQ ID NO: 5181 - DNA, 258 bp, Chlorella protothecoides
atggcgctggacgcgtgcgcgggcatgcagaacctgcgcaccgccatcctggcctaccgcgaccgcatggcctacgagcgcaacgacgcgcggcgcggcgcgctgctcaccgtctgcttggagtacctggagcggtactacagcctcatcgcctttgcctcctacgtgggcgcgccggggtacgaccccggcgacgacccgggctacgcgcgctgcggcgcgagctggcctccatcctggagcgcctgctgcgcatga

SEQ ID NO: 5182 - DNA, 1245 bp, Chlorella protothecoides
atgccagcgaaggctggggccaggtgtacaggtgctgcacgacccagcgatgaacaagatggggtgcagggaataaggaaagcaaagactcccatggtccagaaagatgtgcagatcctgctcccggccagcctcacctcacggcagcgtgcactgctccacgaagtcgccgaggaatgcggcttggcgcatagcagcaccggcgaaggcagccagcggcggctgatcctcggggacgcagaggtgacgcgagactgcgtcagcgacggggatgggccaattgccgacgatgctctggcagccctgctggagcagcacctgggtgccgctgtccggacggccttccagggaagcgcggcacaggcgaccactgccgggcccgggacacatggcatccaagctcggccaggcaagggcgggaacaaggcgcaggtgtccggccccagctcaggggagcggtccgccaactgcggcgacgtccctggctttgccgctcgaatgcagtccctgctggaccttgagcaggccgcggaagtttccgcggcagaggccgctctggatgggggcgggggccaggggctcgtgctcccaaacctgaggctgacgggggtggaagcggggctgctggggcgcagcctgctcaccctggtccacaacaaggacatagctgtgtgcactggaaacatgagcctggtgaggagggagcggatgggcagagtcgctcttggcaagggttccatgactcgcggcgagtcgccagctcggcatgcctggcgtcaccagctttccactgcacctgtgcagggcacgccgccaggccccctgccagtccacaagtttggaccccatgacattgtgcgcctgcgcgccagcaaggccgctgccggcgcccccgtactcgcggagggggtggtgtaccgtctgcgggacgactccatagttatagcgggacgtaatgccgtccagatcccgcccaccgccatcccgcgccgatgctccgctggcccccccatgcacctggggaccctgggcccctccacaacagctgacctgcgtcgccctgcatgccactcccaagcctggcggtgcttacagctcagctgccaagcccacccttttgttccagtggatgacactcctgaggacggactggatgtgcccttgaggctggaaaagctggtcaacaccgtgacccacacgcgtatgaaggccgccttgaatgtgcgactgggttcgggcgtctga

SEQ ID NO: 5183 - DNA, 342 bp, Chlorella protothecoides
atgatcgcggcgcgcgggagcctgctgtacgagccggcgcggggcctctttggggccctctttggcttcatcctcggcttcttcatcttcctcattgtgctcgtgatcggcgggcccacgggggtcgccatcaaccccgcccgcgacctggggccccgcatcgcacactggatgctgcccatcccgggcaaggggcccagcgagttcctgacctacggctggatccccgtcgtcgcacccctgtgcgggggagcggcggccggcggcttgttcatcctcatccagaagttcacgggggagaccaacgttcccccgggctccgtggtctgccccaatgtctga

SEQ ID NO: 5184 - DNA, 309 bp, Chlorella protothecoides
atggcgccaaaaggaccacgcagcgtcatgctgactcagcagtaccgcatgcacaccgacatcatggactggtgcagcgtcgcgctgtatggcggccgcctggtcgccgcgccggccgtcgcggcgcacaccctggccgacctgccgggtgagggaggggacgctgtagcagggggaaagattcggatggggaaagagggggcgcttgcggggtgggggctgtgcgtatggtacgattcaggagggcgtcactcccttggggccctgattcaaggtgtcctggcgaccagtcaccgcatcgggggatga

SEQ ID NO: 5185 - DNA, 1536 bp, Chlorella protothecoides
atggtgcaagacgttatcggctccatcgatcagggcacccagtcgaccaggttcttcctgtacgacaaggacctgaacatcgtcgccaagagccaggtccccctcgcggcggccactccccacgccgggtgggtggagcaggatgcggaggccatcatcgcgagcgtgtcggaggccatccggcagacgatggagtctgccggctccaagtacaacgtgctttccatcgggctgaccaaccagcgcgagaccacggtggcctgggacagcgagacgggtaagcccctgacccccgccatcgtctggtccgacgcgcgcaccgccgcagtgtgcaaggccatgagcgacaaggtgggcggccaggacggcctgcgcgcggtcacgggcctccccgtctccacctacttctccgcctacaagctgcgctggatggtggagcacgtccccgcggtggcggcggcgctggaggcgggccgcctcgcgtttggcaccgtggacagctgggtgatctacaacctgacgggcggcgtgaagggcggcgtgcacatcaccgacgtgactaatgcctcgcgcaccagtctgatggacatccgctcctgcgactggcacgccgagacggtggccacctttggcttccagaaggtcctcctcccccgcatcgtgtccaacgcggagcgctacggcgtgctggccagcgggcccctggccggcgtcccgctggcgggctgcctgggcgaccagcaggcggcggtgctgggccagcgctgcgcgctgggcgaggccaagaacacctacggcaccggctgcttcatgctgatgaacacggggacggaggcggtggcctccagccatggcctgctgaccacgctggcctaccagctgggacgcgacgccgcgcccgagtacgcgctggagggcgccatcgccgtggcggggcagggcgtgtcctggctctgcgactcgctgggcctcatcgccagccccgccgagtcggaggcgctggctgccagcgtgccccactctggcggcgtgtactgcatccccgcctttggcggcttgctggcgccctggtggcgccccgacgcccgcggcgtcatcgtgggcctgacccagtactccaccaaggcccacgtggtgcgcgcggtgctggagtccatcgccttccagaccctggacgtgctggcggccatggaggcggactcggggcacaggctgcgccgcctggccgtggacggcggcgtgaccaagaaccgcctgctcatgcaggtgcaggccgacctgctgcagtgcgaggtggtgaggcccgccaaccaagagaccacctccctgggcgccgcgctggccgcgggcatcgccgtcgggttctggacccgcgaggggctcttcgcgcaggccaagggaggcgagggcaccgtcgtcttctcgccccaagcctcgccggagtgggcctccaagcgccacgccaagtggaagctggcagtgcagcgcgccatggccctggacgagctggcggagagcgacgaggaggcagagtga

SEQ ID NO: 5186 - DNA, 570 bp, Chlorella protothecoides
atggaggagggtctcagggtgttgaagaaggtcaaggacacctttgatgtgccaatcatcaccgacatccacgagtcctggcaggccgagaaggtggctgaggtggctgacatcatccagaccgatctgctgatcgccgccgccaagacgggcaaggtcatccagatcaagaaggggcagttctgcgcggcctccgtcatgcgcaattccacggagaagtgcaagcacgccggtgggtggcttgaagggttttgttggggggcatgggattcagtacgagggaacggggctgttatcgggagttcagatttgccatgctccatggccctctgcacctgcgccccggccaccccacccctgttacataaatgtttccccccttccattaccccccccgaaggcaaccccaacgtcctggtctgcgagcgcggcaccatgtttggctactccgacctcatcgtggacccacgcaactttgtgctgatgcgcgacgcgggcgtgccggtgactgcagacgtcacgcacgccctgcagcagccagccggccgggccctggaggttagtaactga

SEQ ID NO: 5187 - DNA, 1689 bp, Chlorella protothecoides
atgtccaggaaagcacagaggggccgggaagccctcttccagttcaggcgtcgtagagcagcatgctctcaaagcaataaaacagtcatcaacatattggcaacctccccgaatattcagcaggtacgacagctttactcgtcggggcaatatttcggatccgcgcgccctgccctgccaggagctatgccagcatcggatctctcccggaggagggaggggtttgtcgcaaagggaccttggcacaacgccaaccacaatttcaagctaggaggtggaggcctacgactgtcgcacacagcagtctcaatggcaagcgagcctgagaatggccgggacatcatcaaggccgaggaactgccgcgtccattagagatcctgaaatacagagatccccagaacgcaagcaacgtggagaccaaattttatgtactgggaacagctcacgtgagcatgcaatcctgccgcgatgcagcagacctgattgcaagggtgcgcccagatttcgtgcttttggagctttgcaacgagcgcatctccatcctctccttggacaagtttgaggcagcgaggacacttggtggagatgcgagtactatcctcccaaacccacaggaaccaaatttcggggcagccgttgctgcgatacggtcaggaaagagcacgcccttccaggccctgtactcctggttgctggctaaagtggcaaccaaccttgagatcaagcctggggaggagtttagggtggcgctgcgatcagcacagcaagttggggccaaggtagacatccagccggaggccagagttcgaactcacacgcccataaaactgtgcccaggcctaactttttggactgcatcctctccccaatcccctcacacatctcaccaggtggtgctaggcgatcgacttgtttctgtgacccttgcgcgcgtgtgggggggcctttccatctgggagaagctgtcgctggtcaagaacctgacgtggactggattcagcatgctggatgccgaggctctcaccaaagagatagagtccatgaaggtgaaaaggagaggtgcaagggaaggcgccaggagtgggggcggcgccaggagtgggggcggcagcgttcagtgccctgacggggctctggccctcggccgcgacaggccgtggtctgctcggatgtatggcacgtgccattcagctggcatgccactaccacataccctgcaggaggccgacgtcctgacagaggcaatcctggagtttgggaaggagtacccaggaatgattgggccgctcctgaccgagcgcaacctctacatggtgtacatgatgcgaaagctcgcggcacatgcgtcatctgtggtggcggtggtaggagcaggacatttgcaaggcatccggagggcagcctcgacgcaaatctcggattcttatggtcagcatttgatgagggacggacgtgaaaactctgcaagcccgcgttcatgtgttttgtgggtgcaagcctctgccaacatgcgagaactgggaatcggctatcgacatcgaggcgctgatggagcttccccccgaccgccctttacgccggcggctcatcaagctgggagctttggctgggagcgtcctggccgtgacccttgtcgtgcgattcgtcctgaaaaggcgtgcttaaacggccaagggtctgtaccatga

SEQ ID NO: 5188 - DNA, 450 bp, Chlorella protothecoides
atggctcctggccagccattgatcagcattacacgggctgtgcaagggtcgcgtcaaatgatgatcacacagtctgcacactgcaggatgaagcctagcgaaccgctggtcctgctgtgcatcgctgcgggactcatcaatcaggcgtgtgctcgaggggtgagcgacaaagaggccctggtcctgcaggcgttcgcgttcctggaagagtacgcggccacacgcctgaacactcaggagagcctgtacaacttggggcgtgcggcccagcagctgggcatcccacatgtggctgtcacgtactactgccgtgctctggccgagggggtgccacggatgggaagggatgacatgagccgggagattgccttcaacctgatgctcatctacagggcctccggcgctgcaccccttgcagcagacctggcaagaaaatacttgactgtgtaa

SEQ ID NO: 5189 - DNA, 840 bp, Chlorella protothecoides
atgtcgcccctgcatatcccgccacaggaggcattcctggacctcgccctacccacgctgggcgccacgctgcgggccctggaggcagaggcagagcgcagcgcgcccgacgtggcgctccgtcggcgtctgcgctggctgggcaggcgggggagggaggtgggacgagcacgagggcccgtcacgatgctcgactctgagggcggcatgttcagggggctggatgggcgcctggaccgtaggaaggagcacgtgcgcgagctggatgcgcgtgtggaggagctggtgaccacagccgtgcagagagactcggatgccctgcctgtggatccactcgtccctctggagcctgggtgggattggattgcacgcatgtcccccatcgtgaacaagaacgtgtccctcggaggcagacatgaggactgcactgaccctgggtcgtccttctgcaactgcattacccatcctgccggctccacgcgaggctcaccttcacctcccatgccacccaaatgtgcagaggaggaggaggagggtgccgccgcagggtttgtcatgcgggaactcctgcgcgaggaaggcccatttgccctcctggtccaggcggggcaggccctgcatgcggaggggaggtgggaggaggctcgggaactggcgtctgccgcgctggatgtctgtggcaagcgctgggcgcatcgttggaagagggacgcagtcaggctgctggctgcgagaggggcgatcgcagcgcacgatctccccgccgcgctgcacaacctgcggctggcatgcgcacggtggccgctggcgagtcagccctggaactcctttgcactgtga

SEQ ID NO: 5190 - DNA, 849 bp, Chlorella protothecoides
atgcagcctgaccacgcggaggttcccaaagccctggcacgtctctactacaagactggcaagcatgaccttgccgtgcaggctttgaatagcttcatcacaagtcatcccgccgctgtggatgctacgcacatcaacatcttggccgaactgttcactgaggttgggcgatgggccgaggctgtgagcctgctctctcgagtccagacagagctctttggagggcagcctctccccgccgaccttcaggtgaagcggggcctggcgctgctcgcacagcgtgacctccctgccgcgctttccaacctcgaaagcctgcttgccgagccagtggagggcttcgcggacctgtacctggaggtaggcgagcgtctggccgcggcgggccaccccccgctggcgctgcgcttcctggccccgctgatggaggtgggtggcggctccaatccagtggttgccacgctgctggcagactgccacgaggcgctgggcgaccggcgcagcgcgctgggcgtggtccaggcgctcgtggagggcctggacgccggccacccggcgcatgcggcggcgacgctgcgggccgccgcgctgcatcgccagcttggcgacgacgcggcggccaccgccctgctggaaagcgtggagcaggtgctggccgtgcagcaggagggtgctggcgctgaggagggggcgggggcggagctgatcctgcgcagggccgccctgctgcactccgctgggcgcagggtgaggcatgcgttgacgggttggggcgggggagccgtgtgggtggcgggctgggactccccaaaacgtgctcaggcccctgtgtcggcatgcttggtgtga

SEQ ID NO: 5191 - DNA, 453 bp, Chlorella protothecoides
atgaagtctggtcaggtgctgacagacagcaagtggaagtggtatgagccggaacactggcggtttggagacgccctgggaccccagggcatcaactacatgcggcacgccacaggtcaagcatatgggctgtcccggcccgtggcgcagtacatagccaggaacgcgcacatcctgcaccgctatgcgaacgaggacgtgtcggtgggggcctggatgctgggcctggaggtggagctggtgcacgacctgctgctgtgctgcagcagcgccgcacagtgccgggagcagaccacgccagagaagcggtgtctggtgttctccgaggtcacctgcgcggggatctgccaggccgagaccaggctggagcctatctggaagagctgcttggagaagccgtatgaggccgtcaccctggctacctttgaccagaccgagaccagcactgcctga

SEQ ID NO: 5192 - DNA, 2817 bp, Chlorella protothecoides
  modified_base (248)..(257): a, c, t, g, unknown or other
  modified_base (507)..(516): a, c, t, g, unknown or other
  modified_base (2560)..(2569): a, c, t, g, unknown or other
atgcgtaggactggcggaccctcctggggcacctttggtgatggtctggttgcagagggggcatctccgctgcagctccagccattgcaagatgcacgaggagcagaatgtgtgatgacatggacgcacctcggccttgtcttccgccccgtacacttccaggcctgcatcaaggccgagcaaggcggttcgcaacgctggcttccggaaggaggccaccaaaggtggcgagtcacgcatgcccctcnnnnnnnnnnctcgaagaaggcatgcagcctctggagcagcggggcgctatcttccagcaaagcagggagcctgggcacgctccgctcctcgctggggggtggcgccagctctgagagtgtctgtggcttggaatccacgaacctggaagccactgcagtggggtgcaaagatggggcacttcagggttggaaccagattgagagtgtgagggaagattttgccagtttcagagacacccacatgcgtaggactggcgannnnnnnnnnttccgccccgtacacttccaggcctgcatcgaggccgagcaaggggggtcgcaacgctggcttccggaaggaggccagcaaaaggtggcgagtcacgcatgccccttcagccatcccacgcacatatgcaacatgctggactgccatgagctgcagtctcgacattatcgtcgtccagtgtcaagtcgacgacgtcaattgtgcgtgcaggcggctcggtcttgcagggatctgccaaatgtgaagcggcccaaactcctaggttgggaagccaaacctgtgagggttgggaagccatatcggcttggcactaagcatactagaggtcgaatatcgatcccgagcgccgattcgcgcgctcgggaggtaccaggcaggtgcaggagacagagtgtgagggtgtgtgatcaacgtgttgaggtcgaatatcgatcccgagcgccgaatcgcgcgctcgggaggtaccgggcaggtgtaggagacaggtcctggcagccgcggcgatgtgaagtacctgatgacacactcatcacgcacggaattaatcaaatcgattcttccaagatggcgtcccttgaggcattcagacagtacgatttcgaaggagatgagacctggaaggcgtacctgtctcgcgtcgagatcccttccggatccgaggacgccctgctcaagctgaaggccaagtactacaagcgcgaaatcgatccagacttcgagcccagcagcgtggccaagcctgccgtgcctgccgctgatgcggcatcccaggccgccgccagcgcgacggccaggccggcggccgagaagccggcaaacgcacaggctgccactgctcgccccgatccccctgggctccccacccgctccgaggtgtacatcattgctggcgagtgggcactcgtcctcatggccatcctctccctccagcccttcctgccacggcttgcatactctgccttcacgctcacttgccagctctcgctcctcaccaacggcctcaagctgcaacctgctgaccccagccatctcgtcagtagctgctgctcagcatgctccgtccaacccccgcccgcagctgtaccttcagcacgggactcccagcctgtcccccttccccgcggccatcatgccctggatgacggcagtctctggtacggccccgtgtgtgggccggagctgcctgtggagcggcagcgcggtcttcttccccaccctgctctccgtcatcctgtccagcaaccggcacctgggcgtgggggtgctccccctggccatccacgccctgctccacgccgacgccgcctcccaccgcatcttcggcaccaagcgctggtaccaggccagcttcggccgcgtgcacgcgctggtggagccccgcctggagctcctgcgcaccgcggccgccgcgggggaggtggggctgggcttcaccaccctcctgtccgtggtgcagctcggcctccgcggcgctggcaccgcctttgtcatctggaaccagctcaagctgcgctaccagtctggccactcggggcactaccacaagcaggtgggctgaggaggaggggggcgaatgaaggtggctgttgtggcggaggttggcagggtgggctgagggggaggggggcgaatgaacctggctgttgtggcggaggttggcagagggggtggaggcccccatgcagcaccttgaatagcctgccaggtggctgcatgcccggagagcacatggacgtgcactgtgttgaggcccagccaatcgctccaccactcccacctcacatgccgtgcacccatctcccacccctggccaggggtggtttaaccgcagggcatgactactcaggcgtgtgcatgcaccgcttaggactgaccgccgcgttacgccctgctcgtatgggtgccttgcatggtaaactgacaggagagtcaggccaaccacaggccatgggacttggtgtgtgtgttccggatgcagcacaggcttcagggagaccgacgagggggtgccgagtctccgacaatccagcgaaaaaccttccannnnnnnnnnaccacaggccatgggacttggtgtgtgtgtcccggatgcagcgcaggcttcagggagaccgacgatggggtgccgagtctccgacaatccagcggaaaaccttccgagcactcactggacgcgacagaattgcgaggacggctgtggcacgttctggatgcggccatgctgcctcagggcagcctgtagctcagactgtgcaatatgaaagttgttcagaaactgctggcggttgggaatggagttga

SEQ ID NO: 5193 - DNA, 516 bp, Chlorella protothecoides
  modified_base (24)..(33): a, c, t, g, unknown or other
atgggctggccgattgcttctcgnnnnnnnnnngcacagcatgcttcagagtgcacgcagtcgccgagatcctccccgtcacacatccctgcatccgcgcaggtggacctgacaagcggcgatgggctggccgattgcttctcggccctgggtccagagctcgtggcggttgtgaactgtgccgcagcgtccgccccggcattctgcgagcagaatgctgatcatgctgccgcactcaacgtcccgcaccagctcctgaaatccctggcggggctcgctacgacccccctgctcatccacatctccaccgaccaggtgtatgccggcacagggacgcccgctgcagggtggagcgaggactgcaaaccccagcctgtcaacgtgtatggggccaccaagctggaggcagagcgcgtcgtgcaggttgaagccttgagctgccgagaaccccatgcttgcgagccctatcctgatgccaagggcactgcgctggcggacttgctcccctcctggtga

SEQ ID NO: 5194 - DNA, 181 bp, Chlorella protothecoides
gcgccatggaggtcgaggccggcacgagcctggtggtcgtgctggcactgatgttcttcggctccctgctggccagtgccctccccttcatgtttcagatcagggggaacagcatgaaggtggtggcagggctgggaggtggcctcctcctgggcactgccctgtccatcgtcatccctga

SEQ ID NO: 5195 - DNA, 564 bp, Chlorella protothecoides
atggcagattctctcagagacaggggcgtgatgcagtcatgggatgctgtccacatctatcttcatgaaactaccgatcaagcacggtgtggccatgccctctcatcagcacccccaccttcccccgccgcccaggtggctgaggagcatgggcatgccgggcacgggcatggggccgacgattggtcaggcgccatcctcgtgctgggcttcctcggcatgatggccctggaccggtcccagcccggccacgggcacgggtgtgggggtcatgcccacgaggcacgccctcgcggccggcccggcggccgcgaggggccccccagccccacgcggaagccgggggccgtcgatcccgccgtcctggggctgctggtgcactgcgccgcagatggcctggcactgggggccgcagcactgtctggcaacacgcagctcagcctcatcgtctcggtggccatgctggcccacaaggtgtgtggggtttgggaggcaaagtctggaactgggctttcactgagggtagctgctcacacgcaccctgcaccatccactccgccgtga

SEQ ID NO: 5196 - DNA, 1281 bp, Chlorella protothecoides
  modified_base (378)..(416): a, c, t, g, unknown or other
atgcatggcgcaggagcgcctcatgctgtgtcgtgtcgtgccgcagaccttcagaccaatgtgcaccccctcccggccacaccacatgctcgccaggcccccatggcgttcgggctggccacctacctcataggccgcggggcggcgtggcgcgaggcgcgaggcagcctcctggcctttgcgggggcggcgcctgcctcggccacgctgacgtacgctctcctgtccctcttgcccggcggcgccagctcccccacgcttgtcgcacgcagcctcctggcctcgggcggcaccttcctgtatgccgccacgatgcacatcctgccagaggtgctagcgggtgctgggccagggacggtggcggcgacagcggggggnnnnnnnnnnnnnnnnnnnnnnnnnnnnnnnnnnnnnnngggctgggccatgcgcactgagctgccgtccctgccgcccacctggcttcagacggagactcccttgctggagagcaggggtgacattctgtgcagagcaggcaatggccagtttgtccgccatggggcagagcagactggcatgccgtggggggcagatcagagggcgcgcagcaaacggcatttgcagcagtatgaaagtacaaagactagatgtaccatgaccaacccaggcacggccagtcagtcaggtttgggttcgggccgtgccgcacatctggcactgctggctcgacatgcgtgtgttggcgtaggtgctgcgagtagtaccgagggggaccttactgagttgtgttcacgcctagtaaatggtcaccaccagaggaagaccccccaagctgcaggacacagtttcacatgtcacctcccaccatccagaccagctgccccccccaaatcacgcaccaaagctggcacatccacgcatgtgcctcgtcctgcgtcagacctcgggcctgccctggcatccctggtgggctttgcagaggtgctggcctcatcagcaccccgccctccagtcttggggttcactgggcatgggagggcgcgcggagctgctcagcaagcacgagctgggcgggatctcacacccatggcagcccctccgtggggaggcatcgctgcaaggctgaggtggaacagaccggcatacaggaccaccaggcccctcatcgaggggctgcaagattccgtcatctggaccctccccctgctcacctgtgtcatagctctggagggccaggtccagccccttctccatctcgttgaccagcttggtgaagtgggacctcgtgacatctgttag

SEQ ID NO: 5197 - DNA, 1548 bp, Chlorella protothecoides
  modified_base (754)..(763): a, c, t, g, unknown or other
  modified_base (1098)..(1107): a, c, t, g, unknown or other
atgaccgactccgagccaggcgagtcagactcgcaagcgaatagcatggagtacgaggatgaggaattcagctatggatctgaagctgcagattttgacttcgatgacgatgcgggtagcgcgggtctactgagcgatcggaagggaggttacaccacactagacaacaccacattacaaaatagagtcgatgcagcagccggcaggattgctgagctatgctgcatgccaattggcgaagcagcacgcttgctccacgccttcaaatggtgtgcagggttggcgggttggcggatgctcgaagtcagaccgtacactacgatccctcttactcatgcgcggtatgccctggctcaatacaacacagggacacaacgaggcttcaggatgaatggttctcgaacgcagataagggacgatctagtttgcaccctggtaggcataagcatcgtgtattcatctacagagtcatggcatgcagagcgtctcatcctgatggccaaaacctgtgacaatacagcattggttgacaatcatttgccatcagttattttcttccccaacttggtgctcaagcagggccagtgcggtatctgctttgagaccttccctgcaaccagcatgcacgccgctgcctgtggacaccggtattgcaaggactgctggactgggtatgtccacactgctgtggagtcaggccccaaatgtctggacctcagatgccccgacccagagtgcagcgtgctggagaacnnnnnnnnnncccgacccagagtgcagcgtgctggtaggtctgggctctttgcgagcttccttgtgtcattgtctgagttgaaggagtcgcgagcaaggcgaggtccctccatgccaggagaagctgcggtgggcatcgctgctgaaaagtatgggaaggtgtatcctttctgtggccagctgggactgaacggccttcttgtcaaaccctgggtccctccctttgccaaaaacatcccaccatctttcatcgacgccgcaatgcatgatgcagagcgggctgacctggtgtcccgctccaggtgcgtttgcgagtggagagggctgtcggtactggtcccttcnnnnnnnnnnctgacctggtgtcccgctccaggtgcgtttccgagtgctgctgtggagagggctgtcgcagaagcatgggatgtcatgttggttatccgaacccgtgctacctcccccattgcccctgcagactgtggaagggcagcagaggcaatgtctgtcccagtgacagctgcgctggatgtgatctgtgactgcggctcaaagtattgcttcaagtgcaagcaggaagcccatcgtccgcaaggagagcgagaacatgacgtggattttggcaaataccaagaactgtccaaactgcaagtgagccggacaaagaattggggatggatgatagtttggggaagaccgttgaagacaaggttgaagatggtcggtcaggctccaggctgtcgcctgcctgcactccctcaccttgcaactgcccctttccttgcaggcgccacatag

SEQ ID NO: 5198 - DNA, 2574 bp, Chlorella protothecoides
  modified_base (1543)..(1552): a, c, t, g, unknown or other
atggcccaatgcccacccgcaccctctttcccccccacaccacgaccttctccccaacaggtggaggaggagtttgagatcgatatcaacgacgaggagcccctgtttttgaaggggcaatcttccaagtctggcggggagatgagccccatcaagattgtgaagaacccggacggcagcatgcagcgcgcggccatgacccagtcggcgctggccaaggagcggcgcgagctgcgcgaggcgcagcagcgcacgctgctggaggccatccccaaggacctgtcccggccgtgggaggacccgctggcggacgcgggggagcgcgcgctggcggccgagctgcgcggcatcgggctgggcaccagcgaggtgccggagtggaagcagagcgcgctgggcaaggcgccgacctttggcatccgcgactcgcgcagtatccgggagcagcgcgagagcctgcccatcttcaagctgcgcgatcagctggtcgcggcggtggccgacaaccaggtgctggtggtgatcggcgagacggggagcgggaagacgacgcagatgacgcagtacctggccgaggcggggtacaccgcggcggggaagataggctgcacccagccgcgccgcgtggcggccatgtcggtggcaaagcgcgtgagcgaggaggtggggtgccggctgggggaggaggtgggctacgccatccgcttcgaggactgcacctcccaggccaccgtgatcaagtacatgactgatggcatgctgctgcgcgaggcgctgctggacgacgccatgaccgcctactcagtcatcgtgctggacgaagcgcatgagcgcaccatccacactgacgtcctgtttggcctgctcaagggcgtgctggcgcggcgacgcgacctcaagctcatcgtcacctccgcgaccctggacgccgagaagttctcggcctacttcttttcctgccccatcttcaccatcccgggcaggacctaccccgtggagatcctctacaccaaggtgggtgcagggtatgtgggggaagggggggcgagggggggtcagaaacaggagcggggagctcggggcaggactggcgagcttcagggtttttccagcctgggaccgagtgctttgcaattcaagggaccctactgcctctgtagcttacacgcacatccagccttcaatgcgagtatcccaaccactcacatcccccgccgcatcccaacacaacccactgcaggatccagagagcgactacatggatgcggccatgatcacggtgatgcagatccacctgacggagccggagggggacatcctgctcttcctgacagggcaggaggagatcgacaccgcagcccagacgctggtacagaggatgtggggggtggaggcaagggcgacgggaacagtgaggtgggctgggcgggtgatgcaatcacgcagccacagtgccagagtgcagtggccaggggggcagggctctgtaacttgttgcatggtgagacagttctcccaccaggtgcgtcttgcagtcacctgnnnnnnnnnngacaggagatgtggggggtggaggcaagggcgacgagaacagggaggtgggctgggcgggtgatgcgatcacgcagccacaatgccagagtgcagtggccaggggggcggggctctatcacttgttgcatggtgagacagtcctcccaccagacgcgcatttttgaccctgcgccgccagggacgcgcaagacgcgcatatttgaccctgcgccgccagggacacgcaaggtcgtcatcgccaccaacatcgcggaggcgtcgctgaccatcgatggcatctactacgtcgtcgacccgggtttcagcaaacagaaagtgggtcggctgcacacccatagccgaagggctgagccacagtacatccaccaaactcccaccctacagatcgggatggactccctggtggtggcgcccatctctcaggcctctgcgcgccagagggcgggcagggccgggcggacggggcccggcaagtgctacaggctctacactgagatggcgtacaagaacgagatgctgcccacctccatcccggagattcagaggtggcctggggatttggagtgtggtcttgggagagggcatcgggagacagagctgggtgtcaggttgggttctgtgcaaggccacctgatggcaggtcgtgtcagtccccttacactgcagtcccgcacgccacttacctttttcagatccaatctgggactcaccgtgttgacgatgaaggccatggggatcaacgatctcctgaatttcgacttcatggaccctcccccagcacaggtgggtggtggctggtgtgcatctacatgcatggatcatgggagaaggggacaggacagcggcctcgcaagaacaatcacacctcccttgtgtgtgcagtgtggagtgccttgtcaatcgcccattatgtcctcctgcacccccttgaccttgcagacactggtttcggcactggagacgctctataaccttggagctctggatgaggagggaatgctcacgagactcgggaggtga

SEQ ID NO: 5199 - DNA, 789 bp, Chlorella protothecoides
  modified_base (576)..(585): a, c, t, g, unknown or other
  modified_base (710)..(719): a, c, t, g, unknown or other
atgcagggggttgtgatgcccttggccgaagaggttgtgtcatggggagatgcaggaggttgtgatgccctgggccgaaatggctacccgtgctctacaacacgcccatcccacatctgcaggaaaatggccgagttcccgctggatccacctgtggccaagatgctgattgcctcggtggacattgggtgctcagaggagatccttaccatcattggcatgctttccgcccagaacatcttctacagtctaggaacaaggctccatgtgcatagcatccctccatgctttgcttgtgcaatgcgccatgctccgtatgccatccccaccacacacccctgcagacccaaggagaagcaggcacaggccgaccagaagaaggccaagttccatcagcccgagggcgaccacctgaccctgctggcggtgtacgagggctggaagaacagcaagttctccaacccctggtgctttgagaatttcatccaggcgcgctccatgcgccgcgcgcaggacgtgcgcaagcagctggtggccatcatggatcgttacaagctggacctggtatcggcgggnnnnnnnnnnaaggagctcgtgaggtttgggccgcgcatggccatttgggatccagagggcagggagagggcgtgcttgactgggcacgatctggcaggggcttgcaatcgacctgtcctacatgctcaggaagnnnnnnnnnngaggaggtggagagggttgggccgcacatggccatttgggatccagagggcagggagggggcgtgcttga

SEQ ID NO: 5200 - DNA, 603 bp, Chlorella protothecoides
  modified_base (557)..(566): a, c, t, g, unknown or other
atgctcaggaaggtggctcgcccaagccgccaaacatcactcctgcaatttcgtgccagggaggaactacactcgcatccaaaaggcaatctgcgccgggttcttcgcacacgccgcacgcaaggacccccaggtgagtcatggctgcacagggccggtgcgcatgtgcctgtgctggattggcagaaagcgaaatgtgaagcatggcacgcactttgcagtgatgcttcagcgcttgattacaatgccgcatcacactccctgccccccgccatgtattccctgcaggagggccacaagacggtggtggagcatcagccggtcttcatccacccgtcctctgctctgttccagcatcagcctgactgggtcctctaccacgagctggttctgaccaccaaggagtacatgagggaggtgagttttggaaggaggggaatggggaggatgtggcccaggagggtagccttcctgtgtgcagcagcaacaactggtcttgcacaacacttgttgcttgaagctcgctggctgacatgtctctgcgccctcgcaggtgnnnnnnnnnngagcaacaaatggccttgcacaacacttgttggttga

SEQ ID NO: 5201 - DNA, 720 bp, Chlorella protothecoides
atgatatgcggggcaggccctaaggtgcacttctattgtgcaacagaaggattatatcataaagaaaggcgcgcaacctgcaaatttcccatcggtctgagaaccctaacctcattacggccgcacccgagaatccccagaatggtaaactcggccatatgcacgaagcccctgcccgcaccaccttcagtggatgccaagctcttcaagagcttcggcgtggaggtggtgtcggggtttgaccccaccgactttacccccgagcaatttatcgaactggagaggctcctgtacgagcacgatgtggttctcttcaggggtctcgacctggccccagagcaccagtacaaactcaccaaggcctttgaccccacttgtgagtcatacggccacggcaacaaccaggcaaagtccgtgctgcacccagacctgaagaccatccccagcgtgccccaagtccagctgattggaaacgggatcgtgcacgaccactggggcctggccgaggccaagctcaagcacccgcaccatcgtaccttccacaaggaccctgtgagcgaggaggacgaggcggcgggggccacccgattctaccgctggcacatcgatgctgccctgtacggtgacctggccccgcccaaggtggacgagggcgagggtggtcctggggtcctgctcgggaacacccatcctggggagggttgcaccctacgacactga

SEQ ID NO: 5202 - DNA, 1602 bp, Chlorella protothecoides
  modified_base (86)..(95): a, c, t, g, unknown or other
  modified_base (1015)..(1024): a, c, t, g, unknown or other
  modified_base (1286)..(1295): a, c, t, g, unknown or other
atgttcacaacgctaaaatctcgattgcatgggccgctgtcgaggttcccgctcggacagaggcatgttgccctcagcccgctgcnnnnnnnnnncgaacacccatcctgggaggggttgcgctctacgacactggtttgtatcgagaaggcgctggtgcatgttcacaaggctaaaatctcgattgaatgggccgctgtcgaggttcccgctcagacagaggcatgttgccctcagcccgctgcggggcttctcgggctctgcacgccttacctccctccccttccgccctcccgccgtgagcacccaggtgacctccctgtacgcagtggctgcccccgccggcccgccccaggtctgccggtacgacgacgggaccggggacgagctcgccgtccccctgggcactaccgcctttgtctccggcaccaccatgctggacgcgctcccgcccgccctgcgcagcctggcggtgcgctcctcggtccgctacgccccgcatccctacgtctggatggcccgcgcccacgcgctgcccacgggcctgggcctcgaggacgaggggctggaggtcccccccgaggagctgcccccctgggacccccgggaccagcagaccctgcccgtgtgctggcgcaacccggtgacggggcgcctgcacctgcaggtccacccctgcgccatccaggccctggtggtagagcctctgccccccggcgcggcatcccgaacgaccgacgccctctaccccgacggcggcgaggtcaccgacctggccgaggtgcggcgcctggtctacgcgctgcagcgcccgggcatcgcgccggggctggtgtacccgcacgcctggtccgacggcgacctggtcctgttccacaaccggggcgtgctgcacagcgtggtgggggccttccggcccgaccaggtgcgcaagttccaccagtgcaacctggccgccagcgacctccctgcagggcccacgcccgaggacatcgccacgtacgcatccttccgnnnnnnnnnnttgctcctgagttggtctgggctcccgctccgccctgcacctgtagttgtatccctgttgctttcagatccttccgtgcgggcaaggcgctgactggcaggtcggaagcttgcacgctgccgtcatgcaatgtagaagtcaggatgcatggcagccccatctctcgggatgcctgtgtgtccatagtgcctcccgggcagccagcgctgtcgttgttgcaccgtcaggcccccctcattgtgctcaggactccttgccccannnnnnnnnntggcagccagggctatcgttgttgcaccgttaggccgccctcattgtgctcaggactccttgccccagatggatcttgctctacccccaaatgcatgctgcagcacaacgcccagaactgggattcgctcggattccccttatggcacgataataacacagcactcgttattatagcagatccgagggcaaaactggcatggcaaggggtaatgggcgacagatcaaataactcttcaaggacatcaactctctggcagctgcaaggaaagcggttcacaccgtggcctgacaaggtggggtgctag

SEQ ID NO: 5203 - DNA, 603 bp, Chlorella protothecoides
  modified_base (92)..(101): a, c, t, g, unknown or other
  modified_base (529)..(538): a, c, t, g, unknown or other
atgagaggggacccctgcgttcagatctgtgtcaaaggggacctctggaccaccctgacccatgcagaaagaagcccactctccctggccgnnnnnnnnnnagaaagtcttccctcccaggatgacgtagtcgcacaggtgaggattcgtgagaggggacccctgcgttcagatctgggtgaaaggggacctctggacgaccctgacccatgcagaaaggaatccactctccctggcctccctatcacttgtgcccacgccatatcgcaggacgcaacattcttggacaccacctttgacctgaacacgctcataccctccaactcgagctatgcctggtaccagggatcactcacggcgccgccttgctgggaaggcgtgagctggcatgtcttcaccgatcccatggagggtctgtcggtgccacagctggaggccctgcaatcggcgttggcctcgcatcccgaggagcgcgagctcacatgctccccagatgaagacagtggatgtggagtgaccgcagcagacnnnnnnnnnnggcctcgcatcccgaggagcgcgagctcacgtgctccccagatgaagacagcggaggtggaatga

SEQ ID NO: 5204 - DNA, 792 bp, Chlorella protothecoides
atggtactctcatgcatcatcctatgtattgcctttgcgctgggcgatgtcctaccgctgaccgccggctgcggtcagcagcacttccataagggcagacgcatcgctgaggagtccgacacctccgcctggaactatgacctcaatggcgccgactggcccgggacctgcaaggagggcagggcacagtccccgattgccatccagctgactgctgctgccccattcgccggcccccccatctcgttcgagtttggcaaggcaaagggactccgcgtattcaacatcaggaccgcaatccaggtgcgtcgtcaccttttggttatgtgtaggctgggtcttatccggtccccgccggttcctctatccgccgaatccgatcatcgtcgacctggcggacggcgagtatggggccctcccacgcttgacatcgggcagggccattggagccaggaagggcttcgaagccgaatattttgttccagatggatatatcaggccccacccctaatcctcactccacctctcacaggtggaatgggacgacctcgagggcagccaaaccgtgatccccacgaacggcatgtgggggtccgacgcggagaacatctcctccgttcccgtcaaacctttccagttccattggcattctacatgcgagcacatagtggacggcttcatgtgccccttggagctgcacctggtcacgaaggtggacaacgagacggacgcaccggtgccgaggtactgccggaacaacatctgcctggcggtgttcggcgtcacgtttga

SEQ ID NO: 5205 - DNA, 360 bp, Chlorella protothecoides
gcgacgcgctccgcggcgctggcccgcgacctggtgcgcgcgcgagaggacgcgcgccctgtgcagctgatgctggtgcacgtgcgcgagacaccgcaggaagcgctggcctccgcgccgcgcgagctggcctggttgcagatcgagtgccagcgcctgggcgaggagaacgaggccctggccgccgccgcggaggccatgcaggaggagctgagggccagcgccgcactgctgcgccactccaaccccaaccagaagatccagtacacccagcgcctgaagctggagctggaggcgctgcgcaaggagtgcgccgccgtcacccgcgaacgcttcaccctggagcagtgcatcaggtga

SEQ ID NO: 5206 - DNA, 492 bp, Chlorella protothecoides
atggcagggcacgccaagtcggacgggggacccaaggaccgcgcgcagtggggcgaggtggtggccaaccgcggcgcgctgacgggtgcggccctcttcttcctccagcagttcagcgggatcaacgccatcgtctacttctcctcgtcggtgtttgaggtagggcctggggtcatcctgggtgcaaacccgtgcgccctggtgacggaggcttgcatgctgtgcagtggtggagttcagcctactgctcgtgcctggcagggtgctgggcacgagcagcacaatccaccctccctgtctccctcgcctcgaccctctgtgtcacagcgcgcgggattccactccggcacgctggccagcgcggctgtgggcacggtgaacgtgctgggctccctgctggcggcgagcgtgatcgagcgtgtgggacgcaggtgtgttgggtcgactggaagctacacaatgcgcgctggggtccagacagggtcccagtga

SEQ ID NO: 5207 - DNA, 570 bp, Chlorella protothecoides
atgctgctcatggccgcaggcatgcgcctgcctgccctggcacacctgggaccctacgttgccgtgctgggcacgctggcctacatcctctccttctcgctgggggtgggccccgtgcccgccctactggtgccggagatcacccccgtgaacctgagaggtgtgtgcgtgggtgggcgggtgaaggggagggtccttgggggggacttccttcgagaatcctccgatgcattggcggggcagagggtcctgaatccaacatgcccgctggaggactgcagagggaaagcagtcctccgcatgtcacgagatcacagccctcgctgtcagcaagatccaagcacccggcccgactccctcacgttgaaaggcaaggccatggctatggccatggggacccactggatctgcaactttgcaattggtcaggccttcctccttgccgtcaacgccttttccgtgccggtgctctacaccttctttggagtggtgtgcctgattggagcacagtttgcacgcggcatcaagagctcgacccagctgccagaggaattgcccggaacatcgtga

SEQ ID NO: 5208 - DNA, 231 bp, Chlorella protothecoides
atgaccatctccatgaccaagggcgcggtgtatgcgctctacccgctcaccttcagcaggcggtaccagggcgcgccgacggagaccatcgtgaccacgacggtggagaactgtaacgacgagtatggggcagtggctcccacctgcggctgggcgaccctcaacggcgtcaatgtcctgtgcgctggagattggtccaggggggaaggggaggaaggtgggggggtttga

SEQ ID NO: 5209 - DNA, 474 bp, Chlorella protothecoides
atgcgtgacgtcgaccaggccaccggtgaggacctcctgcccatggccggcggggctggaaggggccaacccaatggggccggcgcaggcgccgccccctctgcactgcatggcctgtcaggcatcaagggcagtcacaggtcattgtgtggtcggcgaatacccctgctgacccctctacgcacgcggcccccaccctatatccaccctcaggtgaaggacgacggcgacgatgccaagccccgtcggcggggacggcgtatgacttctcccgagcgctgggagattagccagctgatcaagtccggggtgctggacccatcagagtacccaggcttcaacgacgatgagggcacctatgccgacatggacgacgaggtgggtgtggacttggattgtgcacagaagccttgcatcttgagggagatgtctcttggtgggaatgcagcaagactagcctttgcaagctcatga

SEQ ID NO: 5210 - DNA, 417 bp, Chlorella protothecoides
ccccccccccaaatacacacattgcagcagggcatgcagggccgcttcagcggccgcctggagacgaaggaggacgagaagcggctgacggacgagtgcgcgcgcatcggcccgctcctgggcgccggcggcgagggcgaggggtcgcacggcacgctggccaagatcgtgcgcggcctagccagcggcgagatccgcgccgcgctggaggcgcgcgagcgccgctaccaggagctggaggagcgggtggcgctgctgtccggcggcacggcgggcgcggtgtcgcgcctgcaggaggactgcaccagactgcgcgccgagctggacgggcgcgacgccgcgctgcaccgcctggagatggagctggccgcgctgcgcgacccgggcgacgccgcgcgggccgcaggggcgacggcg

SEQ ID NO: 5211 - DNA, 1083 bp, Chlorella protothecoides
atggcatccagcacctctatgcctttccccacccaaacagcaacccagcacgcttgcttcacagtaaaggtcctgacatcacgacatgagccatcgccagtgcccaggcaagggcagggcaaggaagccgacccaccccggcggccagctcaccttgccgaagtacccgggatggtacttgtccatcatgatgcgatggtggtgctgaccaccagcgttaccgcgaccgccaggatgcttcctatgcttgccgacgcggccatgaccggcactgacgtggcccctcttcttccggttcttcttcaagtctgcacggcgcgggatggggtcggaggagggagtgtgggtggggcgggcacagccaaggagggccctgccgggcgcagaggaggccttcagccacagcagccggcccgtgcacgacaccgagaatcccagctgcgccttcctcgcccacttacgggtcgtcatcgtgctagctgtgcccttgccactccactagaaggagaaagagggtggcgcagcactggcagcacggccttggtgttggcaatgcgggcgtccctagccgggctcgcgaggaatggtgagtgggtttggactgcacggacagtaggaacccctccgatgcctatgcgtgtagtttacatcaccgccctattcacatcagggttcgaggtgttgagtaaacttcctcatcatggagtgggctccaagctggcgaggacgacctggaaggagggcacacactactctatcaccagcataaagctgtcgcaggttcggtcgctgtggcgggtgcaccattccacgctatgtatggatccgtcgaggtcaagtggtgattatatcaatccaacatggtccctactcctcccaggacggagcgcatggcaaggcctttggagtgctgagctggaatggacaggtcagcgacgagcggcccctgcgcatctccggcctcctcaagaaggagtggagagcggtggacgggcccgtgccggcccaggagtcccaggccgctgccgcgctgcgacgagaggctgctgccgtgaccgccgaggcggctgcagtgaccgctga

SEQ ID NO: 5212 - DNA, 519 bp, Chlorella protothecoides
gtcgtggcccacggcgacgcgctcaagcgcctggcggccgccgaggccgcgcgcgacgcgctggaggcgcgccgcgcggcgctggctgccgacctggacgccgcgctgctggccaaaaaaaggtgggcggaggagaggttgccgggggcgggacggtgccgcctcggccctcgcatgccgagcatcgcgccccccctgggccaggaaccagccccacaccctctcaccgacgctcacaccatgcccgaaacccagacgcggctggaggcggactgggagctggagcgcggggagctggcggacaaggtggctgccgcagggcgcgagagcgcggacctggcagcgcagcgcgacgcgcttcagcgccaggtggaggcgctggcgagcggcgaggacggcggcgagggcggcggcgcgcggcagccggacctggccgacatgctgcgcatgctgcgccgcgaccgcgaggtggcgcagatgggcctggagctggccaagcgcgaggcggcgcgcctgcgc

SEQ ID NO: 5213 - DNA, 1344 bp, Chlorella protothecoides
  modified_base (571)..(580): a, c, t, g, unknown or other
atgtactcaggcacaaagcccagcctggtttggggtgacttttgcttgcactggccatactttgctatttcatgtgctctttatggaaacttaccgcttggtgcctgcgctttgaagcatgctgtacccctgggcaatgttgaaatgattgctgtcaaaagcagcaagtcaccgaatggcacaaagcctagcctggtctggggtgacttttgcttgcactggccatgcttttctatttcatgtgctcttgatggaaacttaccgcttggtgcctgcgctttgaggcatgctttacccatgggcaatgtattagatgtggctaggagacggaactctgccaagcagacgccagcaaccatttgcacaagggtgttcaagtcgaagcttggccaggtcagacactccggcccccattcaggcaagtctgaagtctacttgtgcccaatcgcgagttatttgcagcggcgcatagcggtatcagtgccaggcttggatagaaaacacgtccggattgtccgctacaagtttccgtaccagaattgcgaatggaaccatttgcaccacactgttnnnnnnnnnntgacgcggagaggaagctacaagtttccgtacaagaactgcgaatggaaccatttgcaccacactgttcccatctcggcaaatacaataactgatcccccgatgtcatccaacacgctgcccaagcgggttttggtagccatcaccagttacaatggtgcactgtatgacgatggcaagcgcaccggcctctactggtccgaagccctccacccatacaatgtcttcgtcgaggcgggtttcgaggtggatgtggccagcgagaagggcaccatgggctacgacgagcactccatcgagggcgacggcctcgaccccgagtcgaaggaggcatgggaggacgtaaacaaccccctgaagaaggccctgaaggagagcctgctgaaggccgcggatgtcgacccctccaagtacggcatcttcttcggtgcgggcgggcacggcgcgatttacgactacccaggggcctccggtctccacgcggcgggcagtgcaatctacggtgctggtggtgtcatcgcggcggtgtgccatgggcccgccatcctaccggggatcaaggaccccgccaccggccagccggccatcaagggcaagaaggtgacagggttcaccaaggtaggcgaggaacagatggggctgctcgagagcatgcgcaaggacaaagtgcacaccatcgaggagttggtcaccgaagtgggtgccgagtatgtccaggtaggaagggatggagagcagcatgtgcgtaaaggagggaaattgtga

SEQ ID NO: 5214 - DNA, 306 bp, Chlorella protothecoides
  modified_base (67)..(76): a, c, t, g, unknown or other
atggaaaattatcgccgcgtgcgacagcctcgcactgatctgcccccgatcgcccccgatgagctgnnnnnnnnnnagatcatggagaactatcgccgcgtgcgacagcctcgtaccgatctgcccccgatcgcccccgatgagctgctcgtcaccgccatcagcaaccccgtggaggtggccggcaagggagtgagcatgctcgaggaggagcaccccgccattaccctgaaggctatgggccaggccatcggcaaagccgtgtccgtcggtgggtgcctgggcggaggacctcggaggtggtga

SEQ ID NO: 5215 - DNA, 207 bp, Chlorella protothecoides
atgcccacagctgagatcctgaagcggcgcgtggcggggctgcaccaactggtggccacctccacggtcgcgctgacggacgtgtgggagcccacggtggaaggcctggagcgcatcgagaccacgcgctacgcctctgccatcgagatcaccctgtccaaggtgggatcatggagattttctgggagcagccactgcgtgggttga

SEQ ID NO: 5216 - DNA, 1050 bp, Chlorella protothecoides
  modified_base (144)..(153): a, c, t, g, unknown or other
atgaactcgtataattcttgttcgctgacatttgttcttgctgaacattctctgttggcagattctggagcagattcacagttcagagaggaaaagctttcggcattgacacgaaaatcctatacacagaacttgccatccacnnnnnnnnnncattctctgttggcagattctggagcagatccacagttcagtgaggaaaagctttcggcattgacacgaaagcccaatacacagaacttgccatccagttttctcggagcgtctctacttagcgatatcacctatcacgtccactgtgatgaggggttagcatccatcaacaacgcacgctgcgtttacggggaccttgcggtacatacccagcaagtctcgagcacctcgttgcggcaacccataacagtgcatgctgcagcagttcgcatccgcgagggccattccactctttgcaaggcccagtgccctgcctgtgtgcaaccccagcgtcttgcccaagtttggggtgatggacccggtctccgtatttgcagcaagtccccaggagttgctggcagcacgacacgccctggagacggtgctccaagcctggaaaatattgaatcatgcccctatgatgtagatggtagtgtcctccgagcacactcatgcactgtgcaatgtgcaggtgccctgagaactaacttgcagagccaggggagcgacctggagttcagggagcaacacaggacttctggcaatgatgggagcgctttctatgccccagacttcttctcgaatctcaagactcgtgccctgggcagggttttgttgacgagtcgagccacgacatcgacgcagtccctgctgcaagacagcctgcgcagtctgccggatggcgtggtgtttgtggccgacaagcaggttcaaggcaaaggtacagagtccagggccgggccatggtctttgggtcggggcaggcgtcattggcagggggggggaagttttgtgtcaggggcggagcatgcccttaatcagcctgctgataaccttgcttctcccttgcttctctaa

SEQ ID NO: 5217 - DNA, 486 bp, Chlorella protothecoides
atggcggagctcccatggacggaggccgacgtgatacagcgctgccagcatgagtatcaggttgcagctcgtgaaggaggtcaggagggccaggatgcgaccgttcgataccagggatctcctgtacctcctggccgtgggtcagtatcgccgcaggcactacctggacgcgcgcacgacgctgcgagacctgctcaaggtgggattaagaggtttaggagagtgggaggttcaacacagcgtcgaagcaatggctgtagccccgttgaatctttcagctggcccatgcatgatgtgcctgctgccagcccccaacccccagcatgctgctacctgcaggggaatccagagttcaggcaggccgaatcgctgttgaagagtgtggacgaggacattgtgcgggatggcttggtaggagttggggcgggagctgccgtcatcggggtgataggcgccatagcctatgccgcgctgaggaagcgatga

SEQ ID NO: 5218 - DNA, 720 bp, Chlorella protothecoides
atgctggagcgacctgtgtggcaacccccccccctgccgccacgtccacgccctccccaagtcgcgagtgcatgcaatccacaccacaccgctccctcatacttcctcctgcccaaacgcacacacacactcacgctcgccaggcaacaccccgagtacgtggacaagtacatcgccggtacgtccgacatgttccgggcctacatccgcgacgggctggcgaagctggaggcccgggacgacggcgcccaggacccggggacgcccccggcctcggccgcaaacggggcaccggctgacggcaggcccgggggagacgacaggccaccgctgcctgtccctccacggcgcggcgccggggtcgcagccttgacgcggccctcccccggcccggccggcctgccgccggtcctgtccatccccagcccgggtgcggcgccggggtccggcagcggcacgcccggcggccagggtgccgcggccaccccatccccgctggcctccgccaggtctgacggatcggctgcgggctccgtcgcgcggctgaacagcctcaggtatgaggcagcgcggcgggggtgtggggctgggagcaggcgggagaccatgagcgcggtagactctgccggggatgccacgtgggtggggctctggcggcacgggaggctgatacttggacttgcaaagggaggatcacatctctcgaaatccctcggttga

SEQ ID NO: 5219 - DNA, 915 bp, Chlorella protothecoides
gacagcgactgggggaggggggacgccaccgctgctggtggtggcgagccgagaggcagggccgagggggttcggcgtgccgcgtcgggcgctgccaggagcagtggcgccgctgcgggccccccacccccgcccacgctctttcaccggctggcggaggaggcgggcctccccgtgtccctgctggacacccagtaccgcatgcaccccgcgctggccagcttcccctcccgcctcttctatgacggccggctggcgtcgggggtgggccccgcggaccgccccgcggtggctggcgtggcctggcccgccgcgagcgcgggcgacccctcggccccctccccgctgctcttcgtggagtcggggggccgggagcagctggtgggctccagcgcgggctcctccctgacccacacctacaacaacacgctggaggcgcaggccgcggtggcgctggcggaggccatctccgcggcggaccccagcgtgcgcagcgtggcgatcctcacgccctacgccggccaggcggccagcctgctgcgccacgccgacccgacccgcctgcgcatcgcgcgccccgccgacgccgagggcgacggcgcgctggccgcgctggactgcgccgacgcgcggggcgcgcggccgcgcgggccgctggtctgcatcagcaccatcgacgggttccagggtcgcgaggcggacgtggtcctgctcagcaccacgcgcacgcagcgcctcggcttcctcgccgaccggcggcgggtgaacgtggccatcacccgcgcgcggcgcgggctggcggggcacgtgccggaggcgcagccgcagcgcgcggagcgcggcggcaggcggcccaggatctcggccgaccctggctgttacggcggcggctgcggcgtggaggagaattttttg

SEQ ID NO: 5220 - DNA, 837 bp, Chlorella protothecoides
atgcgcctcaccatctcgggccagcgcctccctttcctccagtacctcgtctcgatggccgtggtgcaggctgtgcgggaggaggctgctcggtgcctgcaggattccacaaaggccattgggggtggaggggcttccactgcaggcagtcggttgctggtgagccaaagttccgcctcaggcgtcgccacaccagcgcctgggctgggcgctgtggcgatgaaggggcacgcaagccctctgcgctgcactgagcccctcatgcagcctacctgggctccatcttccctccttccatctccacctccgccgcagggtggcgctgaggtggaggtgcgactgaagtggcccaacgacatctacgctggcgaacacaagatcggcggcgtgctgtgccactccgcataccgggaccgtgcattccacctggtctggggtctggggctgaatgtgggcaaccgcgtgcccaccacctgcctggaccggctctttgaagaggcagccgccgcgcgcagcctgcctgccccgccgccggcccggcccgagcgcctgctggcctccctgctgggctggctggagcccgccgtagacgggctggcgcagcacggctttcagcccttccagccggggtacctgcgggcctggctgcacagcgggcagcgcgtggagctggaggaggcaggcagccgcgtggcgctcacgattgaggggctgacgcccgatgggtacctgctcgcgcgcgatgacgcggggctggcctacgagctgcaccccgacggcaacagcctggactttttcagggggctcgtgcgcaagaagctgccggccgcgtcgtga

SEQ ID NO: 5221 - DNA, 672 bp, Chlorella protothecoides
atggcgggaccgcgcagagtgcccggagctggctcgcttatggcttccccttgccccacccttttcttgttggcggaaggcgactacggcgcggtggtgcgggagctgaaaaaggtgctggccaaagacgccaacatcacctgcgccacggccgcggctgaggtggcaggtgcccttggttccggcctccgctccggcttcagcaatgctgccaaggcttggccaggccgcctgcacgcccactctgtctgctcactccaacccaacccctcctctctgtcctcccagtccttgtgccccaacctgctggagcggctgaaggagaagaacatcatgatgagccgggctgcggaggacacgctgcgcacgctgggcacccactgctactcactgctggacgtggcggaggacctggtggcggccatggagcacaagaaccccaaaggtaggccttggaaggcttgtgagcaggtgcaatggattgagatggggcaccgaaaggccgccgtgcgcaaagctgaggcgcgcaaacggcgtggggctctggggccctgggaacacatgcaagtcgtgcgctgtcgagtcagggatcgtgagggcggggcgcaatggagctgtctgacagcctcctctgaatcccagaccgctcgtgcacaagcaagaaacccctga

SEQ ID NO: 5222 - DNA, 711 bp, Chlorella protothecoides
atggcccaactccgccccctcagccgcctccacccacgcttatcaaccctcaccaccaacatcccccctgcaggcgctgcccccatggatgtggatgaggggggtagcgagccctcccccggcgcggtgtcggtggacgacctcctgccccgcacctccatcgccggcgccatcacccccaccctgctcagcatgctggcctcctccaactggaaggagcggaacacgggcatcgagcaggtggacgacctggtccgcggcgcgggcggccgcatcgcgcccgacttgggcgagctcctccctgccctcaagcggaagcctgcctctctcgggtcagtctcatgcatgcggattcgatgctcgcgagcacactcatcagccctctcactccatgaacctctccgacccgctcctgcgcagtcccggctggcggacaccaaccgcaacctggcggccaaggccctgctcacgctttccaggattgccacggccatgggccccgagtttgaccgtgtggcgggccgcctcctcctggcgcccgccgtgtccaacctgtcggacaacaagaagcaagtgcgcgacgcggcgctgggcctgctcactgcctggctgggcgtggccagcctggatcgcctcctgccggctgtgctggaggccgtcgtggcgacacgaaccctggccgacggcaaggtggccgccctcgcctggtga

SEQ ID NO: 5223 - DNA, 582 bp, Chlorella protothecoides
atggaggtgggtggtttgagggccagaggtggcgccgagtcgggccccgcctcactcgccacatacgtttcccctcttccaccccccttgcgcacccgccctttgaacccccccccgcagggcgtggacctggagagcctgctgctcaacatccacgacttcttcctgttcctgggtgtggacgagatccggcggcgctccggcgtggacgacaagccgttgcgcatggtcaagaccatcctgcacgagctctgcaagatgcagggctacggcatttacgcccacgcccgtggcatcccgggacgggatgcacagccccagcccatcatcttcgcctacatcgccctcaacctgcagaccctgtccaactcaggcaaggggcgtgatcgcccccgagaagggcgactctgcgtcgccggccgtggctcgggagggggtggtggtgcgggccccgccccctccgccatctccgaggaggacaaggcggcggtcaaagccgggctgaaggacatcatgccccgactcatgcaccgatcggaggcggagggagccatgcagcagctgtaccacctcaggcggtga

SEQ ID NO: 5224 - DNA, 708 bp, Chlorella protothecoides
atggaaaaggtggccgcgctcgtggccgagaggggccccgccgcccgcgaccccggcgtcctcatccagtgcctggcggtgctccccagctggggcgagaagaacttccaggtgctgaacaaggtgtatgaggtgatcgccgccctggctgccggcccgctgagtcggcgggacgccgggattgcggtggagggcatggccgagaagatcgctgagctgaaacacaggctccccgtgattgccgggctggacgcggtgtccgaggcggtgggccccggctttgtctgcaccacgctccagcgcctggccggcgcggccaagaaccccaaggtccccgccgaggccctggcctgggtggcggccgcggtgccggcctttggcgtcgccgccttcgacgtgcccgccctcctggcctgggcgcgggaggcgctgggctcggcagccgcgccggtgcgggcgcggggtgtggacctgctgggcgcctgccacgcgcagctgggcccggccatggcggcgggggcgctggaggggctgaagcccgcccaggtgacgcaagtggaggacgccttccggcgcaacccacgcgaggaggtggtacccacccgccacgtccgccgacgcggtgcgggggctggggcggggactgcagcaggaggtgagctggaattgagggagggaaggggtaggagtggtgcagaccgagcatga

SEQ ID NO: 5225 - DNA, 930 bp, Chlorella protothecoides
atggacgacgtggacagggtcctgtttgtatgtagggaactcgatgtgtacaagatccctcccagaaccggagcgggtgggcacaggtcgggggagtggcgcgtggacgacaagatcttcaccgcccgctgccgtgtcatggcgcgagggcaggcccttgagatccgactggaggacaccaccacgggggatgtgtttggagtctgccccgtccccagggggcaactacacctggtagtggaacccgcggccgactcctcccgaaactttgtcgtgcgtttggaggacgccgcctccaagcgccacgccttcgtgggcatcaactttgcagagcgctccaccgcctttgatttctcggtggcgctgagcgaccacgagaagcagctgcagcgtgccgacaagctgcaacacattgaggcgtccgacgacccgctcgccgccgcggcgaagtcgctgcctgaggcggcggccctgtaccagaagcaagatctggcgctggaggagggcagcaccatcaggtgtgggaatgtgaatcttggtgaggacctgtcgagcaggtttgtgtgccgctgctgccatgttcacctggccccctccacgatcccggcacatgcatgggggtctcctctccatgaggctgagcatgcatgcccccgccccccgtcgcaggttggcggtgcgcaggccagagggccagagggcggcgtggcgggcggcttcctctctcgcctgccggtccagggaggcgccctggcctcccccggcaagggcatcggcctggctgcccctcctgcgcccagtaacggtgcctccacggctcctgccgcgccgcgcgccttcgatccccccccctccgccgcgctgcagggcgccccagtcctcccccctcccgcgtcgggcggagaggcaggctgggcgactttcgattga

SEQ ID NO: 5226 - DNA, 1377 bp, Chlorella protothecoides
atgtgtgtggaggccgtgctgaccgtggccgacctggagaggaaagacgtcaacctggacctcatcaagggcatcggctgtggatgtgggacacgatgtgcccttgcctgggggatagccggctgcagtgcaaagttcgtgccctcttctttccttcaaacccctttgccctctgcccggcagctggacggcaaggtgggcgggcgcctggaggactcccgcctcgtgcagggcgtcatcctggacaaggacatgagccatccccagatgcctaaggagctgcacgacgtgaagatagccatcctgacctgcccctttgagccgccaaagcccaaaaccaagcacaaggtggcggcgggagtgcccgcggcccgtcgtcctggttgccccagcttggagggatggagcccgcaccagacccggggggctgagcaccggagcaatgcaaggccctcctcaccaagccgttcagccagcattcccaggccccacaacacttcgccgcccccccgccaccgagtcgcaacatcatcccatcccaaatcccaggtggacatcgacacggtggagaagttcgaggcgctgcgcggcgcagagaaggcctacttcaccgacatggtgcgcgcctgcaaggcctccggcgcgacgctggtggtgtgccagtgggggtttgacgacgaggccaaccacctgctgatgcacgaggggctgccggcggtgcgctgggtgggcggcgtggagatcgagctgctggcgttggccaccggcgcgcgcatcgtgccgcgcttccaggaactggacgcctccaagctgggctccgcggccctggtcaaggaggtcagcttcggcaccacccgcgaccgcatgctgctggtggagggctgccccggctcgcgcgcggtcacgctcttcgtgcgcggcgggaacaagatggtgctggaggagaccaagcgctccctgcacgacgcgctgtgcgtggcgcgcaatctggtgcgcgacaaccgcgtggtctacggaggcggcgcggcggagatggcctgctcgctggccgtggaggccgccgcggagcgtgtgggcggcgtggagcagtacgccatgcgcgcctttgccgacgcgctggacgtgatcccgctgtccctggccgagaactcgggcctggcgcccatcgccagcctgaccgaggtcaagacgcggcagctgacggagggcgacccccacctcggcatcgactgcaacgacctgggcaccaacgacatgcgtgcgcaaaacgtgtttgagacgctggcgggcaagcggcagcagctccagctcgccacccaggtctgcaagatgatcctcaagatcgacgacgtcatcaagcccaacgagtatgcgtga

SEQ ID NO: 5227 - DNA, 1023 bp, Chlorella protothecoides
atgttttatgcgcaatgcgccaaaggagcaatacctctctggggcaggctgcttgagccctgtcttccgactgccaccggctcccacaacctgcacgctgcacaggtggtccctcacgacagcctcctggccgcccagaacgggctcccggccggggacaagaaggcggcgggggagcttttcgccaagctggcaggcggcgggctgggtgagggaccccgcggccctgctgcgccctcggcggcaggccctgctgccatgatgaccagcgctgccgccgggcggcaggccaagcctgcggcgggggcggcgcggctgccgggggcgtttgagccgcagcccaaggcgccagagccggtggaggcagccattctggtgccccaaccccaagcccgggaggagcgagcgcggcggttccggccacgctcgctccggtacgagggtctgtcccccgacgagccagagctgctggagaaggagttccagggggtgacctcccccgagttcagggacttcaaaggccacctgcaggcagccgacaccctcctggcccagctagacctggtgtgggcaggcgtggtggccggcctggacctgatcctgcgctgggtggtcctgcgcatggccgacggcaacatgcagagcctggtgcgggtgctggagctggcgcgcgccctgctgtgcgcgctgcgcgacgctggggggcacctgacggagctggacgccctggtcttcctccctgccatcgtggagaaggcggggcacgggcaggatcgcgtgcgggcgctgcaccgggaggtgctgcacgccgcggcggggctctaccccgtcccgcgcctgctggacctggtgaccccgggcctggcctccaagtcggcgcgcacgcgcatcgagtgcgcggagttcctcgccgagcggctggacctggacggcgcggggccggccctcgccagccgctccaagcccatcagcgccgtcgcggcggtggaaggtgggagggatttgctgtctgaagccctgtaa

SEQ ID NO: 5228 - DNA, 294 bp, Chlorella protothecoides
atggcggacaatgaggctgcggtcctcgccgcagccaagaagcttcctctggacgagagggcggctcacaagacatggaaggtcaggagcgagctcttcgatgacgtgaaggacgcctgtgccaaggccttcagcagcgaggatccaatccttcaccaagcaggcgcggagggtggtggtgggcctctgtttgccaagggcctgggcgacgccaatctcaatgtccaggacacctccattgaggccctctgcgcctggctcgccaaggccgatgtacaacaggcctctaggtga

SEQ ID NO: 5229 - DNA, 411 bp, Chlorella protothecoides
atgaagaaggacgtagaggcggccatcgccgagctgccgccgggaaagcgcgccccggagcgttggaccaggcgggagcaggaggagcgggccgtggctgcggggcagccagaggctatggacgtcgacgatgaggcagagcccggccttgttgccgcggaagcggcagaggaggttgatgaggatggacctgcgcagtaccatggcttttgggcgggctctgctccaaactcggcaatggaagcagcatcaattttgatcgcactatcgtctcgtcaaaacagggtggccttctgggactgcttcgagtccaagaagtggaatgtgcggaaagctgccctggaccggctgcgggacgccgccagggccaccaggtctggttttgggaagttggaaggagtgggagggtga

SEQ ID NO: 5230 - DNA, 303 bp, Chlorella protothecoides
atggaggtggagcatcaggtgggcaagctcctggtggagctgtcaaagtcgcaggaccacgagattggggacggcaccactggggtcacagtactggcaggcagcctgctggaacaggccgagagcctgctggacaggggcatccacccgctccggattgcggagggatacgagatggcctgcaagattgccaccgcggagctggaacgcatctccacccgcttcgattttggcaccggcaccaaggaggacttggagcccctgatcaagacctgcatgacgacgctcagctccaagatgtga

SEQ ID NO: 5231 - DNA, 855 bp, Chlorella protothecoides
  modified_base (621)..(630): a, c, t, g, unknown or other
  modified_base (842)..(851): a, c, t, g, unknown or other
atgcggacgcgagtcgggggcggctcgggtcttgattggcaggaccttcaaatcagccgctccatggtccggtgccaagcgagcagtccaggtcccgtatcttccgatcctgacaggaactcagacgtcaccccgccccacacagccatcatggcgtgggccaaacccgctggcgcctgggcccaggccgtggaggaggaggaggcagagcaggcgccagccagagatgccgtcctccactccgtcacaggacccatcctcgtgcccgtggtggcgaaggagaaggagttcccctcgctcggggatgcccccgaccgcgccggcttcccttccctgggagctgcagcggccgtcaaggattccaagaaggagcggcgcaaaaagcagaccatgtccctggccgactttgtcagcacagtggatgcccccaagccgggcaccttcgttccgagtgcccgggtgggtggctccgctctgcgtcggccactgaatgacgatgacatcctgcgcaacctgcctaccacctcccgggggaaggtggagggcgacgagaagccaggcgacaggctcgggggatccttccgggactacggcggcgaccgggcaggaggtaaggcgttnnnnnnnnnnggagggcgacgagaagccaggcgacaggctggggggatccttccgggactacggcggcgatcgggccggaggtatggcgtcgatccggggagggaggggcaggctcatggtgtacaggttgtagctggagaggccggcgctgtgtgcttggagctgggcctgagtgtggggtctgtgcccattgaaaccaagactgttgactcgggtgcagnnnnnnnnnnctga

SEQ ID NO: 5232 - DNA, 885 bp, Chlorella protothecoides
atggaacgggggggagagatgatacggccggcggtgcggttcccgtctgtcaccacaacctccccggctaggccgagcccccccaaaaccggcactgtggcatccacaccccacgcgcccctcaccctggcagatgtgattgatgcggtcgtcgatcacggtgccgtgcaggggcttgaagcggaacttggcgcagcgggaggcgaggggctcaatgatgcgcgaaacgtagttgcagatgatgatgaagcgtgtgacgcgggagtaggtctccatcgtccgccgcagcgcagcttgggcgtcctgcacgccgcgggggagtccaaaaaggtaagggtaactgcgctcgtctccgctgcctggtcgagtgtgcgcatgtgcgggtctgcgacccaagccggctcctggggctgcactgccacccctcagcatgcaatggcctccgcgtcacccttcctcctcttaggaccccccgccgccactcacggtggtcattgcatcggcctcgtccaggatgatgaccttgtagggtggcacgcttcgacccgcgggcgaggcgcccaccgagatggccgcaaaggacttaattttgttgcggaccaccgcgatgccgcgctcgtcggaggcgttcagctccagcacccgcgcacggaggaggtcggcgccaaacagctgccggactatggccagggcgcaggtcgtcttcccggtgccgggagggccatagaacaagaggtgtgggagctgcgagaaagtgtgtgtagcgggtggggtcattgggacaggccatttagagaacatacatggagcggcaccccctctgtatgcttccatggtcagaaaggcttcaaggatcccattcgagatttgaaagcaaccccttga

SEQ ID NO: 5233 - DNA, 681 bp, Chlorella protothecoides
atgcgccgcgccatcaccacgctgcagagcgcggtgcggctgggcggctcgccggtgcggccgcagacactgatggatgtggcgggggtggtgccggacgccgcggctcacggcctgctgcacacctgccgtgagggtgactttgcgggcgtgcaggccgccgtggcggacctcatccacaagggctacccggtgcgagggtttgagagggcttggaagtccgccgtggcggacctcatccacgagggctacccggtgcgagggtttgaggagaggttggaaggtttcgtgggggacatgtatggaggagggagggtgtggagcactggggctgagtcaggagggtcgagtgcgagcgaggaagacctggacccacacccatccctcacgctcccctccccttcatcacaatcgagacgcacaggcccaggaggtgctggcagaggtgcagggcgcggtgttggtggaccccggcatcgacgacgtgcgcaaggccagagtgttggagcggctggcgctggcggacaaggcgctgatcgatggcgccgacgagttcctgcagctgctggcggtggccagcctgacgcagcgcgtcatcctcggccaggcgtgagcgcgcagcgggggtggttgggatgctccgctactgggagcagaggagcccccgggagccccgactga

SEQ ID NO: 5234 - DNA, 429 bp, Chlorella protothecoides
atggccgaggacgctgtgggtcgtaggcagaaatcctgcaattgcaggagcgcgcttgtcaccccatcccatcccccaccccccacccccaccaactcaggcaaggtgacccgcgccagcgccctggaggtattcatactttccgctctggccaaggccggggccacggtggtcacctaccccatgctgacggtgaagacgcggatgatgacggcgcggcgaggggacgcagacatgcagtactcctccgtgggcgacgcggtggccaagatctggcgaacggagggcgtgccggggtactaccagggcctgcgccccaagctagtgcagagcgtgctggccgcggcgctgctcttcatggccaaggaggagatcacggcggccacccgccgcctcctccttgcccggcccgtccgcgcaacgagctga

SEQ ID NO: 5235 - DNA, 1284 bp, Chlorella protothecoides
gagacgggggagggcctgcccgccgcggtgctgcagtacgcggggcgcagcctgctggagtcgctggtgcgcgacacgctggcgcgcgagcacctgcactggcgcctgcacggcggcgcgccgcgccccaccacgcccgtggccatcatgaccagcgcggccaagggcaacgcgtggcgcgtggaggcgctgtgcgaggcgcgcgggtggtggggccgcgggcgcgacgccttccgcctcttctcccagcccctggtgcccgtgctgagcgcggccgacgcgcgctggctgctgcccgcgcccctggccccgctgatgaagccgggcgggcacggcgtcatctggaagctcatgctggacgagggcgtgtacgactggctgcgcgggcgggggcgtgccgccgcggtgctgcgccagatcagcaaccccctggcggggacggacgacacggcgctggcgctggcggggcggggcctggcgcggggcaaggccttcggcttcgcctcctgcgagcgcgtggtgggcgcggcggagggcgtgaacgtcctggccaggttcgcggacgagggcggggatggcggcgacgccgccctcccgccgcgctacgcggtgaccaacgtggagtacaccgagttcggggcacggggcctggtggagcaggcctgcgggtcgggcagcgggcacagcgcctaccccgccaacgccaacatcctgtacgccgacctgcgcgcggtggagggcgcggtgcgcgccggcgcggccgacggcgacgccgccgccctgctcccgggcctcctgctcaacacggggaagcgcgtgacggtgcgcgatgcggcggcggggggggccaccaccacgctggccgcggggcgcctggagtgcaccatgcagaacctggccgactgcttcgccgcgccgctggggccggcctgcggcggtggcgcgggccccgaccacgcggccgaccaccacgcggccgacgaccacgcggccgacgacccggaagccgacgacgggctgcccaccttcctggtgaccaacgtccggcgcaaggtcacctcctcggccaagcgcgcggcggcgcccgggtccacggccatccaccagacgccggtgggctcgttctacgacctccagctcaacgccgccgagctgctgggccggtgcggctttgacgtgccccaggtactgtgtcatgtttgttccctggccgtgtctgtgtgtgcgtgggtggtgggaagagggggaggtacacggaggtgggagtgcagcatcggcccatga

SEQ ID NO: 5236 - DNA, 267 bp, Chlorella protothecoides
atggtgtggaattttcacccctttagcgcccgtccgactcctccacccgatcgatcccacactcgcctgccaccattcacccccgcagtcatccgcgaggtcttccacgagtatggtgtccctggcttctggaatggctgccaggcctctctggtcatggtcatcaaccccacgctgcagtacaccctgtacgagtggctggcaggagtgcgggccaagttgagagcccagcagacaggtgcgggagctggggtggggcacgcctga

SEQ ID NO: 5237 - DNA, 474 bp, Chlorella protothecoides
atgcatcctgcctgggcggtcctcccctctcactcctacctgctcgcagtagcacaccatcattgtgccctgcacgacctggagcctgcactcaagcctttacccctccacccccactcccatctcagggtgcgtgacttccaggtgcaggacaccttcccctacggcatccagctcacctggcagaaggagggcgagcgtgtgaccagcaccgtgtttgagcgcgggtcccacgttccaagcgccaagatgctgaccttctaccgcaccgagccctttgacatcgaggcggcctacacgccggagtccgacctgcccagcaccgccgacgcgcggattggtgggtcggggggaggggcgatgtgttgggggcatggagggctcgtgtttggagaggagggtgtggagagtggccgcacggctccggagggactgccgtttggggctgccatgcctcctcagcgggtgctgtga

SEQ ID NO: 5238 - DNA, 651 bp, Chlorella protothecoides
atgcttgacgaggaccggaaggaccaccccccacccacccccccacctgacaaagtgctcgaagaggacattgtcaaagttgcggccgcccagatcgcggtcccaggcggaggacaggaccttgagctcgcggccgcgcagcgccaccacgcagacctgggtggcggagtaccccacgtcgatgaaaacgacgttgacgggggtgtcctccggcaggtcggtgcgatagatgccccaggccagcgcggtggcagtggtgtcgttgagcaggcgcaggcacttgaggccggcggtgccggccgcggccaacatggcgtgccgttccgcctcggtgaagtacaccggcaccgccagcacggcgtccgtcacgggcgcgccctgctcgcgctctgccagctggcgcaggtccaccagcagtgccgccatgagctgctcgggggagaggcgcgtggcggcgcccaggtactgcacctccacctcgcagccgccgtcggcgccctccaccaccttgtacggcaggtactgcaggtcggcctggatggcggggtcggaaaacttcttgcccagcagccgcttgacctggctcacggtgttgcgtgggttggtggccatcgcgcccactgtgcgggagacaagagagggaggaattga

SEQ ID NO: 5239 - DNA, 702 bp, Chlorella protothecoides
atgccggaaccccgctttcaacctactcaccaacggttctccattctcacaaccaacagggagtttgatgccaagtacaagctggacatcaagggcaacctacgcgccagcttccgcctgcgcggcgcatgcgagaaggccaagaagatcctgaccaccaaccccgaggcggtggtcagcgtggagtgcattgccgacgacaaggacgtggcagggtccatcacacgcgaggtgtttgaggaggaggccaaggccaccctggacaagctggtccagaccgtgcgcaaggaggggcggcgactctgtggttgccatggagaggggaagacggggcctggctgcatcgagcgcgcacaactggatctcagcaggtcaggtgcctgcctgcgcatcccaatcgctactccacccccgtttcccctcctgcttcaactccaggctgtggaggacgcggggctgacccccgagaccgtgagtaacgtcgagtttgtgggcgggtccagccgcgtgccggccgtcacgcgccacgtcaccgactactttgggcgcgagcccaaccgcacgctgaacgccaccgagaccgtgtctcgaggctgcgcgctgcagtgcgccatgctctccccggccttcaagtgcgctgcatggcctgtgttgttgtttttttgggggggaggaggtggggcgcagggatgtagggggtag

SEQ ID NO: 5240 - DNA, 336 bp, Chlorella protothecoides
atgacccaggacccggcccccctgcccgaggaggacgcgcgtcggctgagctgggaggccgccaccgagcgcttcctggacgtgagcgagctgcgggaggaggacctggcgcggcgcccgctggactcggccctggaccgcctggcctacgcggcgcacaacagcctgaccggcgtggagggcctgcgcgccgcggcgggggctggggccggcacgcgcgacaacccgcagcgcctggacgactacgaccccgcgctgtccctgcgcggcggcatcttcgactccaagaagcgggcgggggggagggcggaggctgtgacgcgggcgtcagcctga

SEQ ID NO: 5241 - DNA, 969 bp, Chlorella protothecoides
  modified_base (551)..(560): a, c, t, g, unknown or other
  modified_base (836)..(845): a, c, t, g, unknown or other
atgccgctccaaattcacatcccacaaacaccctcctcatccccctgcccgccccaggaaaaggcacaaaaggatgccggcctggttcctggcacctccgcccccggcaccgacgcgaacaaggaggaggccgactctcgctccgtctacgttggcagtgtggactacgctgcgacgcccgaggagctccagtcccacttccagggctgcggcaccgtcaaccgggtcaccatcctgtccgacaaggccggcaaccccaagggctttgcctatatcgagttcctggaggcggatgccgtgtccgccgcgtgcctgctggacgggtcggagctgcgcggccggacgctcaaggtgaaccccaagcgcaccaacgtcccgggcatgcgggcgcgcgggcggggtcgggggcgcggcggcgccggcggctacatgatgcccccgcccttcatgatgccctggatgtggggcggctcagctgcatcaaccggtcggacccttcttccactgggtcagtctgctcgctgcaatcgaaatcaggaaagactcccgannnnnnnnnncgctacagctcagctgcatcaaccggtcgggccttcttccactgggtcagtctgctggctgcaatcgaaatcaggaaagacccccggagctcgccatgtgggtcgccttgcatgccctctctctgccccgccgagcgatcggccgcagccagagccccctcccacaccgaaagttctgactctgctgactgcacaccgccttgcaaaacagcaaacacgtgaaagatgcacagggcggtaccttgcagcgcttttggtgaagcagcaaaggagggnnnnnnnnnntgggtcgccttgcatgccctctctctgccctgcggagcgattggccgcagccagagccccctcctacaccgaaagttctgactctgctgactgcataccgccttgcaaaacagcgaacatgtga

SEQ ID NO: 5242 - DNA, 1101 bp, Chlorella protothecoides
  modified_base (494)..(503): a, c, t, g, unknown or other
acgacggcggccgccgccagcgcttgcaggtcggcgccggcccagccgcgcgtggcggccgccaggcgggccagcagctcggggtccggcggctgcggccagcgccgggtgtgtgcacgcaggacgccgaggcgctcgcgcgaagatggcaggccgacttccacctcgcggtcgaagcgaccggggcggcgcagggccgggtccaggctgtctggcgagttggtggcgccaatcacaaccaccgcgccgcggttgcccaccccatccatgaggcagagcacggtggaaaccacagaggcaaatgtctggtcggagggggagtcgtggcgtgcggtgcgcgcgggcgccagcgcgtccagttcgtcgaagaagatgatggagggcgcgcggcgtgtggcctgcagtgagggggggcctgagattggtgaggaggggttgattactggagagggctgcggtgaggagcaagtaagggtgttgaagagggctgcccnnnnnnnnnncagttcgtcgaagaagatgatggagggcgcacggcgtgcggcctgcagtgaaggggggcctggaactggtgaggagggggtgatcactgaagagggctgcggtggggagcaaggaagggtgatgaagagggctgccggggcgatggcgagcgggcgagaggaagagtgggggagagtgagggatactcggaaactcacagcctccctgcatcccctgcttctggcactagtcatcccacccaccctcctcgcgcagttgcctgccgtctcccggcaaacagcgcctcacctcgtcaaagaggaggcgcagcgtgcgctcggcctccccatggaacttgcccaggcagtcggcgccgctgcggacgaagagcgagacacgcgaggccgcaaacgcagcgcactcgcccgccagggccctgacgatgagggtcttgcctgtccctggaggaccatgcagcagtatgcccctgggtggcaggataggcagggaggcatagcggatgacatgggcaggggtgtcggccaggggcgacggatccttgaatgcattaacagaaggagaggggacggcgtctcttgcccaaccccattctgctga

SEQ ID NO: 5243 - DNA, 282 bp, Chlorella protothecoides
atgtccctgtcgcaatgtcaccaccaggtgtgcgagacacccgagggaggattgaggggggtggctggagaggtgcggcgcgggcgagccctgcgatgtgcccactgcggcaagcgcggggcgtccctgggatgccgcctggcctcctgccacagctcgttccacgtggcgtgcgcccaggccgcgggggcctccttcttcctgggcagcttccaggtggcatgcaaggcccatgccaggctgtttggcggggagcccagcgtgcccaagctcctggggtga

SEQ ID NO: 5244 - DNA, 480 bp, Chlorella protothecoides
atgtcatccactatgcctccctgtctatcctaccacccaggggcatactgctgcatgggtatcgaggcgccaacgggggtcatccacgacctacgcctgaccgaaacttcagcagaatggggttgggcaagagacgccgtcccctctccttctgttaatgcattcaaggatccgtcgcccctggccgacacccctgcccatgtcatccgctatgcctccctgcctatcctgccacccaggggcatactgctgcatggtcctccagggacaggcaagaccctcatcgtcagggccctggcgggcgagtgcgctgcgtttgcggcctcgcgtgtctcgctcttcgtccgcagcggcgccgactgcctgggcaagttccatggggaggccgagcgcacgctgcgcctcctctttgacgaggtgaggcgctgtttgccgggagacggcaggcaactgcgcgaggagggtgggtgggatgactag

SEQ ID NO: 5245 - DNA, 330 bp, Chlorella protothecoides
atgcgggcccccgtccctcccagcaaccgcgctgccggatcgcgccagcgggagctgtcgtcgtccgacgaggagcacctgcggtccagggaggcgcagcgggaagaaagggagatcgccagcctgcagcccgtcctcctgggcgccgagccccagggcgagggcgatggtctgtacacccgacccctgaccacgtttgctgatgtggcggggatggagggcgtgaaggccgcgctgcgcgagatggtgctcctccccctcctggccccccaggtcctgcaagacatgggcatctccgctccgaggcagggaagggagaaggcgggttga

SEQ ID NO: 5246 - DNA, 738 bp, Chlorella protothecoides
atgagagtcgctcagggtttgtatgggcagcccaccatctccgtggagccatgcggacgagtggtggtcctgcacacccttccccaccatcgatgccccccgcagggcatgcttccccccgagacagctgcgctggcggcggcggggtccgccgcacgtggcgcgacagccttcctcaacctggagccctgggaggaaagcgggattgctgcgctgcgcgcctcgggcatctcgcgcgtcgtgctgggactgcgccacccgctccccgctttctccggcgtcgccgtggcggcgttgcggggcgcgggcgtcgaggtggacatcctgggcgagacacaggtcgggccgggcgctgcaacaaacgggccgggcgccggcccccacgcccaggccgcggcggccgccggcgacgggcctgaggcgccggcggcggcggcgctgcgcgcgagcctgcacgccaacgaggacctggtgcaccgcgcggcgctgcgcctgccgctgagcctgctcaagtacgcgatgacgctggacggcaagatcgcggccagctcggggcacgcggcctggatcagcagcgccgcctcgcgccggctggtcatggaggagcgcgccgcctgcgacgccgtcgtcgtgggagggtgcacggttcggcgcgacaacccgcgcctgaccagccgcacggagggcaagcacaaccccgtgcgcatcgtcatgtcacgcaccatggacctgccagag

SEQ ID NO: 5247 - DNA, 822 bp, Chlorella protothecoides
atgggatggaggtcaggaggtggtaatgttacctgctgtcgtgtgtgggactgctgttccggtgtacgagtgcgcaccgatcacccctcacccctctgtgcgaccacgcagcccaagaccgactacatgaacctgcctcagcctgtgcgctacgatgagctacagcgggagatcatgaccaatgcgcaccgtgggtcttggggactctacctcgcgttgcctcccgccggccgaggtataacgttctgggccagtcctgcctgcggattgagcccttgccacatggctctggatccctctcaccccttgacccccctcccgaccccgccccccaccccagtgtcgctgaagcccgacctgtttgagggcatgcgcctggagctctccaagcccctgaaccacaactttggcctgtcccacagcgtgtacatgggcaacctggaggtgcccaccgccaacaaccagcccgtgaagatgcccatcggcacctacgagtttggcgccaacctggtgaccaacagcggcaacctcatgctggggcgggtgaccaccgacgggcggctgacggggcgggcggtgtacaacctggcgccctgggccgcgctcaagtcccagtttcagctggccggcgagccggggatgagccagggcatgtttgacgtggacgtgcggggcgccgactggaacggcacgctcaagtatggcaccagcaacttctacggcgccaactacttccagtccgtggcgcagaacctgtcgctggggggggagatcttctacctggcggagcagcggcgatctggtgggtggcgcaggctttga

SEQ ID NO: 5248 - DNA, 1362 bp, Chlorella protothecoides
atgtggcacccaaacggtacgattccggcgcaaggtggagggcctgatagggcagtgaggctgcaggaagacccagtcactcttgcccatgcctccgtccctgcagtgttcccggacgggcgcgtctgcatctcgatcctgcatgcccctggcttcgaccccttgaaccctcaggagagcgccgctgagaagtggagccccgtgcacaccgtgactcccaagtgcttaggcccggcggctccagacatcctactcagcacagccctgctaccagatcagcattccattcctttcccccctcgctcttcaggtggagagcatcgtgctgtccatcatcagtatgctatcctcgcccaacgacgagtcccccgccaacatcgacgccgccaaggagtggagggagaaccgggcagagttccggaagaaggtggcacgcatcgtcaggcgcagccaggaggagctctgatgctggatgcaggacaagagtgctgtgtggaagcgagcccaggacttcctcctgggtcacctgtggttcatgatgagcaggcgtgcagcagccccgtgcagcagcattcttacatcccctgccccacaggtgctgctgccagctacctgcctcctgtacctcctcccccattccctgccacgttgccgggccctcaccacccccagcccaaccccctcctctgtcacaccaacccagcgaataacattcatggcaccgcctccggcacatcgcaggggcgagggcaggcatgctcactcgccgacgttcaggccaaagccaaacttgtagtccttcttcacgtggtccagttcggcagacagcacaaaattgatgcccaccgacagcctctcctccacctgcgggggggacctgaccctgggagcgcgtgcttgcaaggctcggcacggcaaggctgccaggctgggcgcgtgaccgccccctcccagctaccccccctgccccaaaccgggcgcgcacgcaccggtgtcgatgcggccgcggagtcgtgcctgcctcaggatgtagtcgtacccgaacgaggccgtcgcctcgcgcgagttcttgttgaacacaaagtcagtggacagggtcacctgaagtgggggggggcaaggctcacaactgagcgacagcaggccggtgttcgccacctggaccgtggcgatcgaggtgtcggtggcgtgccgcgccgccaaaccgatgcctgcgcgcggggcgcatgcgggcagggtgtcactgggacgcttgcaaggggtggaggcgtgctgtgtatgcacccgggtggtcctcctcttcaatcaagggacacgcaccgtgggatcaaacagtcttgcaagcgtctgggattcccataa

SEQ ID NO: 5249 - DNA, 717 bp, Chlorella protothecoides
atgccccctgcgcatggaaccggtaatcgaggtgccgggcgcatggggagccgtgtgacccgaaccggtcgggtgctggaggatgttttcttcaagaaagccaaggcagctgggtacgtggcccggagcgcctacaagctgctcgagattcaggagaagcaccgcattattccgcgagggggacaggttctcgacctcggatgtcatcccggagcatggttgcaggtcgcctgtcaagccatcgggccacggtctgcaggaggggctgtgctggggatagatctccaggaaacatccaagcctggcaagtggtgcgatgaccgggtggttgttgtgcagggtgacgctcgcgagctgacactggacttctggcaggagtacgcgccgacggtgagcgaagtgtcagttgaacaggttgcagcatcgtccgctgaagagagatctccctttcacttgattgcagtttccctcatgccaaccgtcaccctagcacgaggtacaccgcccttcctcactttttccacacagggaatggatgtggtgctgtcagatatgtgccacttcacgcatggcaacaagatgatggactcctacaaatccttagagctggcgcagactgccgttgacattgccatgtcggcaggcccagggtcgaatggaatcctgcgacctggaggcagcctcatcatgaagcttctgcaggtaaggagggtgtaa

SEQ ID NO: 5250 - DNA, 1365 bp, Chlorella protothecoides
  modified_base (716)..(725): a, c, t, g, unknown or other
  modified_base (1235)..(1244): a, c, t, g, unknown or other
atgccatcaccaacaaacaccaacagatcgcggagaaggcgacggtgctgcctcccctaccagaggaccgcttcctgtgcgggttttcccacatctttgccggtggatattctgcagggtacttcaggtgcggaggccgaggggggggggggtcatatcgcaagctacaagtgggcagaagtgctgtctgccgacgcctttgccgcctttgaggatgcgggcttggacaacgaggctgccgtgaaggagactggacgccgcttcgcaaacactgtgctggccctgggagggggtcgtgctcctcacctcgtgtttgaggaccttgacaacctgctgtctgcgctgtccgaggggatccactctacttctttcaagaaagaaaactttgctggacatcgctgcctcatgctgccgatgtgtcttctactccttcccacaggatttccgcgggaggcagcccacggtggatgctctgctgaggcacaacaaccttgtcactgctgcttaggccgaggatggagaggttgcgtggctcaagcttgccccctggcatcccctgaatccagcaaatgcatgtggtacctttgtccgccactggatggctcttcgacctcgtggacctgtcgaagagccttgtgccccaatgcagcgagcgaagcgcagggttacctcgaaggacgctgcaggtcgaaagagcgttgtgcaataacccctgnnnnnnnnnntgtggcacgcaaggtacctttgtccgccaccggatggctcttcgacctcgtggacctgtggaagagccttgtgccccaatgcagcgagggaagcgcagggttacctcgaatgacgctgcaggtcgaaagagcgttttgcaatcaccccttcaagccacagaaacacgatctcattcctgaatctgcactcagaaggctcatcaaggtactaacatcactgcgtagtcatcaaaactcaccgagacatagcatggaagtctggtcaggcggagtcggacaggtcggatggggagtggcgtttgaggccaatgaggtacacctccttgctctcgctcctggtagcctttggccgctgccaagccaccttcttgaagtagggacgcatgtcagccgcaaactccattgtgccaggcccctgcaggagagagacaatcgacatggccgagaacagaggggctccttggtgtactaccccgctgccgctcctgcaggagctgctgtgcactttcnnnnnnnnnngccgcaaactccattgtgccaggcccctgcgggagagagacaatggacatggccgagaacagaggggcaccttggtgtactcccccgctgccgcgcctgcaggagctgctgtgcactttaa

SEQ ID NO: 5251 - DNA, 2703 bp, Chlorella protothecoides
  modified_base (1061)..(1070): a, c, t, g, unknown or other
  modified_base (1280)..(1289): a, c, t, g, unknown or other
  modified_base (1750)..(1759): a, c, t, g, unknown or other
  modified_base (2372)..(2381): a, c, t, g, unknown or other
  modified_base (2486)..(2495): a, c, t, g, unknown or other
  modified_base (2650)..(2659): a, c, t, g, unknown or other
atgccaacatcacccggcctttctttcttcctgctcactgtgcttgtcacagatgttgacggacagcattgcctccctaaaagtaccatatctatcatagtatgggtgccccatcgatcacctccccccccctcctccccatgtcatcagagccagccgctgtacgcagccttcagggcgctcaaggacggcccagaatgggcctcgctgtccgaggcccagcgccgtgcggtggacctggagctgcgcgacttcgtgctgggcggcgtggcgctggagggcgaggcgcgcgaccgcttcaacgccatccagcaggagctgagcgcgctgagcaccaagttcagcaacaacgtgctggacgcgaccaaggccttcaagcgcctggtcaccgacagggccgaggtggcggggctgccgccctccgcgctggccggcgcggcgcaggccgccgcgggggagccggggtccgaggccgccacgcccgaggagggcccctggctcttcacgctggactttccctcgtacttcccggtcatgacgcacgcggagaaccgcgcgctgcgcgaggagctgtaccgcgccaacatcacgcgtgcctcggcgggcgcgctggacaacacccccgtcatcgagcgcacgctggagctgcggcgggagaaggccgcgctgctgggctacgcctcctacgccgagctgtccatggccagcaagatggccacgctgggcgaggcgcaggcgctgctggagcagctgcgcgccgcggcgcgccccgccgccgaggccgacctgcgcgacgtccaggcctttgccgccggccgcggcttccagggcgacctggcgcactgggacgtcaccttctgggcggagcgcctgaaggaggacaagtacagcatcagcgacgaggagctgaggcccttcttcgccctgcccaacgtcctggagggcctgtttaaggtgagcttggtttcaggggaggagggggtgttggggaggaagaaaggggaaggtgagatgtcggaggctgaagggaggggccttggaacaattccaagggactgcgnnnnnnnnnnggagctgaggcccttcttcgccctgcccaatgtcctggagggcctgtttaaagtgagctcgatttcaggggaggagggggtgttggggaggaagaaaggggaaggggaggtgtcggaggctgatgggaggggccttggaacaaatccacgggactgcttgcgcccacccttggatccagctcctcgatcctgcactcttgatgggaacgnnnnnnnnnntcctgccactgtgctacccaaaggaaacttgaccatcgaggccgctgacggccaggcccccatatggcacccggacgtcaggttcttcgcggtgaagaaggacggccagcccaaggcctacttttacctggacccctactcccgtccctctgagaagagggggggtgcctggcatcgctgctcactgctccccattcctcccgtcgccaaggatggacgaggtgtgcggacagtcacgcctgttcgctcaggatggccagtcggtgcgcttgccggtggcgcacatggtgtgcaaccagacaccgccggtgggggacaagccctccctcatgacattcaggtgacttggggcctgaggcagggtgtgggagatgtggctgagggatctgacaacagcatggagatcaggacgggtctccccgctgctattcgccatttggtaccagacgttccttgccttnnnnnnnnnnggggcctgaggcagggtgtgggagatgtggttgagggatctgaccacagcatggagatcaggacgggtgtccccgctgctatccgccatttggcagacagtgaaaattttatccccgtgcctgtcttcagggaggtggagaccctgttccacgagtttgggcacgcttcccagcacatgctgactcagcaggaggagggcctcatcgccggcatccgcggagtggagtgggacgccgtcgaggtggggtgggttgcaccgggatggcacaggggctcggcgcggagggctgtctgggatgacttcttgagaacccggtgcagaagtcctcttccagcgcgggtacgatgcaccatgtcgctacgcatgcgttgccaacccagtctcatgacctgttcccgccgatccacccctgccgcgcagttgccaagccaattcatggagaactggtgctatgacaggtgcggcgcggtggcgaagggatggatttcaagctgccatggctgtgctgctgcgcctggtggggcaagaccggttgtccagcgctggagccgtgaatatacatccataagctctttcacacaccccaacaaaccacaggcaaaccctggatnnnnnnnnnngtgggccggttgcatgggcaggtcgtccctagggtgtgccccccctatgccttccaagggatgtgctgggcaggtgcaaaaccccagaggccccacgccccgcgnnnnnnnnnnccagcgctggagccgtgaatatacatccatcagcttttacacacaccccaataaaccacaggcaaaccctggacgggtttgcgcgccactacgagaccggcgagaagctgccggaggacctgtaccagcgcttgttggccgcgcggacctacagnnnnnnnnnnagaggctggatgtgtctcgctgcatgagctacttccgacgatga

SEQ ID NO: 5252 - DNA, 417 bp, Chlorella protothecoides
atgcggtgcgacatgcaccttggccaggctcgatggttcactttgtaccatgatggcaatcattccgccatctcccacgtccaggactcccccttgccggccttcgacgccgtgaggcccgaggacgtggtccccggcatcagggaggtcctggctcgccagcatgccgccctggacgagctggagaaggggctgcagcccacctggtccggcatcgtggacccgctggagcgcatcgcggaccgcatggcacgcgcctggggtactgtctctcacctgaaggcgagatggttgtttgcggccgtcaaggacaacccggccctgcgtgaggcggtggaggaggtgcagcccgagaaggtcaagctttccctccgcctgtcccaggtactgagatgggacgggggtaaggtattgtga

SEQ ID NO: 5253 - DNA, 612 bp, Chlorella protothecoides
atgcgccccgcgcgcaggcatcggtttggcggcgcggcacgccaccgacacctcgatcgccacggtccaggtggcgaacaccggcctgctgtcgctcagctacctccagcgcgtgaacgagaaggtgaggggctggggggtgccagcgccgatgccctctccaagggatgcacggccgtacttgtgaccctgtccactgactttgtgttcaacaagaactcgcgcgaggcgacggcctcgttcgggtacgactacatcctgaggcaggcacgactccgcggccgcatcgacaccggtgcgtgcgcgcccgggggggtagctgggagggggcggtcacgcgcccagcctggcagccttgccgtgccgagccttgcaagcacgcgctcccagggtcaggtcccccccgcagctggccgcttggaaatatcagacccgcattcatggaactgtcccccctcacacgccctcgacccactcctgtcgccagacggcaagattggcgcgtacgtggaggagaggctgtcggtgggcatcaattttgtgctgtctgccgaactggaccacgtgaagaaggactacaagtttggctttggcctgaacgtcggcgagtga

SEQ ID NO: 5254 - DNA, 705 bp, Chlorella protothecoides
  modified_base (56)..(65): a, c, t, g, unknown or other
ggtttttgggacgggtgtgttcacatggcaagccggagcaccggtgggggctgggnnnnnnnnnngtggtcgacagggggtttgggacgggtgtgttcacgtggcaagccggagcaccggtgggggctgggaggcagcgcacggggatggcatccgggagtggggcttccttggacgggctgggctccatatgtgaggagccaccccctcagaccccttggcaccgcatgggctcatgctcccatatgccgcttgccctcaacctccccacccatgcatgtgcaggaggactttgactttgagggcggcctcgccaagttctccaaggagaagatcgatgagggggtcgttgatgccctgcccaaggagaaggtctaccaaaaggacgacttttttgacgagctgtcctgtgacgccctgagccgaggcccccacggtgtgtacatggcgtttgctgtcagtcggggtggggctgctcagggggggtggatggcggatgcgcagttcctgcctgtacagtcatgctgcgccccccgcatgggctgggaatgcgtgcggccggatggcagggcgcgtgcaatggcgcagcgcaagacagactttgagaccttcgggaagaccggggatgtaaggcggggaggcttcggacgaggcgacagggtgagcggggaggacatttgtttcggggatcgattgagagggtga

SEQ ID NO: 5255 - DNA, 816 bp, Chlorella protothecoides
gtggctggcgagacggaggtcaaggcccagatcaagctccgcttcatcaccggcgcgggccagcccgtggtggttatccgctccttccagctcacccagcgcaaggccagcatggccttcaaggcgctggacaatgttctgcagacggtgaaccgcgccacgggggcgcgcgaggcgctttcctaccgctgcgccgacatcgaccgcgccatcccctcgctcatgggcgtgtcggcggcggtgctggagtcggtggtgttcgtacaccaggaggacagtaactggccgctggccgacgcgcaggcggtgaagaagcgcttcgacgacattttcgccgccacgcgctacaccaaggcgctggaggcgctgcgcaagctgcgctccgaaaagaccgcggaggccagggagatgcggctgcggctggacaccctgcgctcgcaccgcgatggcgcacgggtgggcgggacggcggagggggggagcaaggagggtgggggacccagggtttgctggggaggagcggcatggaggcagggctcaggggcgtgtggctgtgggcggcacagactgtggctgccgcacaggatccggcgcagggagcacgtgttggacatgcacagcgacggcgatcgcaccctgattccttcaaaccaacacaaccgtcagaggctgcggggcgcggtggaggcgggcgaggacgcgctggtctcgctggaggcaaggatcacggagctgcagcgccgcatcgaggtgagggtgggaagaggggtgtgggaaggtggggttgtcagcatgccggcagggaccgagccgtga

SEQ ID NO: 5256 - DNA, 912 bp, Chlorella protothecoides
  modified_base (676)..(747): a, c, t, g, unknown or other
atgcaccgcggccagggggagtatccgcccgactgcgacgcgcggcgcgtcttcgtcaccggcttcactggctcagcgggcacggccgtggtgacctcagacgccgctctgctctggacggacgggcgctacttcctgcaggcggagtcgcagctggagagcggctggacgctgatgaagcatggcacccccggctgccccgaggtgcgccggccgcctgcctgtttgccggatgcatcgctgctgaccggctctggcacctcgatgccgtcccgcggctggcgtgttgttcactgtgcaccatatcgaggactggctggccgagaacgtacccgagggctccgccgtggggtacgacccctggctgcacacggtggcggccgcggagaagctggaggcggccctgacggagggcgggcgccggctggtccccctgtccccaaaccccgtggaccaggtgtggggccgcgcccggcctgccgcccccgccgcgcccgtggccccgcacgcgctggagtgggcgggcgtggcggccgccgagaagctggccgacctccggcgcgccatggccgcgctccgcgcctcggccctcctggtcaccgccctggacgaggtggcctggctgctcaacctgcgcggcggcgacgtcgcacacaatcccgtcttcatctcctannnnnnnnnnnnnnnnnnnnnnnnnnnnnnnnnnnnnnnnnnnnnnnnnnnnnnnnnnnnnnnnnnnnnnnntgcctggtcacggccgacgccgccacgctgttcgtggacggggccaagctgggcgaggccgcgggggccgcactgcgcgaggccggcgtcggcgtggccgcctacgaggcggtgggcgacgcactggccgccgcggcggcggaggcgcggcgcacctccacccgt

SEQ ID NO: 5257 - DNA, 678 bp, Chlorella protothecoides
atggcgggcatatataatgggcccgcacgtggtggcaccagggggggcaaggaccagttcaactgggagagtgtgagagcggaccaggacagggaatattacctcgggcacagcgtggtggctggagagtgtatcacaacatgcgtctcccccccgccacaggtggcagaagggcaaggatgtatactggtacacccgcgagaaggagggggatgcccaggcggcacgcgaaaaggagctggccatggtgaagcagcgggaggaggacctcatgatggaggctcatcgacccctgatcggctgatgcagagtgcagagttgcctgaacatttaaatgaatctgatcgaaatctactactgctaagaagccactcactatgccctgccccctctccaggcgctgggcatgaagccgcggccgccaaagccggtgacacagcccaagctggatggtgcggacatgcagaagatactgcatggggccggcgacgctgccgaggaggaggacccgggcgcagaggatcgggtgaaggggctgggcttcaatgcctcccgcctcacgtgagtcggtggagggggcgctccatgcatcccatgtactacgctcacagtgcagcaagagggatgcgtggcaagcctccacaaccagcccagccgccggcccaggcccacgattga

SEQ ID NO: 5258 - DNA, 603 bp, Chlorella protothecoides
atggcgcggtcatgggcattgagtctcctatgtgtggccgccgtggcaggtgttgccctggcccagaccatgtacccgtcccagtgtgaccccaccaccgtactcaccccgggagacttgagcattctcgggccggaacaatttcttgtggcaggtacgatcacccagcctccccacattcctggccccctgtcaggcggcgtgaataacagctaccacatgttcaacaccctgaacatcaccgaacccgtccgacccttgctgctgctgaatggcatgggggccacccagtacgagtggcccccctccttcctggcctggctgtcgcaggggtcccgacccgttgtgaccctggatcatgctgggatcggagggtccactttcctcgccgccacggcgccctccatccctctgctgaccgagaacaccgcggcattcatggccgccctgtcagcggcgcacccagataccctactgcctgagtatgacgtgctgggctactccatgggagccatggtcgcgcagtccctggcagcttccttcccttcctcggtgcacgccgtggtctccggtgcgaggcccgggaggggtggtactgtatag

SEQ ID NO: 5259 - DNA, 864 bp, Chlorella protothecoides
atgcctgggtcagacagttcttttttcacacatgttgcttgcctcctctactttcttctcacacccgccaatgtctgcccacgcaggcccccagcatactgggacgactggatgaggctcaactccacgagacagggccggcagtgcatcaggtgtgtgtgtgagctgccaggcatgtgctgcaggctagagaccgtcacccaccctggtctgagagcggcggatgattggcaaccccctcctgtggccccacaacgctacctaaccgctggcacccaggcccgaggtcagccgcacctacaattttggcgagcacggctcgagcaagggccagtacttccgcaccttcctcaagcccgtgactctggccagcgaggccatcgactgggcgagcgaggacctgagccacctcctgccggacgagtgagggagagggttgggaagggggggcgggggatcgccggcaatgtcaatcgcatccttgcaacattgagatgcggctttactttattaagatcaggcctaagagccagtttcattcgccacaaggcaggcggcagtcagcctcaccaaacattcctcactcacccagaaaccccccgccttccaccacaggtatgccacgcgcttcgaggcaatgctggcctccgcgcccacgctggccgccgacgcggcatggacctccgctgccggtcccgtccgcgtggagtacgccagcctgcaacagtaccggctgatcacggggaggtaccgcatgctgcgcgagtggaaggacggcgtgccgcgcgccgcttaccgcggcgtcgtgcgcgtgagaaacccgaacggcgtggaggtgctcatcgcgccggtgccggggtttga

SEQ ID NO: 5260 - DNA, 468 bp, Chlorella protothecoides
atgtcgttcaagaagatgaggcggtatggaaaagacccagccgtcgtggccgccgctctgaggtccagcgagctgctggaggtcagtctgagcggcaaggcggtgcggcgcagggagccgctgaaggcggtggaccactccgagctgcgttccaggacgctgctcatcaccggcctgcccgacaagtcctccatcggtgcgctgggtggaaagcgcggcggctgccacgggcctcgtgtgctgcctgcccaccgggccctacggcaccctgggctttgtgaagatccggaagccggaggtgctggaccccctcatcgccttcaacccccgcttcatgacctgggtggggcaccgctggtacgggctcgtggagtactcgagctcggaggaagcccacagggccagggctgcgctggactccaccgactcctggtgaggaccgggactttggcactggccgggcggtga

SEQ ID NO: 5261 - DNA, 1305 bp, Chlorella protothecoides
atggctgagccggtcggggccctccctcgcactgccactgcaagtgagtatctcatggtggatcagtacacacagcagcgtgcccatggggattgcgaaagctgcttggtacaccccccatcccctgccgccaggctcaccggccggtgcctgactctccccactcgccccacaggcacatgggcggacgaggtggaggaggaggaggagcgcctgatccagggtatggcgtgtttaaaggggtggtctgagcaggatgctcaggttggagcgttggcagccaagctgggtctcgggtctgggtccggtgggcggaaccatgcccatcgcatgcatgcagcccacatgtgggatcggtccgcacaccatgtcgtctgctgtgtctccgacccccggcacggggacggtcgccagcaccaccacctgcgctccgtctccccaacccccgattcctgcacccgctctgactccggcccccgcgaccccttccccccaacaccagccggcgagactctggaggcgcccacggtgggccctccgcactccggcccgccccaggcggcgcgctcgccacgcgcccctgccgccgctgcgaggcccaccccgagcggtccaccctacaagatctacatcagcaacctgccctgggaggtggatgagtacgccatcgagcgcttcttccagggcctggagatccgggacatcatcctgctgcgtcaccgcgacacgcaaaagcccaagggctgcttcgtggagtttgggtcgggctgctttgtggagtttgggtcggtgcaaaacctgaccgaggccctgaccgccgacggcgccgagctcatgcgccgccccatctccgtcagcctggcagaggcgcggcccaacgaccgccgcggcggcggcggcggcggcggccggcactggaacgacggcggatacggcgcaccccgcggcggcggcgccggctctggcgaccgctacggcgcgccgcccccgggcggcaggcgcatgggcgaccgcgaccgcaacagccgcttccccccgcgcgacaacggctactctgcgggacctggggaggacgcggagcgctgggcaccccgccgcgaaggtgagcaaggggaggcgcagcggggcatgggacttgtgctggggggggtgagcgagagtttgctgaggagatccctgggtactctgggacggcaaccccacggtctgttcccggtggagtctggagccgctgctggccacggcaagggtccccgtggcccccatctcgtatcttcagttgcagcgcatagactgcactcctga

SEQ ID NO: 5262 - DNA, 1626 bp, Chlorella protothecoides
  modified_base (1028)..(1037): a, c, t, g, unknown or other
  modified_base (1358)..(1367): a, c, t, g, unknown or other
atgatcacacacgcagtcgcatgccatgctttctcacaggtaacggcatacatgcacgccggcgcacgtcagtttggcttcatggttcggggtctgcagcacctggaacagagcctgggcaagctccacatacccttcttcctcctcaaaggtgcagatcagggtgctgtggttgcaggcctgcttgagccggatacttgggggggcgggggatggcagggcatggggaggctgcgtcaggcatctgttgtagcacagattccatctcccgaggatgcacttgttggggctgaggcgcctctctacgcttcccaggggaccctgtcgagaacatccccaggatcggggacacttgtcggtgctgagttggcagtgctgagaggcggctgggcagggcactggcttgcaagttgtacggggtttgtgcaagaccgtagctttccaacagcgctacccttccaaattgtgcggcgtgctgtccacttgtcacattcagctacctacatcaagtgtacccatgcactcaccgctgcctcatttgcagggggggtggaggagtcagaaggatggaatcagaatgggcgtgcttcgcgcacccacaatctattcaccgcagacaagagggaaagcgcggcccggaccatcaggcccaagatcactcgcctgctgcccgagttcctggtggagtaccccgagctccgagcacagaccgtcggctggaccggcatgccgcccccacgggtggactgggatgggatccttgaggaggtggtggagagggggcgcgcagtccccgaaatcacctggtgtacacctggagaggatgcagcatggcaggtgcttggtgagatgttaatggagggtcagagggagggcggcaaggactggaccccaatgaatgtctgtgggtcacaggaggactgctgtgcagcgtcgcaagtcggtgatttacatgcgttgtgcaacaagcccccacatcctcatcatgtgtgtcaatccttggtccacacaggcattgtgtggaaaannnnnnnnnntctgtgggtcacaggaggactgctgtgcagtgtcgcaaggagcagggctttaggtgctggagcctaccccacctctgccttctgccacagaggccctctcgggcctatcgccgttcattcatttcgggcagctgtcagcgcaacgggctgccctggaagccaggaagcatcgcggcaagcacaaggtggggcagaaggtgctctgggttggggacctgacttgggtgggactgtgcaaggggctctgccgtctgagttggcgggcttctgggatgagatgcactgggaggtgggagctgtgtgtgttttggggtgcgacgnnnnnnnnnncggcaagcacaaggtggggcagaaggtgctgtgggttggggacctgatttgggtgggactgtttaagggactctgccgtctgagttggcgggtttctgagatgagatgcactgggagctgggagctgtgtgtgttttggggtgcgacagcaggtccaagcacctcctctataatttctctaagcacctcaactcctggcctgaagtgcaggagtccgtggattgcttccttgaggaactcatcatacggcgggagctag

SEQ ID NO: 5263 - DNA, 1137 bp, Chlorella protothecoides
atgctgagcataacaaaatctccggcccacgatgtactgactagcaaggccatacaggccaggacttgcatcctcaagccctgcacgccgctcgggaaccaaccgatgtcgtccctgcccaaatccaatccccccaccggcctacttgataaagtccaggctgggcacacgaggaactcccccggctggtgcggcctgctccccgcctccggcctctgtgccctcggtcatcgctgcagcaaggaggggccccacgacacctccagtgtgttgcttggccaagcgtgctctgtggcctcccctctcatggcttacaccttccctcctccccccaagtccatgccacccccctcgaccccaggtgcatatgcccatgacgcgcaaagacagggcacctgcgactcggagtcaatgcggggcagactgacggtgcttcccgtcttgaaaaagttctggagcagctcatctgagaaggagacccctcccatcgaacgaccgctggccgtgtgtgccagaggcgccaaacgctcgagggaaagttcccgaacctcaatcgctctttgtcaggtcacgggccgctggcttttggtggcattggatacccgtgcagtactcagatcgcattcgctggcgattctccctgcttctgtggctagagttgcttggcttcactgtgtgatccccaggcaattcctgtccaaggccactgggcataccacacgcctcgcttcatcggccgaacacccaagggcttcctcggatcaccaaaatccagggggcatgcaagtgaagagaaaggtgccagagcctgcacaggtggaggctgcgggtcctgcaagtgccggcactggccgcgccatgcaatcatctgtcgaccctcgccgagtcagggagctgcgatctggagagcagggaccaggacctgtgctctactggatgactcgggaccaacgatccaaggataactgggctctcttgcatgcggtggacctggccgccaagaagggagtgccagtggctgttgtgttcaatctggtgggtgccagatattattggccattgaatgggcatcaagttaagctgcttggccaagagttgcaaccgtgcacgaaggaggcccttccttgtgctccatag

SEQ ID NO: 5264 - DNA, 2940 bp, Chlorella protothecoides
  modified_base (1341)..(1350): a, c, t, g, unknown or other
  modified_base (1811)..(1820): a, c, t, g, unknown or other
  modified_base (1964)..(1973): a, c, t, g, unknown or other
  modified_base (2061)..(2070): a, c, t, g, unknown or other
  modified_base (2374)..(2383): a, c, t, g, unknown or other
atgccgacagcggcgatgtcgcccttcccgcaccccctcccctcttcactcctcaccgggaccttcttctgggtggccaccactgcgctatcagcacctcggatggagatgctcgtgagagcaccagactttgctgccttgaaggcatactctgttgcagagaggttgtgtgagaagtatgagcgatgcactgatagggtgtgctggggaaaggtagccaatcaccctaactggacaagtgacggcaagatggtgatgtgccggtcgaaacctgccccactgccccgcgacatggttgatcacacccagccctcgaagctctgtaagcggagcgataccaggaagtatggaaaggcggtcctcgtgctcctgatattcgcacccttatcggtatgctgcgccaaagatgcgcgatcccttgcagaaagatacaagaacctcggcgagtaccttggcaaggcgcccggagctcctcctgcccacttcaggctgagctgctggaagcctcacaacctgctgcatgcccactgctgctgccccgcacaggaggtggacgatgatgccttcgattatgaggcagccaaagcagccgccctggcccagcaacccacctttgggggcagctgggcgcccagcccagccgccccttcaggaaagggtgtagcgtcatcaagcctcagagcagaagccgctccatttgctagcgttggacagaaggctcctgggccgccgccaccccaaaaggatgcagctcggctcacagagcgcgccgccccttttaagtcgcgaccaccctctgcagctgctcagcatggacagcatggcttccacacagccatcgccccccatgacctcgacggcaagttctccgtggcatcggttgagctcagctttccttgggcctgttggggaagaggacatggtagtagaacgctgcaccagtcctcaggcttcccagtggtgtcttgttgtgatcactcgctccaggcgaggttccacccggcatgaggggaggccctgccagcgcccggggccatcgtcggcgtctgtgaggacatgtgccccgcggcagagcgtgaaaggcgggagcacctgcacgacatccagatctttgagagggtggacatcaatgacagcgggcggaccagtgcagagctggctgtgaggcgatttgcacgaacggtgtgttgcttggggcttgtattggaaaggatggtggaagtacagcctgtcctatgcatagattgcgtctggtggtctactgcagggatcatactacttcgattacccatcatccatctccaacactggcacactcctcagacacgtgaacaaccatannnnnnnnnngcgtctggtggtctactgcagggatcatacaacttcgattacccatcatccatctcccacactggcacactccttagacacgtgaacaaccatttcctgattctccacaggatgtcaggtgagagggcttgggaagagggacagggtttgcaatacttgagtgggatgggtgcgggatgggtggtcagtgaggcagaacaggacgctatgaggtctggaatttgggagcgtgaagagaacgaggatcagtgctgttggctacatataactccacgatgctgcatgcatcctcaggtttgggctggtgcacaaattcctgtgggacagataccgggctgttcgacaggacctgtacgttcagggcatcacggtgaggctggggtggatgtagtcgagttgtgttgcattcctggttggcagaccacactgcagcattcagggagcttcacatcctgccctcnnnnnnnnnncccaccctggatacagagctgtgcgacaggacctgtacgtccagggcatcacggtgaggctggggtggatgcagtcgagttgtgctgcattcctgattggcagaccacattccagcattcatggagcttcacgtcctgccctannnnnnnnnnctctgcggagaagaccagtctggcaagtgacacaccagggtccatgcttgtgtgtgcagggtgcaatgctggtcatcgccggaccccnnnnnnnnnngcctgcctcaggatgagtttgctatcgctgtgtacgaggaggttgtgcgttttcacgtcatgtgcgagcatgagctctgcggagaagaccagtctggcaagtgaaacaccagggtccatgcttgtgtgtgctgggtgcgatgctggtcatcgccggatccctttgcatgcactcggtcttcctcgtgcccctgcgctccatctcattcaccttgtgcacgccccgctgccagtcacggagatggagggattcaactctcacctgaacatcgagcagatgaacaagaggcatcctcgcaggagtnnnnnnnnnngtcttcctcgtgcccctgcgctccatctcactcaccttgtgcccgccccgttgccagtcacggagatggagggcttcaactctcacctgaacattgagcagatgaacaaggtgacaggggggaaggcttgggcttgcacgaggatggggcctggctctgtggccctgatatccttgagtgacatgtatgagacgcaggcagagaaggggcagccagtgcagtctggtgaggtgaaggcaccctgccgcccaaaggtcatgagaatgtgtctgccccctgtcactgcatgcgagcccccacagcaaccccctcctcattcctgcagagccggagttcagggcttaccacctgctctctctcatggctcagcacggcaagttcaagggggaccagcaggccttcctcgccaccttgcaagcgctgcgagcggaagtgaagacgtcacctcccatcctctgggtcctgcaactacagagatacctgcctgcatcactctcaacgtggcttcctctaggatggggatgaaccaagctttgaggatctcacgtcgcctctga

SEQ ID NO: 5265 - DNA, 984 bp, Chlorella protothecoides
  modified_base (364)..(373): a, c, t, g, unknown or other
atgcacccccacccccacccccaggacaaactgattgatccctccagcatcaccaacatccacaaagtgacgcggaccattggcttgctgaccaccggcgtccccggcgacgctcgttcgctcctgcagaaggcgcgatccgaggccgccgagttcaggttcaagtatggctacgagatgcccgtggacttcctggccagggtcctggccgaccaggcccaggtctacacccaggtgtggtttggaatgaggggcttggggcatggcagcatgtgtggggctttgcagctgccctggggctatcttgacgcctccctagagcagttccttggaggggctgcccctggctcctctcacctcctcnnnnnnnnnnttatcttgacgcctcccttgagcagtttcttggtggggctgcccctggctcctctcacctcctctggcgcagctgcgtcagtgcagaggaccccctgcaataaatcctccacactgcagcacgcctacatgcggcccctgggtgtcatctccacactcgtgggcatcgacgaggaacgcgggccgcagctgttcaaggttgacccggccgggtactttgtcgggtacagggccacggccaccggccccaaggagcaggaagccatcaactacctggagaagaagatccgcccggacctgagcctgagcgcggacgacacggtgcagatggccatctccgccctccaggtgcgtgggtgtcgtgtgagaggggtgctggttggcgtagggttgcttgagctcctcgacgtggtccagcctgtgcagggactgtcgctgcacaaggagcagaatgtgctggccgaggacctgaaggccacggatctggaggtgggcatcgccgagaccagcaacggcggcctgttcaggtcagtcggtatgggatgggatcatccgtggaccggctgcctgtgcatgcagacgccgcatggactcggtgccgtggagatttga

SEQ ID NO: 5266 - DNA, 942 bp, Chlorella protothecoides
atggacacagccgatgaggcggcaaagactgtcgttcggcatgggtttgcaatcggcactgagggcgctggcgtgcagtgcgccctcctcgtcaagggtgagtttgtggagccccctcccccaactcagcgtgccccatcccaccgtatctctgagaaatcggctgggctccgctctggtgcggtggcgtccgtgcaactgtctcccgaagggctgcaggcctcggttgcgcgccagctcgaagatcagcgtgctgcacaggaagccagcgcagcgcttgcagctcaggctcaagaagtcgcccggcagactctgcatgcccagcaacaggcagcccggagagcggctctgcaggcgaaggaggccgccgaggccgcacggcacgaggcggccctgcgtgccgaggagggccggcggcaggaggaggagcagcggcggcgggcggaggaggcgagggtcgcacaagaggctgccagacagctggcggctcgccagagggaggaagcgctgctgcgggccgccgcagaggagaggcagcgaatggaagcggagcgtgcagccgctgccgcggcccgggaggcggagctgcgggctgccgcggctgctgccaaagagaggcaaagggtggaggagctgcagcgccgacgcagggcagaggtacgcctgcggggttcttcacttggaggggagcgctttgagtggggcgcctgtggatacagaatcggcggggctcttgcccttggcggtcatgatgcatgctcgcgcacccttggcacccacgcctcctgtgtcctggtgcggcttggtgcctcattcctctcctcctccctggggtggtcaggaggaggaagcggagcgacgacgagtgcaggcagaagccgcggcgcgggaggcggccgaggccgaagctcgccgacagagggaggaacaggccagggttga

SEQ ID NO: 5267 - DNA, 1911 bp, Chlorella protothecoides
  modified_base (220)..(229): a, c, t, g, unknown or other
  modified_base (1213)..(1222): a, c, t, g, unknown or other
  modified_base (1305)..(1314): a, c, t, g, unknown or other
atgtcgactcttctcactggtgtcgtgcgatgcgacgtcgcatcattgccaagaaattcctcactgcccttgcactccgacctcgctggcttggcgcctgtggtagcatgccggaggcatgggcctccgacagcctccgagaagtggaggatgtccagaaggaggcatgcttacaccttacgacctcagtctgtggctgctgacacttcccaggcgtctnnnnnnnnnnagggtgggttagggaggtgggtggatggtggtttaaccaggactttgccctgggaagcgccggggatgcaggcgcgtcttgggcgaaagcaagcgtctctgagcgagagcgcgattcgcacggagacctggacatggaggggccacaggattcgctacctggtggcggggcgacgcggcgactcctcctcccccgccctcctgttggtgcatggattcggatctaatgcggatcactggcgaaagataatggaggtgcaggccggcgaccgacaggtgtatgccatcgacctactgggtgcgtgggtggggtgggttagggaggtgggtagatggtggtttaaccaggacttcgccctgggaagcgccggggatacaggcgcgtcttgggcgaaagcaaggtatggttacagcgacaagcccaacccgcgcctggccggccccccatccagcctatacaacttcgacacctggtcagaccagctcctggacttcactcgtgccgtcatcggccgcagcgccgtcctttcctgcaactcggtggggggcctggccggcctgcaggcagcggtgaaggaccccgccattgtgcgggcggtgcaggtgatcaacatctccctgcgcgcgctgcacctctccaagcaggcggcctggaaacggcccgccgtcagcacgctgcagcgcgcgttgcgcacgacgggggcggggccctggctcttcaagcgcctggccacgcgggacggggtgcgcagggtcctgcagacctgctacggtgacccaaagaccgtgacggacgagctggtggactacatcctcaagccggggctggagccgggggcggtggaggtgttcctcgacttcatctcctacagctctggcccactgccggaggacttgctgcaggtgtgtgtggctggttggagggagaggggtcacggggctcgagcctgtgctgtgaatgtgacacatgtggacaatggctgcnnnnnnnnnncacccggttacaaatggcaaaatcgggacccacacactccaaggcggtggagatggtcccacactcatccccatgttcctacnnnnnnnnnnctgctgcaggtgtgtgtgtctggttggagggagaggggtcgcggggctcgagcctgtgctgtgcagggaagccaggacgagctgggaatgcgcatcagggaagccaatgatgcttgcaccttgggcctcaatcttctaccctacccgattacaaatggcaaagtcgggacccacacactcaaagtcggttggaatggtcccacactcatccccatgttcctactgctacaggcctgcaaggtcccagtgagcatactgtggggagaggctgatccctgggagcctgtcaagcttggcagaacgctggcgttgtatccgtccgtggaggagtgggcttccctgccaggcaagcagggtgccctgtggcgccgatgcaggacagctcacgggggtctggggaaagcatgtcaggggacagagacctttaaattcctcacaaccccaatgcgtgccccgctgctcaggtgtgggacattgccctcaggacgaggcacccgaccaggtgaacccctttgtgacggagttcatgaggcggcatggcggggagtgcgctacttcacaaagcagccagaggaacctacatgcttccttaaataa

SEQ ID NO: 5268 - DNA, 387 bp, Chlorella protothecoides
atgtaccggggacagatccggaacaagaagagggtggctctgggcagtggctccgaggcacgagtgcactacaccgtgaactacaacctgcccgagatcgagggccctggtggagccggggcggcctgcttgcattcggaaggaagggtttgttcggagggcgggcgactggggcccccgcgccgtcgcacacagcacccggacaccatacggcttccctccctgcttccctctcctacgcacagcccccccgccccgggacccccttcccccgtcatgcaggaacttcaagacggccgggcgggacctggcccagaacgtcaccgcagacgtcgggtacgcgcacggcgacatcccccgcgtcgagctggtcctctggccgcttga

SEQ ID NO: 5269 - DNA, 1122 bp, Chlorella protothecoides
atggtttggggcgtagcaccacatactcctgaccgggcagtggagtttcgcgatgaaggatcacagtcgcgcgaatgcatcgcttatagtaccacttcagatcggcgaatagggacaggtcaaccactcccaaacgcgcgggaaggcgaacattaccagggcccctggcccacccctttcaagcttgagtgtccaccattcaggctcgacaatatggcggaggttgtcgaggagcgccgttccggccccaagtccgtgaaggatgtgcccgccgacgagttcatcaaggccttctccgcttacctgaagaagaccggcaagatccagctgcccgccagcgttgacatcatgaagaccggatccttcaaggagctggccccctacgatgccgactggtactacgtccgcgcaggtgcgccaagccgttggatgcaatggctgcagggcctcggatggagtatggaggcctcccagaggctgcctgctgtggagtctgtctttctgctcgagcgatgttgggcactgggcggtgggcgctgggcgtgtgctaaatatctcattgctgttggaccgacgaggctcccccgagatcatcacttaactcaaagcctgttctcatccctaaccatgcagctgccatcgctcgccgcgtgtacatcaggcagggtctgggcgtgggtgccttccgcaggatctttggcggccgatccaacgccaagggcagcgtcgcccccggtatgtggagggtggaacgaggctggcgcgacggcagtcgctcctagttgttgtgcatgccgctgccgaggcgtttcatggggaaattatagcttggcagtgcccatgatggtgtgcatgttctcgctgacccctcccccccttcccaccaccacaaccctgcctgctgatcactggcccctccccacgattcacaccacagagcactttgccaaggccgccggcggcgtggttcgccacgcgctgcagcagctggaggccctgggcctggtagagaagaccaacaccgagaagggcggtcgcaagatcacgcccgagggccagcgacagatggacctggtggcggcctccgtcaagctcaccccctttgcgctgctgctggagtga

SEQ ID NO: 5270 - DNA, 354 bp, Chlorella protothecoides
atgtgccaggccccactcccacactccacccatgcacatcgcaggtacatcagcagcgccgaactggagtcgctgtcgtcctacatgcgcggccgcctgacggcggaccgcgtgaaccagtcgctggacgagctggcggcgcacgcggcgcgcaatgccgcgctggtcctggccgcgaggcgggggcgggtggcgggcgcggacaagaggcacggcatgtggctggcctactctgtcgcggtgagggaaggagggggtggccctgccggggtcgccgagggggctgaccgcaccctcgatgagggcatggggatgtctgctggtcgcctggcatggggtgctgcgactgcatga

SEQ ID NO: 5271 - DNA, 657 bp, Chlorella protothecoides
atgccacttgcaggggagttgtggtgttttgatgatgacgaggttggcactccttcactggaagacccccctgctcgacgcggccccgcaacacactcagcctctccaccctccatctacgatgcgtgcgacagggatctgtacgagtgctcatgcaaggagctggaccaggtagtggcgctggccaaggccaacggcgccataggctcgcgcctgacgggggccgggtggggcgggtgcaccgtgtccctggtgaaggacgaggatgtggatgccttcctgagggtggtaagatgcagggggaggtatttggctggcgatggaggggctgcaggggatgtggaagggttgtgtttgggggggtccggggagaagggctggcaggcggcggctgcggatggagctgcagctggcctgatgcgcgcagtgcggggtaccgattcctcgtcggtgctgctcgccatcatctcgccgcctgctgaagcacctgctgacagccgcacctcgcctgccggtgcagctgacggaggagtacgtgcgcccgctgatcgccgagggccgcctgaccgaggagaccctgtcggacaacatcttcgcctccaagccgtccagcggcgcggccctgctcaagctggacctgtgagtgggtgccaatga

SEQ ID NO: 5272 - DNA, 402 bp, Chlorella protothecoides
atggccggaacccccatcagcacacactctgacttggagtccgtgtacggcgaaggtgccgccgcggtccgtgatcgctacgtcgcgctctcgaaggcgcaccacgcacgtttcgggaccaagcctgagatcttcgcacgggcgcccggtacgttgggtgctcatctggggcaggatgtgcaacctggatctgggtgtcgtgcattgggtgcgagcccgaagtcgcaggccaggcccccggggtcctcaccggcaggcgccaccccaacctttgcaggccgagtgaatctcatcggcgagcacatcgactacgagggctacggcgtgctccccatggcgatccacctggtgcgtgctgcggtgcagtgcgagtctgggctggtgcccaggatgcctgtgtga

SEQ ID NO: 5273 - DNA, 474 bp, Chlorella protothecoides
atgatgccacacctgcttcaacttcatcacccacctctgcagctgacggcgcccaacgtgaacacgaccttcaagcggcagatcaaggccagggaggatgcgggctggactcgcgtggagtgggcactcgtcaaccggccgacagcggagaacctgtcggtggtacaggggcgtgcagctatgggagaccccaaggacccaaacaccggtttcgtccagttcacgatacgcttcaacaccaagcagcggttccgcgctttctcaaagtccggcgcggtcgtggcgggcgggcctgaccccgtggacgtggaggagctgtgggtgctggagcaccccttcaagaagcaggagaccaaccggtggcgactggtgggcaagctgatgcccgtgccggggacaaaggagtacacgtcctcagcccccgtgatcacgagcgagtcgctgcggcagcacaaggccgcgcagcaggcctga

SEQ ID NO: 5274 - DNA, 672 bp, Chlorella protothecoides
atggcagcactgccgcgcctcgcgctgcgtgcttgcagccatgccacacatacgctgcagggtgcgccaccctgctctgcacccgcagctttcacctccctcctgaggcttgcccagcacgccacatgtccgtctggctcctaccaacccacccgcgggtacgctggccaggaatacctggcaaacaaatttcccaagggcgcctttgctgccagccagacgcttggtcgccccgctgggttcaggccctccgtggtcacctctgatcacgtcttcgatccgtaccaggtgacccagcgcgtggtcgctggatgcaccagcccatacccgccccccgtcagcacacacccttccctcgcgcagggggtgcccagtggcctcagcgccgccaccatgctgacacccaagggtctgaagtacctgtggcgacgagccaagggctcggcgcagaacgtgtatgcgctggccatggcccacaagtacgcgaagcccttcaagatgccgctcttcaagcaggaggcgctgaggctgtacgaggagatcaacacgcatgtggctgcgggtgaccgacgagcgctcattgctgtgagtccctggcccgacccgggctgcatgcttggggtctgggtgcctgggtgctgctctgtcccgagtcaacaaccaggctggtga

SEQ ID NO: 5275 - DNA, 843 bp, Chlorella protothecoides
atggaccaggccatctccatgctgggcgcgcgcggcatcgccaagctcgtggagtttgaccccgtgcgcgcgcacgacgtgcccctgcccgccggtgcgacctttgtcatctgcaactccctggccgtcagcaacaaggccgagtcggcgacggggcggtacaacctgcgcgtggtggagtgccgcctggcggccgccgtgctggcggcgctgctgggcgaggggcgcgaggccgcgcgcgccgtacgcaccctcaagcagctggagccagtggtggcggcgcggtactcggggcccaagggctccaccgccggggcgcccctggccgccgtgcacgagctgctgcaccccggtgggttctcggagggggcggatgcttggggtgtggggctgagaggcctgagtcgcgccagctgggccgcagggcgccatgtgtgggtctccaggcgcggttcgcgggcaggcagcccagctgtcgctcagcatgcccaggttcggggtttgagcagacttctcccctttccatacacgccgccaacaggcacatacagcgcggcggaggtggaggagatcctgggcgcgccgctggcctccctgttcgagggcgacgcctccgcagccctggtcctggccgccttccgggacttcaagctgcacgaccgcgccgcgcacgtgtacagcgaggcggctcgcgttcccgctttccgcgacgtctgcctgggccatggcagcgccgacgagaagatcgcggccctgggcaagctcatggacgacagccaggccagctgcaggttggtgtggagaggttttggagggagggaggggccggggtccagaggttag

SEQ ID NO: 5276 - DNA, 414 bp, Chlorella protothecoides
atggccacgggtgtcctcgagcaggtggtgctggccttctcggcccagatatcggagctccagcaagccacgcttctgcgcgccgatgatgccagtgccgccctgtacaaggatgatctggtggccctggagtcccgagtgcgggagctggagggcagggtgcggggtgtaagggagcagctggccagggaccgggccgccctccccgccgcccaggccgtgatccgggcggctaccctgcagcaacggcagctggagcatgtcgaggcctgcctgcccaccttcctcccctccctcccgcccacccccccggtgcacggcggtcggggtgacacggccaacgccgagcccgcccgtcgcccccgcgcccctggccaggagaactgcgccgagcccaacgccgttccgaggtga

SEQ ID NO: 5277 - DNA, 600 bp, Chlorella protothecoides
gatgcgggtgtggagctggcgcccaagagccaggccatcgtggtggacgagttcagccgcaccagcgtgcccagcatctgggccattggcgacgtgacggaccgcgtggcgctgacgcccgtggcgctgatggagggccgcgcgctggtggagacgctgtttggggggcgagatgtggcgcctgactacgccaacatcgcctcggccgtgtttgcccaaccgccgctggccaccgtggggctgtcggagaaggaggcacaggagaagctgaacggggaggtggacgtgtacgtctccaagttccggcccatgaagaacacgctgtcgggggcggaggagaagaccttcatgaagatgctggtgcacgtggagagcgacaagagcgccagcggcgtgcagccggcgggtgtgacagtgcctgccgctggccgccactggtacatgcacatgcactgcaacacacaggaaggcaccctcaccccctgctccccgatcccccacccctcccctgcgccaggtggtcgggtgccatatggtgggacccgatgccgccgagatcatgcagggcctgggcatcgcactcaagtgcggcgcaactaa

SEQ ID NO: 5278 - DNA, 705 bp, Chlorella protothecoides
  modified_base (279)..(288): a, c, t, g, unknown or other
gagctggcgcgacgcaccgacaccctcatccgcctgatcgagaaggagaacgaggaggacgaggagcggaacgcggcatccaagaagggagccaagtccggcggcgcgccagcacgcaagcgcgccgggtcggtcacggcggcgtcctccgcagacgtcaaggagggcggcgacgacggcaaggaggaggtgggcagcgcgcgcaaggccacgcgcgctgcggccgcggtgtcccccgccaagaattgggagactcagacccctccccacctatggcgnnnnnnnnnncccagttggtgggtgctgcgctgcacttggagactcagacccctccccacctatggcgccgtcgcacctcgtgtggttgctcccttttctgatgtacacaagatggcaaagcagggcagcaagggtgcaatcacgctgcacggcgggtcaaacagcagtgtgcatgtgacaatggatcgagccaggcaacagctgcatacagagaacgtcggggatgcctgcctgctggcagcctacttgctttcaacctccagcaagatctcgttgatgcgctggatgggcagcctgaatgagacgaggaaagcttggcggatgattgacagagtgcagcgggatcaggatgatgtacaggcaggtgaccctaggcttacattccaaacgctttgcaagcacaaccctgccgactgctctccctga

SEQ ID NO: 5279 - DNA, 516 bp, Chlorella protothecoides
  modified_base (179)..(188): a, c, t, g, unknown or other
atgctaacgatctgcgttgacatcgtcgtttccaagctgcttagcaggctgcgccccttgcctttgcggcagcatgccatcctccaatgccttcatggcgctgcaagagttgggggatgccctgccggcccagaacacccctcgagaccaccccggccgcctcaagctcccactggtannnnnnnnnnatcctccaatgccttcatggcgctgcaagacttgggggatgccctgccggcccagaacactcctcgagaccaccccggccggctcaagctcccactggtgtggctggacctcgaaatgtcagggctagaccctgcacaggacgccatacttcaagttgccgtcatcctcaccaatggcactctcaccgaggaagttcaaggtcctgagatcgtcatctaccagccagtggatgtgctggagggaatgaacgagtggtgccaggagcaccacaccagcagcggtctgaaggaggtgcgttaccaggccctggggaatgcgagctactag

SEQ ID NO: 5280 - DNA, 1401 bp, Chlorella protothecoides
  modified_base (100)..(203): a, c, t, g, unknown or other
  modified_base (1063)..(1072): a, c, t, g, unknown or other
  modified_base (1138)..(1147): a, c, t, g, unknown or other
atgcaagcgtttactctgtgcacaccccgcaccgcgcgcgcgaatcggaaggggaagacctcgacctctgctggacgaactaagagtctgcaccgacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcacggttgcccctggtgggagcagccatgacgagttgcctggtgtcgagagttcgccacagcgagctcgcgaccctcatacgaaacggctggtgtgcatccatgctcttgatcagatctcaatcaaacgatgtgagacccgtgatccactcgcccagcacctccccaccgcctgtccctcctcctgcgcccaagccttgccgtacaaacgtgacctgggatgtgatggctgggcggggcctgaaacccaaggagcaaccgaaggccacacgagatgttcaaagtctacaggcagccctcctggagtcggcgctgggccatgtggtgaggaggaggcggtgaagggttcaggtaacttgctgctggcatggaagcgcaagtgccagctgaaggctgctttggacaatgacctctccccggcggcagctgggctccttggcgatgccccctctgatctggtcaaggccttccttactcgctgcaattttgagttggaggaggctctactggaggaagggccccagttggagctctgtcccctgcatgccagaatcgtggctgctctgcggcaacgtattgagatgatcgtgccatacaaaggtgtgtgcgttgttgtgttgaatgacgtgttggggtgcattggtgtcacagagtgtggcaacggaacgaagggaagtggcagtgcattaaacatcaaatccgtggcttcaggtttgagattaccaccgactcatccaccgcactcgcagcctcctgggctagtgcactggcgaccctgggatcgccggttgccgccatggagctctacatggacgccgcaggcatcatctggagggcgttctgctggacacaacactnnnnnnnnnntgactcatccaccgcacttgcagcctcctgggccggtgcactggcgaccctgggatcgccggttgnnnnnnnnnncatctcaacagggtgtaaaggaccatgatgaggttttatggcccagttctgctggacacaacactcacctgggcgctgtctcagatccagaaaccactcctgggcctcaggctggcgcatcgcaccgtcttgagcggggtgctggcttcctcagagctgtatctgctcacggacaacagccctgggcacgaggacacctgggcggcggtggaccgggccgtgggcgaggcgctgaaactactgggcagctctga

SEQ ID NO: 5281 - DNA, 357 bp, Chlorella protothecoides
atgcaacggcacggccgacatcagcaaactaatacattgcattgtatgttggtacgggcattgcacgggctgcgctccacactaccgtggcctcgcctgtcggctgcagggctctccgccaggcccagcgtcaggcccctggcacggctgtgccggcaggagacgctcgccatgtcccagagtgtggagtcagggccggcagtgcactacagcgcggccctcacatccatagatgccagccagtacgaggcacagctggccaccaaggtggcttggctggagaccctcttccaggatctggagcacccaccctttgccatccaccgctcggagcccgagcattttcgcatgaggtga

SEQ ID NO: 5282 - DNA, 1056 bp, Chlorella protothecoides
  modified_base (307)..(316): a, c, t, g, unknown or other
atgaaccaggttaacctgcacacgaccctgagcgggcaggccatggtcacactcctgtaccacagaaagctcggggatgcatggcaggaagctgcccagaagctgcgggtctgcctgggcgacctggcgtcccccatccacatcatcggtcgcagcaggtgggggggcctgccactggtttggatgcctgcataccccagcaatggtgttgacggtcgcatgtcggctgcggcctggcctggtatgaccgcccttgtgctgaggcccagccatgcagcggcaaaggtgtggcagtcatgggcacccnnnnnnnnnngtggtgttgacggtcgcatgtctgctgcggcctggcatggtatgaccgcccttgtgctgaggccctgccatgctgcggcaaaggcacctgtggctgcccatcccccacccaaacccctctcctctcctccatcacgcaggggccagaagatctgcctggacgcggacgaggtggaggagaccctcacggttgagggccagacgctgcgctacgtgcaggtggaggccaacttctcgcaacccaacgcgggcatctcggtgcagatgttggcctgggcgcggcgcgcggcgcagggcagcggcgcgcgcgacctgctggagctgtactgcggcaacggcaacttcacagcggcgctggcgccgcgcttccgccgcgtggtcgccaccgaggtaagcaagcgcagcgtggccgcggcgcggcgcaactgcgcccagaacggcgtgaacaacgtgttcctggctcgcatgcgctctgaggagttcaccgaggcctggaggatggggggcaagaaggagaggtgcggggggtctgggctggtggcaaagtactccttgcttgaggacaggggtacaggggttgaggtggaattcgtctctcttgtaagcacggtgctcgcaggaagtagctatactggtatctcctctcattcccctgatcgagccgtccacacatctcagccctcactctctctcaactcccacactgcacaggctaaaggggttggatctcgtagagtgtga

SEQ ID NO: 5283 - DNA, 2046 bp, Chlorella protothecoides
  modified_base (172)..(181): a, c, t, g, unknown or other
  modified_base (552)..(561): a, c, t, g, unknown or other
  modified_base (1192)..(1201): a, c, t, g, unknown or other
  modified_base (1749)..(1758): a, c, t, g, unknown or other
atgaattcgacaatgtcatctacatcagctgcaatcctggcacgtgacagcaagggacagatgttaagggggtgcctgtacatcagagatcatgcaggggtaccctttcctgtgcattttttgggtctgcgccatgctcatatgtttcgtgccatcacaggattctccaccnnnnnnnnnnattttttgagtctgcgccgtgctcaaatgtttcgtgccatcacaggattctccaccgcgcgtcgtctccacaatactcccccccccaacacgccatgtacagagacgctccatgccaatctggtggctgtcaaggacaccttcgacatagtggagtatgcggtcttcgatcagttcccctggaccccccacattgagagtggagtgtatctgcaacggaaggctggagcaccacggccgccgaaatcatcgagtatccccgatgtcgctccggagaacacggctgctccacagggcgtaaaacggaaagcagaaggggcgaacaactccggacatgaagccgtcccagcctcgaggaggggcaagagatcnnnnnnnnnnatgggagctgcggccccccccttcctccggcgaacaactccggacatgaaatcgtcccagcctcgaggaggggcaagagatccggacctctatttcggggccgaggtccggcaattgaggcagaacctgctccagcagcccatcaaactccgtgttgaagcatccaattctgcgagtcatacgctagtgagtagatgcacggctcctgagaaggaatggatgctgccgaacatcgcgagcgctcgcataagtactgcacctctgactgggcccatctccccggtgttcgattggctgtggagcagccctgcctcctgtgcatccatcaatgagacttgcaagaactggcaccaccttgtgcacgccaaagccccaaatctttatcccaggggtcaggatggctgccccaatggtaccaagcagtgccagattgcgggcaccacaccacactcctgctccgcagggtcgagcctttgcttacgagcgcttcaaaagcgtgcagagactccatttttcagagcggacccatcacctgacgtcccgagaactggctcatgcagtgcaaggtttgtggtttcccagcctgctctcgaaagtatcgaggtggactgctcctggctgcgaccatgcnnnnnnnnnncgctcctggctggtagtgcaatcatccccgatcagacgacattcaaggaaaatccactcttctctaccccctccagcgaccatgcgcacgctggtggaggatggggctctggcatcgctgctcaggtgaggcagcatggtagggagcctcagagtgcttcttggcatggtcgcattgatctctgcactggtgtacccatttcatgcggtcacagtgtgtcaggcacagcgcacctccgtgggctgttcccagaggcaagatctgtacgcccttgtcggcacttttcggcatttaccagacctccggcacctggagattgtacactgccattcgctgagaggtgcctttatgaccagcctggatgcctgccccctcctcactttcttggcagttcaagactgcgagtcgcacatcacggaagcgggattgcaggcggtggctcggctgagtcaccttgcggccctgaagttgagaatctactctctgccgttctcacccagctccatcaaggccatgctggaacacctgggaagcctgaggtgtgcagnnnnnnnnnngaaacctactctctgccgtactcacccatctccttcaaggccatgttggaacacctgggaagcctgaggtgtgcaggaacctggggggccccttctcaccttctcaggttgttctccatgaacaccacctggtcattctccaacgaacaccttcagtgtctggcagacagcccctgcgcccctttcctggaagaactggacctgtcgcggaccagcatggccacagggtgcgctaggcaaaaggctcatccccactctctactggttgatgtcacttcattggcatga

SEQ ID NO: 5284 - DNA, 288 bp, Chlorella protothecoides
atgcccagcaagtacaccaaggacaccctgccgcggcccgacaacccaaacgtcaagatcatcgaggtgccgtctcgcaccatggccgtgctgacatggaatggcggggtccctcgtgaggaaactacggccagcaagacgcaagagttgcgggccctgctggcagcggcgggcgtgaagagcacgggaagcgtgcacgtctgggctgtcagagtgccagttttcctcctgatagggctcagggagagcagtcggcagggttgtgcttgcaaagcgtttggaatgtaa

SEQ ID NO: 5285 - DNA, 201 bp, Chlorella protothecoides
atgaacaaggcgatgggctctggcttcaggcaggtggcggggttcatcttcgggaagaacaaggctgtggaccgtgaaggagccgagaaggtgtccatgacctcgcctgtggcgatggaagtggtgcacaacgagaagatcgggatgacagcgccagtcatgtcccagcaggacggtggtggagtctacaaggtgaactga

SEQ ID NO: 5286 - DNA, 345 bp, Chlorella protothecoides
atgcagttggtacgcgacactagtgagacgatggctcccagcaccgctatggacttgcggaatttctcattgcgggttgtgtgcggaccgcacgatggccgactggaccccaagagcatgcagatactgtgctgctgcgcaaagtgcgcgccaacctacaagaccttcacgctggggcagtgggagattcacggcggacgcggccattgccgcaatgcgaagagctccatccgagttgtagagacgggcaagtccttgcataactggctgcgggatcgagcgaccgctgagatcaccacccaggcagtcagagccacaaggtgggcgacaggttggggggagtga

SEQ ID NO: 5287 - DNA, 1356 bp, Chlorella protothecoides
  modified_base (126)..(135): a, c, t, g, unknown or other
atgagtgatagccacactgttctcaatcagccacgagccatctcgacacctcccaggaaagtcttggagggtcagcagggggatgcagccatagcgcacgtgcatgcgaatcctcattcgctggannnnnnnnnncagccacgagccatctcgacacctcccaggcaagccttggagggtcagcagagggatgcagccatagcgcacgtgcatcctcattcgctgggtgaccgggtgtttttggactggccacgttcgttcccgctggccctgtctagacccccaattgcaatgcaaccagacaatttgggccaccttttcgaggatcaagccaaattctatgcccagttccggccgtcgtaccctcccgaactctacgaggccgtgtatggccttgcaaagctgccacgccgaggcacggcactggacgtggcgacgggcagcggccaggtcgccaaggtgcttgcaaatgacttcgaaaccgtcatcgggacggatagcagcgccgggcaactccgtgaggctgtccggcaccccaagatcacatatcagcatgttcctgccgaagacttgcagggagtgtccgatgcgagcgtggacctggcaacagtagctgaggcgttccattggtttgatcgagagcggttcttccaggagatgcgccgggtgctaaaatccgatggagtgttggccatatggggctacgactttggttacttggagccaggcagcgcggcacaagggagcattcccgacagcgatgttgcagcagccaatgccgcgttcaccgagttccattcggggacagaggggctcggcccctactgggcaccagggagggctctggtcgaggcctggtatgcgggtctggagcctggatgctcccacttcaaggacgtgacctggctaccggaggggatggccataagggaggacatgtcgctcgaccacttggtgaggatctgggaaaagggggttgctcatctgatgaacagggcagaattcatccgtatagtggttggccttttgaacagctggtccgcactgactacctatcgaaagcaacacccagagaaggcggatctccttgcagccttcaaggccacaatggctcgctgcttcagtattgaggatgcagaggcgcccaacactatccgcatggtgcggaacatctttgggtttgtggccaaggaaccccagcctctgtcgattcggatgccagatgttatggagcagcaatcacactcagagagggagagcttgagtgagctggccacttgtcatgctcaagatgatcgttgccaatttcttctctggctggctatcccagggtttcaatcatccgccaaagcctga

SEQ ID NO: 5288 - DNA, 1755 bp, Chlorella protothecoides
atgcctgacaaggagcgccacagcattcccggccatcagtctccagggcgggctccagagccgggcgcgagtccggcatcccgtcccaccttgcggcacttccgccgggagctcgtcacggtggtcgagaacttggccatggtatcctatgtggccgcacccgacgatcctgaagagggtcacacagctcccaccccgtgataccaattactctctgcctggcgcttttgggtgcctcgttcgtggctgaatcagtggtggtgcccgagagccacagggcgcaagatcaggagtggctcgccccgtccaccagccacgctcccaggcatggctgtgggggagcgcgcaacctcctctgatcaccagctggcgccgcatgaatctcaggccccgctgggtccgccccaggcgccctccccatggtgggaggctgcctcccgctcctcccgcttctgggcccgggccagctccatctacgccggctacaaggtggcccaggtccgagcccagctgctcaaggcttccggctggtcccccgatcgcatcaccgcagagcactgggagccgcaccacgccgccgcgggggaggccatgcacgacctctgcatctccctgcgcggcttctacctcaaggctggccagttcatcggcgcgcgcggcgacttcgtccccgcccccatctgcaagcgcctggcgcgcctgcaggaccaggtgccgcccatgagccccgaccgcgccgcgtccctgatccaggcggagctggggggggcgcccctgacctccgtcttcgcctggatagacctggagcgtccgctgggctccgcctccgtggcgcaggtgcacaaggcccagctggcctgcccgcccagccagcggggcaggccgctcctggcgcggctgggggagtgggtgtggaaaccgcggcgcgggcgggacgcccccgccccggccctcctgccgggcggggcggacatgtgcctcgcgtgcgccgccgccccccgggacggagtggtggccgtcaaggtgagctcatggtcctcggccttgcgccaagggaagcgtggacgtgaccctcgtgcttgctcaatcccctgcctccatgtcctttgtcccattgacctcatggcgcttcccacgccacaggcgctccccgtcacgcccctccccgccccctccccgccccagatccagtaccccgacgccctgaatgacatgaccctggacctggccaacctgcgccgcctgtcctccttcctgtccaagaccgagatagactttgacctggtgtcggccgtggacgagctggccgcccagatccggctggagttcgatttccgcagggaggcgcgcgtgatggatgctgtggcagaccagttcaaggtggggggtttcagggggggatattcagagatcagagaagtggggcctcagcatggtctgtgcagtgcaagacccatcaacagtgcccccaagcgttgtctggcatctgggacacaagatcaaggtgcctcacagcatcccggggctggtcaccgatcgcatgatcgtgatggagtttctggacggcatccccatcacccggctggcggcgcacacctccaggtgggttggctgtgtggcagtgggatgggtaggaggctggcttacacgtgcatgcatggcagaaggatgaggggaaggcgcgtggtcgatctggacggagacggcaagatcgattgcgggagtcatgctgggtgcctctcgtgtccctcttga

SEQ ID NO: 5289 - DNA, 1740 bp, Chlorella protothecoides
  modified_base (1492)..(1501): a, c, t, g, unknown or other
atgtctgcaggcgcacttcaccgccccgtcgagcgtgcggcggaagttgatgagcgcacctctgtccaccgagctgcgcgccaagcacagcgtaagcagcaagactggcgctggcgggaggggagggtacccagtgcccgggggtgctcctcgaatccagtctgtgagcagtgggtgggaagtgcagagccgcgctcattcctgggccccctgcatgccgctgcgcaggtccgatcggtccccatcaggaaggacgacgaggtgaccgtggtgcgcggcaccttcaagggtcgcgagggcaaggtggtgcaggtttaccgtaagaagtgggtgatccacgtcgagcgcctgacccgcgagaaggtgaacggagccaccgtcaacgtcggcgtggacccctccaaggtggtcatcaccaagctgaagctcgataacgaccgcaaggccctgcttgagcgcaagaaggtggggagggtggaccggagtgcatgctgccgagcggggatggtggaggtcagggcttccagggcggccgggcggacaagggcaagttcaccgccgaggaggttaccgccatggagaacgtcgactaggcacctggcctctgtcaactggggctatgcgtgcggcgtgactcgcccgcacatggtcgcctctagctgctctcactgtgggagcggtagagggttcaagggtgacaggtggctggacgaccacggggatcggagaggtgctcttcatgtggggaacctgatggaggaagaattgcgagctggaaatagggtggacagctggtgtgaagctgcaggactgctccaagtggaaggtccgggcgactcacaggtcgggctgtgcctaaacccctccctcttgggtatgagtcttccaccccggtctctcgcgcgcggcacggcttgcatggtgctgcacggaggtcgatatgccccataccaaaggcacgacgcgcacagggtagatggtgtcctcccttccaacggtcaccagccagcccgctccccgcgtgaagtccaccagccctccctcccgtcatatcaggtctccggcgtgctcttcgaatgccccagctcctatgcccccatcaagcccatcgggaagggggcctacggcatcgtttgctccgcctgtgacgtgcgcacccaggagcgggtggccatcaagaagatcggggccatcttctccaacccactggacgccaagcgcaccctgagggaggtccagatcctgcgccacctgacaggacaccagaatgtggtggccctgaaggacctgttcccgcccccctctggccccacagagtacaacgatgtgtacatggtgcaggaggtgagctggctgggtgtgagagaggtgcagggtcgggagccagcgcgctcagggacggcgcctgcaggggttcccagggtgttgctgccggctgctggcctcggcgcgggccggctttttgccgctggaaggggttggggcctgcccnnnnnnnnnnacccagggtgttgctgccgggtgctggccttggcgcgggccggcatttgccgctggaaggggttggggcctgcccgccaggcacatgagggtccattgactctcagagccattccaaggaatgccccaccgcgagccctcctccccatgtgcagctggcagatacagacctccaccagatcatccgctccccccagcccctctccgacgaccacgtgcagttcttcctctaccaggtga

SEQ ID NO: 5290 - DNA, 594 bp, Chlorella protothecoides
atgctggggcgcaagccccttttccccggcaaggactacgtccaccagctcaacctcgtctgcaaggtggagcagccggctggaggggagaccggggtgctgtcgcgcgcaggggtcgggcgctgccgtgccgcgccctttgagaccctcttcctaccccttcctttgcggcaggtggtgggcacgcccagcgtggaggaggtcgagcgggtggccaaccccgacgcgcgcgcctacctgcgctccatgccctacatgccgcccatcgacctgggcagcacctttcccgcggctccccccgcggccatcgacctgctgcgcgccatgctgcgctttgaccccggcgaccgcatcggggtccaggccgcgctggcgcacccctacctggcgcccctgcatgacccctccgacgagccggactgcccctccccctttgtcctcaacggcgcgcccgcccagcccagcctcgagcaggtgcggctgcggagggggctgcgccggccgccccagggcgatgggagggtgctggggtttgctgacctcagggtgggtcacgccagaggacttgcagaggccagcatccgccacacctga

SEQ ID NO: 5291 - DNA, 312 bp, Chlorella protothecoides
atggacggcgctcaagggcgccgcaacgccaccgtacacccatgggcttggcctgcaatcctcgccctgacaggctccccgtcccaccatcccacgacaggtggcacggtgggcctcatcgactacggtcagtccaagaagcttcccgacagctaccgcgccctgtttgcccgcctgatcctggccttgcaccgcgaggatgaggcagggatctcggccgcgctgcgcgcgctgggcgtcgagacgcagcgggaggacccccccttggcctccaagctggcgtacggcatgtttgacacccgtggaaagtga

SEQ ID NO: 5292 - DNA, 3111 bp, Chlorella protothecoides
  modified_base (29)..(38): a, c, t, g, unknown or other
  modified_base (755)..(764): a, c, t, g, unknown or other
  modified_base (2286)..(2295): a, c, t, g, unknown or other
  modified_base (2401)..(2410): a, c, t, g, unknown or other
atgcacgaagttggggtagccacatttgnnnnnnnnnntgaccatgcacttggcgccactgtgtcgcttatccccctcttgaccatggccggaaaaactgacagcaccatagcacaacacaatactccaggacatggacgagaagctggccattgccgaggagctgctcaaagggaggcaggccctggtgtccacgcatcatggacctcggctgcttgcatcgtaagtaggggtggcggggtacgatttggcaagagagtccagggcagggacaccaaaatgcatgcacgaagttggggtagccacatttgtcaaggtgagccatggatgtgtgccatcccatcagcagaaacctgcccctacgtgcacccatgcacaggtgccacgtggacaccctgcgcagagggagggaggcatggatgcaaagggttgccaccgccagcgtggcacggcagcagtttgcagacatatttgcatgacaccctgtattcttgcggtgcgaggcctgcgatcgctcgtttggacaatagtgactgcgtctcaaaggatgtagatgaccgacctcatgtgatagtctccttcatcgcggtgataatcgctcctgcactcctatcccagacgtatgcctcggctgtcctcgccaaatctcctggcctaaccagacgagatctgagggtttatagacgcgcacgcgtgtccacaggagctccgatcgatactcaccgccatggtgaactcgtctgccgccgatgcannnnnnnnnngcaggagcttcgatcgatacttactgccatggtgaactcgtctgccgccgatgcagagctcaaggcccggttcccatgccgggaacgcagcatcgatgccctggctacggcagtgcagaccgggcaagcgggcgcctgtaccctgctcctgcatggccccccaagcaccggcaagaccgccatcgtcaggtcagttgctgcatacggtttcatggctggaatagcggggccttcggaagcatgccaagaccactgggggaactacaccatgcgaggactgtgggttctgtgccatgcaggacggcgaaaatgcaccagcgaccggactggcgtgcatgtcggcatggggcatgcgccacgcgttcatcgactgcgtggcgtgcagcaccccccgccccctgctccagtcgctgctgcaccaactcaagggcggcgcaagaaagcgcggcacgggctacgcccaggaccaggactgcgactcgctggcggagctcctggtcctcctgccggccctgttccggggtcatggccgggcacccccccagcgcggtgcctgggtggtgctggacaacgcgcagcgactggccggcagcgacctgctgacggggctgacgcgcgcgggggctgccgcggacgtcccgctgtccgtcctgctcctggccaggcagccctggtccagcacggcgttcgccacctccacgcaggccctggcgccgccggccacgctggagtgggctgcctactccagcgaccagatgatccaggtgggctggatgaggactggggctgggtgcaggtggcatggacaggggttggcatgtgggagccaagtcgagacccaatgtcggggcaaggcaagcctcttgtgcaccagagggcggcgatgtccgacggcaatggggtgatcctggagcaccgaagacgcgcgacgctccccgccggcgccgccccctccggcgacgcggccaccttccgcgccttcctcaccgcgttcgtgcccacctaccgccgcgcgaccacggacctgctggaggtggaggcggcggtggcggcgctgtaccccgcattcagagcgccgctggatgcagggcgcgagcttcggcctgcgcagctccacgcgcgcgtcaaccccctggtccagcgcgtggtcgcggagcgcagccacactgcggcgccggcggccaaggaagtcgggagcggcgtgccctgcacgggggccgcacatgatgcgaccccgggctcgtcgagtggggcgccaccggcgctggcctcccagctgcccttcgtgtccaagtacctcatcctggcggcctacgtggcgtcgcgcaacaagcccaccgccgaccgcgccgtgttcgacccggggttcaggaagaaggcgcggcgcggcgcccaggcgcacgaccgcatggtgaggctcatgtgcaggagtgcgagacttggggcccgggtgtgtgatcgacggggcgtgcatgagcgcagaggatgggaccattgggaggcttcgtgtgtgtaccacagnnnnnnnnnnttcgggagcggcgtgccctgcatgggggccgcgcatgatgcgaccccaggctcgtcgagtggggcgccaccggcactggcctcccagctgcccttcgtgtccaagnnnnnnnnnngggggtgcgagactcggggcctgggtcgaggccgcagaggaggcttggctgcgggggccgcaccccttccccctggagcgctgcctgcacatattctacgcgttgtactcgagccacgagggggaggaggtgggggagggcggggcctggcacgaccccggcgcggagggaggggtcgaggactggagcgacgccaatgtgacccgggactgcttgggccaagggcgacgctcgcctggaagccagccgcggggcggcgactgcggcggggtggaccgagcggcgacctacccgcccgaggtgctgcatgccgacgtgctgatggccctgtccagcctggtcatgctgcgcatgctcagcatgagtggcggggacccgctggagccgggcacgctgtaccgatgcggggtggaggagggggtggtgcgggccatcgccgccaacctcaaggtgcagctctccgactacctgaagctggcctgaaggtggctacaagagttcagggcaccaaacctccttttcctgctgatcccctggacggccacacattgccagccgctaccctgacaactgtcagccctgtacgttcctcactccccgcattcctgaatttacatgtgtgtacaaccaaagcagcagggctgcatctgcaagaattcttcgatcgatcggaggaccaaggtggacaaagaagagcctga

SEQ ID NO: 5293 - DNA, 639 bp, Chlorella protothecoides
  modified_base (579)..(588): a, c, t, g, unknown or other
atgctggccatgggtacaaggccagtcaggagcattaagcctcaggccttgggatgtggccagactaccctgtgctcccgggaggtcatctcggaatgggcaagtcaagctgaggtgattcactctgtcagtgtgggcatggacaccagggtctgcattgcatgccccccaattgcacctccccctgtgcatgctctgcttgctcagcgactcacgtcctccttcccacccccttcccctcttcagagagtgaagctgatgaatcagctgctcgtcggcatcagggtgctcaagatgtatgcctgggaggcggctcaggaggctgcggtgagatgggctgggatcatggaggtgaggaaggacgagctttggcagctgcgcaaggccatcccctaccgcgcggccatgcagtgtctgctcttctccgcccccgcccttgccatggtcgcctgcttctctgcgtatggcgccacatcgcccgacggcttcacgcccgcggccatctttaccagcattgcactgtcaatcactgaatatgaacagcgctcaggtccccaagacttctctcaatcaccaacnnnnnnnnnntattgccgtggagatgctgttgctgttgactctgctttgcatggctcctag

SEQ ID NO: 5294 - DNA, 903 bp, Chlorella protothecoides
atggagaggagggtggagagcagcgaatcagcgactggatggccaatccagcgagaaagagagagggaggcagaagtttcgggagcccctggctcggtaccgatccgacgccgccccgctttcccgcttcccccccctgcccccaataaccacccacccgatcaccttggcgatgttgtgggagacgtcgtagacgacgtgcatgtccaggtcgtcgggcgtggcgtcaaacatcttggcaaaggcctggcggcacaggaaggtcatggaggagcggttgacccaggcgaagttggcggcgcaggccatggcggccaggtagtcctggccctcctgggaggcgatgcgcgcgcaggccagctggcggtcgttgaccgggatgccgtcgcgcgccatggcgcgctccatggccaccagcgcgtcggtggccacctggtggcccagcccgcgagacccggagtggatcatgacgcagacctggcccacggcgtcgatgcccatcttgcgcgccgccgcgcggtcgaacacggcgtccaccacctggatctccgcgtagtggttgcccgcgcccagcgtgcccatctggggcaggccgcgcttcttggcgcggggggatacccgggacgggtccgcgcccagcatgcgccctgcctcctcgcagtgctccttgtcctccgcccatgcgtacccctctcgcaggctccagtccatgcccagctccagcgcccccgccaggtcgcgggaggtggtggggatgatgccctgggaacccacgcccacggggatgtggtcgaacagggcctgcgccagctgctccttcacgcccagcacgtcctcctcgcgcaggttggtgcgcagcaggcgcactccgcagctggattcaggggttttggtgggggctga

SEQ ID NO: 5295 - DNA, 738 bp, Chlorella protothecoides
atgtctcacccctctccatgctcgcttccgctcagggcccctgatgcctggccggacaagggcgcgctgcagtataccgatgtgtggatgcggtaccgcgcagagctgggccccgtgctcaagggtgtgacgttcttcgtggcgcccggcgagaaggtgggcattgtcggccgtaccggcagcggcaagtccagcctgattgtctccctcttcaggctgggggagccgtaccagggctcaattgcgctggacggcatcgatcttctgtccctgggactgaatgatgtccgctcccgcatcgctgtcatccctcagttgtttaccccgtcccgcacctcccccatctcaccgccccaggacccggtgctgttcagcggcagcgtgcgtgccaacctggacccgtacgaccgctacaccgatgctgaggtgtgggaggccctgacccatgtggcgatgcgcggtcctgtggcggcactgcccgagggcttgtcggcacgcgttgccgagggcggcgacaatttctccgtcggccagcgccagctcttctgtgtggcccgcgctttgctgcgcgagcctcaggtgctggtggcggacgaggcgacggcctcagtggactccgagacagacacactcatccagcagaccatccgccgcgaattccggcactgcaccgtgctcaccatcgcgcaccgcatcaacaccatcctggatgccaccaaggtgggctgggggctatga

SEQ ID NO: 5296 - DNA, 792 bp, Chlorella protothecoides
atgggcaagtcgtccctggtgcaggccatccttggggagatggacaaggagacagggcatgtcaggcctggcacaggacttgacaccaacctccttgccactccactctatcgcaatcaggcatgctgcctgtcccaagacctggagacgctgccaggaggcgcagacacggagatcggggagaaggggatcaatctttcaggcgggcagaagcagcgtgtctcgctggcaagggccatgtatcaggacgctgatgtctacatcatggatgaccccctgtcggcggtggacgtccatgtgggccgccacatctttgagaaccttatcacgggagccctcaagggcaagacgcggctgctggtgaccaaccaactgcagtactgccaccatgccgaccagatcattgtggtggacgagggccaggtggtggtgcagggcacctacgagacctgcatggcgcaccccacttttgctgggctggtgcgggagcacgctgctgaggcgggggctgatgaggaggcccccgagcccgccccctttgccaagaagggaagtggggagcttgtgatgcgcgctgtctctcgcagtgaggtggcgctgcaggaggtgttggaggaggtggaggggacgccggaggacgctatcgacggccctccgcatggccaggccaccaagcctgccgtcaccggcagcatgctggtccggccctccaagggctccagctcctctgccacgaagaagcacgacgtcaaggtgatggttgctgggtgggacggacgtaggggggcgtga

SEQ ID NO: 5297 - DNA, 435 bp, Chlorella protothecoides
atggtggacgggcggatgaagagcctgctggtgcatcgcaagggggcgacgcgcgccttcccgccccaccacccgctcatccccgtggactaccagctgacggggcagcccgtgctcatcggcggcaccatgggcaccgccagctacgtgctgacggggacggacaagggcatggccgagacctggggcagcacctgccacggcgcgggtcgcgcgcgcagccggaacgccgcgcgcaacaagctggactaccagcaggttctggattcgctgaagaccaagggcattgccatccgcgtggcgagcccaaagctggtgatggaggaggcgccggagtcctacaaggatgtggacgacgtgatcgagacgtgccaccaggcaggcatctccaagaagacggtcaagttgaggcccattgccgtgatcaaggggtag

SEQ ID NO: 5298 - DNA, 360 bp, Chlorella protothecoides
atgtccaaggcctacctaccagtgagcattgatgccgagttcaagcttccctcagacatctccgccttccttcctcataccaacctcctgtccatattctgcgctgcgcaggatacgggagacatggacttcatgctgtccatgtccctgtcacagctggggacgtgtgtgatgaacctgctgggcacaatcatcttcatcgcggtcatccagccctggatcctggtgggcatagcgcccctgaccattgtctactacttcatccagaagttttacaggtggggttgttcaaagggtttgaggagattcatagagaggtttggattgatgacagagtttgagtttaccctggaggaatga

SEQ ID NO: 5299 - DNA, 279 bp, Chlorella protothecoides
atgagggttcccggcatcttttatgtgaacggcgcactgcgcagcatcctggacgacgagctgcgggcctactgcgatcgtggccccgccggcggcttcctgccggccgtcaagcagattgccaacgtggcagccctccccggcattgtcaggcactccatcgccatgcccgatgtgcattccggctatggcttcagcatcggcaatgtggccgcgtttgacatgtcggacccggaggccgtcgtctcccctggcggcgtcggctttgacatcaagtga

SEQ ID NO: 5300 - DNA, 621 bp, Chlorella protothecoides
atgttccaggacctgcgcccgcacctggcacagctcctgcgcgcgcgccgcggcggcgtggtggccgccctcctcgccggcgcccggcggctgggcacgctggaggccgacgcagccgccgcgacctgggccgccgccggcgcactgggcggcgaacacgccgggcccgtcccggccttgctctcgctggacaggcccgtccccctggcgcggctgggcccctccgcaggcacgcgcggcaagtcggggctgtcgccgctgggcacggcgctgctgatccagctgctgcagctgcctgtggaggccagcggccagtgggccgacgcgcttgcggcactgccgccagcgcagctgaggcttgtcgcgggggacgcggggggatgtcgcgtggtggagacctacctccgcgctgtgcagaagtcgggcaagaaggtgaaggccatgctggcggcgctgaggggggggtgggccttcgccgcccagggggggtcgggcgccaagtttgtccagacctgtttcgacctggcggtgaggcgaggggaggagaggcgagggggaggttgggttgaaactgatgcagaggggggagtcgggtgtggtgtatcgattccacattgctag

SEQ ID NO: 5301 - DNA, 4017 bp, Chlorella protothecoides
  modified_base (861)..(870): a, c, t, g, unknown or other
  modified_base (951)..(960): a, c, t, g, unknown or other
  modified_base (2800)..(2814): a, c, t, g, unknown or other
atggaacctgcctctacacagaccgcttcagaccctcgccaaggcacgccatcatgcacgtgcaaccagaccccacccaattcaacccggcatgcgacgcaccgccagccaatccctgacgcgggcgaggaagtcttccttgaagtcgatgtctcgctgggccgtcagttggatcgggggctgctgggaggcacgctcctcggcgctggcctctcgagccacacgtgcaagcctcgcgtctctggccacagctgcacagtgcaagggaggggagggtcaggggtcaggcggggatgctggagtcgacaccagcagtggctgccagctccatactcggtgcacaggggaatagttggggactacctctccagcctgaaggaagtcgccctacctgtcatgtatggcacgccctggcgaatgcatttattgaagtcaaagccacagccagacaggaattccagggaggaggcctgggaaggtgaatgcacatgccaggtttccagcccagccttagtgaagcctagttgcccagcaacttgccgcgacccttcatcccgagcttgtttcttccattcttcctcccccttcaatcaaccacatgcctgtgacaggaagcgacggcccgtgaggctcggggcaaaggccgccaggccgatctggatgagcccaaacttctgtgcattggcagcgacctgtttcaggggcatcggatgcggtgctcaggatggacatctgataggaaggaacggtgcacaggcaggcccggcgaggtttgtccaaggtgtcgggtcacaggccagccagcagccaggaagagcatgcaagccagctgcagcaatgcactcaccaaccacacccatnnnnnnnnnnctagcatctaccccagctcttgagtggtcagatggtgccatacagggtgcacttgtttcctccattcttcctccccctttnnnnnnnnnncagcgacctgtttcaggggcatcggatgcgatgctatcaggaacaggagctcaggatggacatctgataggaaggaactgtgtacaggcaggcccggcgaggtttgtccaggttgacgggtcacaggctagccagcagccaggaagagcatgcaagccggctgcagcaatgcacttaccaaccacacccagcagcatcccttcaccacaccccacatacatcctcatagcgggtctgcatgtcgtccaggtaccatggcttgggttcgtagtcaaacaggccagtcatctcacagtccacagcaacaaaggaggcatggtcgatggcatcacggatggtgggcatgagctcttgcaaattatgccgtgtcacctgaagtccaagaatgttgggaaatacagtgatatcgggaatcgagatcattcctccctacctccatgctggagaaaccaaaaggctggtaatgcacttatttctcttgctaaagtactgtcagaatcgcctgtccgtcctagacgccggcaagggagcagcgctgcgccgttggcacggtcatcgggagaaacccacccgtcgacattgcgctcgtctcactgcacgccggggagtgcatcggtgcagagaccaggcacttcaaaccgtgattgggcgcgagacgaacggagtgggccagagtctcgggggtgccaggctcttatacagcgggtccgcgatctccgattacatgctgaggtcccaatgtcacgtggcaacgatcgttgcattctgatggccacaaccccccaaaccaaccccgctcagccccatgccgccatgcggcccctggcctgcgcgggcgtgcccgtgaaagctaccctgccgccccggattatagacacccggtccgcccagtccagctcctccatgcggtgcgtgatccagagcgcggcgccgcggccgccgccggcgtccaccgcggcccgcacacagtccaggacgccgcgctggtcgcccacgtccaggaacgtggtcagctcgtccaggagcaggaccgccgcctgctccgccagcgcccccgcaatggccacgcgctgcttctgcccgccagacaggctggacacggggcgggcctgcaggccctctaaccccacggccgccagagccgaggcggtcagcctgtccacggcgtcatgcgtcagggcgcaggcagcaggagaacagccatggctggcctccttccaacacccgagtaccccagacctccacccctccagtgcacacgtgcctgcccagcccaaaggccacatcggcgcccacgctgggcatgaccacctggtggtctgggttctggaagacaaaggcgtggggcgtggccagggaaatggtgcccgagtcgggctgcagcaggccggccagggctcggaccaaggtggacttgccgcacccattggcgcccaggagcatgtgcagggagccgcgcttgacctccagcgtcaggtcgtccagcacctgcagagggcgtgcgagtggaagctgagggagctagagggggcgggaaagggcagggccggcggagcatacgtcctgcaagatcatgtgagggttagggcgatggacctagcggccccctggcccaccggccccctggcccaccgccccatgaggcggttcctctggccccctggcccaccggcccatgaggcggttcccctgggtgaaaaagtgcacaacagctaccttggcatcggtcggcttcccaggtcatgtgcaaagcaatcaccgcttccagctccatgctttctaaaccgccccaccttcttgctcccggattcatcagacagcgtcaagctcagattcctgnnnnnnnnnnnnnnnagcgtcgctcacgagctctggggccggacgcacccgtcagtcgggtgtggggcctgtctcgaccacggccctggcaccccccccgccatccggtcgagcagggttggcaccgcgatgtcagcattccatgatgccgagtggtctcccaacctccatgaggttcgcaatatgtcctcccagggcccggcagttccttgtcacaccctcagctcacccatcagcggatgtgagtctcggatcgaagaattccgacacttctaccacgactgcatctccatcggttgcagcatggcaacatcccaggacgaggtgaccgttgatcttgccttggaagccaggtgcgacctgggggagtcccccgtctgggatggcaagaccaacaccctgtacttcgtggtgagtttatcttcgtgtcgagactgtccgtcggtgagatgtcaatgccatcggttggcacctggggtttcgtggatctcgcatggcgccgagcgtgcgagtgggacccaatgcggtgacgacgatgttccttgtgtggcggtccgccggggatcacagagaggacaccaagcaagtcaaccatgcgttctactcaccagtgcatttgatccacatgccaacatatcctctcttcaatctcctcaccaactccaggacataaatggcagaaccatccatggcttccagccagagactggcgaacacttcactatcaaggcagatgagccgaccgggacgatcgtgcccaccaacgaccccacaaagatcctggtggcaacacagagggacatcctggtggtcgacgtgcctggccgcaaggtgacgaagcaggcgatcgccaccacgcccgaggagcacggcacaggtgcagggtttgagcttgtggatgcccttgtcctcgcatgcttgctgggctggttcaggtctcataggtatttgctggcggacaccatgcactgctgggggatctctgccggcctcgggtggactctgcagcaggctgcctgctacctcttccagctttgcctttggttccccttctcagcacatgcgtctcatgctcacaccacgaatcctccttgcagagggcttcaggttcaacgacggaaaggtgtcgccctccgggaccctcctgatcggccgcatgagcaacaagtggaggaaaggagagcgtggcaggcagtaccgactcgaccccggctctag

SEQ ID NO: 5302 - DNA, 1080 bp, Chlorella protothecoides
  modified_base (376)..(385): a, c, t, g, unknown or other
  modified_base (973)..(982): a, c, t, g, unknown or other
atgtctgcttccccccaccttcaccatgatgtgcagtccgacacggaggaggcgctgctgctgcccagcagcaactctttccagcgagcggtgcaacaccaggagctgcggcggccccagtttggggcgcccgacccgcccggcttccatgtggaggtggtcaaggggcctagcggctacaaccagctgcggctggtcaaggcagacccggaggtagcggcggcggccagggctgccgcgacgtccaaggcgcaggctgacatccatgccgcggcaggtcagcgacgatggcgagaaccagagtgcagacccagcagcgcttctccccttcgccctgcacacactctcccatgcacacacaggcttcacggcggtnnnnnnnnnngaagcttcctggccttgcctgaatgggatcatggaaactcttcctttatatgccagcggggaccagagtgcagacccagcagcgctttccccttcgccctgcacacaccctcccatgcacacacaggcttcacggcggtgctggagatgctgaggggcgctggaaagcctgtggttggccacaacgccttcttcgacctggccttcatcctttcctccttcgccacccagctgccccccagcctccgggccttcaaggagctggtgcgcgcctggttccccgccggcttctgggacaccaagcacctcgcctgccagctccaggccgcgcagccagcggcagcgccggaggacacgagcctgggggcgctctatgccgatctggaggccagggccgcgggcggcgtggcaagtgatcccggtgaaggggggctcatccagaccgcgccgctacccaccgtgggccacagcgtcacgtttgatcgctacgacgtgagatgggagaggggggtgggtgttttgttcttggggggagagggttgccaggaagggtgtgatatggtgatgatgaagcagctctcgggggatnnnnnnnnnngagaggattgcaaggaagggtgtgacatggtgatgatgaagcagctctcgggggatgcttggcaagtcgggcctgacaaatttaccttacacaagtag

SEQ ID NO: 5303 - DNA, 510 bp, Chlorella protothecoides
ggccgcaacgccagcgccgccagcgtggccgtcgagctggcgggcatgcaggcggcgaccgaggcggagagcccccgtgccggcgccgaccccctgggcctgcgcgagctagcgcggccgcggtaccgccgcccgctggccatcggcgcggggctcatgctcttccagcaggtcacggggcagccctcggtgctctactatgccgccagcatcttccaggccgcaggcttccagtccagtggccaggccacgggcgtatccctgggcctgggcctgttcaagctcgtcatgacaggcgtggccgtggccaccgtggaccgactgggacggcgcccgctcctcctgtggggcgtgtcgggtctggtgggggccctgctctgcctggccctggcttcggggggggcgctgcccattgacccggggctggtggcctggaccaacttggcggccctcctcgtctatgtcggctgctatcaggtgtgtggaagcggggtgggtccaggggtgtga

SEQ ID NO: 5304 - DNA, 693 bp, Chlorella protothecoides
atgctcctgggcgccaatgggtgcggcaagtccaccttggtccgagccctggccggcctgctgcagcccgactcgggcaccatttccctggccacgccccacgcctttgtcttccagaacccagaccaccaggtggtcatgcccagcgtgggcgccgatgtggcctttgggctgggcaggcacgtgtgcactggaggggtggaggtctggggtactcgggtgttggaaggaggccagccatggctgttctcctgctgcctgcgcccttcagtaccgagctgtcagtcgtcacctctggggaagtacccttacctgacgcatgacgccgtggacaggctgaccgcctcggctctggcggccgtggggttagagggcctgcaggcccgccccgtgtccagcctgtctggcgggcagaagcagcgcgtggccattgcgggggcgctggcggagcaggcggcggtcctgctcctggacgagctgaccacgttcctggacgtgggcgaccagcgcggcgtcctggactgtgtgcgggccgcggtggacgccggcggcggccgcggcgccgcgctctggatcacgcaccgcatggaggagctggactgggcggaccgggtgtctataatccggggcggcagggtagctttcacgggcacgcccgcgcaggccaggggccgcatggcggcatggggctga

SEQ ID NO: 5305 - DNA, 1932 bp, Chlorella protothecoides
  modified_base (1334)..(1343): a, c, t, g, unknown or other
atgccccataacatggatcccacttgcaggcatttttcacggctgtgcgccctcagccagccagactgtcgtgctctccgacccctggctccgccctacgcgcccagccccacgcaatccgtcgatccagacggcccttctccgtcgctgctgtcgccaccccgctcaatgcacgtggggtgtgtgtgtgtgagttcacctgcaagagcacgtagtgtgatgcttgctgcttaccttaaatctcctcctctgcgcaccgttcccacctcaggaaaccgcacccgcctcccatccggcggtgaatgcgcccaaggaggcgcatggcttcaccctggtggagcagcagtatctggcagaggccctttccacgccacttcctgtccccgagccctgggtgcttcccttggtctataccatttgatccacaaagccatgtgctgcatacaaagggaccccaagccgtggaggcattccgtgacctgcccacttcagcacccacccacactctccacattgccgccctccccaggcgcgcagctgatgtctgtgatcaacaaggacgagaacaagacctttggcgcgaccttccgcacccccgtggatgactccaagggcacgccccacattctggagcactccgtgctgtgcgggtcggacaagtaccccatcaaggagccgtttgtggagctgatgaaggggtccctgaacactttcctcaatgccttcacctaccctgaccgcacctgctaccctgtggcctccgccaacctgcgcgacttctacaacctggtggacgtctacctggactcggtgctgcaccccaactgcgtgagcgacccccaaatcttcgcgcaagagggctggcactacgagctggagggcgaggccgagcccttgacgctcaagggcgtggtgttcaacgagatgaagggcgtctactcctccccggactcggtgaatgcccgcgtcacccaggccgcccttcaccccgacagcacctacgccaaggactcgggcggcgaccccgaggccatccccaccctcacctttgacggcttcaaggacttttacgcgcggtattaccacccgtccaacgcgcgcttctggttctacggcgacgatgagcccgaggagcggctgcgcctgttggctgcggccctggacggcttcgaggcgcggcaggtggacagcgtcgtgcgcccgcagccgctgcttgcgcagccgcgcgtggtgactgagcgctatgcggcgggcgccgtggaggagggcggcgagcctaagactttcgtctccctcaactggctgctggcggaggaccagctggacctggagannnnnnnnnngggaggagggcgtcgagcccaagactttcgtctccctcaactggttgctggcggaggaccagctggacctggagacggagctggcgctgggcttcctgaactccatgctgctgggcacgccggcggcgccgctgcgcaaggcgctgaacgacagcgggctgggggagagcctgatcgggggcgggatggaggacgagatgcggcagcccgccttctccgtgggcctcaagggcgtggccgcgggcgacgtggaggccgtggaggcgctcatcctggagacgctggaggggctggagcgcgagggcttcagcgccacctccatcgaggcttcgctgaacaccatcgagttcgcgctgcgcgaaaacaacacgggccgcttcccgcgcggcctctccctcatgctgcgcagcatggccacctggatctacgaccgcgaccccttccagcccctcaagtgggaggacgacctggccaagttcaaggcccgcatcgcggaaggcagcgacgtctttggtggggcattggtgtgggtggttggtgtggggcgaggtggatgggggggtcaggagtgcattgggtggctggctga

SEQ ID NO: 5306 - DNA, 993 bp, Chlorella protothecoides
atgagtgccctgctgggcaggagcggcaacacctcacctggcccgccccccggtggtgcacccgccccccccgcccgcccatccatagccacgatgagcgacgaggtggtagacagcaatccatacagccggctcatggcgctgcagcggatgggcatcgtgaccaactaccaggctatccgccagaagacggtcgccgtcgtggggatgggcggcgtgggctcagtggctgcagagatgctgactcgctgcggggtcggcaggctgctcatgtacgactacgacacggtggagctggccaacatgaaccgactcttcttccgccccgaccaggctggcatgaccaagaccgacgccgccgcggccacgctgaccgggatcaacccggacgtggccctggaggccttcaccatgaacatcaccaccctggctggcttcgaggccttcaagcgcagcctgagcgacggggctggtcgatcgcgcgtggacctggtgctcagctgcgtggacaactacgaggcccgcatgaccatcaaccagccaggcgttgggccccacccaatcatcactgtgatgggcatacagcccggctctgcgcctcacgacacggcagctttccacccggatcacatggcgccgactcccaccccgttctccactccaccccgactcacacaggtctgcctggagctcagccaggcctggatggagtcgggggtatcggaggacgccgtctccggccacatccagaccatcctgccgggaaccacggcctgcttcgcctgcgtgcccccgctggtggtggcctcgggcatcgacgagcgcacgctgaagcgggagggcgtgtgcgcggcctccctgcccaccaccatgggtgtgtgtgggtggaaagggggacaggcccggctgggtgtcacggcgtggctgtgtgtcagccaccggcgcgagggcggctggggccgggcatcacgcccttgggcaccgcagctctga

SEQ ID NO: 5307 - DNA, 1380 bp, Chlorella protothecoides
  modified_base (439)..(448): a, c, t, g, unknown or other
  modified_base (1115)..(1124): a, c, t, g, unknown or other
atgggctggagctatgccctggtcagcattattgcatctcttgtcgtcaatctaaatgtggaacccccctctgaggacacatcagccttcgttggtgaggcggggtggaggggcgggcggtgcacagggtttcgtagcggccgcttgccggatctccgcaagcgctgtctgtcaacgcccagacgccacagttcatgccgtgtaatgaatgacaccttgtcgagcgcagagacgttccagttgctgggcctgttggatgtgcttaacgcggctgtggggctagtcgccagtgcacccctcacagccttcctccagtgggccggacgctccaatgtcctgttcggtgtgctgcccctggctcccccagaggtttccaagtcccccatcgtcactgtgctctttgctgtatgggccctggccgacatcatccgatttgccnnnnnnnnnngacaagggcctgatgcacagggatccaaggcccgtggggggatccggggtgcattgagggcctcaggggggcaccagtaccaagatatctccgggccccgcaccgatcccatccttgcaggtttccaagtccccaatcgtcactgtactctttgctgtttgggccctggccgacatcatccgatttgcctactacgcctctgtcatcatgggaaagtctgtccccatactggcatggctcaggcaaggtcgcgacctacacatggcatgccggcgggcacctgggtctttccaagtacaagcaggcttgtgcttcagctgaatgaagctacaatttggcgaaatccattcctcccccccccgcaggcaagctcgcgacccacacatggcatgccggtgggcacctgggtctctccaagtacaagcaggcttgtgcttcagctgaatgaagctgcagtttggcggaatccattcctatcccgcccgcaggtactctgccttcatccccctgtaccccattggaatgcctggtgtggagatcagcgctgggcaggagagaagcgtgcctgtccgccttgccgcatccatgcccacatgagaggtctgctacgccaacttcctctgggtgagtcggcaagaatgcctggtgtggagatcagcgctgggcnnnnnnnnnncatgatgcatgcatgcgtttcgggcctgcgaccgaggttgggagggagtggggtgggtaccccccacctgcctgaaactcacaccccaccttggcaccccgcaggtgctcctcctaatctacattccaattttctggaagctgtacagtttcttgctgcgacagcgcaagaagaagctcgctggcagcttgaagaagaaagatgcctgatgtggggcggacgcagcagctcagcacgtgtgggcgagatcacatga

SEQ ID NO: 5308 - DNA, 1692 bp, Chlorella protothecoides
  modified_base (157)..(166): a, c, t, g, unknown or other
  modified_base (732)..(741): a, c, t, g, unknown or other
atggggccgggagtccctgtagatgcaggctcacatcaccaggcagtagaatcagagcctttaacctctcatggtcgcttgaaacacctccaagtgacctcgagaggaaacaggccaggagcactggcaaccacccctgtcaaccgcgtctcccacnnnnnnnnnncaaatgcaggctcatatcaccaggcagtagaatcagagccctatacctctcatggtcgtttgaaacacctccaagagacctcgagaggaaacaggccaggagcactagcaaccacccctgtcaaccgcgtctcccaccgcgaagctgcaggggacggggtgcctggcctcgtcgggcatattcccatgtctctcgtccatggagcctatcacacaccgctcatggcgctgagtccgggtatgggtggacactgtcgaagtgtgcgcatggagcgccgggtttcgccctccgccgtgctgcagtccccacctgcacccgcgaagacccggcccaggccgcccagccccaggaagatgcgcatgcccaccgagccttctgatctggtgcactttgagagcaccctggagcacagggcatgggtgtacggcaccatgggactgctcatggggtctgttggcattgctggcacccacacggacagccctggcgaagtgttggcgctcctggccagttgtgtggcctcctactatgcggcagttgaggggaattttccatccttcattccnnnnnnnnnntttcgtctcgggtgtggtgcactggggcctggacaactatggcgacggcgacacgcccttcttcggcagccagatcgcggcgttccaagggcaccacagcgagccctggaccatcacgcagcgagcctttgccaacaatgtgcacaaggtgttcaagccggcgaccgcaccagccctggtcttgcttgccgccgcccccttcaccccatcctggctcaccacctttggcgccagcctgctgctcctgctgtgcctgagccagcagacgcacgcctgggcgcacaaaaagcccagccagctgccggctgccgtcctggccctgcaggtgacgatgatgatggtggggttgtagggcaaggtatactttggtctctctggaagggcacaggagcgcttgcccgccaggttgctggtggtggtcagcagcccccaccgcgtccacacctcgtgtctgctgtgccgtatgctggcgtgcgtgctgaggttccagccatgaccttcacgctacctttcccgccctcccaggacgcgggcgtcatcgtgtcctgcaaggtccatggcgcccaccacaggccgccctttgaggggaactactgcattgtcagtggcgtgtggaacccgatcctggatggcgacggctcgggtgagggggaagggctcgtaccgcagcatgtggtcaccgctgggtgggctgtggcctggcgctgcattggcgcgtgggactggagctgggcctggcctgtctgcaggcatgctacacaccatgaggattccagctggatggcctgtccttcataccagctcaagcgtgtgccagcatgccttgctgcagaccagggcttttttcggaggctggagcggatcgtgcaggctgcgacgggggtcaagcccaggtgctggacagaccccgagggctttgcaggaacgcctgagggcgaccaggacacgtga

SEQ ID NO: 5309 - DNA, 318 bp, Chlorella protothecoides
atggggtggagtgggcagtccgaaggctctgtcggagaccgggatcgctgcgcgggaccaggaagagagagcctgccagctgcccaggacctgcaggagtggcacccttttgagaaagccatggtttcaatgcaccccccaccccccctcgatcgtttccaccgccacgttgcctctggacccaccattcgagcccccgcccccttcgcgcatgcagtggacagcatcgtgaagagcgaggaccacgatgtcctactggaggtgtatgcgccctggtgcggccactgcaaggttcgggtgcgggtggggggagcctga

SEQ ID NO: 5310 - DNA, 1596 bp, Chlorella protothecoides
  modified_base (787)..(796): a, c, t, g, unknown or other
  modified_base (866)..(875): a, c, t, g, unknown or other
atgtacacacatcgcgaccgtcagataggctgtcccatatctggttgggtctgcgctgcacttacacacgacgcatgcttgcttcctcctcgcaccctccatcccacttggacttccccccctccccctctcctccagccctcagtcggccttcaccgactcgaagatcttgtaggtgaagaggtaggaggagaggaagccgatggtgccgcttgccaggaacatgcaccaggccatgagcccggtgtaggcgaggtagaggacgacggggacgaagccggagaggttgtgcaaggtgttgaacaggaagccgacggagtagatggcgacgtaggcggcgacggagccgccgcggtgggtcagcgccgcgaccagggccaggaagccgaagatgtagtagaagtagccctgccacaggctggtcattgcaaagtagagctccacgaagatggtgccaaaggggagcaggcctgccgcgacaaagaggaccagcgggtgggaggcccagtgcggggcggggatgtggcgcgggatctggttggtgcgggagggccagggcgcgatgtcgcggcgcgcggccagtgcaccgccgccgtaggccagcgggatgctgaccaggagccaaaggaagatgatggagaagaagaagcccagggggatggtgcccgccgaccccgtgtaccacaggaacatgttgagcacggtgagcaccgccacggtcacgccggggaagaagcaggccacgcgccagcacacctgtgtacttggggggttggggagttggggnnnnnnnnnncaagtgggatggagggtgcgaggaggaagcccggaccaacgcgcccccctgcagtgatacacctgctcannnnnnnnnnaaagggggagggtggtggggaggggttgtgcagagtggaaggggataagttgcggtgggggtggggtggaggcttcagggagtgcattgtgacgtcaaccacgcgacccagtccgcatcgtggggaccccccctcccatccacccacccacgcgcaccttgtgccagccctcataggtgcggttggccacgccccagagccagacggccgccgcgcccgccgcgacggagagcaggaggtacatggccagcgcggcggtgagcagcgagccacgcgcggcgggggacaggaagcccagcgaggcgaagagcagggtcacccccgcgctggccaggatctgcacccccgaccccacctgcaccgccagggacagagtgtcggggggcgcgcggaagacgtcgccgcccaccatcttccaccccgactcctccgcctcgggcgggggcgcgccggggccggccgccccgccgtccaccagcagggcctcgtagtgcgccaggtcgcggcggatggtgcgcagcgtgatcagggccacgatgcacgacatgaccaccaccaccatgagcgagttgaggatggagaaccagtgcacgcgcccgccgggcatgcgcaggtacgcgtcccaacgcgaggcccaggtgatgtcgctcgtgtcccagtagacgtcataggtgtacacgatgcgggcgcctgggcggggcaggagggtggggatgtccgg

SEQ ID NO: 5311 - DNA, 594 bp, Chlorella protothecoides
gcgcccgcatcgtgtacacctatgacgtctactgggacacgagcgacatcacctgggcctcgcgttgggacgcgtacctgcgcatgcccggcgggcgcgtgcactggttctccatcctcaactcgctcatggtggtggtggtcatgtcgtgcatcgtggccctgatcacgctgcgcaccatccgccgcgacctggcgcactacgaggccctgctggtggacggcggggcggccggccccggcgcgcccccgcccgaggcggaggagtcggggtggaagatggtgggcggcgacgtcttccgcgcgccccccgacactctgtccctggcggtgcaggtggggtcgggggtgcagatcctggccagcgcgggggtgaccctgctcttcgcctcgctgggcttcctgtcccccgccgcgcgtggctcgctgctcaccgccgcgctggccatgtacctcctgctctccgtcgcggcgggcgcggcggccgtctggctctggggcgtggccaaccgcacctatgagggctggcacaaggtgcgcgtgggtgggtggatgggagggggggtccccacgatgcggactgggtcgcgtggtt

SEQ ID NO: 5312 - DNA, 636 bp, Chlorella protothecoides
atgttcctgtggtacacggggtcggcgggcaccatccccctgggcttcttcttctccatcatcttcctttggctcctggtcagcatcccgctggcctacggcggcggtgcactggccgcgcgccgcgacatcgcgccctggccctcccgcaccaaccagatcccgcgccacatccccgccccgcactgggcctcccacccgctggtcctctttgtcgcggcaggcctgctcccctttggcaccatcttcgtggagctctactttgcaatgaccagcctgtggcagggctacttctactacatcttcggcttcctggccctggtcgcggcgctgaccctcatcattaccatcgaggtcagcatcgtctgcacctacgtccagctgtgcgccgaagactacctatggtggtggcgctcctaccaccgcggcggctccgtcgccgcctacgtcgccatctactccgtcggcttcctgttcaacaccttgcacaacctctccggcttcgtccccgtcgtcctctacctcgcctacaccgggctcatggcctggtgcatgttcctggcaagcggcaccatcggcttcctctcctcctacctcttcacctacaagatcttcgagtcggtgaaggccgactga

SEQ ID NO: 5313 - DNA, 576 bp, Chlorella protothecoides
  modified_base (536)..(545): a, c, t, g, unknown or other
ggggggggattaggagggggtcccttgggggagggatggacgggcagctggcttggtgtttgtggagcttggcatggcgtgtccactttccccgtcgggtcatgcccgagcatgcacaggtcccactcccaatgtccccaccaagcaccaggtaacagtcagaatctcccccaaccctgcaggggccctcacaccttctacctgaagcagagcgggaacgttgaccgctggggtggcgcgctggtcaacctggtgcactaccaggacgccgcgggtctgaccctggcggtgctccagcaccgggggcccgatggctcgcccccacgcggcgagaccttcgtggcctgcgacgacgagcccatcaccctccaggtggcgcagggggtgattcctttagagatcttatctgatttaccgcagtgcggcacacgcatcactgattccccccgctgcactcccgtgcctctgatgggaccgacgatcccgcggacaccccacccacccccctcacacactccgctacgggcgtctgcagnnnnnnnnnntgggggtgcttcctctggagatcttacctga

SEQ ID NO: 5314 - DNA, 963 bp, Chlorella protothecoides
  modified_base (555)..(744): a, c, t, g, unknown or other
atgatccgagctgctccgaggaccgccgcctggccacgatcacttcccagcctcagcgcgcctccacggtttgcccaccgtgtcagcacccgtgcgatgaccttcttcctcgacacattcgccaagagacagtgggaggatccagatcatgcagggtcgaggctgacctgggatcaggcagacttcgtggccagggtggagcgggcccatgcagagggtgcccagctgcgggacggctacgcgcccttctgcaagcacctgttcatacccaacttcacggacgccgcggtgggtgcggagagactcacgcccgacaatgtgcagtccctgcgctctggctacctcaagcgccgccccgaggagctggcggtgctgtctcgctggctgcccaggtcggcggtgccgccccgcaccgccaagcacctggacataatcctgtactcccgcgagcagctggtgaaggagcatgccgccctgccacacgtgtctgccggggatgcagaaaaggcactcccagatgcgccatggggcatcatctccatcaaggcacaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacccatcatgcactcagcccatcaccatcctgaggaacgctttgggtcgggaggaaggcggaagtggcgtcccactggacaaagaagcatacgcggcggctgtcgagtactgggacgctcatgcgatcatccaatgatgcccaggctgcctctcgggaggcatgccgagatttgtgagtccccacctgcagctttaaagcaagcaaagccttcttga

SEQ ID NO: 5315 - DNA, 1260 bp, Chlorella protothecoides
  modified_base (24)..(33): a, c, t, g, unknown or other
atggtagggagttcgcattttgannnnnnnnnngagggctcctgtgtccccgtctcctgcacggttggcaccatcaccgcggtgaagatgggcatgcaaccaagccacagccgcccccttggtgattcatgggcttctgcgcggaccgagaccgatgctgcctcgtgcatcagatcacaggatcccacaggagtatttgataaggttgggagtaacgaggatcctctgcatgtgacgtcaaggtgcagggcaggtgagggcaggagaggtatgagatcggcggagcggccccttatgttaccacccgacaccctccgggatgacttcctccacaccaagagctgcaccctcctcacagacgtcctgctcatgtcgattgaatcatgccctggaactagtgtgacgttgaacagcagagatggtgcggccctcggcagaactcctggacgagatctgcgtgcggttcatcatcaatctccctcccgaggaactagagtgcgtggtactgatgtgtggtggctgtgtggtagtgcaggagccgcgagcctagcctccatgccccctgttaacccaaatccccccttagcaacccacacccctgtctgggcatgcagctgcaccgctgcctccccatcttgccccaaacaaaccggacctccccgatgtgcttgcaaagtgcgcccgcttccccgcccaagatcagtcacatcggcccttgccctcccctgcatgcctctcccacaggacaacatccgggccaaggaccccactctgtcaagcctggggctcaaggagttctgcgccctcatcttcgacgcctgccctgggctggagccgtaccgcggcagcctggacgccatctactccgctttcaatgactacaagcgcgccgtgcccgtgcgcggcgtcatcatgctggaccccacgctgcgctgctgcctggtggtgcggggctggcaggagggcgcctcctggggcttcccgcgcggcaagctgtccaagggcgagtcggacctggactgcgccgcgcgggaggtgctggaggagacggggctggacctgcgcggcaggctcagcgaacaggactgcatcgcgcggcggtcgggcgcgcaggacatccgcctgtacatcgtggcgggtgtggacatggacacccagttcgccccgcaggcgaagttcgagattggggcctacaggtggctgcccgtggaggccctgccccggagctacgacgccgagaggacggtgggcggggaatga

SEQ ID NO: 5316 - DNA, 1167 bp, Chlorella protothecoides
  modified_base (199)..(208): a, c, t, g, unknown or other
  modified_base (292)..(301): a, c, t, g, unknown or other
  modified_base (470)..(479): a, c, t, g, unknown or other
atgcccatcctcaccgcggtgatggtgccaactgcgcaggagacggggacacaggagccctcacccgccggcgccgtcccgggagactcctcctatgtgtgcatctgtctgtctgcagcaagtaggacggcgcaatgggcaggagggtctgcagcacggcacgcatggcaaccctgcagcgcatcctgcatgccgcacnnnnnnnnnngcaaaatgcgaactccctaccatggggtccctccccaggggatgttggtgttggtagtgctgctcgttgccactgccggtgcannnnnnnnnncgccgcaagtaggacggcgcagtgggcaggagggtctacagcacggcgcgcatgccaaccctgcagcgcatcctgcatgccgcaccacgctcgaagcccctgcactcagaccccaggctggcccacggccattcacgcgcagacgagcagcgggacatcgtggactggnnnnnnnnnntgcccctgcactcagacccctggctggcccacggccacacacgtgcagacgagcagcgggacatcgtggactgggcgcggggtgggtcgtgctgtgggtggtgccccgactcctcactgcctcagggttcactgtcgctgtccagaggcgaccctcacagcccccctttcctcctcccccgccgcccttgatgcagtcgggcctggtgcgacacatccttgccagcaacgcgacagagctgcaggaggacatcctcaacaccacagggcgcctgatcaatgccaaatacaagcagctcctggcctactccctctgcctgcgcgatttccggctccagcaccgctggatgggtgaggcagggccacagggggactggggtggggggacgtggtcgtgctggccgcccgacacactggtcatcctggttggtgcacatgttcgaggatccccaccggacccagccggcagcacatgtgcccccattgcgtctggagatccctcggcaccctggactggaccacgggacggcccaccacctgcactcctgctcatgctccttgccgggaggaggcaaaggggccctggatccgcactcctggtccgtcaccgtgcctggttcatccccttcaaggcccacgtcagatctccgtctcaccatacaatccctgcaccactacaccccgcgtga

SEQ ID NO: 5317 - DNA, 1140 bp, Chlorella protothecoides
  modified_base (1128)..(1137): a, c, t, g, unknown or other
atgcgcccccattgcatctggagatccctcggctctccggactggtccacgggacggcccaccacctgcactcctgctcatgccccttgccgggaggaggcacaggggccctgggtccgcactccggccttcatcgacgcggacgaatacctgacagtgcgggaggccaatgccacgctggtctccatcctggccgactacgaggcctatggtggggtgggcgtgaactggcggatgtatggtgcgggcgggcggctggagcgcccgcgcgcccccgcccccgacgcctaccattcctgctaccccgtgggcgagccggagaacgtgcacatcaagacggtggccaacacggcctacgtggcgcgcgccggcggcgcgcaccacgccgagtatcggcgcgggtactacgcggtgaccactgaccggcggcgggtactggggcccaagtcggcggcccccgtctacgatcgcctggtcctgcgccactacgtcagcaagagcctgtgggactacagccagaagatcctgcgcggctccggcatgtcgcgcgtcaagaccatgccctacttccaccacgtccagatccgcgcctggcaggactgccggcgcgccgcggcctggcaggacggcgggccggagcaggtcgcgcccgccaccatgctccgcgctttccccctggacgccgaggggaacgccctgtcctgggaagccgcgcttgccacgagccgcgctgcgggcggggcacgtggtgaggaggcggtgagagtgggaaccggccacatccctgatgtggcagggacaggagcaggcgccgtggcagcgagtgcagagacaggtggcgcggcgacaggaggtggcgcgatggagagtgcaggaacaggcggcattgcggcagagggcaccgtggcaggaggcgctgtgacaggaggcgccgtggtaaagagcgcagtggcaggaggcgcggcggcagagggtgcaacgatcggaggcgcagcggcagagagcgccctgacagagggcgtggtcgcagatcgcacgacggcagcggaggtgtccaccactgcgacatcggcggccggcacaagtgccggcggcgcaacagcagtccccgcaggacctggtgctgcnnnnnnnnnntag

SEQ ID NO: 5318 - DNA, 2454 bp, Chlorella protothecoides
  modified_base (298)..(307): a, c, t, g, unknown or other
atgcaggtgcgagaggtgacgattctgcgcacggtcagtgtccgggcctcccccaggcaaaggcagtcgctggagccggtcaagctccctggacctgggaatcgcttgatcagcgcgcctgatgaaagccaagcacagtgtattttgtgtgcccgggagtactcacgctcgtcagatcaaatgccttggaaattctattcacggcttgtcgtaaatcatggagtgtttgctgactcggacgggctacggcgagtcagggagccagggagccaggttatcagcatactcgcatgctgannnnnnnnnncagcatactcgcatgctgtgtttcttcaccaatgcgttgctgacagaaagagcattgaacctcttcatgcccctgaaagctgttactgctgcatgatggtcgattttgcacgggtggcctcgactgattctgctcagtcagggatcacatgaagaaatgtcgacgtggatccacagagggagttcacaagagaacactctgagcgccagcaagaatggagatgcgtcttgatcggtggacctcccgtcccggcgcagggtctcgaatctgcgcctgtcaccatcctaccagaggatcgagcgcccgggtcgatcccatccgcacatgctgcagagactccttcggaagacaacctcacagcaccccgcggcagcggcgtcggcgcctcgaccatggcaggcttatcttgcgccctgcctgcccgacctcgcgtctgcccctccttcaccgcgagtgctgcctccagcagccgcatctctggacattctaccccacacctcgggaaggctccatgcctcctgctcccgggaaggataacacgtgcccgcccggccttcgtcacgggctgccccgccccccggcttcgctttaccactactgcctccctcagcccgcctgccggacatgtgagcactgcatggggtagacgggaatggcgattgccctgcgaggcgaagcacatggtcactggttggggagtgggttcgggtcgccctgttttcagggcacctgcaccccccggcaccacctcccgcattggcgccgtgcgagagctcacccccctctccttcccccgcgtgcaggagcggcaaggctcccccagcaccagtggggcctcccccctgcccacgtgccttgcggcgcccaccaccggcatggcgcgcggcctgggctcctcctcgggcggcgcgacgctggagcgctccaagctgagcctgaagcagcgtgtcacgcagaccgcgcccaagctagacgacggcatgggcggcggtgggctgggcaagggcgtgttcaacggcggcggcggcggcgacgacggcggcgacgacgatgactactccggcggctttggcgagggcgatgacggcggtggcgacgatggcttcttccgcaaggtcctgtcggagctgtatgacgcgcgcgctctggcggcggtgctgcaggagtggtaccgcggcgtgggcgacctgccctttgtcctgcgccaggcggtgcagatgggcctggtctcctccgcttccctcgtccgcttcatggccatggacgtgcggcccggggtcacgcgcgcgcttacgcgcgcgctgccccccaccgtctcgcgcgaggtggtaggccgcctcatggccgacccggccttcatgcagaagctggcgctggagcaagccatcacaatcgcctccagcctggcgtacgaggcgcgcacgcgcggcgacgctttcctttccgagctggacctggtggcggccaacacgctgagcctggccgccgccaacgcagcgctggtatacctggtggcgccgacgcgcgccgcgccggcgcccgcgcgccacgcctggcgcaatgccctggcccgcctgcccaacaacgtgttcgatgcggccacgcccatgcgcgcctacaccccaggagcgcgcgccgcggcgctgggcgtcaagtgcgcccagctctgcggcgtgggcctggtggccggcggcgcgcaggccgcgctggggcgcgcgctgtgcgcgctgcgtcgcgcgcgcgaccccacctacgcgccctccgtccccgtgcccgcgcttggcaagtcggcgctgggcgccgcagcggccatgggcgtgtttgccaacgcgcggtaccaggtgatcgcgggcgtggaccgctacctcttcgaccatgccgcctacctgtggagctacctggctgcctcgggcgccttccgcgcgctgtccacccacctgggcgaccagacgcggctctacctgcagggcatgcccctggagcgccccgcgcccgcgccggggtccacctccgagcgcgaggcggcggcgcgcgagctcgcaaaggcgctgaagcagcaggtcgcggcgcggcaggcagcgcctgcgccgcccaggcggcggaaacgccccgccggctttgaaatgggcatcggcgccccggcttga

SEQ ID NO: 5319 - DNA, 1773 bp, Chlorella protothecoides
atgggaaggaggtgggtgcgcgggccctacacgccggctctccccgttacgaacccacccacccctccggcatccagggagtacaactccaagacactgctgaaggtgcacgcggcgcgcctgggtgggctggatctccccatccgggtggcccaggtgaaagcggacaccgatttcggggcgctggtgactgcccacccctggctcaacaccacccctctggtggtgaagccggattgcctgtttgggaagcggggcaagcatgacctggtgggcctcaagctggacctggctggcgccgaggacttcatcgcccagcgcatgggcaaggtcatcaacatgggcaccgtatccggccccatcgactgcttcatcatcgagccctttgtgcctcacgacgccgagtactacctgtgcatccagagcacgcgtgccggcacggacctgtccttctccgaggccggcggcgtggagatcgaggagcactgggaccaggtgcgcagcgtcagcctggcggtgggcgaggcggtgacgggcgaggccctggcccccctgctggccacgctccccctggagctgcgccccgggatggaggccttcctggccaccgcccacgccgtgttcaccgacctggacttcacgctgatggagatgaaccccttcacgctgggccccgacggcgcgcccttcccgctggacatgcgcggcgagctggacgacaccgccgccttccgcagcgccaagaagtggggcgacctggagttccccctgcccttcggccgacggctgggccccgcggaggccgccgtcgcgcgcatggacgagggcaccggcgcctcgctcaagctctccgtgctgaacccgcgcggtcgggtgtggaccatggtcgcggggggcggcgcctccgtcatctacgccgacaccgtgggcgacctgggcgcggccgacgagctgggcaactacgccgagtactcgggtgggcccaacgcggccgagacccacgcctacgcgctgcgcctgctggactgcgccaccgcagggcccgacggccgcgcgcgcgcgctgatcgtcggcggcggcatagccaacttcaccgacgtagccgcaaccttcaagggcatcattcaggtgtcttggtgtgtgggtggggggggatccctgtcgggggggctgaggcgggggagcgtccaggggcaaggcagagaccactggcgggggtcagacgcgatgaacccagaggtcgcgcgctgcatcccagacgtccgcgagcaagcgacggacctggaatcgcggccagcacagaccaccagtggccatccctggcccatgcactcgctgacccgacgttgcacaccaaggtcgtgcgctgcatccctgacgtccgcgggcaagcgacggacctggaatcgcggccattcacagaccaccagtggccatccctgccccacgcactcgctgacccggcgttgcacgccagtcagtggggccaagcgatcgcagcacctcccacccaccccctgcactcaccctccccgcctgcgccaggccatccgcgagcgcgccgacgcggtcaaggcggcgcggctcaagctgttcgtgcggcgcgggggccccaactaccgcgcgggcctggacgcgatgcgtgcgctgggctccgagattggcatcgacatcgaggtgtatggcccggaggccagcatgaccggcatctgcaagctggccatcgaccacctgaaggtcagcgatgcccgcgacgcaaaggctgcccagtga

SEQ ID NO: 5320 - DNA, 243 bp, Chlorella protothecoides
atgatggcagcccagatcttcgaggcggcacgcaaagacctgcccgactttgaggcggaggccgccgccgggaacttctccaaactcaaggcctggctgaacaagaacattcaccaggtagaggtcggaagcctgtacccctcggccgacgagctgctggagaaggtgacagggagccctctggaccccagcatcctcctggagcacctgaagtccaagtactcagagttgtatggcctgtag

SEQ ID NO: 5321 - DNA, 921 bp, Chlorella protothecoides
atggccactgctgttacccctggcgaggttgccattgctccctcctccaaggccttcaccgccctgtcggagaagctgaaggagatccaggccttctccggcatctccggcctgctgggctgggacgagatggtgatgatgcccgccggtgccgcggggtcgcgcggggcccagaagtcggccctggccgggctgctgcacgagaggaagtctgacccggccattggggagctgctggagcagctgcagcgggaggagggccagggggccgacgcattccgggccgccgctgtgcgcgaggccgcgcgggagtacaggaaggtcaccgccgtcaccaaggacctcgccaagcgcgaggcggagcacgagaccgaagcctaccaggcgaggcaggcctccaacttctccctcttcgcccccgccctggagaagtgggtggccctgcgcagagagcgcgccgccctgattgaccccggcaagccggtctacgacgtcctactggacgactaccagccggggctgacgtccgcgcgcctggactccatctttgatcagcccccgcctgcgtgcactagtggccccctgcgcgcagcacctgtggcacagggccacgtcatgccagtgcaccaaagccggccattgcagcatctctggacccctcttgtcctggcatgtgccctgcgtacaatatcccgctcacctcccccccaacctcaggtcaaggccggcctggtgccgctgctggcggacctgcgtgcccgcggcacccccccggacaccgcctggctcaagggcgagttcgacaccgacgctcaggccgcgctgtgtcgtgagatcgctttgaccctgggcttcgacctggagaaggggcgcctggatgtgtcggtgcaccccttcaccggtggtgggttggagaggtag

SEQ ID NO: 5322 - DNA, 447 bp, Chlorella protothecoides
atgctgtgctccacgctcatccagcatgcgcacacgctattcgtggaccaccgcaaggagctgatccactttggctggtgggcgaggggaggggaggctgtcgaggggggggggtgtaaagaggcgtggtggtggacaacccagtggtctggagagcatcggttgggcagccacgagtgcaccggctggatgggcatgtgggcgctgaagtttgacaacgtggccaagccctccgccttcctcttcctggcccacttcctgcgcgtgttccccacccccgagaagatcatgctgcaggtgtacgtggccctggcgcgcatgacgcagcaggaaagcgcggcgcgcgacgtcgtgcgccaggcggtggacacgctgctgcccatcttcaacgcggggcgcgcgccgggccaggagccggagacgcccccctccggggacgcgtcgctg

SEQ ID NO: 5323 - DNA, 819 bp, Chlorella protothecoides
atgtcgtgcgctggagtgccgccccaactcttggaaaagaccgcgcagattgtctggccctccaacacccccgcccttgcactcctcgctcctgcagaccagctacgcccacagcattgcggggcgacggcgaccaccgcggcgccggcgccgcggcccggcgcggagcgcgcggcgctggtgcgctcgctggtggagaccgtcatccgcgagctcgtcagcagcaagagcaacgacgcggtgcgcgccggggcggccgagtgcctgggcgtcttggcccaggcccagggctccacggtgtcggaggtgctgggctccatgatggacaggctggcgggcatcagcgaccgcaggctgctcccgctccgggccatcaacgcgcagactagctacgcccacagcattgcgtttgtgatcgagcactgccccgagcagctgccgctgacccaggaggttgtcagcttcctggcagacgcctgcaccatcatggagacggacatggccaagggagggaatgagccgtcggaggctggggagcatgctggatgttggagggtttggaggtttgacggcatggctgcagaggctgccaacgcacaatcacaagcagcccatgtccctgctggccgtccttcgccaacgccaaccacgccaactctgcaggtgacggcccgggtgacggcccgggtgacagtgcgtgggcagcccccccgcgcggaagtcgtggggaagctgcaggtggcgtgcgtggaggtgctggtggcggcgctcggctggcgggccttcaggtgggcagggcaggggctggggggcgtatag

SEQ ID NO: 5324 - DNA, 207 bp, Chlorella protothecoides
atgtctgcgggagacccaccttgtgaagtgaccctctcaacaccctcccaggacctgctgtcgggtcagttcaatgtcacgttgggcgagaagatcacggagcacctgaagaagtgggtggacgcggagaagtggatcagcccccagccgccacagccgggggaaagggcagactggcggcatgtggcacgtgcggtcatgcgctag

SEQ ID NO: 5325 - DNA, 759 bp, Chlorella protothecoides
  modified_base (383)..(392): a, c, t, g, unknown or other
atgccgcgcgcgctgggcgtcgggcagcgcgtgacggcacgccacccggccacgcgccagctgcacgacggcgcggtgctgacggtggcgcccacctgcgtgcgcgtgcagtttgaccgccgcgagctgggcgtggagctggtgcgagacaccgacgtcgcgcccgccgaccccgccgagaacctgccgccggcgtacgccacgcagccgccggagcgacgcgtgctgaacggccgcctcatcgtcagaggtgtgtgtgtgcatttgggagggggtgggggaggtggagtttgggactgggcgaatgaggggttgaaccccttcctgacactatgggtggtgcagtcgcccaaccggccacatcgatcgactgacatcccccnnnnnnnnnnggggggaggtggagtttgggactgggcgaaacaggggttgaacaccttcccgacactgtgggtggtgcagtcgcccaaccgaccacatcgatcgactgacatccccatatctcccatccgcatacacacacacacacacacacacacacacacactccccccgcctcccccttccgcaggcaagacggtgaatgtggagggtcgcgctccaggagcagcgcccagcgcggcgcccagcgtgtcggaggccagcaacctggcgcccgcccccgccgtgcccggcaccaagccgccctactacgtgctgggcgccacgccgcagtccgggccgggcctcccagcggcggccctctgcccggcgcccggc

SEQ ID NO: 5326 - DNA, 411 bp, Chlorella protothecoides
atggctatcatcgcaacacccccccctccccaggtcaagcaatactgcgaacggcagtggaccaagatcctgtcaggccgggtctccatccaggactttgtgtttgccaaggaggtgcggctgggtacgtactctgccaggcacggcatcatcccccccgccgccctcattgccacacgggcgatgtccatggatccacggtgggtgcggaggaaattcatgccagagaacgtggggagagactatattgattgggacaaaggctgcttccaagaagagtgtattgtgattggcctgagcagcaggcaagggcattgggaggcgctggcgcgctccctgctctgggttttctcgcacgaggaggcttgcgtcctccatcctcatgctggcatgcctgcagctggcgagtga

SEQ ID NO: 5327 - DNA, 1191 bp, Chlorella protothecoides
atggacgccgactgggaatggtcgttcgccccaatcccagagtcctcccttggtcctcctcgtctcgaatcctcgccgctcagattcgcccccccccgaaccccccgacaggtgttctgccgcgaggccgagattgccaggctgatgcaggtgctggcccggcgccgcaagagctgccctgtgctcctgggcgaggccggtgtgggcaagacggccatcgtggaggggctggcgcgctgcatcgccacggggagcggcggcctggcaggccagcccctgcccctgtttctgaagggcatgcgcgtgctgagcctggacctggcccgcctcatggccggcacacgtgagcgcggcgagctggaggcgcggctcacggggctggtggccgaggctggcgccgcgcccgacgtcatcctgttcgtggacgagatccaccagctggtgggcggcggcgcggcgctggcaggccgcggcggcatgggcggcggcggcggcccggacctcgccgcgctcttcaagccggcgctggcgcgggggcggctgcgttgcgtcggggccaccacggagcgcgagttccggcgccacttcgagcgcgaccctgccctggagagaggaggagccgccccatctggcgtccttgccccggctcgccggtctcggcgcggcgcgtggccgggctcccccctcaccgtattgcctgccctccatcccgccggaccaaatgcaaaacgacccccccgcaggcgcttccagccggtgtgggtggaggcacccgacgcggcggccacgctgggcatgctgcgcggctcgcggcccgcctacgaggcccaccaccgctgcctgtacaccgacgcgtcccttgttgcggcggtggctctagccggccgccacctcccggcccgccccttcccggacagcgcgctggatgtgttggacgaggccggcagcctggtgcgggtgctgaagcaccgcgcgcgccgcgcgcggtgcgaggaggagaccgaggcgcgcgccgccgcgcacgcgggatacctggaggtcctggccacggcgcgcgactgcgcggcggcgggacactacgaggaggccggcctgctggcgaggcgccgcggcgagctggaggcaaggctgggcggcgaggcgaggcgggacccggtgctgccgcgcgtgacgccggagcacgtcgcgcgc

SEQ ID NO: 5328 - DNA, 366 bp, Chlorella protothecoides
atgcgggcaggcgcgtcggctggctgtgcctgggatccagatacctgcgagtggcaagggacactcgtgagtgacctggccgccaagcgtcgcatgcgctcatcatatgtaacccctgctccggcttgcgaccccgggcacaaaaggtgcccctccccaaacaccacttgcacagaggtgaagctgaacatctacaccctggaggcggtgtcggcagcggtgctgcagctgcgggtccctcacatccctcagcaccagctgcacgcctggtaccaggctggtccgggaggtgaggcgggatgtgatgaggttgtagaattaccttggcatcgccatgtggggatcttggacgagtgcagtgcttga

SEQ ID NO: 5329 - DNA, 363 bp, Chlorella protothecoides
atgtttgtggtcgtccccggcaagtcacgcgaggcggccttcaagatcggagccgagatacagagggtggtgacggctgccaaccccagccccatcctgctcaagcttgagaaggtgtaccacccctgcgtgctcctcaccaagaagcgctacgtcggctttgcatatgagtcccacagccaggccacccccgccttcgatgccaagggcatcgagacggtgcgccgggacacctgtcccgccgtggcaaagatgatggagcgcagcctgcgcctcctcttcaccacgaaggacctgtcgcaggtagtgtgctgcgcatgctatgctgcagactgtgggcagggcgcgatggtcctcagttga

SEQ ID NO: 5330 - DNA, 477 bp, Chlorella protothecoides
atgtctgtgcccccatccgcacccctcaccaggccattctctccgcctccggaacccccacctgcgcaggtcaagggggcaatgaagcgtctgccgcccgcagccaaggtgctcctgcgctgcctcaacgcccgccagtttggcctgaagctgattgccaacgtgacgtatggctacacgtctgccggcttctcaggccgcatgcccatggccgaaatagctgacgccattgtctccctggctcgggccacccttgagaatgccatcgatgtcatcaacaagcatccagactggggagccagggtggtgtacggcgacacaggtatggactcctgggcatgtaagcactgtggaatgatgtggcgcaggggccggcacggcgggggagtgaatgctgttggcccgatgcttcgggctttccccctaccaagggtcgtcaagtatgatgtagagcatgtgctaggcatacccctatga

SEQ ID NO: 5331 - DNA, 1311 bp, Chlorella protothecoides
atgcccagcgtggccgccgcgtcgggtgcctccacccacaccggctggaagcgcctgcgggggggtcgttttgcatttggtccggcgggatggagggcaggcaatacgggcagggtcgcgctcgaagtggcgccggaactcgcgctccgtggtggccccgacgcaacgcagccgcccccgcgccagcgccggcttgaagagcgcggcgaggtccgggccgccgccgccgcccatgccgccgcggcctgccagcgccgcgccgccgcccaccagctggtggatctcgtccacgaacaggatgacgtcgggcgcggcgccagcctcggccaccagccccgtgagccgcgcctccagctcgccgcgctcacgtgtgccggccatgaggcgggccaggtccaggctcagcacgcgcatgcccttcagaaacaggggcaggggctggcctgccaggccgccgctccccgtggcgatgcagcgcgccagcccctccacgatggccgtcttgcccacaccggcctcgcccaggagcacagggcagctcttgcggcgccgggccagcacctgcatcagcctggcaatctcggcctcgcggcagaacacctgtcggggggttcgggggggggcgaatctgagcggcgaggattcgagacgaggaggaccaagggaggactctgggattggggcgaacgaccattcccagtcggcgcaggcaggtttcggccacgcaagcatgcatcagatgcagtttccacggcgaaccagtccgccccgaggcgcacgcaccggatcgatgcggccagccagggcggcggcggtcaggtcgcggcagtacgtgtccagcaccttgccccgctcgcccgcgccggggtgctcgggcgctggccccggcgcggcgcggccagcgcccgcaggggccatggccgcctccacaccgcgccgagcacgctgcgtcccctcctccacggcctggtcccgcaggcgccccagcgcctcggccaccatgcgccgtgggtccaggcgcagcgcgcgcagcaggcgcagcgcggcgtcgtccctgcaacccaccatgcccagcaccaggtggtccggggtcacgaaggacatgcccatgcgctgcgactcctgcatcggtgcgacggagaagacccgcctggcgtcccgggtgaagtgaagctcgttgggggggaatcgcctgcgggatctgctgtgcatgcccttcaccgcggccttggcatcctccagctgcagtggggagggcggggggcgcgtttggggcgcgcagggggtctgggagtatgctgtcacgcatga

SEQ ID NO: 5332 - DNA, 711 bp, Chlorella protothecoides
atgttggttggggtggtggagggcgggcaatggacctcattcaggagccaagcgggtgaagaccaaaaggtcctgtggcacgtggcgccggcatcgcgagcgccggcacttctcgataccatgcgagtctccccacccccctcccacaccttccatgacacccaccccaccccaggtctggcccccgacgacgacctcttcttcgacgcggcggaggatgagctccgtaccgtgcgcagcggtgagctgagcgtgcgccgctcggcctcgctggccagcgacgcccccgcccgcgagctggcagagttcaccttcaccatcgcgcggccggggacggcggggtacgcgggcgtggacacgtgcctggacgtcacgctgggcacgctgcgcttctactgcaatcgccccaccctggcggcgctcatgagcgccggcgccgacttcgccgccgcggcggcggggggcggggatggggccggcggggaccaggaggagcccgaggtggcggacgccaaggagctgggcgcgccgtcgggcgtggagctggcgcaggccgtggaccagtccctggccgagaagctggagggaagcccggtgaggagagggggatggaagtcgtggaggatgtcttggccttggaatgtcttctggggagggggggcccaatggagaagcaaggcatgcactgccaggccccacacagcaatctga

SEQ ID NO: 5333 - DNA, 1122 bp, Chlorella protothecoides
  modified_base (872)..(881): a, c, t, g, unknown or other
atgaacatcaagtgccgcgccagcgggctcaccccctccgccgtggtcctggtcgccacggtgcgcgcgctgaagatgcacggcggcggccccgcggtcaccgccggccgcccgctggcccccgcctacaccagcgaggacgtggcgctgacgcgcgcggggtgcgccaacctggcgcgccacgtggccaatgccgccgcctatggcctgcccgtgcttgtggccataaaccgctttgccaccgacaccgacgccgagctggaggcggtgcgggaggaggcgctggccgccggcgcgcgtgcggcggtggtctgccgccaccacgcgctgggaggggagggtgcggtggacctcgcccaggccgtggtggaggcctgcgccgcgccgcggccggagttcaggttcctctacccaccagagatgcccatcgaggtggggagggtgtgcttgggtggggtggacgggggggaattattccagagagtggcgacatgcatctcaagggcagtgagttctgcggcctgctgcataggcagggctcgcgagcaggacaagtggcgtgcgacttcattgacgctctccagtgaagacgcgtgtgtgcctgctcacggacgagtgatcccacccattcccgtgcccccccccgcgcaggagaaaatccgtaccattgcggtgaagacctatggcgcggcgtcggtcagcttcacgccagaggcgctggcctccatcgctcgcttcaccgagcaaggatttggcaacctgcccgtctgcatggccaagacgcagtactccttcaggtggggccgagggaggacggataaggggggggaaaggagggcacacagcagatgtgcgctggcgcatggaggctnnnnnnnnnnaaaggacgaaaagggggggcggaaaggagggcatacagcagatgtgcgctggcgcatggaggcttgtgcaatgacaggccggaggcccgtgctgccagctcgtatgcagctgggatcaagtctggataggagccgccgtgcacacctctcccttcccatccgtcctcttccccccttaccagcaacgaccctgccgccaagggggccccttccggattcgacctgcgggtgcgggaggtga

SEQ ID NO: 5334 - DNA, 306 bp, Chlorella protothecoides
atgacgaggcgtggcaccttccacccaaccccgccccttgcaaagcccatcccaacaccacccgcccctcctcagaccctggaggcgacccccgtcctggtgcatgcggggccctttgccaacattgcgcatggcaacagctcggtgatcgccgaccggctggcactgaagctggtggggccggaggggtacgtcgtcacggaggtaagggttggcatggtggggtgttcaagaggagggggaagggagtttgagccccgggtacagcgccagaagctgcaggtttgcactgtgagcggggcatga

SEQ ID NO: 5335 - DNA, 573 bp, Chlorella protothecoides
gagttcaacctgcacctgaccggggacatccacgccatcaccgccgcgaccaacctgatggcagcggccatcgaggcccgtgccttccacgaggccacgcagtctgacgccgcgctgttcggccggctatgccccgccggccgcgacggtgcgcgccgcttcgcgcccatcatgcgccgccgcctggccaagctggggctggagggcgcggccgaccccgacgcgttgtccgaggaggaccggcgccgcttcgcgcgcctggacatcgaccccgccaccatcacctggcgccgcgtgctggacaccaacgaccgcttcctgcgtggcgtgaccctgggccgggggcccaaggaggctgggcacgagcgcgagtccggctttgacatcgccgtggcctcggagatcatggcggtgctggccctggcggggtccctgccggacttcagggagaggctgggggccatggtgtttgcctccagcaaggccggatgcgacagccttgtggggagtggggatgccttgggccagaggggtttcggtcgcctctctgagcaggcatgtttgagcccatga

SEQ ID NO: 5336 - DNA, 1020 bp, Chlorella protothecoides
atgccatctctgaagctctgcagaccctcagccatccctcaacattccctgcccctcactccctcgcaggccgccgagcacgtcggcttccctgcagtcatcaagcccatcttcggcgccgcctccatcggcgttgtgcgcgtggacaacctggcgggcctgcgcgccaaacacgcggaggtgtgccgccagatgtccagcgcgcgcgtcgtggacggcgcgctgctggagggcgacggcgaggaggaaggcgggaacgcggggggctggatccagaccacgctgatgatggaggagtacatggacggccccgaggtggacgtggatgtggtgatgagcgaggggcaggccgtgtacggcgcgcgcggggtggcagtgggggtggttggtggcgaagacctagccctctcggtgcagtgcccccctcagcccgcgtcatggccggttgggggccagcccctctcccgtccgacccccgaccctcgacccctcccttcatgcgccgaaccacaggtggattatgacctgaacccttacaaccctcgtggcgggcgcgaggtggtgcccacctccctgaaatcctcgagcatcaagtccaacttcctgaccgaggccgtgatcgggtccctgccacggggcctttcgcattcggagcgtgagttcatcgtggccaacacgccgctgtctccctccctcaacctgctcagctccctacccagggaccaggtatctgccaggtccgtggaggggcgcaccctgcgccgccacgtactgcgcggcgccgtcatcgtcttcatcaccgccggatactcgggtgggcgttggtggtgttggtggtgggcgaattcaaagtcagactccattgcatgggccaaggagctgggcgtgcgcagcgtgctcatcgacggccccgactcctggagccaggtgggttgggcggagtggtttcatgacagccctggcaccagtggtggccacggcaggcctgggatggacttggatgaagacgctgctgcgtga

SEQ ID NO: 5337 - DNA, 1173 bp, Chlorella protothecoides
atgaccgatgccgactcggtctttgaccgcgccctggcggccattgagaaggtcaagaaggtgagcattcttgatgtggccagggttggggaagtgctgacggcctggcatggcgtggaggattttggcgagctggacggcgtggtgtccttctcggagatggcccagccgctggtggcgcggctgatcgagaagctgggcctgcccggcaactccagtgcagcggtggactccgcgcgcgacaagcacgccacccgtcgctgcatgtccgaggcggggctgccgacgccgcgcaacttcctgatcacgcgcgaggacgagctggacgccgcctcccagctggtgggctaccctgcggtcatcaagcccatccacggcgcggcctcgctcggcgttgtgcgcgtggacgaccacgaggcgctcctgcgcgcctacgcgcgcgtgcggcgcgagatgggctccgtgcgcgtgcactcggggatcgtggagcagatggcgtcggacgacgagggggagggcaacttcaccaccacgctgatgatggaggagtacctggacggcccggaggtggacgtggacgtggtgttcagcgaggggcaggccgtgtacggcgcgccgtacttcaacgagaccgggtccaactcgccctccatcctgcccagcgcgcagcagcgcgagctgctggagctgggcgtggcatcggtcaaggccctgggcttcgacatgggcgtgttccacgtggagtgcaagtacacctcgcgcggcgcgcgcctgatcgaggtcaactgccgcatgggcgggggccccgtgcggaacatgaacctcctggtctggggcgtggacctggtggaggaggcgctgctggctgccgcgggcatcccctcccgccccaacgtcgcgtcgcgccccctgcgctgcctgggcgagtacctggtgaacgcacccaagaccggcgtgctgggcgacctcggctttttgcgcgagtttgccgagcgcaagggtgtcctgctggccaagccctgcgtcgcgccggggtcaaaggtggtgtgcgtggctgacggcatgcccacctggctggtggagctgcaggtggaggcagacacgccgcgcgccgccgtggccctggccgaggcgctgagcaaggagatcacggagcgcatccccatccactga

SEQ ID NO: 5338 - DNA, 342 bp, Chlorella protothecoides
atggaggaggagggcgtgatcgagaggttcatccccctggacatgtctgactcagacacggtactggaccgagccctggaggccatcctggctgccaagaaggccgtgggcggcgacctggacggcgtgctttccttctccgaaatggcccagcccctggtggcgcgcctggccgagaagctgggcctgcagggccccagccccgaggtggtggatgccgcgcgagacaagttcgccacgcgcaagtgcatggaggccgctggcctgcccacgccccgcaacatcctgatcgagaaggctgaggacattgagaaggtgggtgaagggggaaagggggggtga

SEQ ID NO: 5339 - DNA, 1806 bp, Chlorella protothecoides
atgaacctacacactttgccaagcctgtcatgtggccgcactcttgttgcccctctaggacctggacacggtacgctcgctggtcttcaacaacgtctcacgcgaccgcggcctgcgagcgctgctggaggccaccggctcggtgctggtgctgggcctgctctcctggcggctggggcccgtgctggcgggcgtgatcctggcggcgggggccaccgctttcctctaccgcgcccagactcgggccgtggagcgtgcggcggcggccgccgccgcgcgcatggccgaggcggcagacgagacctttgccaacatccgcactgtgcgcgtgtttgcaggggaggggctggagcgggagcgcttcgaccgccatgtggccgaggcgcggcaggcgggcctgggattcagcagggccaaggcgctgctggagagcgtgaaccgcggcgccacccacgcctccctcctcgccctctacgccctcggaggctacctggtgagccggggcctgctgcccacgggcacgatgctgacggccatcggcttcaccttcagcctggtgttcgcgacgcagggcatgctgcagagcttcatcgacgcgcggaccacagccgccgccctcctccgtgtgcagggcgtgctggcggagctgccgcccgacccctccatggctgccagcctggcgccaggcgaggctctggtgtcccgtacacacctccgcccctttccctcctcacaaaaaccatctccctctctcctccaggcgcgtggtgggaggtggccaacgccgcggcagacgcctgcgagcttccagggacgagcaacgcagagaaccggcccgacgacgggaagtggagccgggcgacctccacctccgctgcgtctggggccgtggatgatggaacccccgcctccggcggcccgacccacagcagcagcagctcttccgagcgcggcaacacaaacgacaccggcgtcccgaccacatcaccccgcccggctcccgcgcccttgcccaccggcgacgtcgtcttcaaagacgtctggttctcctaccccgcccgccccgagcggccggtcctgcgtggcctgaacctgcgcctgccggccggccgcgtgactgcgctggtggggcactccggggcgggcaagtccacggtgggcctgctcatccagcgcctgtactctgttgactctggcgagatcagcctgggcggcgttcccatccagtccttttcccgcgaggcctgggtggcgggggtcaccgcggtggcccaggagccgcgcctcttctccggcacggtggcggagaacatcgcgtacggcgcgccggaggccacgtcgctcgaggtggagcgcgcggcgcgcgccgctcacgcccacgacttcgtcacgggcctgccgctgggctacgacacgcgcgtgggcgagcgcggcggcctgctctccggcggccagcgccagcgcgtggccctggcgcgcgccttcctgcgcgacgccccgatcctggtgctggacgaggcgacctcggcgctggacgcggcgagcgaggcggcggtgcagagcgcgctgcgcacgctgactgcgcagcgcacggtgctggtcatcgcacaccggctgtccacggtgcaggcggcggaccagatcctggtgctggaggaggggcgggtggtggaggcaggggcgcacgaggagctgctggcgcggggggggcggtacgcgcacctcgtgtcggcgcagaccctggtgctgggcgcgccgggcagaggcggggcgggcgtgccggacgggacgtacagcgggaggtga

SEQ ID NO: 5340 - DNA, 882 bp, Chlorella protothecoides
atggatcgggcgaagcagcaggcgggtgacggcacaccggcaaatgccgtcaccagggccattccaacaccggcatctagaaccactgcccaaccacactcactgctcaaagggctgctgctgcaccaggttctcaaacagggcgccggagagcacgggagacacgaggttgcaggccacacacaccatcacggcgaggccggccctgaccagctgcggccactgcttgcgcaccagaccccacacgtactgatcgtccagggggcctcgtcgtggggtccaggggctgtgtgcgccctgggctggggcgctgaccccactcaaggaggcagctgctgtggcagccagagggattcgccggcatcgcgccaggcccacagggcgacgtgcccagtctgtcggagcggcgcgccatctcaaatgctggagtgtgggctgacgagatacactgacaatggaccatgtcctggaggcgcattaagggcacgtcgcatgcccgatatgaataccatagttgcgatctatggtatttcaagccctactccacaatccctgcacctcgaagcctgtggtgccgacagtctgtatatgacttcccacgtatgctacgaccatgcccggcactgcgccgacgcagcccagctgcgggagatggcagccgatccaacgctcgcgtcctgctgccagcgcgatgcccaggagcaggctgtggttgccaagctcaaggcctcgctgacactcgtcgaccggagcaggcacagggagcacctgagggagtcggtgctgggctgcacccccggcgacaccaggccagatcgtgacagcttggagacgagcgacgacgaagagctcggtacgtggagcagtgtactgggcgtgtag

SEQ ID NO: 5341 - DNA, 1500 bp, Chlorella protothecoides
  modified_base (721)..(730): a, c, t, g, unknown or other
  modified_base (1288)..(1297): a, c, t, g, unknown or other
atgctatggtcctgcctcgaagtcctatatgcgcttggtacaacggggggcgctgggcatgccctcctgcatgaaagggctgcagtggggtgcactgatcacgctgcaggctacccacccacaaccccacctccattcaccgacagcgctgctggggactcctggaaccacctggcggtgcgcctggcgcggaccagcccggacgagaagggggaccccgacctcttcggcctgttctcgggtggaaagcgtggcctggccgtcccgacccgctcctcccacggctacgacttccaggacacctctgccgcccagcgtgcagtggtggtgaagaaggtcaccaaggccgcccaggggcccgaggcggactacgagggcgtgctgctctgcgtccgctcctacggcgctgtcccggtcgccttctcgctcaaggcagccaggaacgtatgccccgtggggtttgacgccggcgacgccagccccctgatctgcagcacccgccaggatgccacagagaagcgatacgagggctgtactgccgatgggcagtgcctctgcacaggccagtatgccaaaccggttccggaagttgtcccaggcaaggggttttaccgcttccatgttgcccacgacgacttccaagtctcacttgccgttgttgaggagagtgaaacaccaggtgagcatggagcaaaagggcatgggccctttcctgtgtttnnnnnnnnnntcccgcaccctcttgcaggcctcgggtttgaggactgctctgcccccgtgaccgatctcaatgccacggtccctggggaaaagaacgcgacggttgtgagcctggagcatcagcacgtggagccagacagatggccggggtccccccatccaccggggtcggccagtttgacgcccgcccccgctggaacgcggcggaacgggaccggcagctggaggtgctgctggacgcccggccctcccccgagccctggtcagccacgttgcgccccggcgactggtacgccggggtcctggggggcctgcgccccgccaatttcaccctgctcctcaaccgcttcgactgcccgctgggctgctcggggcacgggacctgcgaccccggcacgccggtcgaccagcggcggtgcacctgcgacgaagggtgcggggcaggcgccgccggggtggttggctgatgtggtttccgcgtggtttgtcccttcccactgcggcaggtggaccatgtccacactccatggcgtgatgtgtagtgttggtgcttgggcggaggctcagnnnnnnnnnnggaccatgtctacactccatggggtgatttgtagtgttggtgctcgggcggaggctcaaaattcttccgaagccgtttgcagatatgggggcgaggcctgcagcaagtcgagggcggcgctggaatacggggatgtcgtccagcgggagccggcgcagttcgagtatgagtacttcctcatgccggccatcacaggcgagtga

SEQ ID NO: 5342 - DNA, 432 bp, Chlorella protothecoides
atgccccttccccgttgggtgggcctgtgtcgctcggcacacacccgagtgggacggtctaggccatgcagcgggtggttggcgggagcaacgagccatcagacacattctagctcatcggctctagagcaaagccctggcgccagcgatcagctcctccaagccggcctgcatgtggtgggaacccccatcggcaacctgcaggacctgagtcccagggcactgcatgtcctgaggtccgtggagaggatcctctgcgaggacaccaggcacacggcccacctctgctcctactttgacgtgcgcacccccctggaaagcctgcatgagcacaacgagtcggccaagtgcgccaaggggggtgcaagccggctcaccgagaagaagtccatgctgcccgaggcagcaacccatagcccagacccaatctag

SEQ ID NO: 5343 - DNA, 303 bp, Chlorella protothecoides
atgggacactacgctatctacgcatgtgtacttgccattctattcagcctgttcagcatagcactggctcaggatgcttgtagcgggcatggccggctcacgccctccggagggtgtgactgcgacaacccctggccggctcccgagtccaggggctggacgggcaaggactgctccatccccgtctatggcagccccgccgacagcgaggacatgactgactggtgtcgggctgcggaccagtgtgaccagctggagcctcaggcatgggtttgctttgccgcccagttcccctgggagtga

SEQ ID NO: 5344 - DNA, 408 bp, Chlorella protothecoides
atgttcgcccaggcagggcgtcatgcgtccggggttctctggcgccccacgcccatccagtcaccacaccagcccacactccagcatttgagatggcgcgccgctccgacagactgggcacgtcgccctgtgggcctggcgcgatgccggcgaatccctctggctgccacagcagctgcctccttgagtggggtcagcgccccagcccagggcgcacacagcccctggaccccacgacgaggccccctggacgatcagtacgtgtggggtctggtgcgcaagcagtggccgcagctggtcagggccggcctcgccgtgatggtgtgtgtggcctgcaacctcgtgtctcccgtgctctccggcgccctgtttgagaacctggtgcagcagcagccctttgagcagtga

SEQ ID NO: 5345 - DNA, 537 bp, Chlorella protothecoides
atggaggtacccgggaccatcgcacggcggcacagggatgcctggcctggtgcacgatctgccgcatcagtctgcaactcctgtactcgctcttctgcagggctgccggccacggtggtcgcgttcgtgtcgccccacgctctgcgtgctgtgctcagcgacatgtgcgccgtgctggggcccgaccgccgggccgtgctgggccgggagatgaccaagctgcacgagcagtttctgaggggctcgctgcgcgagctggaacagctgcacgatccggcccaaggggcgcgggcaccgcgaggcgagtacaccctggtcctggccccgcccgaggtcgacggtgcgggcggcccagagcagggcctgacggacgaggacgtgcgctcggcgctggcggtggcgatgcgggcggggcacacccgctcctccgcggccgcatccgtgtcccagtcgctgcgcgtgcccaagaagcgttcgtaccgcctgtccctggaggttgggaacacccagcccggccagggggaggggcaggcttag

SEQ ID NO: 5346 - DNA, 108 bp, Chlorella protothecoides
accagccgcgagatccagaccgccgtgcgcctggtgctgcccggcgagcttgccaagcacgccgtgtccgagggcaccaaggccgtgaccaagttcacctccgcctaa

SEQ ID NO: 5347 - DNA, 549 bp, Chlorella protothecoides
gagcgcggcggcgcggcgggcctccgcgccgaggccgaggcctttgccgccgcggcggcgctgcccacgcacggcgcgctggtgcacgtcttcttcgcgcagcgctccaccaagcgcgtgcgcggggtgacggacgtgggcctggcgccgcgcgggctgcgccgcctggcggtgctggggggcgggctgatgggatcgggcatcgccaccgcgagcgcgctggcgggcatcgaggtcctgctcaaggagatcaaccaggggttcctggacgcgggcctggcgcgcatccgcgccaacctggcctccggggtcaagcgcggcagcctgaagcaggcggccgccgacgcggcgctggcgcgggtgacgggcaccctgacctacgacgagtttggatcggtggacatggtgatcgaggccgccatcgagcaggtggagctgaagcagaggatcttcgcggacctggagcgtgtcacgcgccctgcctgcatcctggccaccaacaccagcaccatcgacatcaaggtggtgggcgccaagacccgaagccag

SEQ ID NO: 5348 - DNA, 1383 bp, Chlorella protothecoides
  modified_base (405)..(414): a, c, t, g, unknown or other
  modified_base (994)..(1003): a, c, t, g, unknown or other
  modified_base (1138)..(1147): a, c, t, g, unknown or other
atgggccctcgtagggggacgcttgctgcagtcatgcgtggggcacctgatcgctgtgccatcctcgtcgcagccttacgctcagcatgccattcccacacaccccaggtcgcggacgagaagaatggggccgccgtatttgccgtgctgcgattctcgctggatggcaagtacctgctggcggtggtggagggcaggatctacgtcatggacgcgtttgagggcacagtggagcgcaaggtgtgtggggttgcgggttcctcaagactggccatgcggaagggagctgcatgggccgagggcaccgcagtgcagatgcaggccatggcagtgccagccagagccagggtcagcagcctggaccccacatctcgttccacgaccgatctgaccccagctgaggtnnnnnnnnnncagtgcagatgcaggccatggcagtgccagacagagccagggtcagcagcctgggaccctgatctcgtccacagcaatattcccgagggcggcacggccctggaggcctgcctcaccgccgacggcaagtatgtcctgtcggggtgcgctgaccgcgcggtgagggcctggagcgtcgccgatggctctgtggtctctgagtggaagggccatgctggggtccccacatgtctcaaggttgcaaagttttcgcagctgggggaaccagagccgtgtgcagcaatgtgcggggttgacactcgatcacaaaggcttagtggtgcacctttcatcattgagatgccactctgcgagccaatcccttccctttgcctccctgtgcagtggtcaccccgcaagatgctggtggcatctgcgtgtgctttcttctcgacggtgacctggggacaggggtgtcatgctgcctcacgcaccgtcaggaggctcggtcatccgccagcgatggggaggcgtgcatggtgtgcttccagaccatgtgcggcgctcctggggagctcattcttcgcctcaatgccaccgnnnnnnnnnnaggttgcaaagttttcgcagctgggggaacaagagccgtgtgcagcaatgtgcgggattgacactcgatcgcaaaggcttagtggtgcacctttcatcgttgagatgccactctgcgacccaatcccttcactcnnnnnnnnnntggcacagcatgtggttctcgcccacagcaagtgctttcttctcgacggggacctggggacaggggtgccatgctgcctcacacaccgtcaggaggctcggtcatccgccagcgatggggaggcgtgcatgacgtgcttccagaccatgtgcggcgctcctgaggagctcattctccgcctcaatgccaccaccaaacccatctgtaccgaggcagccttgcgaagtcgtgtctag

SEQ ID NO: 5349 - DNA, 1518 bp, Chlorella protothecoides
atgttctccaggtctgccttgatgctcagagtgaagacctgtaacagcatgagggttgagtattccctacagtgttgcacaagcatgtatgcctaccgaagatgcaagcagaatgagcgccccgagcacttcccgctcccgcaccggcatcgcgaatactatttcagagttacaagaatcttagttctctgcgcagggtttgtgctgaatgaggagcgatgtatgccttgggacaatgcttaccgtgcaacctggacgactcgcgccacgctggcactccccagattttttgaaacgcatgcgattctccgcgcagcctgtgaccgagaagccccaaggaccgccagcggagtggggctgaccgagacagggtgttacctgacgggagcgagggccctgcgggcgctcttcactcgatcttcagatggctaccctcctgcaacaggccctgcagatggggttccagggccaccctctcacttcctggtccctcaccatgatcgtcagggcactcggcgtgtttccaagccgactttgaatcgtctacatgtgaggaatagctccaaggccggtgcagggccggtgtcggatgcacacctggcccatctgcggaatgcggggcaccccgtgcccgaggcccctggcctgcaaggcttcgtagcaaagctgaaagcggcctggcagattttctttcccgagaagcctccggtcttgacccccaaggacgagggaaagaacaggctcaggatgatcctcgtggcagacaggtgggatgggcgtgaggacaaggagtgggccttgcgggagtgcacgtcaatcccgtccatgcaagttcttcagcccatgggccggcgtgacgaaatgcagcatctttcatgcctcagcaagcgacctagttccgctttgtgtggcatcaccccagacagtctgacgggcatgcgggaaagcatcgtccaggcagtgtcagcatatgtggacatagagacagaggaggagattgaggtgaacctgtccaccgacccagagcttggcaccatctattctgtggctgttcctgttcgtcgcgtcaaatctcggaggattgggggggttgatacctcagaggatgggaagatcattgtcaaggtaaggggggacagttcgggtggcctttttgtagcgcttcaagctctgatggcgtgggggcttggcatgcgctccagtaccctttcaaggagagttgcatgcccagtgtgctttggtcctctcactctgacttccttgccttgcagtgggatccaaaggaccccaacagcgatcccagtgaccagttcccctttggcgtgtgaggtgccaatgctcggcctcaagagctgtggagtcgcagcaacgacggagctcagcatccagcaactgcacacatcgttctctagaatccatgtaccccaccaatttgtgcttaacgctcctgccgagatgatatttcccgagcgcatgcgatcctttcacccgcaaagatgtacaaccaagtcctcttga

SEQ ID NO: 5350 - DNA, 2370 bp, Chlorella protothecoides
atgacgaggcaaagcaggatccctctcacagcaggatcggatgcatgcagcacagatccctcccctacagagcaggggctgcattccctcctccacattctcttggccaccctctcaaccccttcacaccccacctgcagggtgctgctcaaggagcccaaggggcgcgaggtggaggacggcgatcgcttcacctacaacgagggctacaccagccgcctgttccgcgtgaagatcaactccatccagctgcgcgagagcgcggaggagagcgccaagaccaacgaccaggtgctgcaggaccggcagtaccaggtggacgccgccgtggtgcgcatcatgaagacgcggcgcacgctgtcgcacaagctgctggtgaacgagctcatggtacagctcaagttccccatcaaggcggtgagcggggaggggggtgccccttgggcacggggaagggggactgtgcagctcgcgcagcgacctgcatcgccatccctgggccgcggcgggagggacatgcagcaaataagccctcccgctcctacaagcgacctgaagaagcggatcgagtcgctgatcgagcgcgagtacttggaacgcgacgggcgaccgccttgggctcgctcaagcgccgactccctggaccccaccgaccaacaccgctgctcagtcgacctcctcgatcttggggcctgggccggtgccctcgggggcgccggggccggcgggggcgccgcctgcgggggcgccgccggccgcgtacagcttggagatgatggggctgcacacgccctccagctcctcgcgctggtgggagatctcctcctcctcggccagctggttgtggtccagccactcgatggccttgtcgatggcggcctccatggcggccttgtcgctggcctccagcttctcggccacagacccctccttcagcgtgttgcgcatggagtacgcgtagttctccagccccccgttgcgcgcctccaccttcttggagtgcgcctcgtcctcgcccttgtacttctccgcctcctgcaccatgcgctcgatctcctccttggacaggcgccccttgtcgttggtgatggtgatcttgttcttgatccccgtcgtcttgtcctccgcgctgacgttcaggatgccgttggcgtccacgtcaaaggtgacggtgatctggggcacgccgcgcggcgcgggagggatgcccgtcagctcgaacttgcccagcaggttgttgtccttggtgcgcgtgcgctcaccctcgtacacctgaatcagcacgccgggctggttgtcagagtaggtggagaacacctgctccttcttggtggggatggtggtgttgcgcgcgatcagcgtcgtcatcacgccgcctgcggtctccaggcccagggagagggggatgacgtccaggagcagcaggtcctgcaccttctcatgcgtctcgccgttcaggatggccgcctgcaagaccgggcagactcggatccccacccccctgcacacctggacggcggcgccgtaggcgacggcctcgtcggggttgatgctcttgcacagctccttgccgttgaaaaagtcctggagcagggtctggaccttggggatacgggtggagccgccgaccagcaccacctcgtggatctggcccttgtccatcttggcgtcgcggatgaccttctccaccgggtccatgcacttgcggaacaggtccatgttcagctcctcgaagcgggcgcgggtgatggcggagtagaagtcgatgccctcgtacagggagtcgatctcgatggaggcctgggtggaggaggagagctggcgcttggcgcgctcgcaggcagtgcgcaggcggcgcagcgcgcgcgggttgccgctgatgtccttcttgttcttgcgcttgaactcctggacgaagaagctgaccagacggttgtcaaagtcctcgccgcccaggtgggtgtcgcccgcggtggccttcacctcgaagatgccctcctcgatcgtcagcagggacacatcaaaggtgccgccgcccaggtcaaagatgagcacgttctgctcgccggtggtggcgtgcttcttgtccaggccgtacgcaatggcggcggcggtgggctcgttgatgatgcgcatgacgtccaggcccgcaatcacgccggcgtccttggtcgcctggcgctgggagtcgttgaagtaggcgggcacggtgaccaccgccttcttcacctccttgtcggcgcccacaaaggactgggccacctccttcatcttcaccagcaccatggaggagatctcctcgggggcaaaggtcttggtctcgcccttgtactcgactgcatagaagggagggagggaggtgggtggtga

SEQ ID NO: 5351 - DNA, 1047 bp, Chlorella protothecoides
atgcgcgggttccgatcatctctgcgcttgtctggaggggacggctctgttccagccggcggccgccgcaccgtcacgctgcgcgcgcaggtgtctggtgggccaggcggctgcgcggacgccctgctctcctcccgggcctgctcgctggatgcggtgctggtgctgcgcgtcgcgcgcgggaacgacatgtttttggccgtgggcggcgcctaccggccctcctggatgggccttcggccccgcaccctggcggagcggggcccctaccccatgtccaagctgtggcaggcaggcgaagatgtgggaacgggttccgaggacggggccgcaggggacgagggcgcagaggccggggacgagggcgcagaggccggggactcggaggccgagagctcaggtgcagcgcacgcgggcgccgcggcggcggggagcggcagcggccccccgcccgagcgcacgcccggcgtcccgctggagctggcgcgcctgatcgaggcgctggaggaggaggaggcgctgggcacccccggcctcttcatgcccttggcggccatccgcgaggcgctggaccgcggcgcggcggcctggccacgcggcgtgggcccgtgcgacctggccgccgcactgctggccgcgctggcggcgctgccggagccggtgctgccggagggcgccaaggcgctgtgcgacgtcgcgtcccacaccaccgtgcgcatgctggggcggcgtgcgtgcgccgccacggccatgggcgtcgtgcgcggctccctgagcgggccgcggctggagctgttcgagcgcgtgctgggactgctgcgcgccgcgctggcaccgcgccgcgcggagcgcaacggcctggcccccgccgcgctggcggtggtgctggcggaggtcatgttcccgcccctgccccgcgagatgcatgcggcggggggcgggttgggcgacgccgcggcgcggggcctgggcgccgccgccgagaacctggccgccatcggcatgcggcgcatccgcttcattcagcacctgctgaccgaggagtga

SEQ ID NO: 5352 - DNA, 864 bp, Chlorella protothecoides
atgcgtgggcccgtcagcgcccgcgggcgtggcgatgtgcgcaaggtggtcatccggcccctgaagcgcctcgccaccggtcttccatctgggtacgaggagggcgcctgggcccagctggagaccgcggtgctggctgtgcagagtggcacccccacctccaccagtctggaggagctgtaccacgccgtggagttcctgtgcaaggacgggggcggggccggcctgtacggccgcctgtccgtcctgatccgcgcccacgccgcggcggtggtgcagggcctggcctcggcgccgccctcagcccccgtcttccttgagcaggtggggtctgcctggcgggcctacacctcccagctcctgctcacccgccagatcttcatgtacctggactgcggctacctcaaggcctccgccaacgtgcccggggtccgctccctgtacgagctgggcctgtcggactttggcgccgagctcgccgcccgccctgccctcgtggaccgcgtcgtgcgcggcctggtggacctggtggaggccgaccggaacggggcggcggtggatgggaagctggccgcgggcctgctccaggccctgaccctgctgcatctctacggccccgccttccagcggccactgctggcggccacgctggcctactacaccgcggagggcacgcgtctcgctcaggagctggacgtgccggcctacctcctgcacgccgagcgccggctggcggaggaggaggcgcgctgcgaggcctacctcggccagcagagcagggacctgctcatggccaccctgaaggccagcctgctggaggagcacatgggtgaggaagggaggggctactgtagaaaagagtga

SEQ ID NO: 5353 - DNA, 579 bp, Chlorella protothecoides
atgctggggccgccgctgaagtccaagggcgagaaccctggcgatgaggcaaagcgccactacgaccacgcggagatcctgaggcggggctactttggcgacgccaccaccgcctcggtcgcgaggcccaccctgggcgcagccaccgggtccctgaccccagacgtgcagcgggtggcgggccctgcagcccggggcgggcactgggggcccgccctgtcgcacatgatggccacgcagcacgtcttctggatgggggacctgaactaccgcctgcatgggggtggggcggggagcacgaccatcctcaaagccatagcggaaggcgagctcgagtccctgctggccagggaccagctgctgcatgccatgcgcagcggcgcggcctttgccggctggcaggaagcccccatccggttccccccgaccttcaagttcaagcgcgggtcgccgcgatatctggggcaggagggcgagggcagcgccagccctggcctcggcacggcagcaaacctggcaagcagggcagcggaggagggtgtggcctccatcccccctctcaacgaggtatggggctga

SEQ ID NO: 5354 - DNA, 1803 bp, Chlorella protothecoides
atgaaccccatcaacactgtgttcgatgccaagcgcctgatcggccgcaagttcaacgacggcaacatccagcacgacatctcccactggcccttcaaggtcgtgtctggtgctggcgagaagcccatgatccaggtcgagtacaagggcgagaccaagacctttgcccccgaggagatctcctccatggtgctggtgaagatgaaggaggtggcccagtcctttgtgggcgccgacaaggaggtgaagaaggcggtggtcaccgtgcccgcctacttcaacgactcccagcgccaggcgaccaaggacgccggcgtgattgcgggcctggacgtcatgcgcatcatcaacgagcccaccgccgccgccattgcgtacggcctggacaagaagcacgccaccaccggcgagcagaacgtgctcatctttgacctgggcggcggcacctttgatgtgtccctgctgacgatcgaggagggcatcttcgaggtgaaggccaccgcgggcgacacccacctgggcggcgaggactttgacaaccgtctggtcagcttcttcgtccaggagttcaagcgcaagaacaagaaggacatcagcggcaacccgcgcgcgctgcgccgcctgcgcactgcctgcgagcgcgccaagcgccagctctcctcctccacccaggcctccatcgagatcgactccctgtacgagggcatcgacttctactccgccatcacccgcgcccgcttcgaggagctgaacatggacctgttccgcaagtgcatggacccggtggagaaggtcatccgcgacgccaagatggacaagggccagatccacgaggtggtgctggtcggcggctccacccgtatccccaaggtccagaccctgctccaggactttttcaacggcaaggagctgtgcaagagcatcaaccccgacgaggccgtcgcctacggcgccgccgtccaggcggccatcctgaacggcgagacgcatgagaaggtgcaggacctgctgctcctggacgtcatccccctctccctgggcctggagaccgcaggcggcgtgatgacgacgctgatcgcgcgcaacaccaccatccccaccaagaaggagcaggtgttctccacctactctgacaaccagcccggcgtgctgattcaggtgtacgagggtgagcgcacgcgcaccaaggacaacaacctgctgggcaagttcgagctgacgggcatccctcccgcgccgcgcggcgtgccccagatcaccgtcacctttgacgtggacgccaacggcatcctgaacgtcagcgcggaggacaagacgacggggatcaagaacaagatcaccatcaccaacgacaaggggcgcctgtccaaggaggagatcgagcgcatggtgcaggaggcggagaagtacaagggcgaggacgaggcgcactccaagaaggtggaggcgcgcaacgggctggagaactacgcctactccatgcgcaacacgctcaaggagggctcgaactacgcgtactccatgcgcaacacgctgaaggaggggtctgtggccgagaagctggaggccagcgacaaggccgccatggaggccgccatcgacaaggccatcgagtggctggaccacaaccagctggccgaggaggaggagatctcccaccagcgcgaggagctggagggcgtgtgcagccccatcatctccaagctgtacgcggccggcggcgcccccgcaggcggcgcccccgccggccccggcgcccccgagggcaccggcccaggccccaagatcgaggaggtcgactga

SEQ ID NO: 5355 - DNA, 1368 bp, Chlorella protothecoides
atgccccactcacacccgcacctgcacaccgcaccacagcctccctgctgcagcggcagggtggaggacctgtcccgcgcattccgcctgtcggagcgcatcgatgcgttggacggcctgcgcgcagccttcaagggccacgtccggcgcgtgggcctggcgcgggtgggcgatctggagcgggagggcactctggtcagcgacctgctgacctggcgcagccgcctggagtcgtacgtggcgacggccttcgcacgcagcgaggcctttgcgcaggcgctgaaggaggccttcgagtacttcatcaaccagcggcagaacaagccggcggagctgatcgccaagtacatcgacggcgtgatgcggggcggcgtcaagggcctggcccaggacgacatcgactcggccctggacgccgtgctcgtcctcttccgatacatccaggtattcattgttctccacgggagccatgtatggcaggggggttatgtggtggtcaggcaaggaggagggggaggggggcttgggaggggaggagggacggagagtgaggaggaggacgctcctgcccaggcttggtggcttgaggaggcagaatgctggattgccttggctcgcagccctgctgggctttcacgtggattgcaggcggactgtggcgatcagcagcgttgcaagcttcccactcaccctcctacccgcccacacccacacccaccgcagggcaaggacgtgttcgaggccttttacaaaaaggatctggccaagcggctgctcctggggcgcagctcttccatcgacgcagagaaggcgtgcatcagcaagctgaaggcggagtgcggggcgcagttcaccaccaagctggagggcatgttcaaggatgtggagctgtcccacgacgtcgtggcggggttccgggcctccctggcgggcccgggagcggggcagctggcggtggggggcgccgcggtgcaggagatgggcgtgcacgtcctgactctgggcttctggccctcctaccctgccgacgagtgctccctgcccgaggtcctcaccgccagccagcaggtgtgtgcccgtgttggtgtgtgtcggtgggggcagggcgttttggggggcgggcgctgtcgggggatgaggtggaaggtggtgcatggcggactggccttggacaccacgccacctcacccccccgctccaccatcatcctctccagacattcaaggacttttacctgaaaaagcactcggggcggcgactcgtctggtacaactcgctgggcacctgcgtcttgcgggccagcttccgcgcagggtccaaggagctgtccgtgtcgctcttccaggcgaccgtgctcatgcagtttga

SEQ ID NO: 5356 - DNA, 807 bp, Chlorella protothecoides
atgagccctccctcggtcacccaccgacagcgtcaggaagtcaaagacctccgtgcagtaccgccaggcattggcgttcccgcatgggtgtcggggggcagcgtcctcagatggggcaccgtctggagcacacgttctgatcccctgcccaccgccccagccctccagccagacccatggtggcacccaggtcaggcccaggaccagccgccccgcagcaactcacacttgggtgatctgccgcgactcgtggttcccccgcagcagggtgacgtgggcgggccagcgcgccttgagcagcatgagcagcgtgaagacctccagggagttgtagccgcggtccacaaaatcgcccatgaagatgtagttggtggcggggacctggccccccgtctcaaacagcttcagcaggtcgtgcagctggccatggatgtcgccgcacacctattgggcagcagttgtttggtaggcatgccatcgcgctgggcagagaagatcaccagggagctgcgtggttggcagactccaggccaccttcaccacagggtgctggccccccctcccccttgcacatacacacatggtgggatcctccagcctcccacagccctgcgcaagccatacgccaaacctaggagacacactgaccgtgacgggggtgttcacaggctgcacattggactcctccaccaggatttccttaaccgtgtcgcaaagagacttgagctcctcctctgcaaggtattgggctttctgaaccttctccagccaggcgtccaggtttttgctggtcgcagcggtggatga

SEQ ID NO: 5357 - DNA, 591 bp, Chlorella protothecoides
atgctcagccaagtgcatctttttaccttgcaggaaagtaccgaccgtatcaactccttggacttccaccgcacccacgacctgctggtgacgggtggagacgacgatgccatccggctgtatgacacagagaccggcaccgcccttcaggcgctgctcagcaagaagtatggagtgaagtcgggcgcggactatgcgctgcggtaccatgacctccacagcaaccgatatgtacgttacttcagaggacatggggccaaggtcaccacgctgtgcatgtccccaaagtcggacaacttcctgagcgcggcggaagacaagcaggtgcggctctgggacctgcgccagccccactgccaggccatgctgcagacgccaggcctgccgacagtggcctacgatgagcagggcctggtcttctgcgtgggcgccgagagcggggtggtcaagctctacgacgcccggaactacgggcaggggccatttgcagccttcacggtgagggcacagagggggcgcaaaagctgccagggctggacggctgtgcctggtgggtatgctgcaagcagaagagcagtggcgggcggctga

SEQ ID NO: 5358 - DNA, 1032 bp, Chlorella protothecoides
  modified_base (89)..(173): a, c, t, g, unknown or other
  modified_base (253)..(262): a, c, t, g, unknown or other
  modified_base (384)..(393): a, c, t, g, unknown or other
atgccaacttgcaagcagatcttattcgacgacccaatgctgtctatctctccgtgtatgcgcaggaaagcagagacggaggcagacgnnnnnnnnnnnnnnnnnnnnnnnnnnnnnnnnnnnnnnnnnnnnnnnnnnnnnnnnnnnnnnnnnnnnnnnnnnnnnnnnnnnnncagcgaccgggttgagcagcgaggtgattgccgccatagacccatggttcttgtatccctgcatcaaccgcaacctcggnnnnnnnnnnaattcatggcaacttgcgagcagatcttattcgacgagctaatgctgcctatctctccgtgtttgcgcaggaaagcagagacggaggcagacatcattggcatccagagagcacatgccacnnnnnnnnnnccatctttacctcccacctgctttgtggatcccatcttccaccgtgcctcctctgaccctcaccagctggcagcacaggcatgctacgatcccgccgctgcggcatctgtgttccagaaactgggcgctgctgagaagaagatgggagggactgccatgcccaagtttctccgtacccaccccctgtcagacgagcgggtggctcgcatcaaagaggtgtgctctggcgtcttcagcacatggtgttcaggctgcggagttgccttgtttctacatggaacatggtcaagtgctgccaattccggtcaccagtgtctccgccttccatgtcacaggagctgcccaaggccctcggcatgtatgagctggcgggatgcggctccctccgaggccgggcagggggcctcttctcaggccttggcgatggaggctggcgatgacaagggaggagatcgtgccgtctttgccctgtgcagtgcacaccctccctgcaacccacagtccctttgtcatcattgcaccttggctgactccacaacaatcacagccgtgacacgcgtcgcagactgtgccaggaggcacagtgcagcagagttcaagaattggtgggtttgggaatgcagtgccatgggctgctga

SEQ ID NO: 5359 - DNA, 1953 bp, Chlorella protothecoides
atgcatggcgcttgctacatgcgccttcaatgccatatcttttgtgctgcgattcctgactggccggccctgccattgaatgagctcctgcgccgaccctccccctaccaccctgcaaccagaacctgcggcacccctcacccattccaaccgaccaaagctgcggggcttggctctgcccggcggcacgtaagagggctcctgggatacaagcgcggcgccagccagcgccgcggcagcagcttggtcgtgcacgcagagcgcgacttttacggcatcctgggcgtcagccgcgatgcggacaagaagaccataaagagcgcataccgccagctggcgaggaagtggcacccggatgtgaacaaggaggcaggggcagaggacaagttcaaggacatctccgcggcctacgaggtgctgtcagacgacaataagaagagcgtgtatgatcgattcggggaggccggtctccaggggggcggcggcaggcctggtggtgccggatttgagagtgtcaggcatgaatcaggccggcattgctgcgtgtgtggtggggtggggtgggggaagaaaggacaagtaacgatacttgagccatatgctttggtatgctgcagtcctggtcaactggcttctccaaattgccatctgttggtctcacaagccagtttatgcgctatcccccatccccccccgccccccccttctcctccttgcagcaaccccttcgacatctttgagtcgttctttggcggcatgggcggcggcaaccccttctctgacgcgtttgggggtggcggtggacggggccaggctcgggacccgagggaaggtgctctggctcaggccggcttacctacctgttgtccaagagttgtgcctgaatggcgcaaggttccttggcccttcaactatctcgctgccatggcctgctcagccaccaattccatcttttgcccgcatcctcatcccctcccaccttccgcccacgatggcccaggtttgggctgcagctggacttcatggaggccgtcttcggctgcaacaaggagctggacatcagccacctggagtcgtgcggcacctgctctggctccggggtcaaggccggcaccacccccaccacctgcaagacctgcggcgggcagggccaggtggtgcaggcagtgcgcacgccgctgggcatgttccagcaggtggccagctgcccgacctgcggcgggtcggggcaggagtcgacgccctgcggcacctgcggcggcgacggccgcgtgcgcgccaagaagaggatcagcctgcgggtgccgccaggaattgactcgggcagccggctgcgcgtgcggggcgagggagatgcagggaagaggtgcgcgggggggggaggggggtggagagagctttttgttttttggggggggtggggtgcgaatggagatacttcctggcccactagctcaccctccaggccccaatcacccacctcgatcccctctcgacccctccacaaaccgccaggggtggcgagcccggggacctgtacgtcatgctgaccgtcaaggagcaccccacgctgcggcgggagggccagaccatccactccgacgtgcgcgtgccttacaccgacgccatcctgggggcgtcggtcagcgtgaccacggtggacggggacgtggacctgaaggtgccggcggggacgcagccggggaccaccctggtcatggccaagcgcggcgtgcccaagctgggcaaggccggcgtgcgaggagaccacctggtgcacgtccaggtcagcatccccaagaccctgagcggcgaggagcagcggctggtggagcagctggcggagctcagctccaaggagtcgggcaagaagagcggggccaaggcggggtggtttgggtgagcccacgcggctcgcggtgtggcctcctggccaccgctgcagcgatatga

SEQ ID NO: 5360 - DNA, 978 bp, Chlorella protothecoides
  modified_base (961)..(970): a, c, t, g, unknown or other
atgctgcatcgttacccttacatcagcaacaccacggcatgggaaagggtgggttcccacctcaactgccctgcgcagggcacagcagggcaggctccacgccctttcccctacgccgccagacggagcggtcgatcagcggttggccttggccacacgctcgatctcgtccttcttcttgatggcgtaggagttggaggaccccttggcggcattgatcagctcgtcggccaggcactcggcgatggtcttgatgttcctgaacgcggactcgcgcgcgccagtggtgatcagccagatggcctggttcacgcggcgcaggggggacacatccaccgcctggcggcgcaccacaccagcggacccgatgcgggtggcatcctcgcgggggccgccgttgatgatggcctgcaccagcacctggatggggttctggtcggtcagcaggtgcacgatttcaaaggcatgctgcacgatgcgcaccgccatctgcttctttccgttgttacggccgtgcatcatcagggagttggtcagcctatcggtggaaagaagattgttaaagtcgcaaccagctggtttgcacaggggcgctacacgaggcagcagctccgacgactcaatcatgcccatcacccacctctccaccacggggcactgggccttgcggaagcggcgcttctggaagcggccggcagagtggggcgtgtatcggtcatgcttggccttcaccgcgatgtagtcgatgagagacaggtcggtgacctgcggccagggaaagcgcgggaggctgctgttcagaaacattccgtcccgagcgccaggacggacggaggaaccgcccacgctcgtcgtagtcacaagggaagagcatattcctaccccagtcccagcaatcacagtgcagcatcagcgtgccggtccacgtctccccggctcgatgcgcgcctcccaggccgannnnnnnnnncgtcgtag

SEQ ID NO: 5361 - DNA, 1815 bp, Chlorella protothecoides
  modified_base (383)..(392): a, c, t, g, unknown or other
  modified_base (667)..(676): a, c, t, g, unknown or other
atgactactcgggttggggcaaaggtcctggcccaggcatgccgacccttctggcgcagcttggtgcccagctctgctgtgggcagggtggaaggcatgcagaatcccggcgcagaccttgggttgcattctgcggagcacggtgtgtggggtcgtcacgccctgtttcacaccgcgccacagtcgctggcctccctgccggtcaccattccggccctgggggagtccatcagcgatggcaccgtggcatcattgctaaagaaagcgggggataccgtggaggaggacgagcccattgtatccattgagactgacaaggtcacggtggatgtgagggccccccaggcgggtgtcatcctggctgtgctgaggttcccccatcnnnnnnnnnngtggcaagaaagggctgaggcgtctttctcggaggtcggggggtttgaaattacgagtgcctggaagcagaggttcccccatccctcgacagtacagcatgagcagccacagggcatcgaccatggcacccatgggagagtcttgctgaaacccacggcaagtgttttgcctactcttttcgtggaggagggcgcaactgtagaagtcggccatgtggtggcaacgatcgacactgacaaggctgcgcaaaaccatttggtgcgtcctcacatgnnnnnnnnnntggggccttatgcaatggatgccaccatgggcatgccttcactgctgtgcaagaccacactcaccctcatgagcctgagccctgcgcaaaaccatttggtgcgtcctcacatgtgcggtacaatactcatgcctccacgcatacatcctgtccacacagctgccggagcgcccgccaaaaaatccaccagccaagaccagcccgagactacgcccaaggcacccgccgagccatctgcgtcgcatgcagccagcgcgggggagtctggctggtcacgtaccccttcgatacacttccctgcgcgacgcactgatgacggcacagtcatcagttcccttcccgcaaacgaggcgcaggcagcacttcaaagtgaggagatggggtggtgtttggacattcgggcctcaattttcgcctggtttggtctgtcacgatattcgggaagggggccccctctcctgggaatggtgtaccagttgcgggcttctccatggccatccaggcaggctcgttgtctgatgagaaaccccagtcacgcagctccaaaccctgaggtatgtgatgctcctcccctcacactccacagaactggagggaggaagcagcagtggcgggacagaaggcagtcatcccccaacagtccttgcgtcagccagccccccacccaagcagggcccgtggctgcaactgaacccccgccggggaccggctctcacgggacaggtcgggatcttcctagaccttcatccctgcagcctttgggcgtggtgcatgcccgtacaccatacatcaccagtgcaaccatctcggcaataccttgttgcccttctgtcgagggcgcaggtgtccagcaggagagatggagcgaggggattggggaccagagcctttttgtcgctgcatggctacagtttcaccagcaacctgccccggcttgccagcttgacagggtacacctccaggtcgatcggatcctgcttgtctttgagactgccaatggctttccgaaacaggttgttcttcgggcaccaactcagcacctgagcagtgccatgacgatggtgaggggtgggtggggtgggataggagggtgtgggaatttgggcaccagacgtccctctgtggcacgattgcattga

SEQ ID NO: 5362 - DNA, 2286 bp, Chlorella protothecoides
  modified_base (344)..(353): a, c, t, g, unknown or other
  modified_base (1763)..(1772): a, c, t, g, unknown or other
atggaagatctcgatgacccggcccccggatccggcgggatgtcggaatgcatcggtctgtgccaaacgaaagtctgcggcttgctgggcatcactggagacgtatgggatcgattctcgagatccgagaattggtgggtcatcgggcagcgtatcgatccttgggatgctgtgggagggcacatcaagagggtctccatgtcaatcatattcacaatggcttgcttcaccccacaggtcggccctgcaggcgttcctgtctcaacccagcactcaatccgtcatcctgacactggacggcagggagttgagcgcggtatgaccttcaagactccagatcaggnnnnnnnnnncgttttggaccgcatgttcaactatcagaccagttcatgcctcttgttgacagcccacccatcaccaattcgataccagaccttcaagactccagatcagggcaagggttctgcgcgtcacctctgcctactcaaagttcatgcgcagcccctgagcaaagcaaccttctcctcaaatgtgagtgggtgcatcgtcatgttatctgcaccatcagcactggatcaacatgcttcaacccacggacttcatgtggaagacccaacatgccttggtggtcactgccctaaaggccttttgagcagtccagatgtcagcagaccatggccattggcaccgcaggtggttgccatggagttgtcccgcggcatccaggagcagctggccgtcctctcctcccgcgtcttcatccccatgctgcaagcccaagccaggcaggcgctcatgggagcaaagccatgcggcggcacctgcatccccccgtcagctgccaggaccgcagcccaggcgctgcagcagtatgtcctgaaagtgaatgcggcaaagcccgccctgcagccggggtccttcctcgtcatcccggatctgggcagcgcagagctctacgacggcggcccagacgcccccacccccgcatctcgcgacctgctggcggccctggatcaggcggcgggcgcctggatcggccagctccgagaggccctggctgcaatacctgtggtacccagcgcacagcgctggcccagggcacccgcgttcctggccgcctgggccgcgcgcgcggagtccctgcagggcctccatgatcaggcggccggccccggtatgcagcgggcgctggcgctcctccgcgccaacgccagccctcggctgccggccctggaacggctgctggcggagttgagggaggcctgcccaaaggcagcctccgtggcaaggcacggcgccgcgcttggtccgaggctggcagccctcgccggcgcaggggtgcagcacctcccacaaaccttccgcccggtcatgctcacggccatcctgatgtggcagcactgccccgacctgcgcgccgccccgggcctcatgctgagcctgctgcggcacgtcacaaacgacatcgctgagagcgtgaggcaggggacagaggggacctccatcctggtcctggaaggccccgaagcggtgcgcaggctggagctgtgcctgcacgtcctgggcacctggaagagcatgtacctggaaatggcagtggctcctgcttggcatcccgtgagggttgtgatggtggagaaacacttcaagtacagacaattgggcagctttgctcaaactctttcacctgccaagcacaaaaacaagctgtgcacagccctttcacctccatatctcaccaccccttgcagctcaacacagtnnnnnnnnnngaacactttaagtacagacaattgggcagctttgctcgaactctttcacctgccaagcacaagaacaagctgtgcacagccctttcacctgcacatctcaccaccccttgcagctcaacacagtcgaacccccacaaagggcgcgagtatgtggcgcttccctcctgccaccatcttctctggcatggacgagctgctggagagggcccatgatgtccttgggccaggggaagagctcggatcccaacacttgatctcgaatctatactcctgcatctaccctgctccagggccgcgaattgacggccagtctgcatgccatccagaccgagttcaagtctgtgctcaccactatgcaagaggtgagtggcagatgctccagccttctttctggcagcctgggatcccactgactgtcctgctcactgcttcagctgactatccacaccagtggccagagcagatgccgccgacgcacctggatgcaggtggacggcgaccccctggaccctga

SEQ ID NO: 5363 - DNA, 2325 bp, Chlorella protothecoides
  modified_base (1553)..(1562): a, c, t, g, unknown or other
  modified_base (2278)..(2287): a, c, t, g, unknown or other
atgctggaggggctggctgctgtcgttctggccagcgcccgacgccttttgggggtcatctgcatccatgatgcaggccagcagtgcgagggtgggcctctgctggaagtgactctccagtgccaggcaggccagctgttctggaaacctgacatgcatgctgccaggtcagacgagtggacactcatggcagaggctcggcggtgcaccagagcttctcagggcaggcaatttatcgagaagtcgatgcaagccctggtggcatcctggctcgagggctttctagaggttggacgggcgatggctcgccccggcctggaggatggtgaggatggtgggagaggctgcacaaggagtggaaacttgtatagacttcagacatataagccgttccacaagactgtacgcggatgtcactctggccgccacagccagcgcagaggcatgcactgcctgggaggctgtatggacgccattcgagcacctctggaagcagacccccaagagcgtgctgcaggtaagcatcggcttcaggcaccgcagccatggtctgcaggacagcaggagtatttggcagccgatgaagtgctggatcaagcagggttcttgtcacgctttgagatgaaggttcagcaactgcatgccctatctgagcagatccagggcaccaccctgatgtgtgcctcaccctccaccaatcatgctccttaccctgtcttctccacctcccctcaggccctcccggccacatcgaccctgggctggttgagggtggatgcgcgcttgttcaagcagagcctgctgacttgtgctggcaagctgagccatgcattcaccagtcacttgcagactcagaagcgtgatgggggcgcacgtgttattcagttgtctcctggcctggcgccttgcctgccaggaaagtatctgcaaacatgcaagcagccgtcaccccccttccccttcccaccgagtgcagctgggcaggtgcgtcgccgacgtgagcgccttcatcacatccgctgccaccgtgctgaacgatgccatcgctgcgcctggcgccggctcggcgcagccctcccccgccccgtccccgtccatcaagcccacgtcgcgacgcggcaccgccagccactcgcccagcgcaggcctggctgccagcctgggggcctccagtccacgctccacccgctccagcctcgccggcaacctgctggggcaggccaggccgaagcggcagagcgtcaagttggccgccgggatgggggtcaggggcgaggcgtccctcgactccgccagcctgtgcaccccccgaccaccagtgtccggggagagcaggaaagaacggtacctggccgcactgcactgcggccaagaggtcagggccgggaccaaggaaattgcagctcagctggtgtttgccgacgagtcaggtgggggcctcaagggggacgggggttgcttgattgggtactgttactgctgtgggcatggtggagcacacaggtacttattgaggtccatacatcccttcccccagcggccctgctggcgannnnnnnnnnatgggcatggtggagcacacagatatttattgaggtccatgcatcccttcccccagcggccctgctggcgaggagtggcgcggcgctgagtgcgggtgtgcagaaccaagtggaagcggtggcgcgagagtggaggtcactgcagaagaagctgctgcacatgaaggaggcactcgcacacttcataagtgcagagacgcaggaactgcacagggctgtcattgcctaccgtgctgatgtggaggcacacaggatgcgattcaccgcgacagctccttatgccgtcacagcagagctcacactcgcctgtcaatgtgcacaaggcatccccggctgtacttgctcgcaggtttcgccggcgctggaggttctgcaggggctcgagcatgatggtggacctgaggtacggcctggtctcatgggtgtcggccactccctcaaagcccggcatgacctgttggaccttccatacgaacctttggcctccttgtcagcttgcaaggtgggtggtgggtgccatgcaagcaggagactgcaaggggctgaagtctcctgttcattcgttctgtgggatgccagacacaaagaagcagtgctccatcaagccctcgccctcatcctacagagtgaggcaaccgctttgagaggcatgtgggacatgattgcccgtttcctgagctcccacgaggagtggagggcccagtcttggactggannnnnnnnnnatgctccatcaagcccttgccctcatccttcagagtga

SEQ ID NO: 5364 - DNA, 2178 bp, Chlorella protothecoides
  modified_base (216)..(225): a, c, t, g, unknown or other
  modified_base (845)..(854): a, c, t, g, unknown or other
  modified_base (1383)..(1392): a, c, t, g, unknown or other
  modified_base (1893)..(1902): a, c, t, g, unknown or other
  modified_base (2069)..(2130): a, c, t, g, unknown or other
atgacgagcttgcaagggacagatggatctttgagcactcggcacagaccaccatcacagtctctcggacgtactatacacacgaggtcggtcgagatcattgcagatcatgcctgggatgcgcaagagcttagtggcttctcgcatgggaaacggtgccttacgtacggtcacacggttacgacgcctgctcttaccccatgtgccatgcaggtnnnnnnnnnnggtggcttctcgcatgggaaacggtgcctcacgtacgatcacacgattacgatgcctgctcttaccccatgtgccatgcaggtggacgcagcatttgatgctcgcgaggatggcaatgagaatgccctcaaggcaaatggggatcttgcaggacatgatgtgctcatcctggtggacatgtgggctcctcatgagccccagcacagacatttcacgcaattcgccattggaccccccccgcaggaactccatgccaagctgcaggcacaggtgtcggagctcatcgccaggatcaatggcaagctgacccccagcgagcgccagaagctgatcaccctctgcacggtggatgtccatgcaagggatgttgtgcagcgtttgatcgaggagaaggtcgactctgtgaatgccttccagtggcagagccagctgcgatactaccagtctccccagtccaaggagtgcatggtgggtcccggcgcagtgactgtgtatggagtgaccttgggtgtgcagcaggacatgccacggaaaggccagctggagggtatatgtttatacacatatgtacatgtatatatggtctgtatgcccatgtccctggcacgctctgctgatcnnnnnnnnnnaggatggagcgaccttgggcatgcagcaggacaagccacggaaaggccagctggaggtcgcatctcaccccaggtctccatctgtgatgctgacatcgagtacggctatgaatacattggcaactgtgggtgcctgtgcatcaccccattgaccgaccgctgctacatcaccctgacccaggcccagcggctgcacctaggtaagcatgcagctggaggcctggggcagctgcctggcagccatgacctaggaacccaccatggcccgcaccactcccgtcccgcaggcggagccccggcgggaccagcagggacggggaagacggagaccaccaaggatctggcccgtgcgcttggggtgcagtgctatgtgttcaactgctcagatcagatggattacctggccatggggcagatctacaagggcctggcgcaaacaggtatggcttctgcgaggagctctgcctcgctcttgggcagatttgggatggtcacggatggcagccactcctccgcttgcacagtctgnnnnnnnnnnttacaagggcctggcgcaaacaggtgtggcttctgtggggagctctgcctcgctcttgggcaggcgcctggggctgctttgacgagttcaatcggattccagtctctgtcctgtcagtctgctctacccagtacaagatggtggcagctgctctccacacacaccaaatgcttcaccacaccgcagactcttctggatgccttgagggcgaagaaagacagattcgtttttgagggcacagagatcccccttcgccactctgccatggccttcatcacaatgaacccaggatacataggccgtgctgagcttcccgaatccttgaaagccctcttccgccccgtctccatggcggcgccagatctgaccctcatctgcgagataatgttgatggctgaggggttccaggaggccaagaccctggctcggaatctaaggtttgctggccaggtgggcacagacgttgatgaactgcactctccctgtgctgtgcagactgtnnnnnnnnnngtgaggaaaaggttagcacagacgtcgatgtactgcactctccctgtgctgtgcagactgtgcgaggacctcctcagcaagtccaagcattacgactggaagctgcgtgccatcaagacgaccctgtatgtcgctgggggcatgaagcgggctgcaccagagctgannnnnnnnnnnnnnnnnnnnnnnnnnnnnnnnnnnnnnnnnnnnnnnnnnnnnnnnnnnnnnacctacactccgttcactcgcagttccgttgcttatggtgggccgtga

SEQ ID NO: 5365 - DNA, 1155 bp, Chlorella protothecoides
atggccagcaacaagacgtgccggcaccaatggattgtgctggacggcgacattgatgcggagtggatagaaagcatgaacactgtcatggcaagtctggtggggggtgtagctcccgaagcattgaagggctggatcatcccaagatagcatgatgcatgtccaccatcttcacaactcttgcaggatgataacaagatgctgtcgctggcctccaatgagcgcattccattgacagacaccatgcggctcttgctggagattaaccacatgaactactgctcccctgctaccgtctcccgtggcggggtcatctacatgaatgtacacagcaccaggcgctcaagccgcaactggttcctctcatcaggcgagccaggggaatgggatgagagcatgttgaggattctcgtgctcctcaagtatgtggagaagacgattgagttctgtgccaagaatcttcgttatgtcactcccatgtctcctgcaaaccaggttcaaactctctgcaagcgtctgcatgatggcacacttgcctcccaacagctgctggatgccagtctaccctccagcgaggaagacccgagtcgcttcagggtggaggctcactttgtgatggcctgcatctgggcgttcgggggagccctctcctaccccatggcaggaccaaccagcacccctgaacaaacattgagcttcgctcctgtcaagactctcacaaataccattcaaagtgctggctcatgcccccatcccctctcaggctgtcgacagccaggctgcattctccaagtggtggcgcggggagttcaagagcgtcgccctgcccgccgaggtgtgtctcatgacaggaggagccctcctgacccccctcatgatgcctctggagtccaaacctctcccacgattggcccctctggcctcctgacaccatggcggaatcgcacattaactgccttggtccctcacacctgcccagggcactgtcttcgactactatatggacaatgtcagcgggcaaatggtgccctggacgcagcgcatccctgccagcatgccaggcccccctctgaccgcgagggacgcaattcaggtcgtgcagacccccgagtttgtggaaacggtggatactgtgcggctgcgctggttgactga

SEQ ID NO: 5366 - DNA, 876 bp, Chlorella protothecoides
  modified_base (253)..(262): a, c, t, g, unknown or other
atggagcagatccgctcggcactgaccagcagtcgggtgccaccgtcttggatcgccgcatcctaccccaccatgaggaaccttgcatcctggctggaggacctgagccagggcgccagcgtcaccgcctcagacctgagagtgggcatgcaaggggccggcggccctgtgctgcgcagtgagcggaacgagggaccccccatccaaccccctcaccatcttctgcaccgagcacagcgtgcccagcagctgnnnnnnnnnnggggaccccccatccactttcctcaccatctcctgcaccgagcacagcgtgcccagcagctggaggactggacccgcgcaatggagcctccacccgtggtgtggctccctgggctcttcaatcccatggccttcctgaccgccgtcttacagaccaccgctcgtcagcagggctgggcgctggacaggacgctgcttgtgacggaggtgagcatgccatcatgcgctgatgcgcttcaaataccttttccggtgaccattggcagcaggggcatgcctacagccacagggccagcaagacggccagaatggtgcctggtccctctttgcccaggcctgctggagcagagcctggattcccccatgacacgcgctgggcacgatttcacgcaggtcacacgtcgtgcgtatgaggctgtctcagagcccgcacgcgagggggcatacatccatgggctgacactggagggggcacactgggacgagaaggcagggtgtctggaggatgctcggcacaaggtcctctcctgccgcatgcccgtgatgcacatcagggtgagactgatgggcatggcatccgtgtttgaggcagcaagggtttcgcgaggtgcatga

SEQ ID NO: 5367 - DNA, 1743 bp, Chlorella protothecoides
atgccaaccctggcgcccatgccaaccctggctttcacaccaatcccaggagcgtgtcaaggccctgaagaaggagcatggcagcaagatcctgggtcaagtcaccgtggagcaggccatcggcggcatgcgcggcattccggtgagtgtgaaccgttgtgtattccaggagactggaggggaggcagggcaggtatctcgctatgtatcactcgtcgtgtgggtacagctgtggggctcgtagtgccacaaggtattggtgttctggcgagaccctacagatccgaccaagtcggaccgtggatggaccagagcttgccaagcgcaccgcggcccccctccccccccgcccctcttccacccacagtgcatgttgtgggagacctccctcctggatgcggacgagggcatccgcttccgcggctacaccatccccgagctgcaggagaagcttcccggcgccgcccccggcggcgagcccctgcccgagggcctgctctggctgctgctcaccggcgaggtgcccaccccggcccaggtgtcctcagtgacagaggagctgcgctcccgctccgccctgcccgaccacgtcaaggcgctgctgggctcgctgccggcgggcacgcaccccatgacgcagctggcgcaggcggtgctgggcctgcagtccggcagcaagtttgcggcggcctacgacgcgggcctgcacaagagccggtactgggagccggtgctggaggacagcctggacctgatcgccaagctgccggagatcgcggccatcatctaccgcaacacgtatgcggggggcgagctgatcgcccccgatccggccctggactgggccgccaacctgagcgccatgatggggttccgggagcacggcgcgctggagctgatgcgcctgtaccagacaatccacacagaccacgagggcggcaacgtgtcggcccacgccacgcacctggtcggctccgcgctctccgacccctacctggccttcgccgcgggcatgacggggctggcgggcccgctgcacggcctggccaaccaggaggtgctgcgctggatccagcacgtgacgcgcgagatcggggagagccccagcaaggagcagctcagggagtttgtctgggccacgctcaagggcggcaaggtggtgcccggcttcggccacgccgtgctgcgccgcaccgacccgcgctacacctgccagcgagtgtttgcgcagaagcacctgcccgactaccccatgttcaagctggtcagcgacctgtacgaggtggtgcccgacatcctcaccgccacgggcaaggtgaagaacccctggcccaacgtggacgcgcactcaggcgtcctgctccagtactacggcatcacccaggagagcttctacaccgtgctctttggcgtgtcgcgcgccatgggggtgctggcgcagggcgtctggtcccgcgcgctgggcctgcccatcgagcggcccaagagcctcaccgtggatgccatgctggaccgcgtcaaggggcagtgaggcaggagctcgaaggtgccgaggccgcggcgggtgccgaggccgggtggccaagtggagtcgatccccagcaggacggcatgcgcgcgcgatggctgtcgcgccagtcgagagaggcgcgagccggaccactccgactcctggggcccaggcgcacgtctcccctgccaccctctccttgtggtggacgcctcaggtgcccctccctcccc

SEQ ID NO: 5368 - DNA, 546 bp, Chlorella protothecoides
atgggcaacgtggatgccttcctgcgcgccctcctcaccttcaataaggatggtctgcacgtgcccaatgtggaacgcgtggagaaggaatacctgtcgcagccgggtttcaggcctgagtccatcaagtccaaatccagtgccgccgctgggctgtgcgcctgggtgctcaacatctgcaagtacttcagggtctaccaagtggttgcccccaagcgggcagccctggctgaggccaaccagaggctggctgtggcaagccaaaagctgaccgccatccgcgcggtcgtggcggacctgaacgccaaggtggcggcgctggagagcaacctcctgcgcgccacagaggagaagaacactgccatcgcacaggccgagcggacggcgagcaaggaagacatctcaaggcggctgattgcgggactggcaggcgagaatgagcgttgggcagccaccgtggccgagatggaggatgaagagggtgaggcggagggtgctgggcaaatgtgtgagtgctttgctcttgtgggacagggtgcctggtag

SEQ ID NO: 5369 - DNA, 279 bp, Chlorella protothecoides
atgtttctgaacagcagcctcccgcgctttccctggccgcaggtcaccgacctgtctctcatcgactacatcgcggtgaaggccaagcatgaccgatacacgccccactctgccggccgcttccagaagcgccgcttccgcaaggcccagtgccccgtggtggagaggtgggtgatgggcatgattgagtcgtcggagctgctgcctcgtgtagcgcccctgtgcaaaccagctggttgcgactttaacaatcttctttctgccggtgtgagacattag

SEQ ID NO: 5370 - DNA, 261 bp, Chlorella protothecoides
atggcacgtgcgctggagagtatggacggccagggtgttatggtgaaccgactgccgctcaactcctgtcacgacggcccatccctgcaaaccatcctggagcggcctctggagaagaaggcgggtatgcgctatgggcctcgagggtcaaagcgactcatctactggctggacaatgtcaacatgccgattgttgacaagtatgaaacccagtcggccctggagctcatccgtcaaagcatagactacggtggctggtaa

SEQ ID NO: 5371 - DNA, 258 bp, Chlorella protothecoides
atgggcctcgtggagggcctggaggccacaaaggcgacggccgcaaacgtggaggacagggttgcggaagcgagggagaatgaggccattatcctccagtccttggaaacatacagacccgtggccatccgcgctgcaatcatcttcttcatcatggattcgctgccggccctggaccgcgtctacctcttctccatggccgcctttgtgatggtgagcgtgattggtgtttggatgtggttggaccatggtagatga

SEQ ID NO: 5372 - DNA, 612 bp, Chlorella protothecoides
atgccgccttcttcctgcccaggcgctggatgggtgtggcaccgtggccgcctccttccatgtccttggctgcttcagtgcgtggctgcacagggagccggtggcgcaggagctccagcatcgctacgtggagctggtgggaggccttgggcggtgtatcagctagggatggatatcattggcaggacgccgcaccgccatggtcagcgtgaaacactggcatgggagtcctggtggaacgctggtcaacactcaccgagcccgctccacaaacctggcatgcaggtgtccatgtttgggaaggaagtggaagcggccgccgtggtattccgggagcagcgctcctgcccccttgtgggccctggaatggctcccttctccggtgccgtggcgtggtcgcgtggcatccaggagcggattcgtggcggacaccagggcatggccagcctgcctccggccatcctgaacagcaagggggggcgagaggtccagcgggcgtacggcgagctgcttgcggagctaaaggcatttgaggcggagcagatggagctgtgggaggcggaggtggatgtgacctctgcctcctccctcatgcagcccctgatccggtag

SEQ ID NO: 5373 - DNA, 840 bp, Chlorella protothecoides
atgcagctgtccctcacctcctcctacggtgacccagagttcaaaatggtgagaatggaagcaagggctgagataacgactctccaggttgcagacattggagtcaagtctgttgcaggctcaaaagtctcactccctcacccccctccgcgaaaggacattttggctatgtgtcgaaaggcgggtgtcaagaacaagggagtggcattcctcctgaacgatgggcacgtgacaaaggaggacttcctggcgcacatatctgatctcatgacgtctgggagccctgcttcactctgcagccaagaagacaaggagggattttgcgatggggtgcgggctgaggtcaaggcatcaggactgctcgacacagccgataactgctgggacttcttcaccaagcggggagaactggccaaggagacggttgtagtggaggagaagaaggcggcgacccaggagctcatcgagtccatcaggcgggagagggaggtggtggacgaggcggtgggcgcgtcgcaggcagatgaggaggaggcagcggccctgcagcgggaggtcaccgccttccagacagagtgtgctgccgatctggccaccgctgagcccatcatcaaggaggcggaggcagccctcaactccctggacaaggcatccctgggcgagctcaaatcctttggcagccctgccaaggaggtggtggatgtcctggccgctgtcatgatcctggcctcgagcggaggaaacattcccaaggtatgcttggcgcaggcaggcactccacggagctcagggcagggcggtggtggggacccttgcgcttcacatgctttgctgaagtag

SEQ ID NO: 5374 - DNA, 213 bp, Chlorella protothecoides
atgcatgtcaagactggggatgttgtccaggtatgtcacattggctacggcctggtggaccgcttcttgggccaggttattgctggagatgaccggggcaaggttggcaagattgtgaaggtacacaccaagattgggaaggtgctcattgagggcgtcaacgtcaaggtgagcagacacctctatgttggtagcactgtgggagctgtgtag

SEQ ID NO: 5375 - DNA, 198 bp, Chlorella protothecoides
atgaccacagatgcggtgctctcctcctggacggatgtgcagcgcctctggcaggattatctggaaaccaaacgtctggcgttcccccggttctactttgttgccccggccgatctcctggacattctggccaatgcctctcagccgcaagccatcgtcaggttgagttctggacatgcctctcccagatctgtctga

SEQ ID NO: 5376 - DNA, 582 bp, Chlorella protothecoides
atgtgccaggcactgtttgagcggcacaagctcgtggcagccacgcagctgtgcatgcgagtgctgctgcggggaggcagcgtctctgctgcagcggcagcctgcctgacgaacggctccgagggactggaagccccacctccaaaccccctggcggactggatgagcgactccagctggcgagcggtggccaaccttgcgcgagtatcaggctttgaaacgctgctgcacgagcttgtcggcctgccgaagcgatggagggagtgggctgagctggcccgcccagaggaagtcctgctgcccggagagtggaaacgggctggctcgctggagaggctgctggtgctgagggccctccggccagacagactgacgcaggccaccgagctgttcgttgcttccacgcttgggcccaaatttgcagccagccagccatggagcctggacgacgcttacaaggtaagcctgggtgtgtgtcgggttcctcttggcaatgggccatggggtgactggggttcacctttccacaacaagagactgatcagatgggtgttggtgcagtgtgcatctgtgcagagatga

SEQ ID NO: 5377 - DNA, 372 bp, Chlorella protothecoides
atgcaggccattggtgctcgctttgagctacagaccggcaccctgctgggtgaagtgctagatctgaaactccaccgacatgctgcgaagtgcgaggaggtcctggagcaagtgcagagggaggtggtggtcgaaacggcactcgccaaggtggcctccaattgggccgagcagcgcgccacatttgttgacaagccgggacagggggttgccctgctgaccgttgcagatgcgcgcgccacatttgtcgacaagccgggacaaggggttgccctgctgaccattgcagatgcggtggttgagctgcttgagaacgacaccctcacgctgcagggtcttgcgtccagcaagtttgttctggtgaggggctga

SEQ ID NO: 5378 - DNA, 387 bp, Chlorella protothecoides
atgcagcaggagtaccccatccaccactctaatgtcgcccactactcggaggcgcagaaggttgcatcccgcatcgggcacaagcatggtggactccgtgttgaccccacatcttcctggaggatgccattccagcacccattacacctcaccctccaagttcctaaggggttattgtgtgcacgacaatgcaactcagagctggggagcttcgagcatgaggcagacacctgccttggcccactttgtccacggctgcttagatcgcagggacacggagaacacctcctgcctgaaacgggtctgggtggcatagactgggcattcgtagacatccctggtctcaaagcttcccacagggagggcctgtcgggggtggaggcctga

SEQ ID NO: 5379 - DNA, 189 bp, Chlorella protothecoides
atggaggtcgactacaaccccgccttcaggctctacctccagaccgagatctccagcccacactttgggccagaggttgcggggcacgagcgcccagatctgcaggccagcgcagcagagatcgtgcggtccctgggcgcactctctgcccagctccagagtctggaggacgacctgctggcgaggtga

SEQ ID NO: 5380 - DNA, 384 bp, Chlorella protothecoides
atgcacggccgtaacaacggaaagaagcagatggcggtgcgcatcgtgcagcatgcctttgaaatcgtgcacctgctgaccgaccagaaccccatccaggtgctggtgcaggccatcatcaacggcggcccccgcgaggatgccacccgcatcgggtccgctggtgtggtgcgccgccaggcggtggatgtgtcccccctgcgccgcgtgaaccaggccatctggctgatcaccactggcgcgcgcgagtccgcgttcaggaacatcaagaccatcgccgagtgcctggccgacgagctgatcaatgccgccaaggggtcctccaactcctacgccatcaagaagaaggacgagatcgagcgtgtggccaaggccaaccgctga

SEQ ID NO: 5381 - DNA, 1731 bp, Chlorella protothecoides
  modified_base (1194)..(1203): a, c, t, g, unknown or other
  modified_base (1691)..(1700): a, c, t, g, unknown or other
atgccggtcatcgagcgatcgtgccgaccccatcagcaagggggaaacaggtgtccactcccttccctgttgagcacctgcgcccagtgcctgcctgagtcagtcgaggccccacctgctgttccccaatcacacccccccctctcctcccaggttgggcatggcgcccaccgcttcacctacgaccacgtctttggcggagacatggggcgccccgcctgggagctgtacggcgcctgcgtggcgccgctggtggagggcctgttctctggctacaatgccactgtgtttgcctacggccagaccggctccggcaagaccttcaccatgggcagcagcggcttcggcgcgcggcccgaggaggcccgcggcgtcatccctcgcgccatggaggacctgtttggccacgtgacccagcgccccgccatgcactgcaccgtgcgcgtgggatttgtagagatccacaacgaggagatccgggacctgctgaccgccgccgtcgggggcggcggcgcggggggcggcgccggcatcaagatccgcgaggtgccgggccagggcgtctgcctcgccggcgctgccgagatggaggtgaccagccgcgaggagctggccgcggtgctggaggcgggcagcgtgctgcgcgccaccgctgccacgggcatgaaccgccgctcctcccgctcccacgccatcttcaccgtcaccgtggagcagcggcggatggaggagggcgaggatggtgcaggcgggccgcgccgctgctcaacggcctcgcaggaggacacgcacggcggcgggcgcagcggggacgaggccgaggacgacgcggcggaggaggcgccgcaagcggccgcgcccggcgaggacgagggcggggcggggtcctacctctgcgccaagctgcacctcgtggacctcgcaggtgcgcgcttgtgggggaccctggaggagggcagaggggctggccggcaccccgccggccacggtggcgtgtgcctcgcattcccgggtaggcgagcatgcggtgcgctgagggagcatgccctcccatgccctgcacctgcctggcccccccagacccacccagcgccgtgcgtctcggtggtacctggtgtgtctcacgggtgcctgatcgggcgcacggggtatctcctccccggtccccctctccctccctctcgcattctccannnnnnnnnnccagcgccgtgcgtctcggtggtacctggtttgtctcacgggtgcctgatcgggcgcatggggtacctcctccccggcccccctctccctccctctcgcattctccacacccgcgcccccctcccccccccaccctctccctctcccccaggttccgagaggctcaagcgcaccggcgccacgggggcccgcctccaggagggcatcgacatcaacaagggcctcagcgagctgggcaatgtgatcagcgcgctgtcggagggcaagccccacgtcccctaccgcaactccaagctgacgcgcatgctgcaggcgcgtgcaagctgggaaacagggggagtgaggtcatgtgcatccacgggtgtgcgtccgtgggagagcagacaggagcagcatccgcgctggaggtcgttggggtggggaagatgggggggtgggtgtcgctgcactcactgcttccaccacgcacctgcgccccaacctcctcnnnnnnnnnnggagagcagacaggagcagcatccgcgctga

SEQ ID NO: 5382 - DNA, 1257 bp, Chlorella protothecoides
atgcatgacggggcaagtatcgagcacctgcaaggccacgacgaggctgtggccctgggctgccccaagtgtcggtgggccgtcaggggatgcgggcgctgtcgggcactcagtcccgaagcccggaggatcaagcgtcagaagagggagctcggcagtagacttggcaggcgtggcgctgcagcgaatgctccacgaggccctgcgcagctcaagcagaacaactcccagactggaccctccaagcgctgcttcccagccgaagcgccggccgcttcaaaggcgcagtcccaaacaggagcgtgcgccgccccgccggctaaattccgccgggtcgagcaggaggcatcacctgttccgggcaagcaggcattcgctgctgccaccgggagcgtgaggcaaagggaaggccccgaagctgcgcccctgccagggccagatggcccaccgccctccaaattccgcagggtccagccgtcaggcagctgctcgccgtcccatggcacagtgagcagcggcagtacatccacggccccgcccccttcaccggcccatgccgttcctgcggcagacttccggaagaagctggaggtggggatggaggaggcccggaagcggcggctgagtggtaaatccgacacctcccatccatcgccgctctctccccctctgaagcggatgtgcaagggtccaggcccggcgagcccccgcctgctccccgaggacccccgcgtcgcgctgtggcacccacccatctcgccctacggtctgctggaggaggagctctaccctgacccctggaagctgctggtggcctgcatgctcctgaacaagaccacgagccgggccgtgcgctccgtcatctggacgctcttcgacatgtgccccggccccttggtggcagcggccacccacgtggcccgcatccaggccctcatccagcccctgggcctggccaacaagcgggcggaggccatccagcgcctgtcctgggactatgcccacaaggactggcgggacccgcaggagctccacggcgtgggtcggtacggggcggacgcctaccacatgttctgccggggcctgtggcgcgaggtggagccggaggacaaggacctcaggcgctaccgcgactggctcctggccacggggggccagggcatgggcttccaggcggaggcgggtggcggcggcaggggcgggggagcagccggcagccaggggcctgagcgggtggaagccatgtgctgcgactga

SEQ ID NO: 5383 - DNA, 204 bp, Chlorella protothecoides
atggcgggagcgtcctcgccgccctccaaggcccccgctgagccccacacccccgatacagaggcctccaaggccgagtgcgtgtgcgtggccgtccacgtgcggcccctcattgaatcggagctggcggaggggtgcgagcacgccctcaccgtcacccccggcctgccacaggtgcgacttatggtgggggggcccctttga

SEQ ID NO: 5384 - DNA, 3408 bp, Chlorella protothecoides
atgaccaggcttctatcccccaccttccacttcgcaggccagctgaccgggtcggcctcagtgccctcccacgtgctggacctggccagcgccgcaacgcccccgggatcaaagccgggggacaggccgccgcgagatgcgcacagcgtgctcgccatcgacgtgttggcctcccatcggtcgctggggggccgggggtcggagaccccgggcgtcgccccctcgctgtcccacttcacgccggtgagcattgcacgctatgcacaggatctgcccgacaccactttccatagttccccagagcccatcattcctctggcactgagcgtctccgccttgaagccaccacttcccccccccccccaggagatcgggcactgggttctggcaggcacgccccacgccgtgctcgtctgccagctgacgcccgagggccgcctgcgcgtacaccacgccttccgagaccccggccttgagggtcaagacgcgtggtctgggcctcctgggcctcccattgcgacctggggtatttcagaggactggtcagagcctggcgggagaaggaccgtgcacatcgccatcgcctggagcggaggcagggtggctctgtaccggacctccatcatggacagcctgccgccgcccgtcgccgaggatggcggcagtcgaaggggggatgccagccacgcagcgtccccgggcccaggaggcaccagcgcgtccaacccagcgaccccgccgccgcggcgtgaccatcgcgccgaggccccgctactcgccgagcccgaggctctgggcgtcctgcgcctgccctcggccccttcagcccttcagctactgcagagcgggagcctgacggcgctggcgccctggggcccggcaggcacctccaccgcggtgtggatgtttgcagacccctggcggggtggagatacgcacggccctggtcacggcgcactgcagaccccacacatgactggcgtggactcgatgcggctgccggactggctggccggcggcccgccccctgacgaagcaaacggcggtagcggcggcgcgtctgcgccgggacccccgcctccggccggaaatgcggtggcctttgccggggaccaggtcgtcctgctgggaagccgccatgtcagcgtcctgcagcgctgcacctgggaccagcgctgcgcggcgctggcggcggcggggcggcacggcgcggtgctctgcgcctgcctgaaggcagaggctcgtgtgctgatggtgcctcgcggcggccgacccggtctcgagagcgcctggcccgccgatcggccgccgagcgggcgtgccgccgtgcatggtgccgccgagcgcgcgctgctggcgctgctggccgaccagctggcgggcccgcagggagctcgagggaccggaggcagtggcgaccaccacggctgcactgcatccagtcatgcgttcctgagccctgccgtgctggctgacgtggcggtgcgcacctgcctcctgctcgggcgccccgacctcctctcaggcgcagtggcgaacgcttttctgtcggcgccaggtgcacaggaccagggggcggccggacgaggcgagttgggcgaggcctcgcttgcgaccccacgccatgctttcctggaggccctggtgccgcacgtgtcggcgggtcggctgaccagcctgggacccgaggtgatgcaggagctggtgggaagctacgcggccgccggccgccccgaggtcgtggaggcgtgcgtgctgcgcctggacccgaccaccctggacctcagccagggcagtgtcccgatgaaactagtgtcctgggatgcttggggagggttggggacgctggctttgtacactgcctggctccgcctgggcctcttggcactgcattgctccccatccaacaagttctctccgtccctgtctcgaccacaggtggtgccactctgcatgcgccacgacctgcatgccgccctcattgccatctttggcggggtcctgcgcgactggaccacgcccctctgcctgctgctggtggaggcggtgagcgcgggggctgcgcaggaaggaaagggcgacgctgaggctggtgccgccagccatggtccccgaggcgctggctgccaggcagatggactacgcccgtacactgcccgggagatgcagctggccgcgcgactctggctcctgctggaggcgtgcctgctgggcctgggctaccctccccaccgcgccggctcgcttgaccccggcgtcgcacccgtggccaagagccaggccctggccttcctgctgctgacgccatggccggccatcgcagactgctggagggcctggagcggggggcagcgtgagtcgggggggcagaattccgcaccgccagccgtccaggtcagtcttgggggttactggggtggcatgtgcggtgatgctgtgatgggcagggcatccacgacgatagcgttgatctcagagcgggagggacccaacacgtatggcacagaccacccaccaacccttgcatatgctctgataacctccccaacccctctatcaaacccttctgtgcagcaatcgcgacaccccgccctgaccttcctgatggacctagacccgttatcaacattggccgtgctttcctctggactggaggggtgggaggccatgctgggcgacgtggtcgaccttgccgggcagagctgcccgaggatggaccaggataccctggacagcacggtgactcagcacgcggtcgacgtcctcgccgcagaggtcctagccacctggccggcagatgtgccgcaggcacgcgccagcctggacttcatcggcgcccacctggccgccggccgggccagggcgtgtggcggcgtggtactgcgggtactgcagcgcctcgccgccctgccccacggcgaggcggcgttcacggccgtcacggccgtgaacgccgcggcaatgacccctggggagagggaggaggcgctgtcactcgccaggcggcactctttcccacgcgccgaggccagcctacaccatgccggcggcgactacgctgcggcgctggcctcctgcctcagcattgagagctggggcgcggagacatctgagggcagcctcgcgcccagggcccccgccgctgcctacgcagagtcggtgctggatgggagcacacagatcgatgcggggactcgctctgcgttcctggagcatgccgtctctcgcgccgcggcctttgtagctcaggacgccgactcagcggccgccttcttcctgcggtggatcgcgccggaccggcagaggcagatcttggagggcctcgcttctcaggcccagctgcactacggctacctgggggcgctggttgggctgggggacgggggagggcgtctcaaggtgcgctga

SEQ ID NO: 5385 - DNA, 618 bp, Chlorella protothecoides
atggcagcgccggacagcgaggcggacgatcctgtccatgcagccgccgaggcattggaagaggtcgctcgcgaggtggagtttgtcgcgcagtccgtcggagcccccgatgagaacaggctaggcatccaaccccctccctcggctctccttcctcatcaatgcagcctgccgctgccgcatgtgacccttcgcctcgagcaagtggctgccggcctctggcccgtcgagacggggctgccgctccccgccggccgcgtcggccgcgcggtgtcggtcgccgccggctcggatcgcgagggcgccctccgtgcctacgagaccctgctcggcacggcaggggtcgacgccggggacgagtctgccgcaccctcgctgcgcgcgcgcctcgtggagtcggcgctgctcctcctgcaggccgccgccgagcagttgccgggcaccgcgccgcgcgagcgcgcggcattggctgggagctgcgacgcgctgctgggatatgcacggcggcttcaggacagcgcagctgccgcccgcctcgtcccggagctggaggcggctgccgctgccctgcactcccgcacctctggcagggggctggcgttgctgggagggttctga

SEQ ID NO: 5386 - DNA, 990 bp, Chlorella protothecoides
atgcgtcacgagggctgccaaacggccgcagggtatctcttggaacgcagcggggactccagcgcagccctggaggtttacgcactggccgcatccaccttggccctggctcgacgcattgcccggtccagcgacgccgaccttgcggagttcatgatgagtcagcatagcctgggcgaggacatcgatctgcgccgcggcagcttcagcgctgggacggcctccaggggcgcatggcctgatgccagcagtcctcatgcccctcttcccgggtcatccatgccagagctccaggcttcacagcgggccctggaagctgccctgacactgtgcacaagggtctcacaagaagcagaggatgatgggttgggcgacggcgcctcctcagctcccgacaccaagcctcagtccctgtggtttcgactgctggagttctgcctggtccaggccttggacagggagggagcactccaaggggtgcaggtccttgaatcaaggccaccgctgccagctccagcccagtttccttcccccctcgcccagcctccttcccctcccggcctcaccgaccagcagtgggcggtgctgcacgccctcctgctgggatttgcacagcaggtggtggcaggggcggccggccgcgtgtccccgcgcagcatcgcggaacgcatcatcgccgcggcgggcagggtgggatccgatgcccaatgtgcggcgcgccgccccggacccatggcaggaggcttcagggccaccctgctgagcctcctatccacctgctccctggaggcctccctgctgcgctgcgcgcggaccgctgcagggagcgacggcgcgggcctgctgaccctggcagcgggggcctgctcgaaacccacgctcatgcttagcgccggaggaggcacgctggatatgacaatggggggtgcggggcacgtgacgcagcagccagaggcggcaaacagccagcatgagcctttgacatcatag

SEQ ID NO: 5387 - DNA, 720 bp, Chlorella protothecoides
atggcagtcctgttcctgggccttcagcaacatacacagcacgtgggaacggcagctcacaacccctcccactcgtaccgccgtccccgaaccgcagccaaggggacgcggtgggagggtttggtggcatccatcgcgccgcgtgaggcgccggagctgcggcgtgcgctgctggatgcggccgtggccacccgcgatccgggcctgctggacgccctctactcctgcctggtggacgcgggggctgtcggggagctgatcgccgccgatgcgccggggctggagacgcacctcatccgcggtggcggcctggcgggcgtcgcccacgcctcccagatccggggcctggagccggggcaggtcgcgcgcgtggtggcactggcgcgcttctacaccgcgcgcagggagtacgccaaggccgcccaagcctacgaggtgctggccgacgtgccagtgactggcccacgccaggagctgacgctggagcagagggccgagtacctggccctcgccaccctccagggcttatacggaaaaggtctgcctggtcctgacacgattggcagccccatctgggaacctctccccaccactccgcctgcactccgtctcccaggcgcgaagctgtggggaggctgtgctcctggaccagctcacggccaaggccagggtgctggcggcgcagaggcgcatcctggagatgctgacaagggacggtga

SEQ ID NO: 5388 - DNA, 513 bp, Chlorella protothecoides
atgtcggggatcgccgggggccgtatctccgctggagtgggtgccaacctcatcggcatgcactccacagaccgaaatcaggaggccacggtgtacgtgggaaacgtggatccccaggtcacggaagagctactctgggagctcttcgtccaggcagggccagtcggtgagccgggttgcatcgaggtgcaggtggtggggcagcaccccaaggtccctcttcctatgaccagcctgaactggaggagcggcgcctgggcagggcactgctggcggaagcgcgctgctgctcctgccactcaccccctggagctccaggatgtcttgccggtggcatgcctcacagccctgctgttctgtctttctggcgggtgcgctggacgctcacaccatgtttccccccccccacacacacctcttgcccacagtgaacgtctacatgcccaaggaccgggtgaccaacctgcaccagagctatggcttcgtcgagttccgatcggaggaggacgctga

SEQ ID NO: 5389 - DNA, 1209 bp, Chlorella protothecoides
atggacgggcgaatctctgtccagggccatcaagcgaaagggctcttcattgtttgtgtgagacccccagatctgacgtggcagctccgttctcctactgcaccactacgtgtctcctgcactcccctcgaggaccatgaccgacagcagcggctcgtcgggcctgcagtggcgcaaagactggtgcgtcacctcacgatggcggcatggagcgaggcccacggcgatacccacccacccccccctcacccaacttatgatgtctacaaggtgctcgctggctttggggtcatagacgcagctctggaggaggatgctggtgacctgggggatatcagcgccctctccacgtacgctgcgcgtgtttgcagaccgggggctcaggaccagggccaggcagctttgggttgtcgtcgccgccatgaaggaggcctcatgtcactgcctccagcccgagcatgtccccctccttacaactggatcccggcggacacccaggccactgccgagttcacggccaaggcggcgggcgtggtggcggggctgtgggtggctggcgccgtcttcgcgcgcgtggaccccaccattgcgctgacctggcgggtgacggaggggcagcgggtggagcgcggcgcgcgcctgggcagcgcccatggccccgcccgcgcactgctggcggcggagcgcgtggcgctgaactttatgcagcgggcgggggggatcgccaccgccacggctgccatggccgccgaggccgctggcacgcgcgccgtgctgctggacacgcgcaagacggcgccggggttgcgcctgcttgacaagtgggcggtggcggcggggggcggggccaaccaccgcatgggcctcttcgacatggtgatgatcaaggacaaccacattgcggcggcggggggtatcgccgccgcggtggcacgggcagaggtagggcggcgtcgagcactggagggagggaggaagggagggagggagtccagtagaactccatggccccggatcccagtcgccgcacacaatgtgcaaggtgctgcatcgactcatccacctccccatgcccaccccgtctgtgcgcacccatccctttccacagagctacttgcgggagcggggcatccagtgtggcctggaggtggagaccagcacactggaagaggtgcgccaggtcatcagcatcctggaccaccagcctga

SEQ ID NO: 5390 - DNA, 873 bp, Chlorella protothecoides
atgcctaccccctcactcaccctcctgccgccgtgtcatgttgtcgagcatgatgcgggtgaccaatgtgtcaggctggtggtccaggatgctgatgacctggcgcacctcttccagtgtgctggtctccacctccaggccacactggatgccccgctcccgcaagtagctctgtggaaagggatgggtgcgcacagacggggtgggcatggggaggtggatgagtcgatgcagcaccttgcacattgtgtgcggcgactgggatccggggccatggagttctactggactggcgtgtcgcgggcactcaagcatgtggacaagcagccaccgaggacagggattcaggacggtctatctctcgagtgctcgacgccgccctacctctgcccgtgccaccgcggcggcgataccccccgccgccgcaatgtggttgtccttgatcatcaccatgtcgaagaggcccatgcggtggttggccccgccccccgccgccaccgcccacttgtcaagcaggcgcaaccccggcgccgtcttgcgcgtgtccagcagcacggcgcgcgtgccagcggcctcggcggccatggcagccgtggcggtggcgatcccccccgcccgctgcataaagttcagcgccacgcgctccgccgccagcagtgcgcgggcggggccatgggcgctgcccaggcgcgcgccgcgctccacccgctgcccctccgtcacccgccaggtcagcgcaatggtggggtccacgcgcgcgaagacggcgccagccacccacagccccgccaccacgcccgccgccttggccgtgaactcggcagtggcctgggtgtccgccgggatcctgcgaggtggggttggggggggtga

SEQ ID NO: 5391 - DNA, 381 bp, Chlorella protothecoides
atggagtacttcaagaacgtcatgctgaagctgtttgagacgggggaggccggcagcctgctgccggtggtggcgaccgtgctccgcttctcgccggaggagctggagcggtgcaggaaggccaccgcgcagtgggggacagggcacgccaaccacacgcagagtgcgtcgcaggggggtggggagcagcgaggcgcgtttcgtgtggagccagcacggcgctgtgcacataccatcgcacgctgtgtgcgggaactctccagaaatcccagctggcatgccagcacctcgatccagccccatcaaacctcctgcgcagatggcgcagacgccccctcgctcctctcagggctgacatcctggctgggatccggatcttga

SEQ ID NO: 5392 - DNA, 996 bp, Chlorella protothecoides
atggccaccacccatcctgttgcccccctgcagctactgcacgacacctttggcgcatttggagtggtagtgggagcccccaaggtcatgcgggaccctgacacaggcctgtccaaaggatttggcttcgtcagctttgatgactttgagtcctcaggtgaattgatgggagggtgggttcaggtggtgagggggatactgttcctggtcatgaaggctgcaggccaggacgcaccggtgcgctcagcagaggcctggccggccagagctcatcctcctgcaccgcccgtccgtccacgccgtgagctgcccatgccaggatcgcacgcttcctccaccccgccacttcacgactccccagatgcggcgatcgaggccatggacggccagttcctcatgaatcgcaccatcagcgtcggatatgccttcaagaaagacacgcgcggggagcggcacggcacccctgcagagcggctgctggccgcgcagaagaagctgcagagcaaggaggtgcagcgaccccacacacgctttgccacaggtgcgctgcgggccaggccttcggtggttggagctgcattcccctgggcgtcgtttggcagtggccggcgccggggcggggtttgtgcacaggcagtggcggcgccaaggcgacctgcaggagtcgtaggatgggtggtccctgccatgcacgagatgccggcactgcctcgccggcccgaggcaggtggggctgcagaccgggttcccggcgcccggagcccaggcggccatggcgcccaccgggtttgcggcgggggcacccatgccgcgcccgcccccgggggccatggtgcccggcgtccccggtatgatgcccccgccgccccctgcccccccggggtatggcagctacgcgccccccccacccatggggtaccggcacggggctcccccgcccccgccggggtacggcgcgctgccgccccccccgccccccgccccaggctatggtga

SEQ ID NO: 5393 - DNA, 1263 bp, Chlorella protothecoides
atgcgcaccttcgccctcctgctggtcctcagcctcgcactggggagctctcctgccgtccacgccgcccgccccaagttcctgcagcccgagttctatggttccattgctcgccagctcattacgcagctggaggtcgactacggcctgaccccggagcaggcggaggtcgtgcaggccctgtacggcgatgtcaccgcccccgaggccgaggaagccattcagggcatcggccggcatgagccggcgatcgggcccatccggccgggcatggagagtgcgcgcgtgcaccggcccatggtgacatgtgtcccgtcctttccaacttcgcagggcgacttcgcctccggtgccctggatctgaccaagagcgaagccaccgaggccgcgcccgcccaggagtcgctcaacgtcctcaactccctcctcttcgccaaggctggtgatggcgacgtgccggccgtggaggacctcctgaatgtccaggtggggtgcaaggtgttgcgggcagcagggtgttctgcctgggacctgtcatggggccccatggatcacagctccctccggggtgccatctttgccccatgggcatggcccgccgctccgcaccaaacccattccccgtcctctcatgtccctcgccaggccgaccccaacgcggcggccgacggccagaccccgctcctcgccgccctcgtcctgggcaacaccgggctggccggggtgctcatctcccgcggcgccgacaccaaccgccccggccccgatggcaagacccccctcctggtcgccatcgccaactcctcggtcgcctcggccgaggagctgctggacaacgtgagtcgggccggggctctgcctgacgctgcggatctctctgacctgaagcacacaccctgcgtttgcaccgcgtcgggactcctcgtcgccggcgcggacgccaacctggccgacggcgagggcgtgaccccgctcctggcggccctggagggcggcgacgcagacatcgtgcgctccctgatcgaccacggcgcggacgtgaacctggcgggccccgagggcgtgtcccccttccagtgggtcctggcccagagccccatcgacgccgcctgggtgtcggagttcatcagcgccggggccgacgtcaacacccccaacgccgagggcgccacgcccctggacctggccgccggcgacgccgacgtgaccgcggccctcatcgccgccggcgccatcccgcccccggaggtcgaggcgccctag

SEQ ID NO: 5394 - DNA, 1839 bp, Chlorella protothecoides
  modified_base (333)..(342): a, c, t, g, unknown or other
atggtggaggggggctcggactgggtcagggttcggtattggcagggaggtgcaggttgtcggtggccatggatgacagggggcccatgtgagggcgggaagaggaaggtgactggtgttggagcaaaagaacgtggcgaggtcggcagctgggtcgggacttgcagcgagctcgagtgcctatggggggcccagagcattcgatctgacgctgcccatgcgctccccatgcagtgctcctgggcactgaatcaagattgtattccacctcccccctccacctcccacaccatagggcctttggagcggcgtccctggtggccggcctggcgnnnnnnnnnngccgctacgccggcccaggtcaagcgtgcgctgctggcggccgccacgcgggaccgggtgctgctggcggggtcggaggcgcacaaccgcctggcgtacaccgacctgaccttcaacgccaccgtacccgactccggcgcggggccgggcggggagggcgggggcgggggcggcctttccacgcccgccatcctgggcctggcgctgccgttgggcgcgctcctgctcctggccgtgggcgggggcctgtgttacggctgggcgcggctggcgtctcggcgcggcgcggcactggtggcccaccgcctggacggcgagtgggagatcgcggagaagcgcatcaagctggtgcgccgcgccgacggcgagccctggcagctgggccacggctcccacggcccgctgtacaaggcggtgaaggacggggtgcaggtggtggcggtgcggccgctacggtgcgggggggagggcgcggagcacgagcgctgcgtgcgcgagatcgcgatgatgcgcttcctgtcgcgcgacgccaacatcacccagttttacggcgcggtggtgggcgcgcagagcctgaccctggtggccgagttcatggcgggcggcgacctgcgcgccgccatcgacgccgacgcgcgcgggcggctggcctggtgggcggggggcaagggcgtggcactggacgtcacgcgcggcctgcacttcctgcacaccctgcgcgttgcgcaccgcgacgtcaagtccggcagcgtcctgctcacgcgcgacggccgcgctaagctgagcgatgtgggcatggcgcgggtggtgggggagcaggcccccgatgatggcttcgtggggacccaggcctgggccgccccggagctgctggcggggcaggcctatgacgaacgcgtggacatctggtccctgggcacgctgctgtgggagatcgtcacgcgggaggtgcccatgcgcggcatgctgcgcccgccgctggtccccgaggagtgcccgcaggaggtggccgacgtcatcgccgcatgcatgcagcgcgaccccgctcgccgccccgacgcccacaccgtctacaccctgctcctggaggcggagccggcgacgggggccgaggcggcgggcgcggcgccggacgcctaccccggcagcggctccgtcaccgactgctcttcggtgggcacgccgcggggcggcacggcgccctccccgctcagcgtgatcagcaacagcttgtccctggccgagcccctgcgctggtcggccacaccgaccggctccagggcgcagagcaaggggtcggcggtgcaccccgtcagcccccagctccgctgcatggtggaccagatccagcgacgcttccgacatcacgaggccatggcggcggcgcgcgccgaggccgtcagcccgcgcttccccagcccctttgaggagcaggcgggccccacgcccgtgaggaacgtgttcggtcggccctctgcggggaccggcttcgtgtga

SEQ ID NO: 5395 - DNA, 417 bp, Chlorella protothecoides
atggacgctgccaacatctgggcgccagagggcctgccgtctggcttcgactatgtcctctccacagccaagggcccctctgtgatgctgatcgagacgtggggccagaatcggtacagctcggagaaggatgacttcatcaaccaggctctgcaccagcgggtccagctggccctggcgcagaacatcaccatcataatccccgccggcatcggcctgtgccccatctgcgagaacatccttgccgcccaccccaacatcatcacggtccagggtgtggacgtgcgtgatcagctgagcagctttgccgagtcaaactcctcctgcctcagcctgctggcgccggggggcggcatgggcaacggggtgctgggcgccatggcccagggcaacctcaccaccatcctgcctcagtga

SEQ ID NO: 5396 - DNA, 1944 bp, Chlorella protothecoides
  modified_base (993)..(1002): a, c, t, g, unknown or other
  modified_base (1160)..(1169): a, c, t, g, unknown or other
  modified_base (1820)..(1829): a, c, t, g, unknown or other
atgcgcaagccatcgcatgcctccccacataccctgacagacatgaccccggaccagccccctcttcccaccaccctcctcaccgcgatcattgacgatgccagacccctcaccacccatgttcttccttcacttcacccaaatttgcaacgagagaatcgcaggggatcttggatgcacgggcagcacctgtccacctcacactcggagatggggcgcctatatcaaacccacgatcaccgcaacgtaaacctctcacgtcctgctgacagagacaccacccagcccagccatggcctccagagtcgcagcctcctgcctgagcaccaaatcgacctccgtctccgcagtctcgcacatgcaaagctgctcccggctcgtccagaagcccgccttcgccgcaagactcagcgccccggccttcacccgtgccaggccttcgagagccttcaccacctccgtgcgtgcagcagtcggcaccatgcctggaaccgtgtacgatttctccgtgacggtgcggcggggtcgggagctgggaggtgggctggaacttgcctggaagcagggtttccacggtctaccccttctcgaccatggcccccggcccttttcaacctgcagagcatcgatggccagaacgtgcctctgaaccgctacaagaacaaggtcctgctgatcgtgaacgtcgcctcacagtgcggtttcacgccccagtaccttgagctggtggagctgcagagcaagttcaacagcaagggtttcgaggtcctcgccttcccctgcaaccagtttgggaagcaggagcctggtaccgccgaggagatcaaggcctttgccaagagcaagggggccaacttccccctgtttgccaagatcaatgtgaacggcagcgatggtgggttgagtgggcctgatctgtggtgggagcatatttgggccagtggcttcccagtgagatgggtgggggctgaccctttgtggaagtggctcaannnnnnnnnntgtgggcctgatctgtggtgggagcatgtttgggccagtggcttcccagtgagatgggcggggactgaccctttgtggaagtggctcaagggcgagaagggcggtttcctcgtggacggaatcaagtggatggcagctgtggctgacgacttgcctcnnnnnnnnnnaaaaaaagagtttatgctgaacatcccgtgggtaaacggatgtgatggctttattgtgctagtggcagctgtggctgacgacttgcctccatccagttgcataatgtcctccccctgccaaatttccgacgtccgcagacttcaccaagttcctcgtcgacaaggagggcaaggtggtgaagcgctatggcagcaccaccacgcccggcgccatcgccgacgacatcgccaagctggtgtgatgcagactctcatcgctggagcagacttttggtcgatggcatgggctgttcagctgtgtcgagatggttccagacatgttacccccccctcctattacttgcaatggcctcggaatgagggaagcgtgagcagctttcccccggggaggggccagccagctgcaaatcaaagagtacatggggcagggtcaggggtctcaagggtccatgctggcccaggcccgaggttgcctggtcgtcagttgtaccgagatcatccggccgcgcgcggtcccaatgtgccgacctgctgcgctggtgggcacccctccacaccaagcaaccatcctggagcctggtcccgggcttcctcacgtgagccccagcgcgcaaactccgcttcttccccacttccccaccccctcacccnnnnnnnnnnacgtgggcctcaggagttgtcggccggttcgctgatgatgggtcctaggtcgccaaagtcgggcatgttgaaggaaggggaggagacctctgcggcactcggcagattccagtag

SEQ ID NO: 5397 - DNA, 1464 bp, Chlorella protothecoides
atgcattctgcgctgctttctcctcatgttcatccctgctgtccccacctccctgcaggcaagcccagcaccctggagatccctgagggcccccaggccagcgaggcgcccgccactcccggggcaagcccagaaccctggagatccccgagggcccccaggccagcgaggcccccgccacccccggggtcaccctgcaccagccccgccaggccacctcccccggctccgttacctccgagaacgcgcccaccccaggcgacaaggagtcggagatcggcagcccccgctcccacgccatccaaggcgagcgggtgcaggtcgagcgcctcggcgggcctggcgaggccgcgctggcggccgtgggcgagggcgaggagatcaccactgtggacgcccgccccgacttcgaggtggagtccatggccgccgccgacgtggcgagcatcaagcagcaggaggccgccctcgtggtgcgcatggggcccagagggtggtgggttcggtgattctggggaagaaggaggtggatccctggcgcgtacaagaagatgcaagcctggccttgaacagcagatggctggtgtgcagctcatccgccgtcgctgccttcaaccgcccccattcccctgccaggccgcccagcgccagcaggagctggaggagaaggagggggagctgcagcggttgaaggagcaggccgagacgctggaggtggatgccgagggcctgctggcccaggcctcgctggagaagctcaaggtggaccaggcagaggagaagcgcgccgagatcgagggcaacgaggcggcgctgtacggtgaggcggaggccgcggagaaggagcgccgcgcggtggtagcgcgcgcgcgccccatcgcggcggaggccgaggcccgcgagcgcgacgcggcggcggtgaaggcccaggcggcggacaccgagtaccacgcacaggtgctggaggcgcgatcccgcgcactgctggcggagtcggaggagctgaagacgctgtcggagagcaaggccgcggaggcggagctgtttgctgcggagctgaccatcgtggagcaggagcgggaggagatcgcggccaaggcggcctccatccactccggcgacctgcccgcccgcatccaggccaaccaggtggagatcggggtgctgtcggcgcgcatcaagaagctgcgcgacgagatcgaatgggcggaggcggagatgcgcaaggttcgcgccgacgccgacgactggcagcgcatcgcggcgcggaagaagcacgagacggcgggcctgacgctgcgcatcagcgaggcgcgtgaggcggcgcgcctggcgcttgagcgctcgcgcgaggccgcggaggaggcgcgcgcgccctcggagttcgccgaggccaagtacggcgaggcggccgagctggccaagcgcgccgaggcgctggaggcggaggccgcgggccggcgc

SEQ ID NO: 5398 - DNA, 582 bp, Chlorella protothecoides
atgcagctcagggaccactcttgccgggtgctggcggcggtgctcgccgcgggcaacgcgctgaacagcggcacggcccggggcggggcggctgccctgaagctggagtccctgctcaagctggcggacgtcaaggccagcgaggggtcccagccccggccacacgccggacggcgcggggagggacctggagcttcacgcgccgacgggccgggcacggagggtgctggcgtcggcccgccgtcgagcgacggcccgccggcggccccgccctttgccctcaagctgcgcagcctgctggactttgtggcgtggattgtgtaccgcggggagggtgcggaagtccgcgccgccacgcaatacctggcctcggagctgggcgccctgtccgaggcggtgcggcgcatgcagagcggtgaggggcagggatgcggtgggtggttgatgagagtgctggtgggctcccttgagcaagggcaggagggggggggtacgaccagtgctgcggtggcgtggagtgccgtgccgagcgcttttgtggtgcggcggggcggcgtcgggcgccgaggccttggcctatga

SEQ ID NO: 5399 - DNA, 438 bp, Chlorella protothecoides
atgccccgtcccacacccactctgcccctgcccgccggccagatcgtgccgagcgacgacgaagccaaggcccttcgggcctacccaggcccagcagaggagctgtcgccgccagagaagttcatgctggtcatgagcgacgtgccgcttattgtggggcatgccggggctgcatgcacggtgggtttgagcgaggggacttggggtcctcggggcccacatgaagactcaccaccatgccacgccacgccatgctgcgcctcgtcctctccgcaaccccaccaggtcggcgcgctcatgttccgcctccagttccgatcgctctgcgaggacgcggcggccggcatggcggcggtcaggctggccacagagcagctgcgtgccagccgccgcctgcgcaaggtgcgatgcgtgtgcagcaggggcgcagggatttga

SEQ ID NO: 5400 - DNA, 339 bp, Chlorella protothecoides
atgcagacggggcactgccaccgcggcggcgcctgcacctacgcccacggctacgacgacttgcgggcgcgcgggcaggggtgggtggggacgccgcgccagggctccgggtcctcccaggcgcccggcacctgcctctcctcctccctcagggcgggcagcgacggcgacacaggggtggccctgggtctacgcctccctctccctcctccccctctcgcgcgcgcacacaccatccctctggtggcccctgcgttcacaggggagcgggcggagtccgacgccacgcccggctccgtccagacgctctcgccccgcgcgccgacggaccggggctga

SEQ ID NO: 5401 - DNA, 2355 bp, Chlorella protothecoides
  modified_base (97)..(106): a, c, t, g, unknown or other
  modified_base (339)..(348): a, c, t, g, unknown or other
  modified_base (442)..(451): a, c, t, g, unknown or other
  modified_base (1844)..(1853): a, c, t, g, unknown or other
cgcgcgcctccgacggcggcgtgcgcgtcccttctgccacggacggccccgccggggcgggcgcacccagtgccgcgtggcacgacagcctggcccnnnnnnnnnngtccccgtcagccggtgggagagggcggccaacgccgcggccgtcccagtacagggcgacgctccggcggccagggcgggccgccgggaaggcgcggcgcgttccgacgacagcgtgcacgctacagaagacggcgcgcgcgcctccgacggcggcgtgcgcgtacctcatgctacggacggccccgccggggcgggcgcatccagtgccgcgtggcacgacagcctggcccnnnnnnnnnnggcattcagaatccgggatgcaccagtgttgtaaatggaagccagaagcagcagcctattgataaaggctgtcgagggggcgcagcgcatagcnnnnnnnnnngggtagaggaggaggtcgcggcataccgagccgagctggagcgctccggcctgccgcggcccgcggtggcggcctcggcggcggcgcggcgggcgcagctcctcgctgacgtcgccgcacgaggggctgggagggagagggcatccaagcgggcgcgctccccggaccgtcgcgccggccgaagcagcagcctattgagaaaggctgtcgagggggcgcagcgcatagctaaagtgggaaactggtggacgccggctgctgaaccctgggggcttgcgctcgccccacacgtgcccgaggcgcgaacgcctgggaaggtggggatccagggggagtctcccaggacatccagagcatattcgacaaccagggcgcatactcccccttactactttcactgcatgtccctgtgtccaggcaataccttggaacttggagggcgaagcgtgcgcgacttccggcctcggccaaagtccgacatggcgtcgctggccgggggatattttgcacactctgtcctgccgcctcgacagcctccgcgcgaacggagtcgggtcggacagatcaggaatcctcgaagacgggtggccctcaatgtcgcggcagtctgcgctgagcccagcccacacttggatcgagccaccggcacgcaacccagaacgttgcaggcgctgctcttcatggcgaggtccctggcgaagaatgaactcagcgactctgaggcgccgtggggcctgcctccggccctcctggcgcagctggaatgggtgggtggacccctgccagtcaccctcacccaggccgctacatctcctccggcccccaagcagcgagcgccccctgcctcggaacaggctggtcggggcggccccgatccggagcgggaggacgatgacaaggaccccaacaagaagagcaaggactactatgcaaatgtgggcgatgtcatccgcacactgagggacgacatcccctgcatcttctggaagccttttgactgtgcgctggggcactgctgggggtctagtcctgattcggcgtgtgcatcctttgagaagaggattgcgtggctggcaatgacctggtgccattttgccctgctgacccctttcaattctcccatctcgccacgccccacacacacagatcacatctaccgcgacgacgtcgtcttcagagacccaaacatctccttccggggcttgacaaattacaagcttgtgatctggtcgttgaccacatttggacgcctgtttttcgccggcaaggaggtgtctgtggtcaacatctggcagccagaggagggcattattaagtgcgtggggcagggctgggggtggagtctcctcttctcttattgttggtgttggcttgatggtgctgtgcgtgactnnnnnnnnnncatcaagtgcgtggggcagttctggggttggagtctcctcttctgttcttttcggtgttggcttgatggtgctgtgcgtgacttccgctgctgcgcccaagattggcgtgtcgcccctgtccacccccttcccccccaccccgccttacactcccccaggatgaggtggcaggtgcaggcccggccacggctgtggtggctggccgagggcgtttttgacggcatctcggagtaccgactggaccacaggggcctggtgcaggagcacctggtgaccaatgtgcagctgcgtgatccgcccatcaccaacccgctcctctacggcctgaatctgctcatgtcgccccggctggcccctcagccctcccgagtaccctgcccaggtgagagggctgtgtgctttgggtgctggctgcatgtttgcaggccgttgcaacgggagtgtgagcatcgccatgcgggatgctgtgtcacagctcttctgcccaccttcaacctctag

SEQ ID NO: 5402 - DNA, 897 bp, Chlorella protothecoides
  modified_base (756)..(765): a, c, t, g, unknown or other
atgaccgcctggcgcgcaagtgagaagggagatcgggggttgggagggaaggtggcgggcggcagtggtttggagcctggggcttgcaggcctactctccaggtcacaaagagggcccagcccctcctcacgcccaggtacctggagagcaagctgaaggaccaggcggcagcgctggacctgctggcacacagccggggcctggagggactgcgccagctgcagggcccctacctggacctggaggtccggggcttgcccggcctgcagtactttgggggcctggtgtggggcggcatcatcgacgagtttgcggcaggtgagggatggagggggtgggggggcgaagcaggctggcctgcagggtgccagcgccgagggggcctcctggaggccgcgcgcatgctccaggcagcccccctttccccctctcaacacaccaaatgcctgcgccctgccccgatcctgccctacctcaggcgcggacaggcgcttcttcatgctgggtggaaagggcggcgtgggaaagaccagctgctccgcctccctggccgtccagctggcggccgccgggcacacgacgctggtggtgtccaccgaccccgcgcactccctctccgacgccctggaccaggtgagggcgtgtggtgggagggcaccaggagctcggaatggagtcgagagcggcggcgtggggatggcgtgggggaaggggggaggagggcgcggggcgcgggctccgcatgggggcctggnnnnnnnnnngaccaggtgagggcgtgtggtgggagggcatcgggagctcggatggagtcgagagcggcggtgtggggatggcgtgggggaaggggggaaggagggcgcggggcgcgggctccgcacgggggcccaacatga

SEQ ID NO: 5403 - DNA, 198 bp, Chlorella protothecoides
atggcgagccagcagcccgactcctcccaggccctgatcctggcccagcaggagatggaataccgcgttgctctttttaacaagtacaaggacggcgacctcaatgtgggggagaacagctgcgtggacaggtgtaccagcaagtactggcagaccaccggcatcgttggccagctattgggcactggccaggcatga

SEQ ID NO: 5404 - DNA, 282 bp, Chlorella protothecoides
atgggggcaccttccgcaacgctgcccacccaagacctctgggccccaccccccttcccccaagcaacacgcctcgcagctgaagtggtgggagggctgacacaggaagctgctgagcacctgggcctcgcccccggcaccccggtggcccagggcggcgtggatgcccagatcgggatgctgggcctgggggtgattgaccccggatcgctggcgctcctcatgggctccagccacctgcacttgggcgtcaccgaccagatgtgcgtgggggatggttaa

SEQ ID NO: 5405 - DNA, 339 bp, Chlorella protothecoides
atgaacaccgccaaggcgctgttccacgacgaggcacgtactcagttcatcgtcgtcaccatacccaccgtcatggcggcggcggagagcgtgcggctggcggagtcgctgcgaaaggagagcgtgccggtgcggacgctggtggtcaaccaggtcatcggcgacggcgcgacgcagagcttcctggacaaccggcgcaaggaccaggcacgtgcgctgcagcgcctgcacgacaaccccgagttgcgaggcctggaggtcatcaccgcgcccctcttcgacctggaggtccggggcctgcccgcgctggagtactttggacgccaggtgtggaagtga

SEQ ID NO: 5406 - DNA, 981 bp, Chlorella protothecoides
atgctgcagacgctggagcagatcctgggctactgcaccccccgccagctcggcgccctggagagctcctgctccttcttcatcaagtccggcatcaccgacaaggtggcgatgcaccatctctccttcatcccgcgtgccaagggcctcaagcccgacttcaagtgcgtgttggatgtatgggtcgggttggggggtcctcatgcccatgcggcacggcgagtcgtatgtgacgctgtacgcgtttgtgaccgcgcagtccaatgcggcagcccagggcacggccctggcgctgggcacctaccacaccgtggccctgctgtcctccgcggccgaccgcgcggcgcacgccgaggcggccgagtacgcgctgcacaccacaggccgcggcttccacggccagctgggcctgggcgactacgagcagcgtctgcggccgacgcgcgtgcccggcgtggcccgcagcgcgggatctggcggcgcgggatctggcggcgcggcggcggcgccctcctcctccgccgccgccgccgacgcggtgcagctggcggtggtggcagcggggagctcacacaccgcctccatctcgcgccgcggcgagctcttcacctggggcctggcctcctcgggcgagctggggcacgggggctggacgcccatcgaggtgtgcgcgccgcgcctggtgggctccctccaccgcgtgcgcgtggtgtcggtggcagcgggggccaaccacacgctggccatctcggaggcgggccagctctggtcctgcgggcgcgggcggcacggccagctggggcacggcgccttccacgacgagggcgtgctgacgctggtggaggccacgcgcggcgagcgcgtggtgtcggccgccgcggggcgcgcgcactcgctggcgctggccgccgacggccggctcttctcctggggcgacgcgcggtggggccagctggggcacccctccctggctcgcctggc

SEQ ID NO: 5407 - DNA, 696 bp, Chlorella protothecoides
  modified_base (377)..(386): a, c, t, g, unknown or other
  modified_base (681)..(690): a, c, t, g, unknown or other
atgatgtgcttccgctacacaggtaaccacagctcgaatgcagaggctgcacggcatggacagatgcctgaaatgaaggcagaggctcggggcactcggtacaggaggacttggctgggtcctgcgctgtggcgagcagaatgcgccgatatgacactcaacgaattcatgctgcagcatgccataggcgtgcgtcgtgatgctggaccaatgtgccgcccctcattatgtttcgcctactcctcgcagggtgtgtacaacacggctcgctgccggggcattggcaacgaagcgatcgtgcaggcgctgcgagagcttgcgggctacgaggtgtggacgtgggaggagtgcgtgaacaccttttgccagaaagaccnnnnnnnnnnggcgctgcgagagcttgcgggctacgaggtatggacgtgggaggagtgcgtgagcaccttctgccagaaatgcaccgttggggttgcccacatgtgcagctttgcctggggtcattctctgtcttctcgcatggacctcccagggaggcattcaagacgactacttcaccgagcacggcgaactcgtcatcaaccatcgagtgaggggtgtgctgccattgtgtgcgggctcggatggacgatgcgggggttgcgccggcagccttgtcggccagaagctgtcaatgccacagcnnnnnnnnnnctctga

SEQ ID NO: 5408 - DNA, 357 bp, Chlorella protothecoides
atgtgtgcgaccgcctcctgtcggcctctgtggactatgaggagtctggctggtgggtcgggtgggaaatgggttgggaaggcgtgccgcgaggtggaggcagaacctggagtgattcaatgcctgcacgagccatcgtccccgccatttccactccaagccaccctgctccgccgctgcccctgcaggtatgatggccagatctttgtgaagccgccagaggtgcttgccagagaccggctgctgggcatgtacgtgagggtgattggggtccgagcctgtcggcgggactgtacaggggctggtgaagtatgggaagtccaaaggagcctcaaacagcatcacaggccaccctga

SEQ ID NO: 5409 - DNA, 420 bp, Chlorella protothecoides
atggccatctccctgctcaaccattttgcaggggtggaggagcagatcgtgtacctggtgggcagcttcggagcgagcgccgtgctcctctttgccgtgacggagagcaagctggcccagccgcggaacgccctgcatgacctccagccattgtgggcctatgtcggcgcggcggctgccacaggctccggccccctcgtgagccagaccggccctgcagccttctgttctttcctccccttcacaccgcagtttgtgggcggccaaatcttgggcgcgctggtggggcttggcatccgccatgcgatccatgtgccctgggtggcctcccccctggccatggccctgtccctgaccggcatgcagctcacctccaccacccacccgccaggtgggtgggagtgccacagggatgggtag

SEQ ID NO: 5410 - DNA, 1071 bp, Chlorella protothecoides
gaggccgcggcgctgctgggggcggcggcgccgctcctggcggccctgctgggcccgtacgccccggcgccgacccccagccagatccgcgccgcggtggaggctgaggtggagacgcgggcggcagcgctggccgcgcagcgcggggagctggccgccacacaggcgcgcgccgctgagctggcgggccagctgggaggcctgcgcgcacagaccgaagcagcgcggagcgagctggcggagctggccggccgactgcggcgcgggctggagggcgtgggtgggggtgcaggagctgccgacgcagctgctgatgcggcggatgacatggcggccgacgtggcgctttgccagcgccggctggaggaggagaaggccagcaacgtgcacaagctgaagacaggtgggatggggcctctggatgtggctggttcgttccagtgctgtgctgtgccattggatttggacagcagcagctccctggacctagataggtacctttgccccgctccagacccagcgccccacaaccagctccccgcctcccctgcccacccgacacaggccgatgccttcctgaccatgaacgagcgcttcctgagcaccgcgcgccagcacaatgcgtgccacacctgcggccgccccttccacggcgccggcgagctggaggccttcctggcgcggcaggagcgggagcgcgcaaagctgcccagcgcacgcggcgcatgggaggccgccctgcgcgacgcagaggcacgcctggcccggctgcagggcctggcgcccattgccgcacgccacgaccgcctgcgcgacaccacgctgccggagctggaggccgcctgcagcggcctagagtcggcgctggccaccgcgcgcggcgaggccgagctgcgggaggagggcgtggcggaggccgtgcacctgctccaggaggcgcgggggctgctcgagaccgtggcctggccggccgacaagctggcggcggagatcaggtttgagatctcggttgggagagtgcacgtgtgcgcatgggggttgaagggagaggatgctgtgttgcaagcttaa

SEQ ID NO: 5411 - DNA, 801 bp, Chlorella protothecoides
gcccacgcccgcgccgcacacgacgctgctgggcggcgccgggcgcggcgtcagccgcaccgccagcttcctgggcacgccgcgcgccgacggcggcggggagaccctggagcagctgctggaggacctggcggggccaacgcgcgaggcgcccgcgccgccccccgccccggtgagtgtgtgggtttggtgtgtgggggccgggagggagggtctaggagtcggctcgaagggggaggtgcgcggccgaggcgaatccgccgcctgctcccttctccggcgagggtggtgatactccggatgcactgggcaggcctggcgcacggtccacattcaaacccgtccccgccacacacgggcacccccgtgccgcacgccctcacaccctcccccgcccaccccaaatctgaaatcctacaggagctgcggcgtgtgggcggccccttggcgatgcgttccaacgacgcgctgcacctgcgcatcctgctggaccactcctgcctggaggtgttcaccggcacgggggaggtgctgagcacgcgcgtgtaccgcggcacccccccgcccggcaccggcccgggcatcgacctgatctgcttcggcgcaggacccgcgcacctccgctccctggccgcctgggagctgagggcgctggacgccgccaccgcctcggtcccgctctcgcccgtggtctcgccgcgcggcgacggcggcggcgggggaggcagcgccggcgcgctcttcgaccagctcatggcggggctggacggcctgtccgtggtcgaccgcgccagcgcctga

SEQ ID NO: 5412 - DNA, 675 bp, Chlorella protothecoides
atgcctgaagttggtggggggggtccattactgtctcggagctttggttgggatctcactggggcagtggttttcataggacagccaccaaccgccgaccctttcccacattgccacaggatcggaggagcagtcgccgtggcagtcggggagggaggtgcgcctgcgagagcaccgcagaccagttcacctcgggatcccttacttgcatggggccgcgtcttcagatgcaccgaccccgtgtctacatctcgccaatcctcataccccctctccccacatcaacagggtgaaacctggagtgtgagtgccgcgggcgaccgcttcaaccgctggtggggcgaggaccactatggcgacggcagcgtccgcaagcacgggcacagcaccgcaggtggtggtgaagggcaatcctcgcggggggagacatctgtcgggaagcgccctctgtgcgccgccgtcacgagctctgaacacacacagacccctcccccgaccgctgatgttacaggcgaggcctgggacgctgtagagcagatggacacgtactacaaccccatcccgcactttggctatgagctcgcgctggcccactccccgcagctgcgcagtgtccccacgctgccctgggaggacgaggatgacctcggcgactccggcctcggggccttttga

SEQ ID NO: 5413 - DNA, 711 bp, Chlorella protothecoides
atggctgtgcctgctccagtgattgcgaagcagtacagtacaccaagtcacccatcccgcaccgtcctacccatcccttgtcccgcacctctccagtggtacgagcggtggtgggaggtgtcggactggaagggcatgaaggagctgggtgcggagaagtggggctgcaacgccaacggtgggtgctcctgggtggggcacagagtgtgcagctccctgcctgcagtggagtccctctccaacccggggccccaccctgcctcgccactccccaacccatggtcaggcgacgcctggcgggagacatggaaggagacgatctcggtggatcccgtgaccgggcagccgtctgtcgcccgcagcgcacacaagtgggccaacaacgcggcgggcgacgagtgggaggagaaatgggacgagggctacctctccaagggcgcggcctccaagtccgcctccaagtgggcacgccagggggccgaggtgtggcacgaggagtggggcgaggactacgacggcgcaggtagaaagtggggagggacgtgggcgcgtgatggaaggtgggagggagacggtgggcgacgccggtgtatcgctgaccgatctggagtggccaggggtggctgcgtcaagtacacgaacaagtgggcggaggccgaggaggccgagggcgggcgcagagaggtgggtggatgcggtgagggagcatga

SEQ ID NO: 5414 - DNA, 879 bp, Chlorella protothecoides
  modified_base (696)..(705): a, c, t, g, unknown or other
atgctgatggagcgggtccgcagcgtgcacagcgtgatgcagcgcatggcggcgggggaggtgcccttcgatgccgacgtcgcccggggggcggccgcgctggcttcagggctcccagccttgggcgacctggcggccctgcgccaggaagtttcaggcgaggccgatgtgctcatgatggtgctagctgccgcggtgaccaagggctccggagcaggcacgtcgggagttggatggggcctggggatctcgggcgggctggcacgcacgcgggacagcgtctgcttccgctctcaggatcgagcggagatccccgctgtggccctccattccaaaccaaaccacactgctgccgcctcaaccatgaccccctcccccgcctccgcacgcagccgcggagatgatcaacaggtacaatctggcctacgatcggactggtgctgccggcatcagcaagcgcctgaccgtgcctcccacgggtggcgcaacccgctcgccctcagagccgctgatcaccccctgagccctgcccctgcactgccctttcctgccctccctcgaaaacgctctttcatcgctgtgaggctcgcaggcacacacgtgtcaccagggcacactcgccatgcctgcctgccgggggggggaggggacggcaccgggctgctggcatgcaagccagggtccgacacacgcagnnnnnnnnnnttcatcgctgtgaggctcgcaggcacacacacgtgtcaccagagcacactcgccatgcctgcctgcggggggggaggtgacggcaccgggctgcgggcatgcaagccgggggtcggcacacgcacggccagcttcaggccagggatgggaaggcggcagtgtcctccacattga

SEQ ID NO: 5415 - DNA, 2004 bp, Chlorella protothecoides
atgtctgacagtgtgccaggcacttctgacccatggtacccgccggcccacgccgccggcctccaccaatgctcaacaatgactcaccggccattctggcctgctcctcaacccctccttgtgacagcctactatataattttctatcagcaaaccaatctcacacttcctcacgggcctgacactgggagcgtcgcagcgtccatcagcatctctgaagcgtcgcgcttagaggtgcgcgagcgatgcctcgaccctggtgccctggttcgtgtatggtgttggtacgctgccatcagggcacatcacgatgcagcccgtgctggtcagcacgaggtccaggcaaagaccactcccctcacgcaccgcacactgcaggtgctcgcctactttgtcaagactcacgacttggtgaaagtcaaggacctgcccttcaaagagagctacctgtcggcccaggtgctgtgtcaccgagtacctctgtatttccctgcccaggccacgagtgtacccacggtgttctactactgtccgaagacggacattgccctcaacatcaagacctgctcccaaaacaccaccgtgggtgtggtggtggatgtttacgacgacaagctagatgctatccggcacggctgcatggctgcgagcgcacatcctatcgtactgcacatgtgcaggtcgacaagtcgagcgggacccagcatcagtgtcaacgtatcgggggtcgacatggcagctgacagggcctgccagaattttgccagtgacactgagcaccctctcacttcctgtcttgattcggcacgtgaacgtacaggcatctgtggggaggggcacccgccagttctgcctcactctggaggagatgcgcagctagaagagctgcacaatggctgtcatctcctgccacgctctcatgacttgtggcctctggaagaggagcttatcacgtggcactggcaccgccaccctagcaccaggacatgccttgagcgcgacaacaacagcatgttggctgaggcactacccccttcaatcttcgagctcagtcccgacccatcgagtaaggggagcaccatcataagggatttcctgacgagctcacgagaatttcagaggtccagagctctgcgtactttctttcatgcggaacctccggcgtcccccggacgtccccccggtcggccaccacaaaaagcgagagctcaagacttgccaagggcctcgcatgcgagctggctccccctccgcgatggcagcaggaggcagtacgggacacaagctgggcttgcccctactcctcctcctgggatacgcctcactgctacagacggcggtaaggtcgcgattgggttgttgtatctcacctttaggacgatgcggagctccttgcaaggttggcgaaatgcctcttacccctcacgtcgcagatggcttgtaaatccaccttcttcgctcttccgtctgcgagatggcaaatgtgcagacgccaaccagcttctcacccacccgacaattcttaggaagcggggctatgccagggtcgggaccatgcataccggcaatctcaagtccacacgactgaagatcgcggcggtcagccttgtcagcctgaagacatgcaagtctccttcctgccaggcactgatggctgtcgagtgtctccccaaaggccagcctgcctgcacgccggattggatgggaaacacaggcgatgggaacatcgggtggcacaactttgggacagccaaccaaggcgatcggaacttaggcaacaagaaccaaggaagccacaacattggcagcaacaacaaggggaatgttaacatttgcaacaacctgtctggcgattcacagtcctgcaccccatctgatttgaacaattcagacaccatcgtcgtgagctttccccctcccccatccaagaagcggtctcctccaccacccaggaagagggcgccaccaccgcccaaggccaagtcccccccgccaccaaaggcc

SEQ ID NO: 5416 - DNA, 780 bp, Chlorella protothecoides
atggcgtccttcaggagcctccccatgcaaggcagtattggggctgcacgaccatacagtcgtccactccggatggctactctgtctgcgatcaagcgcaccaccgagaagaatgtggtgtgcattaagatgctgaagatccgcgcgggatcagagaaggcggtgctccggctgtgtcacgaggatggccccccgtgcagcgttcatgtgatgggctggagaactgatctcgtcccctggaccgccccgcccaggacccctttgatgaccatgccatccacttctgggagcggtacgagggcaacgtggctctgggccggcacaacaccagcacccagctgctatcctgtcgctgggcggcgtgcacacccaaccattcacagagaatcattccctcttctccaggtccagccgcacctggagagccccatcgggatggcgctgtacgagtggaacgacgggcagctaggggcggtgtgcttgcagggcgggccaaagggcgagggcggcctggatgacgccacgggggcgtcgggggctgcaggaggggccggcctcaagcagacatcagccacgctggacctcagtgagcactgcctggggctgtgtggtgctgcctggacaaatcgcggggtctcgtgcacgtgtctggccattgccccaagcaatttcactcctgccatcgctcggcccctcgcccacagccaactctcgggacaaggaggacgactcacgggcggtctggggcctgggaaatctgaagaaactggcagatggtag

SEQ ID NO: 5417 - DNA, 1206 bp, Chlorella protothecoides
atgacggaggtatgttgcatgctgtttggatcctcctttattaatcttcctgcagctgaagactctgcccaccagaggaatccggcctctcacactccatgccgtcctgtgcagttttgggtcagtcaggccaatcactggtgcgagtactgcaaggtctggctcaaggacacggctcagtcgcgtgccgtgcacgagaagggcatcaagcaccaggagaatgtggccaaacgtgactgcccccacccgagcccgcacacaggactgagcgcgatgcgacgcaaagccgtggacgagaaggccgccgccgtccagaccgccaagacgatgaaggcgatcgaggaggaggctgccgcccagtttgccagggaccgcgccgaggcggcggcccatcgagcggccagcctgggggagtgggtgctcaaccacgagacggggcaacactacaacgcgcagcaccggtggtactatgactcgggcagcaagatgtactatggcggcgacccccccgactggacggccagccctgccacgctaccgcacgcagcccgcttcgaggtcatgtatccgcccctgacccggccccgaccgactccaggccagggcccacccgcggccgcctccgccgcgggggccagggcaagcggcagggcggctgcgcacccgctgtctgggctggggggctacgcaatgcccagcgtgggccggattgggggagccaagggcgtgggccgggtggaagccaaggccacggacgcccaggtggggaagggggattggatgagaggaggacgagggcagggagccagcggagggcatgaagacgcatgctggcggcacctttcaagtccgagagacgacattcgcccccccaaacccctattcctctctgtccgccctgtagagaaaacatgccgacaagctgaaggcgaagaaggcgataggaaaggatctgcccaagcaggagcaggaggctctggcgcggcgggaggcggcgcgggcccgggtgcagcagcgcacgatgtcggcgttcgggctgcagtgatgccggcaagccctgccaggcagagagctatgttaggcagtgcttggggacatcgagccgggatgggacccgcagcatatggacacatggcacacggtgaagcattgagaagacacaggaccctgtgctcctggcatgcgctgatgcttctagcggaatag

SEQ ID NO: 5418 - DNA, 954 bp, Chlorella protothecoides
atgcacggcgtggcactgcctggatgctatctcctccaagtggacgaggcgcttgacatcagtgcccccgcacgcttgagttctggccagttcattgggaccgactcaaccccccacgcaggcacacagcatgctgtaggactggagcagacagccctcaaggagctgggccgagatttccctgcaggtatcaagctggtggtgacatgtccgccggtgtgcaggggcatgctgctcctgcgccccgacaacacccgggttgcgggggggtccgtccctgccctggagcatgcccgacgcgccgcagtagaggtctggaaccgccccatcggtgcgcgcggggatatggacgcagcggggtggactcctggtgggaaattgagatgcagtgattccagtgctgaagcacctcgggctagagtgtcatactataatgcagtctgtcaatcaaggtttagaccaaagttacacacgcagacacacgcctacctccctcttctcacaacatcacacccgacagttggacgtccacgtgggctcccgagcctggcagccctccaggcagaggcctccgctgccgcctggcagcagcacgccgcaggcgacacagccggccccacggcatccaggcaggaccctgtgcgcccagaatctggcactgcagctgcgccgccgcgtaggtaccacaccgaagcgagtctggcgtgtgcgccaggccgaggcatccacgcgagcctcgaaggacaggcgagcggcggaacggcacccgcaagcagccgctgggcgggtggccaggagggcaggcaaccactccgagcgctgaacacgaatcgtaactccgtggccagggcagctgcgagtgcagagtcggtgccagcgcctggctgcgagccgcggtgcgcatggctgaggggggtggacgtttggggggcattgcggtcaacactgatgtag

SEQ ID NO: 5419 - DNA, 264 bp, Chlorella protothecoides
atgatcaaattgcagcccgtggggtgcaagacgcccggcacaggcatggagatagcccacaccaagctgcggggcgtggagagcgcggggatgatatgctctgcccaggacctgggttgggcgagtggggctgagggcgaggcagcccgtgttcccccaggcttgctccctggagagcccatcccagaggaagaacctgctcaggtacaaggctgtgctgcatgtctgcatcccggacatggaactaacgacgcccacaactag

SEQ ID NO: 5420 - DNA, 702 bp, Chlorella protothecoides
atgcgggccaacgtgatgatcgagcgcggcgtgaaaaagtacggcgtcatccttgcatttgacgtcccaggtgcgctgggcgctgcagggtggcgggtgtggctccaggaatatggggcagggcagggatggggctggccggccgcgcttacaggcaagctctggccgataaacgagcagctttgggtgcgatcaccacccccgtccctcttgcagtcgcccctccccccccacccatacacaaacccacccacacccacccccgatgcagtgaacaaggaggcgcgtgagatggcggaggagctgggtgtgaacatcttcaccgccgacatcatctaccacctgttcgaccagttcactgcctacctcaagcacgtgaaggaggaggagcaggaggccgcgcggctggaggcggtgttcccctgcgtcctgcgcatcatgcccacctgcgtgttcaacaagaaggaccccatcgtggtgggggtggagatcgcagagggcatcgcgcgcattgggacccccatctgcgtgccgtcccaggtgagggggagtgcaggggcggcgaggaagcgtgccgactcgcgcccggcagggggcctgggatgcaggagctggcgtcgccgtggccggggctacccctgtttggaccgtctcgctggtctgaagtgccatcgcggcattccatgctcaagaagcgagtga

SEQ ID NO: 5421 - DNA, 657 bp, Chlorella protothecoides
atggagaaggatcacaaggcggtggacacagcaaagcgaggggatgccgtggcaatgaagatcgagggaggacatggatggtccagtggggctgcgcctgcctacgccactgtgaagcttcgattggagtgccgatgcacggcccacatgccgtcatgtggcaagccatgctctgttgcatgctggcttgtgtacaacacaggggaatgccgcgacgactctcgtgcactggccaccaacccggaccaggcggcaaggctgtacggacgccactttgaccacaaggacgacttggtgtcaaagataacccgcaagtctatcaatgtcctgaaggacatgttcagggacgacctgaccaaggatgactggagattggtggtccgcctgaagaaggtgggcagggatgtgcaagtggaaagctgcatggagtcagctctaggacgaagactcaagcatgatttggaagcagcagggtacatgtgcttccctgcaggcctccccttgtgcacccttgtgaggcaaagttgcagcgctcaggctcgcagccggctgacaaggcggtcccaactctggcccccctcagctctggaaaaggaatctcagggcgacatacatcgacccgggaacccggccagtgcttcaaaccgcaatacatag

SEQ ID NO: 5422 - DNA, 1164 bp, Chlorella protothecoides
atggcaatctccgaagagaagagtaaggccatgtggctgcaaatcgccgggcatcgaccccagccacccggccaaggatctgccgtcaccccgcccccaggtacgtcacgctatggatcggcctcagctccaccgtcatcatgtacaacaaatggttgctttctttctccggtgagggagcaggcgtgggccgggcacggaccgggtcagggctggggccctgatggacgccatggtttaaattgcgccaggcgggtgctggctccctggggtgctgctgttgtcagcacagcccgcctggccttgagtgccacgttcattgacccaagcccccctcacatcgccctcacgccgccctcagggttcccctaccccgtggccctgacgctgtggcacatggttttctgctccttcctggccaccgtgatcgtgaagctgggctatgtggagcccatcgggatgagccgtgagacctacctgcgtgccatcgtgcccatcggcttcctctacgccggcaccctctggctgggcaacgctgcctacctgtacctgtctgtgtccttcatccagatgctcaaggcgctcatgcccgtggccgtctttggcgtgggctgcatcttcggcaccgaggcctactcccccgcaaccctggccaacatgctggtggtgtccctgggcgtggccatcgccagctggggcgagatcaactttgtgctggtgggggtggcgctccagatgctttccatcgctaccgagtccacacgcctgaccctggtccagatcctgctccagcgccgcggcctcaagctcaaccccatcaccaccctctactacctggcccccgcctgcgccgccttcctcctcgtcccctttgccctcatcgaggcgcccaagatgctggcagatgccgagctggtcatcgcgcccgccatcatgatcagcaacgccgctgccgcctttgcgttgaagcgtgggcaacacacctggtctggacctgcttgcatggccgcggtccacctagaagcggtgctggccacgctttctccccagggcaagtgcttgccagttgcctggttggaccgtggggttcgtccgcagcgcatcgtgctgccacctgatctgcatcaagacctcacttcactgcccaattcgcccaccccttga

SEQ ID NO: 5423 - DNA, 1398 bp, Chlorella protothecoides
atggcggaatatatgtggactggatttgccgtcgcactcagaaagaaagattcaaggggtggatacttgcaactcccgagccgggccagaaaaggtgcatcgccacaagccctcacagtcaaagaacattttcatctcatagatcactcgaacaagagtctcgcaagatgggtcagtgctttaccactgtcggtgcgtcaggggtgggggtgttggagtattgacgcggagttgcagaacgggagcgttccggagtcgtgggatttgcgcgcacgctgtcgtgattctcatggagttgatgcctccccccttcactcacctcctccctgcagtttggcaaatttaaccgcatcggtcaccctggtaagttgctgcggcatgcatggggtgttgcctggcgtctttcatgtgggagaagctgctcatggaccgaaggcaactctcccatgcaggattcaactgcatctggtgctgtgcgggagaggctgtggccgggaagctcagcctgaggatccagcagctggatgcggtggacgcttcacagcaccctctcaccccaccccaaaccctcatggtcgcagtcttcgtggacatcgtggtgtctgtgcagtaccaggtggtgcgcgagaatgtgtacgatgccttctacaagctcacagactccaagagccagattcgaagctacggtgggtgcttggaaccggatgcctcgtgacatgcccatctgcggtgcacggggaggccggagggttggcgcctgtgtgtggcatccctgccctgcatgctgtgcagtacctctgcgcttgctgcctctatctttcagggtctgttgaggtgcccaagatgaacctggacgacgtcttcatcagcaaggagcagattgcggcggcggtgaaggaggaactggcaaagtccatgacgggcttcggcttcgccatcgtcaacaccctgatcaccgacatcgagccggcagccaaggtcaaggccgccatgaacgacatcaacgccgcgcagcggctgcgcctcgccgcctacgagcagtcggaggcggacaagatccgcattgtcaaggcggcggaggcggacgccgaggccaagtacctggcgggccagggtatcgcacgccagcgccaggccatcatctcgggcctgcgtgagtcggtgcagaccttccagaacgaggtgtcggacgtcaactctcgcgacgtcatggagctgctgctcatcacccagtactttgacacgctcaaggtggggataggtgcagggttcggtgtgggagtggggtcagagaccaaaaggttggctccgcgcctgggctatctctggggtgcactaccatgcatgctcgtgaggaggggagacccaatgagtttgcaccgcgttgatgacctctga

SEQ ID NO: 5424 - DNA, 1140 bp, Chlorella protothecoides
atggagattttggcgagcactgctcaccagcctttgcacaggtttgaggaccgagaccacaaggaagcaagcaacaccctgattcgcatgcacaggcaaggaagctcagtgtccacagagaacttttccatcattgagtctcgagactctgtaaaggtatcttgccattttgtggattggagtgtggtggtccccctgccccctgcaccatggctcgaatacaccgtgcgtagcatccacctccaatgtcccctctttcccttgcatcagtcttttgagggaatgcactttgacgacatctatgccaacatcaccgctcgacgaaatcgtattttcttgttgatggaggaggtccgcaggctgcgtatccagctgcgtgccaaggtgcgggagagatttgatagtcctggagggaggagaatagcatgtccacaggatgcctgttgctgctggcagcttaaatcatgtgtcactcgtacccttgcttgccagggaggcacagagtccaaggaggccttactggagagcgagacatatccatcctccatccccctcttccccgccatctcggacgagaccctcaagcggtactggcggtactacttcactgcagtggccggaatcatcagctttggtgccctgctggcacccacgctggagcttcgcctaggcctgggagggctggagttccagtcgaggtgtcaaggaggcgtaggagaggggcacaggggagagtgggcgcaatcatttcctcatccattggcatccctcggcccgtctcgtcgactgcaccccgttctgcctccctcaacctgcctgccaaacacatccctgcaggcaccacctaccgcgacttcatcgccagcctgcacctgccaaatcagctggcggacgtggaccccattgtggcctccttctgtgggggcgcggtcggcgttctctccgccctgctgctggtggagatcaacaacgctaaagtgcacaacaagcagcgctgcctgtactgcgaggtgggtgggtgtcgggctcggtatgctttgcgacggcgggcctgcctggatgggtgggtgtgactgcactggagcgcggaccttcgcccgagtcccctttaagttggcccggcccttgaccattgcctga

SEQ ID NO: 5425 - DNA, 1836 bp, Chlorella protothecoides
atgagccatgtcgtcaccaccgttccttcgcagcacccccttttagcatgccctttctcgcttcgtggtactaggcacggcacatgggcattcaagagcggcctgccgccgagacgacaccagacgcatcgcgtgtgcttcgccaccagaggttccaatgactcccggcctgaagctcggcctgcgccacaggagcaccccatgccggcgctgagcagtgatcacaaggcttttaatccagatacacatgtttcttcaaagccgaccaggacgggactcccaagcttgcccttggccctgggctcctttgctgcactgagcgctggcatcctcgtagatgccgtctcccctgacccagatcctcgctcctgccctgttcccattcccgaccctcccctccaccccacccacaggcccagcttcggggctggacctggcgggcgccggctcggtgctggaggcggtgctggtactgggtgcgacggtgggcttccacgagctgggccacttcatcgccgcacgatctcagggcatccacgtctccaagttctccatcggcttcggcccagccctggtccgcgtccaacggggcgaggtggagtatgccctcagggcactgccgctgggaggctatgtggggttcccggacgacgacccaaactccaccatccccaagggcatgtagagcttgaggatccattggcaatgtggctcgaggggcgcctgctgcacgcatggcactcccgagggggccgatttctttactacgcccttcggtacacatacagcagcacacacacacacactgcctcgtccgctgcagacgacccagacctgctgcggaaccgaccagtcgccgacagggtgcgcgtagtcattgctggagtggtgttcaacgtcctgctggcggcctccatctgcacggcccagcccccagcaaatcaagtacccctattgtgtaattcctccgcaggcattgacggtgggcacggtggagcccatctactcgccgggcgtgctggtgggggaggtgcagcgcggcgccattggcgagcgggccggcttgcagcgtggggacctgctgaccagggtggggccgctgacggtgccctcctccgagtccagcctgagcgaggtggtggacctgatcaggtgcagcgagggagagggggtgactctggctcttctaggaaaggggtgggagggggacagcatgctggctgccgcccatgccggcaggcctgtcgcctcgcgccccgcctgctgcggagttggccatcgtgtcaccagcaatcagcccttggagctcacaccctccaccccactccccacccctgctgcagtgagaaccccgggcgccagctggcgctggacgtcgtgcgagggggcgagccgctgtccctggcggtggccccagccgagcagcctgatggccggggtcgcatcggcgtggccctggcgcccaacgtcgtgctgcggcgcaccaaggcctcagacccggtgacggcgctgcgcttgggcgccagccagactgcgcgcctggccggggtcatctggaagggtgcgtgggctgtgggggggcccggacgtcgggacacatgcgtggtatgcagctgtcgggaggcaaccgcagcacccatgctgggacttgaaaggataatatcgggggccgaggcatccacctcaagcgtgctcttcatggtctcccaacgagtccgtacattgaagcgtgtgtccaaccctgatcccaaggtcctgcacaagccaccaacccctcgctccacgccaccccccaaccccaaccccccacccccaactccaaccccaaccccccaa

SEQ ID NO: 5426 - DNA, 777 bp, Chlorella protothecoides
atgacctggagcagcaggcacatccccacgccttgtgtcccccccccctgcccccaggcgctggcgcaggtgacggggaagaaggaggcggcggtgcgggccgagtacggccagtgcggcgacctgggcgcggtggcggccgcagcgcgcggcctgcagaagaccatgttcccgccgccgcggctgacggtgccgggcgtgctccgcgccttccgcgacgtggctgctgcggagggctctggcagccaggaccgcaagaaggccatgatcgtgaagctgctggtggcggcgcgcgacaacgaggccgggtacgtcatgcgcgcgctgcagggcaagctgcgcatcggcctggccgagcagaccgtgctggtcgcgctggcgcacgccgccgtgctttcctccgtaggggacgagactgcgggcggggcagcggcggcggcagggcccgctccccccgccgcctcgcacgaggcgctggcggggcggctggaggaggcggctcgcgcggtgaagctggcctactcccagtgccccagctacgacgacctggtgccggcgctgctggcgcatggcccgctgcgcctgcccgaccacgtccacttccggccgggcgtgccggtgaagcctatgctggccaagcccgccaacggcgtgtcagaggtgctagacaagttcaccgacgcgcccttcacctgcgagtacaagtacgacggcgagcgcgcacagatccacttcaccgaggacggcacggtgaaggtgtgttggaggtggccgtga

SEQ ID NO: 5427 - DNA, 804 bp, Chlorella protothecoides
atgatcaagcccggggtcaagtcagcggtgctggatgccgaggccgtcgcctacgaccgcgtggagaagcgtgtgctcccattccaggtgcgtcggacccacggtgtggagtcccaatttccccaccacatcccgtacgaccagccttccactccttgcattgtgcacggtgagcttggccaccggcttcgcaccccccacctggcctccctcccccaccctctaccctccctgaacccaccctctacccctccgctcgaaaccccttccccttctcactcgcaggtgctgagcacgcgtgcgcgcaaggacgtgtccctggccagcatcaaggtggcggtctgcgtcttcgtcttcgactgcctgtacctggacggccgggtgctggtgcaagagtcgctgacgacgcggcgcgaggccatgcgcgccgcgctgagtgaggcccccggcgagctccagttcgccacggccaaggtgtcgacggacgtggaggagctgagtgccttcctggacgacgcggtggaggcggggacggaggggctgatcgtgaagacgctgggcgatacctacgagcccagccgccgctccagccactggctgaagctgaagaaggactacctggagggggtgggggacaccttcgacctggtgcccatcggcgcctggcacggccgcggcaagcgcacgggtatgtacggctcctacctcctggcggtgtacgacccggagaacgaggagtatcagaccatcagcaaaatcggcaccggcttcaggtcggggaggggggtggggggtgggaagtga

SEQ ID NO: 5428 - DNA, 1023 bp, Chlorella protothecoides
atggccctgtgcccgccgctcgtccttgcagatgccatcctgacgcggacggaggagctgcggcgtggcaagagcttcgacctgaaattgcctggactgctggtcattgataccccagttgaaatgtatgaggggcctcctctggccgcatcatatcaagctggactggcatgccacgactttcccagaaccctgcttcgacctgcgcgagttctgccttgctctgtgaccactctcgctcaaaacccgttcccaggccacgagtcctttagtaatctgcgttcccgcggatcaggcctgtgcgacattgccgtcctggtggtggacctcatgcacggtcttgagcagcagaccatcgagtccctcaacctcctccgcatgcgcaagacgccgttcgtcattgccatgaacaaggaagtctccacatgcgcccagccttttctgggctgtgctgcgccgctgttctgcgccgcgcttcagatgcgagcctggcccatgcatcacgtaacccacactgaccccttctccccccaggtcgatcggctgtatggctggaaatctgtgcccaactcgcccatcatagacgccctcgagcgacaggcagagcatgtttgcaccgagttcgagcagcgcatggacaaggtgtggagactttggcatggcccctgggggactggggccttggggttggggtgtggaaggaaggtgtgcagggatgtttgtgaatcagtgcctccggcagaggggactaggttgacaaggggcccagatggaatggaggtgcgtgccctgccgtcgcacccctggtggtctctgcatggttccaggcttgaggagcggctccacttgtcaaaggtgggtatcccgggcccccagatcctgagatcccctgctccccctcgcgccgcagatcatgctgcaactgaacgagcagggcatgaacgtggcgctgtactggcgcaacaaggacccccgctccttcatcagcatcgtgcccacctcggcacacaccggagagggtga

SEQ ID NO: 5429 - DNA, 702 bp, Chlorella protothecoides
atgctccagggcccctgtatccaaaggatcaaggtagctgacgtgcggttcccacacaccgccccgtatcgcaggacgcgcgtcgtggcggctccttggcccacgaagacgggcaatggcacgtggcagcagtatgtaacgcttccagaggccgcgctgcagcctgtgccagaggggctcagcgatgaggcggccagtcagttccttgtcaaccccgtgactgtctatgggtttgtcaagacgctggagaccgacaacctgatcaagaacggctggatcgtgtccaatgcggcaggctctgcgctgggccgcatgttcatcacatacgccaagcacaagggtctgaagaccatcgctctggtccggcgcgaggctctgcgcgaggagctgctgagcctgggggccgcggcggtgattgtcaccggcgagggcgtggatgtcgaggccgagatcaagaaggtcaccgacggcgagggcgccgacgctgcctttgagtgtgtgggcggcgatgtctctggcatcgtcaagggcctccggcatggaggggccctgatcgtgtacggcgccatggcggagttcacctttactgccggcatccccgacattctgttcaggtgggagggttggagggggttggggaggagcctaattggggagctggggcctgcatgccatgcctcgagcttctcatgcttgccttga

SEQ ID NO: 5430 - DNA, 423 bp, Chlorella protothecoides
atggtgcgccagaaggccaagtacgagcgcttcctgaacaagcggtccgtctccaacccccggcacggcgccgtcaagttcagggcgccctcccgcatcctgtggcgcaccgtgcgcggcatggtgccgcacaagaccgcccgcggcgcggccgcgctggcccgcctgaaggtgttcgagggcatccccaccccctatgacaaggtcaagcgcgtggtgatccccgacgcgctcaaggtcctgcgcctgcagcacggccacaggaacgtggcgctgggcgatattgccacctccatcggctggaagcaccaggagaccgtgaaggagctggagcacaagcgcaaaatcaagtccgccgcccgctacgtcgccaagaagaagctggcggcgctgcgcgccaaggccgaggcctccgtgcagtga

SEQ ID NO: 5431 - DNA, 600 bp, Chlorella protothecoides
atggccgagaagctcaccttcgtcaacgacctgcaggtggagttgggagggggtgcaggctacaggtgtggggccggctgctggctggtcctgagcaatggcaatacacgctctgctccctcctttccacagtgcacggtgctggaggtcaagtccatcgagggcttgggcaccaccatcgacgtggtgctcatcaacgggcagctgcaggagggggacaccatcgtggtgtgcgggctgggaggcgccatcgtcacccccatccgagccctgctcacgccccaaccgctgcggagatgcacgatttctctcgttgcctcacccacgccgccctttccaccaaaaactgaacaggagatgagggtcaagggcacctacgtgcatcacaaggaggttcgggccgcaatgggaatcaagctggcagcccacaacctggagactgcggtggctggcacgcaggtgaggcagggtgccaggcggtatcttctggttccgggatctcgggagggaagagcacgacatccattgtggtgcggcggtaaacttggaggggtcccgggagcacagtgcaaagttcatgctccaaggggccagctttga

SEQ ID NO: 5432 - DNA, 879 bp, Chlorella protothecoides
atgaccaccatccccgatccctcactcaacaggaaagctgagaagctggctcgccgcgagcagctgaagaaggaagggaaattgttgacaggcaaggccaaggctgaggccgagaggctggcccgtgtgagggagcagttcctgaagcaggcagggatagacgtcgatgcaggcgcccccaaaaagaagccggtgtacacaaatcgcaagaggacgcagcagcgcaagcaggtgaacccagaggcggaaggccctgtgtcagcagcagccgaggaagagcccgcaccggccccagagccagaatccgaagtgcctgccgatgagccagcagcgcctgccgatgagcccgtggagggtgccgtggaggaaacctgggaagcgactgtggacgactgggaggccatggacgaggacacgctggtgcttccaggccagcagcccgctgcacccgttgcgacagccgctggcactccacaggccgaagttgcagagcagaatggtgaggcggcgacgtctgagaaggctgtggaggaggcggtagcagaggaggaggagagtgacgaagaggaggaggagggggagaccagcagcagcgatgcctcggagtcggggagtggcaccgagactgagtctgagtccgagtccgagtccagctccgagtacagcagctcggaggaggagagcacggacagcgaggcggagatggaggagcggatcgcggcccagcgcgagaagcgtgcggagcgcaggaagctggcgatggccctgcgcaaccctgccgacctgaggtcgcccatctgctgcatcctggggcatgtcgacacaggtttgctgatggggtttggggcccagggatatcttggttgtttagattgctga

SEQ ID NO: 5433 - DNA, 456 bp, Chlorella protothecoides
ccccccccaggcgcgctggaggcggcccccgccatgggcttcgccgacatcatcctggacctcgtgtccagcggcgtgaccctgcgcgagaacaacctgcgcgaggtggcgggcggccgcgtgatggcctcgcagggcgtgctggtggccagccgccgcgcgctgctggagcgcccgggcctgctcggcctcgtgcacgagctgctggagcgcctggacgcgcacctggtggccgacagctactactccgtggtggccaacatgcgcggcgagtcggccgaggccgtggcggccctgctcctcggctccaagctgctgggcgggctggagggaccgaccatcagtcccgtgctgacgcgcggcgccgacggcgggcccgcccagcacggcttctacgccgcgcaggtgtgcgtgcccaagagcctgctctatccagcggtcaaggagatccgcaag

SEQ ID NO: 5434 - DNA, 1107 bp, Chlorella protothecoides
  modified_base (649)..(658): a, c, t, g, unknown or other
  modified_base (715)..(724): a, c, t, g, unknown or other
atgacgcccgcccagtgtggcaacggccacgctcctcgggaggctggaggcgaggaggccccgcaggacgatgacaccgttttgcagtccttctcgggcgtcgtactgaagcgatcgagctcggacgcaggatggcccggatccttgcagtgcaccaagagggcaccccctcacctcctttcacccagtgccttgtcgtggcttcctcaagagggcggcccgcccgcgctcgcactgcccttcaccgaaattgccatgcatgcggtggtgagcgccaccggggaccaggcggcctgcctgtacctccagctcgctggcggcgacagcgactacgacgatgaggcggaggaggaaggggagggtgcgtcggaggtgtggctcatcccctccgatcccgccctggtagagcccttgtttgctgccctgagcgagggcgcggagaggaaccccgacgacgactgcgaggagggagaggacgaggagggcggcatcttcttcgatgaggaggaggtcttggcgggcacggatgctgcactgcatcgcctggagatccaagaagtgagtgatgctgggtcggcctgcctgggctgtgggagatggcctggtgcggcaacctccctcccaccagtgtgcctgtggaagttctgcnnnnnnnnnnacggatgctgcactgcatcgcctggagatcgaagagtgtgcctgtggaagctctgtnnnnnnnnnntccacgtcatcccatggatgcgacaggctttgggaggagacccaacccggttcagcgatgctgatgaggctgatgaggatgaggaggggatgtcacagtgccgtagggattgcaccggttcgctttggcaagcgtccgtgctttccttgctgctgcacatccacgtcatcccatggatgcgacagccgatcgcccttgcttggaatcccagcccttgcccctatgccatgattccagtcttgctgttcagagtgtgcactgatgaccaaactccagttatgccagttctgctactgacatcccgtgatacgataacgctggatcatatgtctgagcacacacccgccatgcatcacccctttcactccttgggctgccgatga

SEQ ID NO: 5435 - DNA, 789 bp, Chlorella protothecoides
atggtcgggggtgtgacgcctaagaagggtggcaccacccacctgggcctccctgtgttcaacacggtggcggaggcacgggcggcgacgggggccaccgccaccgccatctatgtcccgcccccgtttgctgccgcggccatcatggaggcgctggaggcggagatccccctcatcgtctgcatcacggagggcatcccccagcacgacatggtgcgcgtgaagaaggcactgagccagcagagcgcgtcgcgtctcatcgggcccaactgccccggcatcatcaagcccggggagtgcaagatcggcatcatgcccggctacatccacaccccgggtcgcgtcggcgtcgtttcccgctccggcaccctcacctacgaggccgtgttccagaccacgcagcagggcctgggccagagcacggtggtgggcattggcggcgaccccttcaacggcaccaacttcgtggactgcctggagcggttcgtggcggacccgcagaccgagggcatcatcatgatcggcgagattgggggcacggccgaggaagaggccgccgacttcctccgcgcctccggcactgacaagcccgtggtgagcttcatcgcggggctgaccgcgccgccggggcgcaggatgggccacgcgggcgccatcatctcgggcgggaagggtaccgccggggacaagattgctgcgctggaggccgcgggggtcaccgtcagccagtcccccgcccagatgggcgtcgccatgaagaagttgtttgaggagcggggactgctctga

SEQ ID NO: 5436 - DNA, 351 bp, Chlorella protothecoides
atgcctcgtgggcctcaccagcgtttcaatcccattccttccactccagctcccctcccattgcgcatgtttaagaggagcaaagttcccattgtcgtcggcgggacaggcctgtacctccaatggttcatgcatggcaagccagggacgccggtgtccacccccgaaaccgcagccgctgcccaagcgaggctggcccaggcttgggaggaggcagccgagcagggccagaccctctcccaggagcaggcctgggccctcgggtgccggctggtgcgggacctgggggacgcccaagccgcagaaaggtaccaaggaggagtgagggagatgcatccaagaggggtttga

SEQ ID NO: 5437 - DNA, 924 bp, Chlorella protothecoides
  modified_base (15)..(24): a, c, t, g, unknown or other
atggcgtgttcaagnnnnnnnnnnctcgttctcgttagttgccgggtagcggctcgcagcagcttccgtcagcacggcctgcgattgagcaccgagtggtatcaggctccggaacgactgacgaagttgacaaatgtattgtttgatggtgccatgctggcgaggtgccctgtgactcgtccgagaagaattgcatgccgggtagggaggcctgcctacaggtcgacgattcccgcgctcgatccacggcagctcgcaactcggcgcgcggaaaatttagtacccgtccggatggaggtgcatcgaatgtcacggctagatacggctttatcgtccacattgggccatgtcacggaagtgtttccggagaagcgggagcatggcgtgtccagttgccatacatggccgtgttgccatgagaccgacagccctgtctgcccctgcggggctcgtactgcgcgcccccatcggaaccccatgatagccggtccttcgcgcatcgcatcacgtgctggatacgctgcgcttgcagctcgaggcttggcgcgcatgacatcggaccaggccaggcctcgccctgccgtcgtgatcattaccggcccaactgcggtgggaaagacggacctgtcgatccgactggccaaggctttggacggagagatcatcagcgcggactcggtccaggtctatcggcagctggacgtgggctccgacaaggtgaggaccaacaggacatggacacctggtgggttgtccaccctgcaacccatgttccgcaacaccgcacaacaaacacccttgttgtggctggctcatcctctcaccacacaaacagattcctgtggaagcaaggcagggcgtgccccaccacctcatcgacatcctggacccccagcaagacttctcggcaggcatcttccatga

SEQ ID NO: 5438 - DNA, 909 bp, Chlorella protothecoides
  modified_base (271)..(280): a, c, t, g, unknown or other
atgagcggtgcgtgggaacaattttccgggaacggaggggacgaaggcattggattggctctggtgatgtatacatcaccaaggtcggcccttgtttcgtgcctccgggttcccccctctcatcctccggcgccctgctcactgtccccaccccatgccctccatcacccacccgcagaccccaagttcgcgctgctgggagcgatgcagtccctctttgaggggtccatgtacacctttgttttcctctggactccagccctcagcactnnnnnnnnnnatggcgtgtcttgctgtgccacgtatacttgtgtgctcggccttgacgccccattctacagcactcctccacttcctccatcccagccccaacggcgagcacctgccgcatggcatgatcttcgcctgtttcatggtgtcctccatggtcggctctgccctggccggcaagctcatgtcgctgaccacggcaatcggagcggtcaagatgccactcgggatcgctccgcattgcttccctctcaccctgctaaccctcaaatccacattctccacctttgcaggatcaaggtggagcgctacatgcaggtcgtgtttgcttttgctgccctgtgcctcaccatccccgtcgtcgtcccgcctgccaaggccagcaacaggttggacgaggggagggagggaggatgtgcagggggtggctggctcgagaggaaacatgccgtggcatggttcctgccctcgagacatgagctcgtacaatgttttccggcgcagcatgtctggtcacacatgccctacccccaccgtcctccacgctctgcagcgatagcctgtcgctggctggcaagctccacctcctggccttctgcggcttcgaggtctgcgtgggcatcttctggccctccatga

SEQ ID NO: 5439 - DNA, 957 bp, Chlorella protothecoides
  modified_base (599)..(608): a, c, t, g, unknown or other
cgacgacgcgtcgagcggggaggacgggacggggcggggcccctcgccctcgcccgcgcatgggtacagcacgcgccgagcctcgcgcgcgggggcggggccggcgccacggcgccccacgcaggcttcgtcccgacggcggtgacgtgcacgcatggtggacggcgaggtccccacatccgccgcaaggtgtgcctcgctccaaccccgaccctccacatcctcgggtgccgtcacccagtctgcttacaaggccttcagggcatgaaggaatgtgaatgttatggagacaagctgtactgccacagcgggtgggtggggcggggagacagggaggcgcacagcaggggaccacaggccgggagggggcggtggcgtgccggtgcctgggaaggtctgcctgcacattctgtggcacgcagggcagcaccccctgcgcggccgccaccagacgctggtcctcatcaaagtgggaaccggcctgcggggggaggaagggcaggcctgggtgcggggaaagcatggtgtgggcagaccttgccactggccggccagcccccatgcatggccagcaaggtacccctccaacatgggaccannnnnnnnnngggaggcgcacagcaggggaccacaggccgtgagggggcggtggcgtgccggtgcctggggaagcgaggggggcagccaaggtcccaatcccccccaggagggcgaggcggggggcattgggggccggccatgtcaccatggggtgacgggtttggaaggggaacaggggggatggtgggaagaatcgagccctccgggccctgcccgctcacaccgcggcggcctctgcctcagcagccagggaccctttctccagcttggcggcggccaccagacgctggtcctcatcaaagtgggagccggcctgcggggggaggcaagggaggcgtgggtgcggggaaaccatga

SEQ ID NO: 5440 - DNA, 1407 bp, Chlorella protothecoides
atgaacgctgtctgctcctgggatacagacccaggcgcgacatgggacaggggcacctccattcattctgttgggcgtggcacgcccccggcgcccctctcagagcagtccccgctcctcaaacaacttcttcatggcgacgcccatctgggcgggggactggctgacggtgacccccgcggcctccagcgcagcaatcttgtccccggcggtacccttcccgcccgagatgatggcgcccgcgtggcccatcctgcgccccggcggcgcggtcagccccgcgatgaagctcaccacgggcttgtcagtgccggaggcgcggaggaagtcggcggcctcttcctcggccgtgcccccaatctcgccgatcatgatgatgccctcggtctgcgggtccgccacgaaccgctccaggcagtccacgaagttggtgccgttgaaggggtcgccgccaatgcccaccaccgtgctctggcccaggccctgctgcgtggtctggaacacggcctcgtaggtgagggtgccggagcgggaaacgacgccgacgcgacccggggtgtggatgtagccgggcatgatgccgatcttgcactccccgggcttgatgatgccggggcagttgggcccgatgagacgcgacgcgctctgctggctcagtgccttcttcacgcgcaccatgtcgtgctgggggatgccctccgtgatgcagacgatgagggggatctccgcctccagcgcctccatgatggccgcggcagcaaacgggggcgggacatagatggcggtggcggtggcccccgtcgccgcccgtgcctccgccaccgtgttgaacacagggaggcccaggtgggtggtgccacccttcttaggcgtcacacccccgaccatgttggtgccgtagtcgatggcctgctgggagtggaaggtcccgttcttgcccgtgaacccctgtacgataacccgggtggtcttgtccacgaacacggcgggggtctgcggggttggagtaggggtgtgaaggggtgggatgggtgcgacacctgggatgaagcgcactgggagcggccctcgcggccatgcactctcacctcggcggggtgggatgggcgcgacacctgggctgaagggcactgggagcggccctcgcggccacgcactctcacctcggcggtgctcaggagccgggaccccagcggggccaaggcttgtgcggcaaccctgtgcgaatcaggtgggcgggattggcttgcgatgcagatgaatgtgtgcagtatgaaactcagacggatcaccgtgcgcacctctgcagacgctgcatgctgggcccgtcacgaggaggaggtccgcggggtttattggtgccaaaatgcgggaggagacggagcacacaggttactcggaccctaa

SEQ ID NO: 5441 - DNA, 312 bp, Chlorella protothecoides
atggaggccttttacatctaccttttcatggtcggtgcagtggcagcggccgtattcgagtatggaaatcggctggtgaaggtgacggctgctcccgatctggccttcagggggttcaagaccaattacctcgtggtgtactccttcatgatgggtacgaggggccggggcgaggggcattcggggccgtacgtgtacgccctgtatgagcactatggcttcacccggggcgagatcgggcgcctcttcatcgccggctttggctcctccatgatcttcggcaccgtgatggggtccctggccgataagtag

SEQ ID NO: 5442 - DNA, 1062 bp, Chlorella protothecoides
atgcacgcgccgtgcacatgtctttccaccctcgtccttccaagtcaacccccctcccaactccccaaaaggtgcctggcggcgctggcggagtgggaggagctgtactcggtgtgccgaagggagtggcagaagatggagccgcagacgcggcgcgagctggcccccgtcgccgcacacgccgcctggcagctgggcgagtggaagtgcatggaggactacgtggacgtcatcaagcaccagcaagcggggagctccgagggcgccttcctctccgccgtcctgcacgtgaagaaggaggactacaccgcggccatgggtgagcgggatttggatggtggagggatgcggagggggaggggtccctgtcaggaacaagggtctgagggaccccctcccaccagctcccaccctggcccgcgccccacctctttcatgctgccccccatgctttcttctgcagtcgacgtcgaccaggcgcgggagctgctgggcacggagctgtcggcgctggtgggcgagagctacgagcgcgcctacggcgacatggtgcgtgtgcaacagctgacggagctggaggacatcctgaccttcaagctggccgagcaggtcaccaaaggtgggcgtggcgggttgagatggggaggaggagggctgagggaggaggggcgagcgcatttcttggtgcatggggagggagggaagtcgcttgggatggaccccacgacctctccatggctgatacatgtgcatgccgagcggcatgagaggcttgcacgctccgtctgcccctgcacctcacccagcagataccgtgacacccccccttcaacattcatccaacccgcatcccaccccactctgcacaggaaaccctgccatcatgacgcacaccaagaacttcacgcaggcgatgtgggcggggcggatgcagggcgtgcaacgcaatgtggaggtctggcaggcgctgctcagcgtgcgtggcctgctgctggacatgcacgaggacaccgccacctggctcaagtttgcctccctctgccgcaagagcgggcgaaggag

SEQ ID NO: 5443 - DNA, 1383 bp, Chlorella protothecoides
  modified_base (824)..(833): a, c, t, g, unknown or other
  modified_base (1326)..(1335): a, c, t, g, unknown or other
atgggaactcgcagcatcctcctccctggctttgtcgctgtcagagatgcgcttcgttgttgccttcgtcctttatgtgctggtgggagtcggcctgcggcacgtgcggtccaccaaaggcgagtggacgcgaacctgaccccttgcatggcatgcactggttcttcaatgtgcctgcgagtcgcacggggtgcgtgcagcggccccgtgaacaacaagtccctccctagacccccgaacagctcggcactggtatgccgtgatcacgggcttcctcctcatctactacccctttgggacgggggtgctccacgccctcgtcccatcctccctcatatacctggcgatgtgcgccttccccacccactgcgggacgctggcgtggctgatcgccttcccctacctcatcatgaagtgcgaggggtggatcagggggggtcgccagatggtgtccatcaaggagggcaggctggagaggaaggcttgctggtgctcgatggccgagaggatggctcgccagccccgccaccccccccccttgtccctgcagccacgtcttccaggccagcggtctgtcatggaaggagggccagctcgacttcacgggggcccagatggtcctcaccctcaagctcgtcgccatcggcgtgtgctaccaggacggccgcacccacgcagacaaggtgggctggcaggagggcggcgtcgggtgcggcactcgatgcgtgccgctcgggcctccagaccctgccgccggtgtggtgcgcgaccagggtgtgcatggcctgcgctggccggcgactgcgcggctcgttcggggggannnnnnnnnncctccagaccctgccgccggtgtggtgcgccaccagggtgtggatggcctgcgccggccggcgactgcgcggctcgttcgggggggaggtcatcgagcctgcgctgcaagggcaaaggctccccaccccttgcatggcgcgtggaggcgcgccccatgctggaagcctctgggccctcccactccaccctttccccccaacgcacctgcccctcgccacatggccccccctccactcgcccgccgccctccccccttactccacaccgcagcacgatcgcccgtaccgggctgccatgcgcctcgatcgcctgcccagtctgctcgagtactacagctactgctttgcctcggggaacctgttggccgggcccttcttcgaggccaaggagtactttgactttatcgagcggagggtgggtggtcgggtggggtcgccgggtcgtgccatcccgggatgggggaaagaggcgctgcggagaatgtggcccagnnnnnnnnnntcgccgggtcgtgccatcccgggatgggggggagaggcgctgcggtga

SEQ ID NO: 5444 - DNA, 573 bp, Chlorella protothecoides
  modified_base (30)..(39): a, c, t, g, unknown or other
  modified_base (310)..(319): a, c, t, g, unknown or other
agctggaggccggcccgaggggcacggcannnnnnnnnngctgcgcgcgagggcacgagggcggcgcccgtgcgaccctgggaccgtgagaagctggaggccggcccgaggggcgcggcggccgggccgctggagggcgtgcgggacctgcgggagctgctccagcgcaggagcagcgacggcggtgaggccgcgaggcggggtcctggtgctggtggcgacgcggcgccagcggcgcccggcgctcatcgggtggccgatgcccgcccaccaccggcacaggggtatccaggcaggggtgctgtgctcnnnnnnnnnntgtgcattgatgcatggccctggaatcctctagaggggctcaggggtatccaggcaggggcacaggatgaacccggggagccgctgcagctggacgacctgttcaggcgcactgccgccaagcccagcctgtattggctgccactcacggccgagcaggtggcggcaaagcgcgccggggctggcaatggacaggcggcggcaatctcaggatcagaggctgctctggagaccaggaggcctctgcctgcgtag

SEQ ID NO: 5445 - DNA, 3939 bp, Chlorella protothecoides
  modified_base (308)..(317): a, c, t, g, unknown or other
  modified_base (585)..(594): a, c, t, g, unknown or other
atggcgacaggggctgccccgatcaacgtccgagagattctctccgtacgtggggccctcggggcagggtcctcctccaggcgttggttgactcgctcccaggacccgagacactcaacccccttctcccctaacccgcagctgcaaaacctgggcatccaaaatgccaacatcaccttcaccaacgtcacgctggagtcggagaagtacatttgcgtgcgggagacctcccccactaatcagctggccgccctccagtatggtgcctcgccatccgatcggccagtgcctgcgctgcgtgagccgtnnnnnnnnnntacggcatgcctcgaactggggcttctggagcacgctggtggcccatttgaccctcgaatgtttcaggccgccctccagtatggtgccccgccatccaatcggccagtgcctgcgctgcgtgagccgtggagctatagtcccttcagccagcgtcagcagtctcatgagaccatgggagctgcccgggcccttgcccttatccagcgtgcaacatcccttcccacccctcctcccttagcctccactcctcttccctgcgcaggtgannnnnnnnnntaccctcgcacactcctctccttgggtctggatcccttcccatcctcaccctcgctggcaggccctcgcccgtatccagcgtgcgacatccttcccacccctcctccctcagcctccactcctcttccctgcgcaggtgatcatcgacctgagcaaccccagctcgccccagcgccgccccatcaccgccgactcggcgctgatgaaccccggctcccagatcatcgctttgaaggccgcggtgcccggcgtgacgggggacaacctgcagatcttcgacctggcggccaaggccaagctgaagagcgtgcagttcccgcagtcggtcgtgttctggaagtgggtgagccccggccgcctgggcctggtcaccgccacctcggtctaccactgggacctggagggggacgcgccgcctgccaaggtcttcgaccgcgcggccaacctggagggcacccagatcatcacctaccgcgtggacgcggcggggaggtggtgcgtgctggtgggcatcgcgccgggcgcgcccgaccgccccgccctggtcaagggcttcatgcagctgtacagcgtggaccaggcacggagccaggcgctggaggcccacgccgcggccttcgccagcctggccctgcccggccgcgccgacccggtgccggtcatcgcctttgcccagaagacggcggcggcggggggggcggtgacctccaagctccacgtcatcgagctgggcctgcccgggaagaccagcctcaagcgcagcgcggagctcttcttcccccccgagttcgccgacgacttccccgtgtccatgcagatcggggacaagtacggcctggtctacgtcgtcaccaagctcggcctgctcttcgtctacgacctggagacggccaccgccatcttccgcacccgcatctcggccgaccccttcttcatcgctgcgcccgcgccctccaccggcggcttcgtcgccatcaaccgccgcgggcaggtgtgtgttgtggggggtcgaggggaagagtgttccagatgaaggggtgctcgccagaatgggatcgcttcagtagcatggagcagatacagcatctgcatgaaggggtggccgccagaatgggaatcgcttcagtaccatggagcagatacagcacctgcgtacaccctcagactccctcaaaccactcccccctcccccctgacacacgcccgcaggtgctggcgggcggccccgcgccggacgccatcatccccttcatcgcggggcagctgcagaatgtggagctggcgctggccctggcccaacgcggcaacctgcctggcgcggagggcctggtggtgcagtccttccagcggcagtacgcagcggggcagtaccgcgaggctgccgagaccgcggcgcggtcgccgcaggggtcgctgcgcacgcgcgagacggtggaggccttcaagcgcgtgcccgccgtcccagggcagacctcccccctcctggtctactttggaacggtgctggcgcgcgaggcgctgaacgcgtacgagagcgtggagctgggacgcctggtgctggcccagggcaagaagccgctgctggacggctggtggcgcgacggcaagctgtccgcgagcgaggagctgggcgacctcttccgcggcgcaggcgactgggacgcggcgctggccgtgtaccgcgccgcgggggcgcagggcaaggtggtggaggccctggcggccaagggcgactttgaggagctggggcgctatgcggccaccaccggctcccagcctgactacctcttcctgctgcagagcctgctccgcgactcgccggaggcggcggtgggcctggccaaggccgtggcgcgtcagcccggcccgcccctggacctcaacaccatggcggacctgttcctgcagcgcaacgcggtcaaggaggccaccgccttcctgctggacgcgctggccgacgactcgcccgcccacgccgcgctgcagaccaagctgctggagatcaacctggtgacggcgccggcggtggccgacgccatcctgggcgcgggcgggctcacgcgctacgaccgcccccgcgtcgcgcagctgtgcgagaaggcgggcctgtacgcgcgcgcgctggcgcactacaccgacctggccgacatcaagcgcgtgctgggcaacgcgcgcgccatcgaccccgccgcgctcgtggagtactttggcacgctgtccgcggagtgggcgctggactgcctgcgcgtgctgctggaggccgacccggcggccaacctggagctggtggtgcgcgtcgcgcgcgagtacagcgagcagctcaccgtggcgcgcatcgtggcgctgtttgaggccgccgggtcctgggacggcctctacttcttcctgggcggcgtgctggcggggagcgaggacccggaggtgcactacaagtacatcgaggccgcggcgcgcacgggccaggtgaaggaggtggagcgcgtgacgcgggagagctcctgctacccccccgaccgtgtcaagaccttcctcatggaggccaacctgcccgacgcgcggcccctcatcaacgtctgcgaccgccacggcttcgtccccgacctcacgctgtacctgtacaagaagtccatgctgcgctacatcgaggggtatgtgcagaaggtgtcccccgccaagacccccgccgtggtcggcgccctgctggacgccgaggccgacgaggccttcatcaccaacctggtcctctccgtgcgctcgctggtgcccgtggccgagctggtggaggcggtggagtcgcgcaaccggctcaagatgctcaacccgctgctggagcagctggtcagcgaggggtcgcgcgatcccggcgtgcacgacgccctgggcaagatcatcgtggacgccaacaccaacccggagcacttcctgaccaccaacccctactacgactcgctggtggtggggcgcttcgccgagcgccgcgacccgggcctggcctgcgtggcgtacaagcgcgggcagtgcgacgaggcgctggtggcctgcaccaacaagcacgccatgttcaagctgcaggcgcggtacgtggtggagcgcgccgacgccggcctctgggagagcgtgctggggccggagaacgccagccggcgccagctcatcgaccaggtggtgtccaccgcgctgccggagtgcaagaacccggagcaggtgtcggtggcggtcaaggccttcatgggcgccgacctgcaggcccccctcatcgagctgctggagaagatcgtgctgaacaactcgtccttcagcaacaaccacaacctgcagaacctgctcatcatcaccgccatcaag

SEQ ID NO: 5446 - DNA, 330 bp, Chlorella protothecoides
atgcactgctctatgatcactccacagggtgctggtacggcagacagcacccctgacatgctgaccctcccggagcctctcctcctgcgcctggtctgcttcctctcccccgacgacaccctgtccctcgcccagacctgccggcatctggcacgcctggcgggcgaggacctggtgtggcgccggcacttcctttaccgctggcccgatgcgggcatgcaggacgagggcgccacccccgcctggaagccttcggggtatggccgagatcaattcacccccgagcccagcgtccccgtccctgagctcggccatgtccttgcatggtag

SEQ ID NO: 5447 - DNA, 363 bp, Chlorella protothecoides
  modified_base (291)..(300): a, c, t, g, unknown or other
atgcagggagctgcccctgatctggccccggtcatcaccggcgcccaggctgttacgcaggcggctcccgtcacaacctcgagaaaggcatcgggaagcgcgcttcacgaacctgaccctgctgtcgtcccggcagtcgagcaggcgcagggtcggcgccggggacaggtcgcagcaccaccggcgacagaggcggcggggcccgagatctcttgccccgtctgccgcctgccggactatggcaggcccctgctgggctgcgatgcctgccagatgtggttccactacgannnnnnnnnncgcgcaggcggctcccgtcataacctcgagaaaggcatcgggaagcgcgttgcgcgaacctga

SEQ ID NO: 5448 - DNA, 1035 bp, Chlorella protothecoides
ccaccgcgcgctgcgcatcgagaccgcccggcgggagctggcccagcgcgccgacgcggcggcgcggcgggcgcgggacgccaaggcgctcaagggcgaggtgctgggggagcggggcggcgcgctgcgcgacgcgctgtccatgaggaacaagggtgcgtggcggagtggtcgaggcccgagggggtgggtccgagagggttgcgaacctgcgactgggacctcgggcccggcggtgcctggtcgcagcgctcgcggggtgggtcgagagggttgcgaacctgcgactgggaccctcgggcccggcggtgcctggccgcagcgctcgcgtgccgccctcaacctgggcaagtccacccgacaccgcctcacggactcgagcacagggctgctgcgggcgcacgagcgcctggcgcgggagaggaacaagctcaagggcgacgaccgacagctgcgcctggaggccctcaaggcgcacgacttcgaggcgtaccaggagatgctgcgcgcccagtccacgggcgccgcctcggcgggggagaagtacgttgccatctccaagttcctcaaggacacggaggagtacctcattcgtctggccagcaagatcgccggggtcaagctgtccgccgaggtgtccaaggccactgccgacgccatagtcaaggcccgggcgcaggtgcggccggagggggcgggcctgagcgaggaggatgtccaggcggcggcgcacgcggccgcccaggacgccgcctccaacagcgccgtgctgcgggcggcggggggcggcggcggcccctccgacgcccagtcgcactactatgagctggcgcacagcaaccgggaggccatcgccgagcagccatcgctgctccgcccgccgggcgacgccaggctgcgcgagtaccagctggtgggcctgcagtggatggtcagcctgtacaacaaccatctcaacggcattctggccgacgagatggggctgggcaagacggtgcaggcgagtgaggccgtgcaggactgtgatcgtgggtg

SEQ ID NO: 5449 - DNA, 1695 bp, Chlorella protothecoides
atggcgctgatcgcgtacctgatggagcacaagtccaactacggcccccacctgatcatcgtccccaacgcggtgctggtgaactggaagagcgagctgacgcagtggctccccggcgcgcgctgcgtctactacgtcggcacgcgggacgagcgcgcgcggcgctacgcgtcggaggtgcagagcctgcagttcaacgtcctggtcaccacctacgagttcatcatgcgcgaccgcgccaagctggccaagatcgactggcagtacatcgtcatcgacgaggcgcagcgcatgaaggaccgccagtccaagctggccaaggacctggaccgcttcacggccgcacggcgcctgctgctctccggcacccccctccagaacgacctgctggagctctggtccctgctgaacctgctgctccccgaggtgtttgacgaccgcaagatgtttgccgagtggtttggggacggcggcgcgggcgcgggcgcgggcgccggctccgaggccgactggctggagaaggagaagcgcgtggtggtcatccaccgcctgcaccagatcctggagcccttcatgctgcggcgccaggtggaggacgtggagagcaagctgccagccaaggtggcgatgacggtgcgcgtgcccatgacgccctaccagtccgccatctacgactgggtcaaggcgacggggacgctacggctggaccccagcgcgcctcaggagtacaagatgaagcggcagttcgcctcgctgaacaacaagtgcatggagctgcgcaaggtgggcgatgcctttttgctttggcgtgcttggagggtgggggtgggggttgggtgcggggtcgaccgaggcctccagcccgtggctgcccctgcctgcgcagcccatgtgtctgcgatctggcttgccatcgacatccccatgcacaccgagcccctgatcccccccccctttttgtctgcgcagctgtgcaaccacccgctgctcagctacccgccgctggactggggcctgggcgacgccatcgtgcgccagtgcggcaagctggtggtgctggaccggctgctggtcaagctggtggccacagggcaccgcgtgctgctcttcagcaccatgacccgcctgctggacctgctggaggtgtacctgcggtggcgcacgctgccgcccgcggcctgccagttgctggaggaccggcggcgtgcttcggcggcggcggtcaagcgagagggggcccaatcgggcgccggcggcgatgtgacggcgggtgctgggaccgcaggagagccggccggggccggcgcaggggcgggcggggatgctggacagccggacggtcctgcaggggccgaggagaccacaggagcccccgcctcgccgaatcccccgccaccaccgaggcggaccatgggctacctgcgcatcgacggcaccacagcgctggaggaccgggagcgcgccatccaggccttcaacgcccccgactccgacgcctttgtgttcctgctgtccatccgcgccgcggggcgcgggctcaacctgcagagcgccgacacggtggtcatctacgaccccgaccccaatcccaagaacgaggagcaggccatcgccagggggtcttcgaaagcgcaggaatcagaatggatggaggggtttggtggggctcacgcccgttttccctgccgcctctga

SEQ ID NO: 5450 - DNA, 678 bp, Chlorella protothecoides
atgctcgcaaggggggcgatcctgccactgttcctggccttcgccgtgctggcttgccccgccacggcctcagcagcagtgcaagtgactctgtacggtgagtctctgtgcccctactgcagagcctggatcctggagcaggcctcagatctatttgatcaaggcttctccagctacatcgagttccgctacgttgcctggggaaatgcccaccgaagccatgtaagcgagggaggggggcgggtctgggacatgggcctgcctcattccacgcgcggtgcccctgctactggcccggcggccccgtccttggatggaggcgctgctcatttacatgtggctgtctatggactcccccagtccgcatggtggccctggaggagcgtcgggggacgtccacagcacctccctgctggccggccggctgacaccagctctcaccgcccccatgccccccctctaccgccccacacacacgcaggatggcccccagtgccagcacggtgcggcagagtgcgcgggcaacgacctgatcaactgcgcccaggcgctgtaccccgcccaggccctgtggttcccgtacgtacggtgcctggcacgcaccggcgcgcgcgccccggtcgcgggctccgacgcctgcgcggcctccagcgggctcgcggcctcggccctgattga

SEQ ID NO: 5451 - DNA, 357 bp, Chlorella protothecoides
atgacggtgtttgtcacggtgtttgccacggccatcgccatcaccaaggaccttcccgacatcgcgggggacagggccaacaacatccagacctttgccacgcggctgggcatgcggcgcgtggcctggctcggctcggggctgctgctggccaactacgtcggcggcgcgctggccgccgccgccaaccccgtcgcgctgaatgcgcggctggtcgtgccggcgcacgccctgctggcggccgcactgacctggcagacggcgcgcatggcggagacgcaggccggcgtcaccgcctactaccgcttcgtgtggtacctgttctacgcggagtacctgctgctgcccttcatctga

SEQ ID NO: 5452 - DNA, 417 bp, Chlorella protothecoides
atgtctgccagccctggcgggcacccatcctcgccctccccccccacccccttcctggcggccttctggaggttcctgaggccacacaccatccgaggcaccctgctcgggtcgtgcgccatcacggccaaggccctggcggagaacccggccctcatcgactggggtctcctgccccgggcctgtctgggcgtgctggccctgctggccggcaacggctacatcgtgggcatcaaccaggtgtacgatgtggagatcgacgccatcaacaagccctggctgcccatcgccgctggggacctgagcctgcccgtggcgtgggcgctgtgcctgggcctggccgccggtgaggttattgattgtgtggggctgggcgtggcaagaggctgccaggcaggcaacaggagcccacaatga

SEQ ID NO: 5453 - DNA, 561 bp, Chlorella protothecoides
atggcgttcctgcagcggctcatgaactactggctgaatgaggtcctggtcaacactctggccaacagccggacgttccagaagttcgctgtgcggtccagcgcctccgtggaggagctggtgaagaagactgcggaacacaaggagcggatagcgggccagggtggcgatttcatgaaggttttccgggaagaggtgcggttccggggcaggctggcgagcaggcgatggatggcatgtacaatcccgcgggtctgtcggcgtggtgcaacccaccgcgtgaccccgtgcacatctgcttccctcacagatgaccaagggcctaagcgatctccagaagaagggcgggaagttgtagtcgacctgagagacagcttgaaacctgtccagagccgacggggacatccccagactgcgctcacacgagaccacgccacgaggtcccccctccccctccctcctaccaaccccagccctcgcagggatgtgtaccagtccgcgctccctcgtcccccgagcagcccccggggggtccagggtgccggggcccgcaggatgtaa

SEQ ID NO: 5454 - DNA, 2034 bp, Chlorella protothecoides
atggctgtggaactggcaagaacggccagtctacttcttaataagagattcgaaagccctatcgatgcatcctcgtcgcggtgggtgcaagttgtgctggaggcagacggcaaacctgcagggagtgctggggaccctaggaatgagagcaccgcctgcttcctgcggtgcatgcagtccccaccccgatcaccacatgagaagtcgacaagtgatctgagtcgactcctagcctggcttcggcttgatcagacagctggcaacctcagagatacagacattagagcagagttcaatctgatggagtgtaggatgcccagcgtctggtcaatcttgggactggcgaccgcgatcaaggtgctgctggtaccagcctataagagcacggacttcgaggactgccttgcacccaccagtgcattgaacagcagcagcgcagccgccaggtatgtgctagaggccaacctgtcggctcaactattgccatcctgccccactgcacatcgactcctcacgtcatcctgtacaaaaggcggcctcctgggcggaccccgccatgctggaggtgccgcgcctgaactacgccagccatgccacagtggcattccagcgtggaagcgtcatcgtgagcgaggtggcgctcctcgcggcggcctggtgggcctgcaggtccctgggaaggagagcacagagcttggccctggctctggtggctctgcaccccggcctcatcatggtggaccacatccacttccagtacaacggcatactgctgggtgggatggacgaggcgtggggcatggggtagaccatgggtgctggcatgatattagggatctttgttgcgtctatggcggccctgagagatgggcagcacctgctgggtgcggccctctttgctgtgctcctcaacttcaagcacatcttcctctatgccgcgccggtctactttgtcttcctgctgcgacactactgcaggtgtttgtgggaggggacatgagggatgctctggggggactggaccaggcgtcatgccaggccgcacaggatgccacaatagagcagggtgccaggggtcgctcggccccatcccgcttcctcctgctgggctgcatcgtggcagctgtgttcctactttccttgggaccctttgtcactcgtggccaggcagggcagctcgccagcaggctgttcccctttgaccggggcctggtgcacgcctactgggcccccaacttctgggcgctgtacgccgcagcagacaaggtgctggccgcggctgtacggcgcagcgggcgctggctgccccccaccgcgcggatgacaggtcgggggcttcagcaggactgggtggtgtggctgggggggcctggtggggacggcagctttcgaggtgctgccaccggtaggctccagggccacagcccttgtgaccctggtggccatggcgccctgcctcctgcacacctggcgctttcccaacccagccaggttcccgcaggctgctctgcactgcaccctggtatcattcttctttgggtgagggtcgtttgggatggttcggggtgcatggagaacctgaacgtgtaccatgtccatgagaaggccatcctcatggttctcgtgcccggtgccgtctttgtcgtgcacgaggcacatccggcgcttgcaaaccggttcttcttcctgacgacgctgggaacctactcgctcttccccctcctctacagacccgaggaatacagcatcaaggtcttgctcctcgtgctctacactgcgagcgccccccagctgctgagctggcagctgggcacgccttcccggctgcacacccttcctggcgcctacctctggggcttggtgggggtggaggcagcttctagctggatcctgccgtacctccccggcagccgactccccttcctccccctggctctggtgtcctgctactgtgccgtgggcatgggtgcggccctcatttggtcgtcattcccctatatatcgcctccagaacccaagcgtgcgcctcattga

SEQ ID NO: 5455 - DNA, 1230 bp, Chlorella protothecoides
atgccctccatcaggctcttgggtgggccccgttccggatcctactcctccttcataaggcaagctcagtcccggccaccagccccggcatcatctcgccatcctttgaccgtgcgagctttgaaggaggttcgaactcgtcgcgaggaaaatgttcctggtgatgtgtatgtcgatcacacctgtataggtgagaacgggtgggcaacccgcagcgtctcatggagatcaccaagctccattcggtgtatcaacatccttttggtagatttggtaggaatgcaaacattgaagacacaggcgttccccatgacgttcccccccaagcacaccacccccatcacggcgacgcaggttctccatccacatgccacgccagtccccggaggagacggcgcagctgatgtcctccttccccttgcccatcaccggctgccgcgacgtcttccactgcggccaccatgccgagtccacgtttggcggcgcctcctacttcatccgccgcccggacggcaacatcctggtggacagcccccgctggagcccgacgctggcggcgaggctagaggcgcttggcggggtggacaccatcttcctcacccaccgcgacgacgtgggcgaccacgcgcgttgggcggcgcgctttggcgcgaagcgcgtcctgcaccgccgggagatgaacgcgcgccagggcacagagttggtgcttgtatcactgtcgtgcttggaaagacctcgtctggcgtactccccagcccaaggccatctctctgtgcgggatcttgcccacactccccccctcactcctcctcctccacccgtgcccgcagcaaggtggagcgtcccctggatgagacaggaccctggagcctgggggaggggctcaccgtctacttgaccccggggcacaccgaaggacacgccgtcttattctacgcccctgatgccgcgttgctggccggcgaccacctgttcctgtcgcggcggctggggcggctagccatctccatcacgcacaactggtattcgctgccccgccagctggaaagcgtggcggagctggtcgacctgcccgtgcgccatgtcctgccggggcacggcaggccgatgcactttgcgagcgcaggcgagtacagggcggcggcgctggaggtcctgcgctgcgacggccagtgggacgatgggaggttgcgggcggttggtgggagaaccagggagctgcaggtctag

SEQ ID NO: 5456 - DNA, 1080 bp, Chlorella protothecoides
atggctgcagatgaagaaacccctggtgtccagttctcagctgcagtccaggttgcaagacaccgccgtgctgaaactgtcacagatcaggtattgtacaggaaaaccgggcgattcagccctttttgggttctttcaaagttcctcaaccttcaccgtgcccattggagcaccggatcttccactagtatttgcgtcatgtgcgccatcttcagatccagtgtggtgctgatgcaggtctcggttcacatccacgggcctcgtcgggtcatggaccaccctgtgtgtgctgggggagcgcagcaaagccatgcagtcgtccactggtgcgttctgagagtggaagaaagaggaggggtggagtgcatgtgtttgggaggtggcagtctccggacacctatcccctgccacactggccttcccaagttgacgagtacaagagggtccttgagcctacaccatcaacccttccattcaccccacaatcctggatcaggcagcacatacagcatctggaagctgacagacctggatcagaccacgctgtccatctttctttttagcggagcacacgacgagctgtggaagcaggcccctggcaccctgatcgccatcttcacccccaaagtgaagaatgacagggagctgtgtctgacagcaatttcaggagaccaggtgtgggtcctcggcacggcagccgagttcgggtactgcagggctcagaagaaggtatggcgcagggaggagtgcatgtacattccgaatgctcgacacgaatgtcctcttggcccttgcgatgcagaaacgagcacctcagtgggcccctccccatcccgtgccgagaatgttgccacagtgccccatcgtcttcctttcatcccctcccaggatggtcagccatgccgggtccccgtaaatatggcgcgctgccctttctgtccctaccatgttcaggtaggcattcttctggagcactgtgcacagatggtagcacaaagagagagttggggatttctcactgtatacttgggtcgcaggtctgctctgttctccagtccacccctaacggacacccccccc

SEQ ID NO: 5457 - DNA, 357 bp, Chlorella protothecoides
atgcctgggcggcttggtggggaggcaggtttgtgtccattgtatcctccatttcgctgctggctttcggctgagaatgctgcaatatgcgccaacccctctccctccccaaccccccatcctgagcaggtggacggcgaggcgtcgcagcagcccgccggcacattcaccgtttctcgccagggccaggtgcccatgctgcagcgcgtccatccggcccttgccagcgtggtcaaggcggtgacagacgtgctggacgatgctcgggaagacgaggggatcagccgcaagcagcacgctgccctttcctctgccatggccacagcgctgcaggacaagctggaccccaacaactga

SEQ ID NO: 5458 - DNA, 279 bp, Chlorella protothecoides
atgagctccgaaaccatcatcaaggccatcttggatgaggagcacagggagaagcagctgaagaagaagaggaagggccaaggtcgacacgctgcgccgcgcctctacatcaccccacacactttcacagaggggaccaggaagaatgagaagaagggcaagacgctggaggagatggagaaggaggagggtggccccgtccaggagtcgctggtgcccatggcgcagacccagcgtgccgccaaacgcaagggggccaaggacgccggtgaggtgtga

SEQ ID NO: 5459 - DNA, 441 bp, Chlorella protothecoides
atgtcgattcgacacccccgctcagacaccagcatcctggaggtgagcgagctccagcgtgccgaagaagagctggaggcccaggaggacgatggcgtgaagctggaggcgttcaacctgaaggaggagcgggccaggggccactttgatgaggcgggcaattatgtccaggacgccaagggcagcgatgaggaggaggaggaggacgcctggctcaagtctgaagaaggtgggtcgggtcgagtagagtcaggggggcaatggggtgacagacgttccgattgggaccctgcagctgtcatccctgcttgcagggagccaggatatgaaaccctctgtcgcatccatcatgtactgctccctgccaccctgccactccccgatgagcttcccatccactcacagccacggtggtgtctgaggaggtccgtcgtcggctga

SEQ ID NO: 5460 - DNA, 312 bp, Chlorella protothecoides
atgctggaggatgttgcacaactgtacaggcgagaaacagggagcgccatagtagaaacggcccacatggagctgacggagcccagccttaagcaggcggtcgactcgtgcgtgtctcagggcgcaaccaaaatcgtcgtcgcgcccttgttccttggtccgggccgtcatatccaggaggacatccccagactgacggaggaggcagcgtcagcccaccctggggtggagtgccgggttgcagggcacctgggtgttgataccttgctggtgcagctgttgaagatgagagtgcaacaggtgttgtcttga

SEQ ID NO: 5461 - DNA, 519 bp, Chlorella protothecoides
gcgatcctggctggtggtgaccgggagacccgtccagcggccccaccccgacgcgccagggcacaccaggaccttcagcaccctggccgaggcggtgcaggccagccagccggggcacaccatcctcttgcagggcggccagccccaccgcgtgagcggccagcccgtcgtgatcagacacgcgctgcgcctgctgggcagcggcggccgtgcggaagctgtggtcctgcgcggcgacccgggcctagagaccgtactgctcttccactcgctagcgcagctgctcaacctcagcgtgcacagcgtgcgcggcgcctgtctcatgcacctggccggcacgctgcgggtcgggggctgcatcctggagagctctgcggcggggctgccccacctcgtgtctcagatcgctctggcgggggacgcagctgagaggcggaggctgcactttgacgagactcgcctcctggtgagggagttgggttttgattcattggtaccgcaagccaggaccgaaggatg

SEQ ID NO: 5462 - DNA, 600 bp, Chlorella protothecoides
atggcggcggcccagccgctcaccgccgcccaggtcgcgcggctgcagcatgaagcagcggcgctgctggagccgggggagagcgtggctgccggcctgagacgcttgggtgtcggcctggggcgccggcccgggaagcaggcggccaaagcggcgcaggcggccggtgcgggggcggtgcccgacccggacagtgccgccaagttcgagcggctgaccgcgctgggcgtatcgctgatggaggcgggggagacggatgtctacacccagtccaaggtgggcgacgcatggggttgtgcgccgtgtgaggtctcctggggtggcgagcttgcatcgcgtcaggagaaccctcgacgctggccagtcgcacttctgaaacacgccaggtgcgagaaccccaggcacccgcgggcactcaacctccacttggagtactttgcgcgtgcagcggccgtatacatcgatgccgacgaggggccctccagcctttttggcggctctgcgcccgccaccaccgcctacgacgacgccgatgaggacatgtttgggggagggtccggtgagtctgcattcgggcgtctgggaggatgctgcgcctga

SEQ ID NO: 5463 - DNA, 339 bp, Chlorella protothecoides
atgcaggccagtgccgcccacccaaccgtcgtcgatgttgtggacatgctactcgagttttgggaggcggcggtgcatgcaatcctggcggcaaggggcctgtatcgaccggatctcttcacacgggagaggctgtacgggctggcggtgcagcgggccaggcacccaggcctctgcgcctacatcgcgaacgccctccaggagctcagggtaatgctgctgaggagttgcgggttgaccgtggggatgctgagtcctgtcgacattgtcggtggggtgcagagtatgcatgcgggtggatgcccatgcaccctcctcaccccacccaggcaccgctga

SEQ ID NO: 5464 - DNA, 714 bp, Chlorella protothecoides
atgatgcaggaagcatctgtggcagcagatgatagcctgcggcccggccccgtgcctgcggaggagcccggatcacccgatggcgtgagggcggtggcgtcagacaaggccgaggatgtccccgacgacaaggattttttcagctgcaacatttgctacgaggtgggtcatgtacggcgggtttctcccctgggtgtgcatgccaacccggaattctcgctcctcacctggccttgtgatctcactaccggccccgtcgcggcccccaccgcccagacggccgtgaaccccgtggtgactctgtgtggccacctctactgctggccgtgcctgtaccgctggctccaggtgcagcgccactcccacacctgccccgtctgcaaggcaggcgtggacgaaagcaaggtggtgcccatctacggccgcggccgggagggtgtggacccccgcacccagacccagccccgcgagcctaccaaggccatcccctccagacccctgggccagcgcacaccccccgtggtccgtgccgcggctgccgaggcccagcaggcgcagcacggcatgggtctcatgcccgcgctcttcggcctgcagcccggggccggggggggcagcgagcccctgacccaggagcagcagcaccaggccttcctgtcccgcctgctcctcatgctgggctcctttgtgatcatgtgcctccttctcttttga

SEQ ID NO: 5465 - DNA, 435 bp, Chlorella protothecoides
atgggacgggtggcttcgccggcacctcgcacatctgttccccctgttctccgagcttgcaccttcacccgcaacccagacacggagggagctggaggtagaggcgatgcacagagggaaggcgcacggaagggaggcgggcaagccggcgaggcggcgggggagcccaatcgagctgaccacccctcttcacgctcgaagccggcggcagaggcgtcggccgctgcgcactatgcggcatggcccgtcaaggagctcaggcgcttcctcaccgaacgagggcaggaccccaggggcatcgtcgagaaggatgagctggtggcgcgtgtggccgctgcagctgctgagatggcggctgcggtccccacaccaccacagggctatgtttacgaccctgcctccaagttctggtacagcgctgcgtcaggtgactag

SEQ ID NO: 5466 - DNA, 594 bp, Chlorella protothecoides
atgcgggagggctaccccaacctgttcgggtcgcagctggggaacaagctgctctacacctggctcggcgcccagcacatgctgtccatccccggttcggacctctccgacctggtccaggtcgaggccgacggcaagccgctggagctgccggccggtatccagggcctcatgctgctcaacatcaactccttcatgggcggtgtggacctgtgggccacctcatccgaggctggtctggagcagaccctgcagccccagcgcctctgggatggcaaactggaggcgagtggagggaagggaggatgggagggcgtgctccctcacacgaggctgccgggtttggagtccagacaggacgtgatctggcgggcttgcaggagcaacgacggcatcctcccccccaaccccttccacccatccccgccccactccaagcagctggctgcggtgtttggcatctggcacctgggcaagctgcagatcggactggacagcgccatcaggctgtgccagtgctcggagctgagcatcaccctgaccaagtccatgcccatgcaggtgccaggcctggggcactggcctcgtagttga

SEQ ID NO: 5467 - DNA, 744 bp, Chlorella protothecoides
atgctctcctgccatcctgggcccaacgctcgcccacctcccaggattcttgtccctctcagcagtccgaaggctgaaagtgaagcgccgtcagcttcagacccacagaccttcctgcttgcacaggcaagccctgtgcagcagtccccaatccatctttgctgcccccgcatccatccgctgttcctcaggggccatgccaagtccagcttccgtgctgcccaggcgctggaagccatgcaggacccacgagcggctgtggtgtcgctgagggaatgcctgtccagacagcctggcagcgaccccgccaaggcactgctacgacgactgcaagcccagctgtcagtgcaatgccaggcacctggtgccgacgagcttcgaagggctgcctgcgtcacccccccaacaggatgggactggcgctacatgccctcacaggacggctgttcccagaatctcatgctcatgttgcatgggctgggcgacagtccagagccctatgcgtcactggcccagagcctgaagatcccccaggtgcagctctggatcattgctcaaggggagaggggtgcgttggttgaaggaagcggcaccgacctgggaccgggatctccgcttgcaaccccatctgcactctgcattcccagacagacttcttggccatcaggggaccactcgctgtccctttcacggagaacggacggtgctggtatgatgcattcgacgccgacttcgagatcttga

SEQ ID NO: 5468 - DNA, 558 bp, Chlorella protothecoides
atgcaggcggtgcgacctcctgtcccatgtcgcgtaagcccgtcatggagggctcgacttcgggaaaccctgccaacattcgcttggaggttgttatccccctatggctgcacgtctcggactcggaaaggtgagctccaggcctcgccggacacagcacgccgtagctatcccgggactgtcaccagatgccacacatcccttgctactgggtccgacaggtacctgctgctggaggatccagagacgggggatgtgctcatgccactcatctacatgaaggccctgctggaggcgaattactcccgcaagctggcttccctgaagcaccgtgtcgttacttgtgagcagggagggtgttgggcaggcttggatcccagtgggcctttgagtcccctcacaatgtcaaagttgtggttcgcaaggagcttggtgaagagaacaccccccagggaatggatggcacttgctgttgagagccagatgcacatgaccatggttgcgtcacgcttccagctggcgaatcgcgcgtttgccggagccctggcagcgccatga

SEQ ID NO: 5469 - DNA, 657 bp, Chlorella protothecoides
atgctgcggtccttgggtcttttcaaggccttgcacaggtgtggcatggggttggagcgcatacggcggggctcgcgctgcccaatcccgcccccaaccccaacccctcctggacacactgcatgcgcacgtggtgtgtgggcatatggtgccggcgtgcggcgggtcctgctccaggcatgtcctcaaacaacacccccctcccaccgccgctgcagggccatgaagcagtctacttacttccccctgcttcgaccaccccccgatgacttcatggaggagctggatgctgagctagccaaggaatcggtccaaccccctcttttccacggaccccgcaccatcgaggcctcggcatcaaagtacatgttcatgttccaggtggggttgcgggagcgggagacgaggtcgaggagggcggcgaggcgcccacctggatgcccagcgcccctgcctggcggcccggggggtggaacggcttgcagtgcgacgccaccatcccaggacagcgacacaccctactcccctgcaggaggacgaggagcaaaaggcgccggacaccaagcggcactgcacccggaccggcacaccgctggtgagggcgcggtgggtggcacagatggcgccctcggtgccggcgtggcccatgtcggatag

SEQ ID NO: 5470 - DNA, 729 bp, Chlorella protothecoides
  modified_base (134)..(143): a, c, t, g, unknown or other
  modified_base (404)..(413): a, c, t, g, unknown or other
  modified_base (649)..(658): a, c, t, g, unknown or other
atgctggtgggtgggacaggcgcagcctggtggtggtgggaggagggctgggtgtggcgcatgtcatcggtgtgcctcgtccaccgctcgattccacccacgtccatgcagacacatggctctgcgctcgcatnnnnnnnnnngtgggtgggacaggcgcagcctggtggtgggaggaggagggttgggtgtggcgcatgtcattggtgtgcctcgtccaccgctcgattctacccatgttcatgcagacacatagctctgcgctcgcacccctccccacccgtgtcctttcaaactccattgtccacagggctgcgggtcgctgctggtgcgcagggtggctgtccaggtgctgacatcgctggaggccctggtgcgggccggcattgtgcactgcgacatannnnnnnnnnggtgcgcagggtggctgtccaggtgctgacgtcgctggaggccctggtgcgggccggcatcgtgcactgcgatatcaagcccgagaacatcatgctggtggatagaaagcgcagcgacgtcaaggtaggggctccgggacggccatgccgcgtggacatccatcgccggccggccactgggtgcccgtatagggatttgcttttggatgacaatgttcccttcccgaacgccactnnnnnnnnnnaaggtaggggctccgggacggccatgccgcatggacatccatcgccggccggccattgcgtgcccgaatag

SEQ ID NO: 5471 - DNA, 693 bp, Chlorella protothecoides
atggtgagcctctacgacagtttggacaccgagattgaacatgcagcctggcccttcagagtccaagttcctgccctgctgatccctcctctgcaggccagcagcgcagggaagcagcggattgctggcctggagtctgtgtgcacctccctccgagcgctgattgttcggcacctgtttgagaaaggtgcttggcaccccagccaatgccacgtgctcggcttttctcagggtggcacagtggccctggagctgacgagactccttgagccggggctcggtctagggagctgtgttgcggtttcggctggcctccttccggagtggctgcatgcccacagcaaatccacagaagtgcccagggagcgatcagagcagggggaaggcgtgtcgagggtgatgcttacctacgatccatgtgaccatgttgtgccggagagggaggtgctggccacaaaggcctacctggaatcaagacctggacggtatgaggtccaggcgcgccctttttccggccgcggacacaagttctgggcgagcagggaggagggcctggccatcgtggagttctggagccaggcgctgagctggaggccacctggcagtgtgagcgacgctgacagcaccttcgtggagatcagacccggcaccctccaagatttagggcccaatgcctggcacgggcccttgtag

SEQ ID NO: 5472 - DNA, 615 bp, Chlorella protothecoides
atgacggagacggggatgatcctgggcaaccccctgtgcggcgagcggcgagtcgggacgactggtcgaccaggacaacaaaggtgtgggggtgcctttgtgcggagggccgctgggcgcgcgctcgctgctcaccgagggcatggcagcaccagcgcgcttttgctgctgccggatggcgctgcgcttgctgcctggctcgcggaaaccctgtgcacggtgcatcgcttgggctggggttatgggcgagcatgtgctctgggcgatccacagcgacccaccgccattgcctcgccccatacagttgggaaggagggcgaaatccgcgtgaggggtgcgcagctgttcaaggagtactggcgcaaccctgaggccaccagggatgcctacgatgatgagggctactttcaaactggcgaccaggcggtcgtggagggcgacccgccgtactacaggatgctggggcgaagcagcgtggacatcatcaagcatggcgggtataaggtgagtccggcgccggaagcttcacggagcagcagggtgggatccggtggtgcaggcggacgatgtggcactgaggcctaccaccaggctctgcccctccatgccctgtaa

SEQ ID NO: 5473 - DNA, 855 bp, Chlorella protothecoides
atgggatcctcccacctcttaccacccccctctccatgccccctccgcagggagctgaagtacgtcctgaacgactcgggcgccagcgcaatcctggcctctccaagccactttgagcgcatggcagacctggggaaggccctggggaccacagtcgtccccgtgggtcgaccactgactcatgggagcaggcctcagcaagggtcacagggcctcaaacacctgctggacaatgttgcgccggaagatagtgcgctcatgatttacaccagtggtaccactggcaggcccaaaggggtggtgcacacccatcggggtctgcacgctcagacgagcgccctcatcgatgcctgggggtggcaggccgaggaccacatactgcacaccctccccctgcaccacgtgcatggcatcgtcgtcgccatgctgtgtggcctgcaggccggggccgcagtcgagtttatgccgcgcttctcgccatcacgagtctgggagcgtgtccaggtgcgtgtggcggcctttgggcggaaaccacacgcacatgcatcgaaggagctccgtggcgagaagtctgcgagagcggtcttttgtcccgatctgcgctgggatgggagggtggctgaggcgaagcgatccagcgccgacccggtcagcatcttcatgggggtgcccaccatgtatgcgttcctcatcaatgcctacgagggcgccccggccacgagccaggggggaatgcgcgaagcagcccggagactgcgcctgtggacctgtgggtctgcggcgtgccccaagcccaccctcgcggcctgggcagagatatcaggtgggggcgcgcgctgtggtggtggcagttga

SEQ ID NO: 5474 - DNA, 525 bp, Chlorella protothecoides
atgccaggggaggatgagaaggagcagctggcatgtatcatggaggtgctgggcaaaccgcccagcgacattgccctgtactctgcacgggcgcccatattcttcgaccccggtgagggcggtggtcgacaggatggtgcatccaagggcgggctggtgcaggggggtacacctgggcggcttgggactggtgtgttgactgtggcctcccacgtcgatggcttccagaggcgcccccaatccccccccctccccatctcccgagcaatcaatccttgcgtgatcacccccgccctcccctgcctcggcccccgccccgcagagagcggcgagccgcggagcaccacgctgctggggaaggacacgctgcaccgccccggcagcgtcacgctgacgcgcgcgctgggcggcgtcgtgggccgggacgcgagcttcgtgcgcttcgtcgcggcctgcctgcgctggcgcccggaggagcggctgacccccgccgaggcgctgcggcacgagtggatcgcgggctga

SEQ ID NO: 5475 - DNA, 2982 bp, Chlorella protothecoides
  modified_base (665)..(674): a, c, t, g, unknown or other
  modified_base (1709)..(1718): a, c, t, g, unknown or other
  modified_base (2568)..(2577): a, c, t, g, unknown or other
atgcacccggccttcagcagcgcagctggtactgtgcattcgcagcgacgtcctaatgggcttcacatgcgagtgcacagcagcaagcatgcctcgaagtctacagcggtggagaaggtaagcgtggtcgccgggcgctgctcactgccagctcccaattcgcgatctcagcccaccccgtcccccgaacccaatgtgaagatggaggccatggttcatgagtacttccaaagagtgctcacgcgagccgatggggacaccgccagccggatcctgcatcccagcgtggagcatcgagacatggtccgagacatcggctaccagggggtgagggaagtcttggagtacgttcaccaagtgaagaagtcctaccccgacctttgggtggaagccacggaatttgggcctgccgaaggcggccaggcaatctttgcagcttttgagggactggccaccgagaagacgccccttttcaaagggatcgatctcttccgattcaatgatgacatcacccgcatcacagaagtggaggcaccttgcgcacgcctccccttcacacagtgtaccggagcaactggcagggagccaagggtcaccaagaaaggaagaaagctgttgccaacgggtccaacggcaaccccgctcccaactgaatgcacatcctnnnnnnnnnnaggtttcagagaccacctggaatacttaaatgatcggtgcgctgctgatatgacagctgcaccactagcgctcactagcaatcggagccggtcaggtgtcgcatctcggcgacatcgcattcgataccgacaccaatggtcatgcaaaggcacgcctgtcggagctccagtcacaattctcacacccatggcgacattcaagcgcatcgtacctccttccacgttgtactctggtctctcggcatggggagcactgtccgcccccagagcgtgcagcgtcaggagcgtgcactggaacgggggcgtgccccttcggaggtccagagggtgcgatcaacccaaaccacataaacagggtgtttcagttagggcctacaagccaactgacaagctgcaggactggcgagtgcagcaggtacggtcggggtgggacaactcggggctcctcctggagaagttggggcttcacctcccctttcgcctgtgcgagtggttgacagatgaagttctaagggcacatcaaccccgtttacccctccaccgatgccgcattgcagatggtggaccacgtgaagaaggatggcaagggctcagcctgggtgggatggtgatcggccgcagcgctgcccccattcccccatcgcacccccacaaatcccctggaattgcttggcaggatccagcacaccctactgtgggagtgcatgggatgcagcactaccttcacgacctcaggacagccttccctgacttcacaatagagatcgaccagattgccacctgcgacatgaactccctgatggtgcagtacagcgggactgcgacggggctgggcgaataccattcgcacaagccctcccaccatgtctcggccttctccgggatcaatttggttcgcttcaatcacgaccgatccaagatagtggagatccagggcatgtgtggccattgcattgtgaacacttccccggcctccctgggcaccttctgctcctccgctcacaagtccaaaccccacccacggctgagacagtnnnnnnnnnnggtgttgccattgcattgtgaacagttccccggcctctctgggcaccttctgctcctccgctcacgagtccaaaccccacccacggctgagacagtgtatcggagtgcctttgctgaggaccgactggagctgggggagagggagctgcatggggagggaggcttccgggagctccgcctcaggcgcctcggcacctccccctgtgccgccctgggcagtggtgttgaaccttggccaaggtcccaaaacaagcgtccggcggggcaggccaacaggatactcacagccaagagcacgggacaggtgcctgtgggtgcagcccatcttgtggttcctcaacgtcacctaaggtccggccccggtctgccgccccgggccctggccacgcccccgcccccgcccccggcccaggctgtgcatggactgctggggctgctgctggcgaggcacatgcggcccgcgctgaccaggcgacccgccgtgctcgtggccggggcctcgcttgactccttgaggggttccgcccctcccgccaccatagttccggggcggcgtgggggcatacggcgcggtcggtccctgcggccggccggcgccgccgccgcgatgagcggcgtgtgccgaccgtgcgccggccagcatgcccgccaccgtcctcaccgcatctgtgcagaggagagggggagggagggaagacgcctctccctccggaccgcccagccccctcacgcccctaaacccctgtgctcgcacccgtgtgctcggggctcaggctacccctcgcatcctccaccgtgcactgaaaggcgccggccagccgcgcgcggagcctggccagcggcgccaccnnnnnnnnnngcccctcgcatcctgcaccgtgcactgaaaagcgccggccagtcgcgcgcggagcctggccagcggcgccaccaggccggggtcgacgcggaatctgagccactcgtccatcaccaggcaggccgccgtggggcgcgtggcccggcgaccaaccccgtcgtcaggctcgccctcgctgtcctcgtcctcgctttcctcctgcttcgccagctgcaccgaggcggccaccagcagcagggccagggccggcacctcggagcacgccttgacgtctgcaagggagcaaggatgggaggtgtggcgagggcaggcaggggccgggctgggacccaagcgctgcgctgcagcacaagggcactgcagtcgagggggagtcccgcctttgccgctgccttgggcatatga

SEQ ID NO: 5476 - DNA, 186 bp, Chlorella protothecoides
atggcggcggcggggagggggcgcctggagaccctgcgcctgctgctggcgcatggcgccgacgtgactgcgcgctcccaggacggctcctcggcggcgggctgggccaggatgtttggccacgccgacgtggcggccgagctggagcagcacgagcagcaggtgaacgagggagatcacatctga

SEQ ID NO: 5477 - DNA, 531 bp, Chlorella protothecoides
atggtgcgcgtgccaggcttcacacatccggtggaggacttttacctggaggaggtactgcgcctggtgcagtaccaggtcccccgcgaggcacagggccagcgcgggggccagcagcacgcctggcacaaggcgaggcccggcaggggtctggggctgggcaccgcgcacgcgcaggatccctggacggctcgtggcggcaagaggatggatctgctccctgtgcggtgctttgtccagggcctctgcctcctgtgcgtcgtcagtgtctgtcacgaggccacaccccatccgcagggatgttcatcctcgcatcgaatcaatcatccactcttcgtcccacctcagcaggtctccagggcgcagcgcgctgctgtgcaggcggcggtggaggctgcgttcaaggacgacagcgacgccgccttcgagcacctgctgagcacgctgggcctgggcatggacggggatggcgccgtgtccgctcatgttctggacgtccagcacgaggccacaggtgggagggcagggtga

SEQ ID NO: 5478 - DNA, 1332 bp, Chlorella protothecoides
atggtcctcataggcaccgccaccctcaccgggtctcggtacggcaacctgaaccaggactttgtggtgagtgcctgggagcggcgggtcgggggcacgggccgcggccggaatatacccgcaatgggagttggcgcgtgggaggcgaacagcatgagcatgaactgttttttaccgggcaggtgcagatccgggctgcctgagatgtcgcccgcccccattacttctcatggattggtgcatgtcagggtgcactcgggcattcgagcatcctggagcacatgtgctccacaccccggcttagattccatcccaccccgccccgatcccgccagtcacccccttccgttctcccccctctccaaccctcctccttcccctttgcaggtggtggagcagctgctgaccgcgcggcagatgaaggccctgaagctgccgcagtgctacgtggcggccgtgctggacgggcacgggatgctgggcgaggacgcctcgcgcgaggcggggcgcgccatcgccgcctcgctccgcgccgcgcccgcgctgcacacgcgcggtctggcggcgctgtccgacgcggaggtggaggcgctgctgggcgcggccttccaggcggggcacaaggccgcgctgggcattgccgcacacgcgccgggggtgtacacctacccgcgcggcgcgcgcggcgcgcagacctacgtgctcaagtccctggacggcggggacaaggcgtacatcgacccccacctcggcgcgcgcatcctggagtacggcaccaccgccacggtggcgctggtgcagggccgcgcgctggcgctggccaacgtgggcgacagcctggcggtcgtggggcgcgaggagggcggcgcctaccacgtggacctggtgtccacgcgccactacggcgccgacccgggggagcgcgcgcggctggcggccgaggtgggcgacgccgtggcggtggagagcgaggacgggtacatcagcgtgcgggaggggcgcatgcgcggctaccagctggccatgacgcgcgcgctggggcaccgcctgctcagcaagctcggcgtgtcgcaggccccctccgtggtgcggcgcacgctggggccggacgacctctgcctcatcctggcctccgacggcgtgtgggaggtgttctccccctccgaggccgtcctcacgctgtgcgaccacctggccgcggggcactccgcgccggaggccgcgctggacctcgtacgcaccgcggtggaggtcagcgacggcaccaacgtggacatcggggcggacaacaccaccgccgccgtgtttgtcttcgacgacctcctggactga

SEQ ID NO: 5479 - DNA, 348 bp, Chlorella protothecoides
atgggggaaggcagtcctctggcgacgcgattcccgctagacacaggtaatcaccccgcgtctcgtctcacttcacgctgccaggcagccgccgcggcagccatcagtcagacggcgctcgccgtcgcccagtaccagtccgagaccgacatcgatgaggtggacctcgacctcatcctgcggctgctccagtacatctgtggggaagggccgttcagcaacccacaagcccaaaaggatgcccagcccggggccgtgctcatctttcttcctggctgggacgagatctcacggctcaaggaactcctggagcgcgatcaggccttccgccggacccacagcgggtga

SEQ ID NO: 5480 - DNA, 243 bp, Chlorella protothecoides
atggccatggtggatgggatgaggggccagctggcctcggagctccagcgccttggattcatcagggacgtgggggaggcgtccagctccgccgccgacctcgggctggtccgtgccgtcctggcagcgggcctgtaccccatggtggggcggctcctgccgcccacctccggccgtgccatggtgatgacgagacgaggcgaaaaggtccgcatccaccctagctccgtcaatgccaagtga

SEQ ID NO: 5481 - DNA, 585 bp, Chlorella protothecoides
atggccgcgcatcgcgcggagctgctggcggcggtggccgcacaccgcgtggtcctggtcagcggcgagacggggtgtggcaagaccacgcaggtgccgcagtacctgctggaggacgcgtgggcggcggggcgcggctgccacgtgctctgcacccagccccgccgcatctccgccgtgtcctgcgcggagcgcatcgccgcggagcgcggcgaggcccccggggtcaacgtcgggtacaacatccggctggagagctgcggcgggcgcgacgcctcgctcctcttcgccaccaacggcgtcctgctgcgcatgctgtcctccggcgccgacgccctggcccacgtcacgcacctggtcatggacgagatccacgagcgcgaccgcttcgcagactttgcgctcatcctcgtccgcgacgtgctgcccgccaatcccaacctccgcgtcgtcctcatgtccgccaccctgcacgccgacctcttctcaggcgcgtgtcgtgatgctgggaggggtctgggtttggtcccggaatgtgtccgcgaggggcccctgtcccccacccagggccaggcctgcctgtga

SEQ ID NO: 5482 - DNA, 723 bp, Chlorella protothecoides
atgtttggtgctattgctggcggtattgcttctgctcttgctggtggcgccatgtctaaattgtttggaggcggtcaaaaagccgcctccggtggcattcaaggtgatgtgcttgctaccgataacaatactgtaggcatgggtgatgctggtattaaatctgccattcaaggctctaatgttcctaaccctgatgaggccgtccctagttttgtttctggtgctatggctaaagctggtaaaggacttcttgaaggtacgttgcaggctggcacttctgccgtttctgataagttgcttgatttggttggacttggtggcaagtctgccgctgataaaggaaaggatactcgtgattatcttgctgctgcatttcctgagcttaatgcttgggagcgtgctggtgctgatgcttcctctgctggtatggttgacgccggatttgagaatcaaaaagagcttactaaaatgcaactggacaatcagaaagagattgccgagatgcaaaatgagactcaaaaagagattgctggcattcagtcggcgacttcacgccagaatacgaaagaccaggtatatgcacaaaatgagatgcttgcttatcaacagaaggagtctactgctcgcgttgcgtctattatggaaaacaccaatctttccaagcaacagcaggtttccgagattatgcgccaaatgcttactcaagctcaaacggctggtcag

SEQ ID NO: 5483 - DNA, 393 bp, Chlorella protothecoides
  modified_base (327)..(336): a, c, t, g, unknown or other
atgccgtcccccagccagcagacgctgctgatggcgccgctggaggccgcgtgcggcgagaacctggcgcggtggcaggcgctgctgccctgcggcgtgcgcgccgggctcgcggccgccctggcccccgtcgcccgcgttactggggcggccacctggcgctcatacgtactcgctttgcagagtgacggcgccggcggcgcagtcatggacctggtgctgcacctggtcgggccggaggcggggctccaggcgctggcggagaccaggacgcgggcctgcccggcggcgacgagctctcctgcactggggcctggggtgcggggnnnnnnnnnntgcccgcgtcaccggggcggccacctggcggtcatatgtgctcgctttgcagagtga

SEQ ID NO: 5484 - DNA, 1323 bp, Chlorella protothecoides
  modified_base (431)..(440): a, c, t, g, unknown or other
atggagctggtgctgcacctggtcgggccggaggcggggctccaggcgctggcggaaactgggacgcgggcctgcccggcggcggcgacgaactctcctgcactggggcctggggtgcgggggcctcctctgctcgctccaaattttgtgaccacagctgcacgcgtcgaggcctggagcttcgtcacccacccctcacccacctcggggcggctggcggcgacggtgcgcgccgttggaggggcgctggggccggggcgcctgcacgtcgtgcagctcgtgccgcgcgccctgcgtgtggttgatgcgcagacgaccctgctggacccgcgcccgggcttgcacacgctgtgggagcggcacgagacggacgaggtatcaggcgatgcattgttggaggtggaggtggaggtgccggcggggatggcggnnnnnnnnnntacgctgtgggagcgacacgagacggacgaggtatcaggcgacgcattgttggagttggaggtggaggtgccggcggggatggcggcttcaacccacggcaccgccacgcccctcctccgcctcgactgctggttcgaccgcttcattctgcccgtgggggactaccctgccgacgcctcgcgtggcatcgccctgcctggggccatcgtcacgtggacgccccatgtggacggcgctccgtgcgccgacagcatctgcagcgctgcggcccaccaggtcagcgccggtcacgcgctggtcgccctgcccatcccggacttcagcatgcccttcaacgtcgcgagcttcactgccctcgccctctccctcatcttcgcttccgtcctgtctgtgctcctccggtgggtgctgagcacaggagtggggggtggtgacaggggcaaattaatccccgtggtggcatctgaggtactccgtggctgcacggcaggcatgcgcacatctccatctactgcaaacagtgtgtccggacgatgcagcgggcagcccggcaacagaccctttagggcagggagtggcaaaggtcctggcccggaagctggccctggccctgctgctggccggcgtgctcatcactgcattcgaccccggggccctggagggcgtcctgcgtggatggacctgggcctgagcgtgcagtgtccgagccacaggggtacatccactcgagaaaggtcactcggtgagacttggtccactcagcggcaagtttaccagcttcatgtccacctcgcaccaccaacgagtcatgcaagctgcagcattgttacaaaaggctctgagaccagggtgtgcagcatggaccgctcgcaatcagcttga

SEQ ID NO: 5485 - DNA, 324 bp, Chlorella protothecoides
atgttctttgtcaccggcagtgtcgatgagaatgagatcattctgcacaatgtgctgactggatttgttgaggccattgtcctcctgctcaggtatgagtgcagagcaagcggtgatcagatgaccctggtcgctcagcagttgcacgtagtattcgcatcctcagccatcatcaaccctgcctgctccgccaggaatgccgtggagaagaagacggtccttgagaacctggacctcatcctcctcgccatggatgaaatcatcgagggaggggaacgcgagggccagcgctcctggcaggccacctggtgtgcacctttatga

SEQ ID NO: 5486 - DNA, 390 bp, Chlorella protothecoides
  modified_base (283)..(292): a, c, t, g, unknown or other
atgaacgacatcatcgatgtggatcccacgctccctgtcgtcaaaaatgtcttgctcatggataatgagggcaagcgcattgccgtgaactattattcatcagagtgggccactgtccagcaacaagctgcctatgagaaatctctctttgccaagacatcccgcacaaatgctcgaggagaagccgagatcatcacctttgacaacgtggtggtcgtgtacaagtttgtgggcgacctcatgttcttcgtcaccggcagcgtggatgagaatgagatcatcnnnnnnnnnntcccgcacaaatgctcgaggagaaggtgcgctgtggtgctgatcagccctgttgaggacattttgttagggcttaccggctggcagagggtttcctga

SEQ ID NO: 5487 - DNA, 690 bp, Chlorella protothecoides
  modified_base (184)..(193): a, c, t, g, unknown or other
atgccgattcattgctgcttgttggtacccggagggctgcgacattcgaattgcgtgtcggtggggactgtcgaatgccatctcggtgagccctggggatgctcacgtccgacccgggccccccgcgcgacgcgctgcaggtaccagggtcacgtgagcgcagccctcgtcctgggcggcgtgnnnnnnnnnnagaattgcttgtcggtggggactgtcgtatgccatctcggtgaggcccggggatgctcacgtccgactcggcccctccacgcgacgcgctgcaggtaccagggtcatgtgagcgcagccctcgtcctgggcggcgtggacttcaagggcccccacctctttactacctgccgtcaccgcaccccccccccatccccccctctacagatctacccccacggctccacagactcgctgccgtactgcaccatgggctctggctccctgaatgccatgtcggtctttgagtcggggttcagggatgacatggaccaagcctcggcggtggagctcgtcaccagggccattcggtgggtgctgcaggggttgtgtggtgtcaagtgcgcttttcagtggtgccaagggcgacgggtgtatagcccaggagccaggcacaggtcctggtctgccaggcggggcaggctgcctggatcccttttggtccccgaaatactgtga

SEQ ID NO: 5488 - DNA, 816 bp, Chlorella protothecoides
atggtcctcaagaagatcggggaggagctggaggaggagtttgctgcggtggtggacttcctcgggcgggagcagggcttgcttgtcgtcgtggaagattcctgccatgagtgcctggtgcgccagggcctgggcaagtggatcctgcccttccaccccagcgaggcctttggcctgcaccgggcggtggacttcatcgtcagcctggggggcgatggcctgattctgcacgctgcgcatctgtttggcaccaccatcccgcctatcatctccttcaagctgggctccctggggttcctcacctgccacgaccaccgcgactaccgccgacacttgcacgacgtcatccatggctgcacagggtgtggccagagcagggggccctgctattgggctgtgggtgagaagcaagagctgctcgggagtggactctggtatctgttccgtgaaaggaggggggtttgcagcagcgcccacacttttctggcggtacattgcccccaccccttcacctcccaggagctcaccgagtgcggccccatcaagaactcgtcgggcgtggcgctgcagggcatccccatcaccctgcgcatgcgcctgacctgcagcgtggaccgcgcggatgtcggcgaggggccgccccccagcgaagactgcgtggaggtgctgaacgaggtggtgctgagtcggggcgccaacccctacctgtgcaacatcgaggtgtatgaacgcgacaactacatcacccaggtgtgcagaggggtgtggcggaggggaggggagggggagcctgctgccatggaggtgttggcctga

SEQ ID NO: 5489 - DNA, 690 bp, Chlorella protothecoides
atgattgaggcggtggagaaccacatgccccaggtggtgatcgtggacgagatcgggacggcggcggaggcgctggcctgccgcaccatcgcggagcggggggtcatgctggtggccaccgcgcacgggcagacgctgggcaacctgatcaagaatccgacgctgagcgacttggtggggggcgtgaccagcgtgaccctgggcgacgacgaggcgcgggcgcgggggagccagaagtcggtgctggagcgctgcgcgcccgccaccttccccgtggtgatcgagatgcgcgagcgagcgcgctgggtaacgcactgggtggaggagagcgtggactgcctgctggcggggcgcacgcccatggtgcagctgcgcacgcgcgacgcgcaggcgggcggcgtcgtggtcgagcgcgcacgctacgacgcaggggatggtctgacgggggattccgggccgaacccgctggcgcaggggggcccagcctccctgcgtcccggcgcgggcgccggcggggcctttgacgccatgtttggggcgggcgtcgcccggaacgggctgcctcgtacggcgggcgtcggggcggtggaggagagcagggcgccggatccctttgcgtgggccacgcgcctgcgggaggtgcccgacgaggtgagcaggggctgtgggaggggaaggtatgggtcgtga

SEQ ID NO: 5490 - DNA, 732 bp, Chlorella protothecoides
atgactgcagagagcctggtggacgaggatggatcggtgatcgtgcgtgatgacctggaggagctgctcaaggtgctcccccccgacctccggggcgggctgtgccagcacccccaccgcgcctccctgctggaggtggtgctggacctgggtcgccgccccgaggcacgctttctcaaccaggcgggcggcgaggtgttacgcgagcgcccggtggtgctggacctgggccgccgccccgaggcgcggtttctcaaccaggcgggtggcgaggtgctacgcgagcgcccggtagaccgcgccgacctggaccgcgccatggcggcggtgggcgagttcgggggcgacaaccgcgcgggcatcaccggcacgctgcaccgcatcagcgccatccgcaatcgcaagggcagcgtggtggggctgacctgccgcgtcgggcgtgcggtgaccgggcacatggacatgctggccgacatcctgcaggccgaccccacctccctcctgttcctgggtcgccccggcgtgggcaagaccaccgtcatccgtgagctggcgcggtcgctggcggacgatcacgcacgccgcgtcatcatcatcgacaccagcaacgagatcggcggcgatggggatgtgccccacccgggcatcggcggcgcgcggcgcatgcagttgtccgcctctcttggtgcggagcagcatgtgctgactcgatacgaccagtgcctctcgtag

SEQ ID NO: 5491 - DNA, 693 bp, Chlorella protothecoides
atggcaggcgccccttcccggcatgccgacgctgggtcttgccgagcgctggcaccctcgtctgattcaccggcgccccagcccatgccaccccccaccccctaccccaatcaggtccaggcggatgggatcctggtggccacgcccacgggctccaccgcctactctgtggccgccggcggatccatggtccaccccaacacgcccgccatcctcttcacccccatctgcccccactcgctcagtttcagacgcagtgcctggcacgccggctgtgcggtgggcgggcctgggggttgcggggcgccggtgagtgtcatcgccaggcaccccctgctctgctccatgcgatgttggatctggtcgcccctcacccaggccttgggtgctgctctgttccgcgccaacaacaggccgccgacgcccgtgatcctgccagactacgcggtactgcgcctgcgggtgagccccgacgcgcgctgcgcggcgcaggtgtcctttgacggcaagcgcgggacggagctggcccccggcgactcgctgcgggtgtgcatgagtcccaacccggtgcccaccatcaaccacgccgaccagaccaccgactggtttggcagcatcgagcgctgcttccactggaacgaccggctgagccagaaggggctggcgcaggcgcagccgcccacccggccctga

SEQ ID NO: 5492 - DNA, 834 bp, Chlorella protothecoides
atggcgattgggcttcgcggacgactgagccgggatgggcttgctgccctaggttcttttgaaaacgtctttgacctcgacaccctccaaaagtcctgcgcagcgctcaaagctgggctgcgcaagcatgtatccaacacaaagtacgcaggcagctgtggagaggagggtcaggcgcccaaagcccgccgaagacccccaccagtccggaacccctctgcgcaacagacagcggttgggctggccgctttcgcccacataattttcgtgacgggcagagcacagtggctgactcccaccccggcatcgatcgctcaaggccacgccctgctgcaatccccggctcagaggaccatgacccccccccttcctccctgctgcatccgtgcaggggccgcgccctgggccctgccccgcgttttcttcgccttcctcgccgtggccatgccctggcgcttctacgactttgtcttcagacaccgcggctacaacctcttctacctcttcgacttctgctactgggtcaacgccgcggtggcctggtacctggcgggcggcgcggcgggctgggacctgccccacctttccgcagccctctactcgctggcagatggcccggtggcctgcgccctggcggcctggcgttgccgctggacctttggctcggcagaccacacgaccaggtatgtgttttgtgtgtgtgcttccaatggggtccccagcggatgggtgggatctgctgctcatgtgcacaccagcgtgcagcctgcctggcctcgtcttggaagggggaggagttacctggtcacagtgtctgcatgtggagagagttga

SEQ ID NO: 5493 - DNA, 1047 bp, Chlorella protothecoides
  modified_base (430)..(439): a, c, t, g, unknown or other
atggatctccaaaagctacacgtgcctggttatgtgagttgttatgttgctggagttgttgtgatgtctctcctcggacaagacggggggcagatgtgctggacatgctaccatccgggcgcacgggatgccatcggctgcacccctgtcagagtgcagctacagcctcgcgccggaccacccgctcccctgcccctcacgctcggtgctgccacgaaacctgttgttgaaccaaatttatggcccttcttgcagacaacaggtatgcgggattggagagggtgggctggtgaccaaatggtagtctcaagtcactccgaagtctgctctccttgccaggtcatcaagagagtgtcagaccgccggcaagcaccatcatactgggagacaagaggtgagccagcacctttgaagtgccagacagtccaannnnnnnnnngtgtcggaatggggcaaacggctgccaatcgtcgcttcaatccattttcctctctttgcagacagtccaactattgcacacagtatgctgctgcttatgcacctccactccctggaagcgagaacatccgttcacccctcagaatcaagaacctggacgcagaggacgcgagtctcaaggcaatgtacagtgctgcgcagggccggatcagcagtcagcagctcgagaggatccatgagcatcttcgggagagactaagcggaaagttgggatcccatggcggcaccgcctttaagctacgaaaggtgagaacatggcaaagcatgggacgcagaagtggcattcgcttggaatgggagattgatcaggagggcacgaggcgatgcgacgaaggtggccatgcagtcttgtgggacaaagatggacatttgccacatttgttcattctgaccccctcaccagggttaccatggaggcgtttgagatgtgcagctcaggccaacatcaatgcatgcaggactcgaccacctactgaacatttccctgttccacatcaagtgcgcagtatgatccagagtgcaaaggtcgcatcaagtaccatgatctga

SEQ ID NO: 5494 - DNA, 1170 bp, Chlorella protothecoides
  modified_base (227)..(236): a, c, t, g, unknown or other
atgtgtcaccacccctggacgccaaggaatcccctgtctcctcaatcaggtggtgagagacacctgctctgcgatgcggcaatgctccggagccgtcgtggctctggcgatcgacggccccgccgccgagctagcgtccgcctgctcctcagcccccgccctcaccctgctcgactgccactcggacgcccacggctgctgggcccgggccggggtacaaagctctnnnnnnnnnncgagctagcgtccgcctgctcctcagcccctgccctcaccctgttcgactgccactcggatgcccacggctgctgggcacgggccggggtacaaagctcccctcatgccatcccaggcaccctggccgccccgcccggattgtgggcggggcgtgtcgcctcggcggtcgccgccggccccgcccccgccgcgtgcgtcgtggacggactggatgggtgggtgggcgcgcacggggtgcgcgccgtgctttccttgctcgccgacctggcccgctcgccgggagtggtcggcctcctggcgcggctgcgccccggcgcgcacgaagagcgcgcgtgcgcgctgctgcgccgcgcggtgcacgccgaggtggcgctcctgcccccgcccccgggggcagggccggaggcgctgtgcgtcgcgctgtgtgcgacaccgagggcccgcgccgggcccagggtggaggccgtcgccgtgagccgcgcgggccaggtcggcgagcaaggaaagcccggtcaggggggggcttcgctgatgtatgcgcccgtcacgaccgcgacggcgccaggcccgcgcgtgggagaggaggctggagggcaaggctcgcgaggtgagtgggagcgcgtcggcgccgccgctgcgtgcgctattgtcacaggagggcccgaggccggctcctgcagccctgcgactgacgcacacgaggaggtccgggctgctgtgccctccccccgggggtgggactgctgctcgcctgtgcatgcagtccctggacaagcagtgcgccacccagcaagacgccgcccctctccatcgagacaatggtggctgacggcccctccattcccgtccctgacggcacaggccccagcgtgcgagcaggggtggcgcccggggcggcccctcccccaggcccaggggtggcgggggggatga

SEQ ID NO: 5495 - DNA, 936 bp, Chlorella protothecoides
atgaggggctggacaaccctggtccccctcctgcgtgacgtggttgcccgcgcgcggtgcgcgggatccctgcatgccgccaagctagacatccgggcgttcacgagcctgtcacatgcggcacccctgggagcggcgcccccagctgtcaccggcctgcgccagtgctttatcacacctcaccgcacttcctccccactcccacccatcgaacagctggcaaaggcagccgggtcggcgcccggcctggcctcctgggcggctcgcggggcgctcgccgccgcaccctcgcccccgcacctgctccatggtctgcgctgggtggcgtccctggcgggaccgggtcccgctgccgccacgccctacggcgccgcggcgctgactgcgggcctgtcggccgcgcagcgccgctggctggccctctggctgggcggctgcagcgcctgggtggcggtgctggtggtgctgggcggcgtcacgcgcctcacccgctcgggcctgtccatgaccgactggaagtttggcggcgagcgtgcgccctccggcgacgcggagtgggaagccgagttcgcgcgctacgcggcctcgcccgagttccgccgcgtcaactcgcgcatgaccctcgacgagttcaaggcgatctactggatggagtttgcacaccgctactggggacgcggcctgggcctgctcttcgccggccccgccctggcctttgcggccggccgcgcggtgacgacccccctggcccgccgccttgccctactattcgccatgggcggcacccagggcctggtgggctggtggatggtgcggtcggggctggaggaccccgccgaccctcatgccgtgccgcgcgtctccgcctaccgcctggccgcccacctcacctccgccttcgccatctacgccaccctggtctggaccacgctggac

SEQ ID NO: 5496 - DNA, 405 bp, Chlorella protothecoides
atgaccagagatcgggatgatggtgctcgcgctcctccaggtgagatcgcctcgcctccgtggaaccgacagggggaccttcagatgttgctctccttctctgtacctgacatgaaaaaccgaaagaagaaaccacgatcaccgctgtgctgcccaccccctcgtgcggggcaacgaacgccgggaggggaggatccaccagaagactctgctcaagaatctagcctgactgcccccctaccctcgctacccacaatgtcccgctctgctgccgaccgaggctgcctggtgtacgtgggtaacttgcccgacgacattcgcgagcgtgaggtgcgtagaaggtggattgatgtgagctcggtcagggtggacttgccaccctggccggcatccgcgtcgcgatga

SEQ ID NO: 5497 - DNA, 591 bp, Chlorella protothecoides
atggccgagacggatgagggtgtgtggggagaaatcaatcgcgtgggcgcgcccgcccgcggccgcggcccgctgggcgtggacaacttcatcgacaccaccaacatcgagggccggtttgacttctcagagtttgtgcgcgcctacggcaagtacctggacgagcagctgcggctgtacgccgccgtgcgctggacctgcagcgccgtggcggcaggcggccccggtgcgggcgcgccggggggggaaagcgcagccggctacggcgcggcggggtacggggcaccgcccggccccgccgacgcccagcgctcgccgggcggcgcgggccggttccgcacgcttccggcggcggagctgctgcaccagctacccctgctccagcgcctgcagcggcacctggtggactgcgtgccgcgcggcgcggccacccacgatcccgtggccctggcgagtttctcggttttgttcgaaaggggaaggatgcctggcctgggggaagtatgcctggcctgggtgcaaagctgcctccccaccgtacgacgctcccggctgggcgtcgctgccgtgctgggctgcttgccgacctga

SEQ ID NO: 5498 - DNA, 231 bp, Chlorella protothecoides
atgtctgccagctggcaggacctgaaggaccacttccgcaaggtctgcaccccctcctacaccaacgtcatccgcgagcgtggcgaggcggtcggcgtcgtggagtttgacaacgaggaggacatggaccgcgccatccgcaagctggacgacaccgagttcaagaaccccttcgagaaggcgtacatccgcctcaccgaggagggcgggcggggcaggcccgccggcggc

SEQ ID NO: 5499 - DNA, 1542 bp, Chlorella protothecoides
atgtactggcccggcaaggatgcaccagcccatcagagccatgagaagaaagcacgaattgccccgaattctcctccctcccaacaggcagcgctggacgccgtggtgcgcgagtctttccagctgtacaaggcgctgagcgagggtgtcatcaacctggcggacgcctacttctccatgccctacttgcaagcaggtggggtccctgtggtggacctgcggtgtggtctgctgcgcgtcgtggtttgctggtgggaggtgggttgggggctcggagccggccccgccgcgcgctgcatccctgtcccagcggtggccgtccatgaccccgctgagagacccatcccagctcagaacctgatccccttctcctcccccccctctccccacacagttaaggggctggagatctaccgcgaggccagcgccggcaccgacgcgctcagcgccttttacgccgccgtggggcagctgggcggcgtgagcgccgcgcgctccctgcccagtctcaccccgccgcccgccgacttcgtggccagcatggaggagtacctggccgaggcgccgcggccggagggcgaggccgcgctgcccaagcggcccagctccctctccatttcatggcgcgcttcctggggaggggtcgtcggggcccctgcccgcaccctccccagggacaaagaggctgcacaacccccttgtcccgacccatccctctcttcctccactgcacagaggagcgggcccctgcgcaagggccgcctggcacactccgcctccgggagagccggcgagggcggcgccgcgtcccacccccgcacgctgtccagcgacccgggcatggtcctggcccccagccaggagcccgcggggggggaggagggcccggatggcggctctggcgggggcctggcgtccccggggggggcgccaggctcccccggcgccggcacgggaccgccgcgcgagcgagacctgctgggcagcgaccccgggaccccggcacgcaccccggcgcacgcggcgccctccccgctggacctgctggggggcctgacgctcgagggactggacgccccgccccacgcgtcggccaacccctttgccgggccggacccctttgccgcctacggggcggagccgggccacggccagccgacccgcggcgcagacccgtttgcgctgcccggcgcgcagcacgcctttggtttcggcgcccagggggtcgacgccgcgccgtggcaggcggcgccgccaggggcaccgccgggtggtcgcccgccggtgccgcccctggacacgtccttcttcgcggggctgagcaacggcgcaccgacgtccagccctgccgtgctttccccggggggcaccacgcgctggacccagggcgccgcgggcacgccgcagggcggcggcgaggacctaggcggcggcgaggacctggtgagggcggcgggggcgagggacccttttgccacgctgaccacgctgtcgccggggtcctctggcaggatgccctccccgggaggaggcctgctctga

SEQ ID NO: 5500 - DNA, 825 bp, Chlorella protothecoides
  modified_base (174)..(183): a, c, t, g, unknown or other
atggagacgcttccgcaagaatgttgtcttggagaacttgaagaagttcaagctccgttgtcaatccccttgtcatctgtgtgcggcattcattcgacttggatcgcaggaacctgctcccgggatcccctcaacctctcctgcccacatccgttcagcgactcccaatatttnnnnnnnnnnaatccccttgtcatctgtgtgcggcattcaatcaacttgggtcgcaggaacctgctcccgggatcccttcaacctctcctacctacatccgtttcgcgactcccaatattaattccagaattcgacacatccagacggattggtgctcggtattcatccgttcagcggcatcaacgaagacgcaggtgtgcaaggtctcgaaggccccatggcgccggcacagatagtggcagaattggacccctttgcatccgcgctggatttggaggagcaccactttcgggacggcagagaggctggagtgcagtgagttgcgatcacgaggctgagtttgggttgctgccccgtgaaagtagggttggcaggccctcacctcaacgtggagcctggggaaaggcagctgggtatgcagagggccgggccatgggcgtcgaacaaggttttcgcatctcatatgaagttgccttttattcgggctgcctcagtcagtggcacacagccggggagcatggcggccgcttgaagctcaacccccgggtcctacgacacatggcactactggaggatctcgtgcggtccttcccctggtctgatgctcaggtgagggggtgggggtccaggctcattcaggcccccaggtga

SEQ ID NO: 5501 - DNA, 1713 bp, Chlorella protothecoides
  modified_base (1138)..(1147): a, c, t, g, unknown or other
atgtctattcagacgactcactttgctgcatgtcgcccatgtacgcggcctggcatttgcccatgcagccccattccccacgagcccctccatgcgggccccgcgaggcggtccagagtgggctcgtacccgctcagggcagtaaaacgccgggtagagatcctagatgagcaggcgatcgacaatttggcggcatgttgtgatgacttcgtgtgcacctccagtcccgccgtggagaacagcgtccgcacgctggcgcgcgacatacagcgagccgatggctcctggacccgccggatcctggcaccagacgtggtgtacaaggtaatggtgcaacgagacaggcaggatgctgctggaccatggctgagggtctgcatgaacaccatggaggaaaatgctgactcagcaatgcatggacgggcggtctgtgcacctggcaggctgatgcacctcagtgcgtctgcgaccggctctttttcgtgcagcgctacagttcttactgcatgggcctcctcacctcgaccctttctgcaggacaactttcgtagtttcaagggcatacaaggctacgactccctagactttgtgccaaacatcgtctctccatctcgcgtgaccatacgacgcatgcgcatgctgcgccaagatctggcggtcgtggagtgggtgctggatggccgtttggggcccctgtccctgtcggtgcagggagagaccgaggcacagctcaacttgctgtcgggccgcattgtggagcagagggagtcgtggccaggggctcccctcccctggaccctggcaagggcgctctggtcagtgggtaagaagaccaaggacacggtcaggggtgggaaggcggccataaactctgccctagatcaggagggcgagagccaaaatcagtttcagggggatcccaccgaccccacgaggttcttcatggatcaggtgtgcatgggtgttggggtgggtgtgttgtgggcgagtgcccccagattgatcgtggtgggtggggtagaaggtgccacggtgtgcctgccatggctttgcaaccttcctgcatcctgctaccctctcaccgcttccacccgccccttgcagacgaaaaacagtttgtggaatgacatgatcaacnnnnnnnnnnaattgtggcccaggtgcaggaaccagcggggtcagatgcatgagggtggacatgccacatgggacagagagagatgggggccacggttgggggagcccgtttcagcaacttcaggattgggtctgggatgcagtgtggtgaggctcagcctggtagatgtgcatgctgagcgcaaagattgtatcaccagagagcacacatctattggaacagtagggcgaatgtgttgcgaccgaggttatggcagtctggggacaggcgcaggggccccaaagcctgtaggggggtatccaaacgacacgcctccaagcgatgcgctccgccctcagcaatgcatccgacaagtcggcacggctcacgccagcccaaactgcccggcaatggtgctgtccagggccctgcccagcaccttctgcagcaggcctaggacccagagcttgagcgccccgcccgctgccaggaaccaggcgggtggcggcttcgcgcccggcgcggtggcggcgttgatgacgccggcgatgcgcgccgcgacctgggacgcgggctgcacgcccttggagttctga

SEQ ID NO: 5502 - DNA, 1041 bp, Chlorella protothecoides
atgtatgctggaagctaccccttgcgccctgggcctggcctggcgacgactgcgggcccccacggcctagacatccctaccccgccatgctgggggagcgagagggtgagaggccctcccaatccaccgacttccccgacacggaacagggcgagtgtctgcggctgctcgacgtcagcctgcgatgcagcatctgctacggcatctacgacacccccctcatgctgcgtggctgcgggcacacctgtgagtcctggtcctggtagggtctgtgatcaaggctctgcagtgcacagggcaagtgcgtgctgtggcattccgacgacctcttacactcgctcccactcacaccatgctgcagtctgtgcctcctgcatccgcggcagcctggactttcaggagaaggccggtcagccggcctgcccaggctgccgccacccctgcgatgcgcgagacctactgccctgccactcgctgcgtgaggcggccgacaggtaccgcagggccaggggcgcgatcctggacctgctgcgaccggttcctccacctcgagcgtcctccgccgagctggagggggcgccagccccgccgccggcggcagcgccagggccccctcctcctgccccgcaacgcatgcgaacccggtcctccagcaagtcctcagaggcagaggcggggccaggctcccgggggtccgatggcacagcctccccctctgcgagctcgagctcatcgggcagcgagtgggatgtcgaccctgctgcagtaagtgaggcggacagcagcccggccaagggggggcggagcggcgggcaggtgccctgcaagcgtcagcgcacaggggctgggggtgggtccgacgaagttaggtgcgtcactgggagtgacccagaacacagtagaaatcctggacttggaggaccctccccgcccgagtcagacccgcccaaggtgagggggcggggtaggcatgggagtggagcacggcaaggagcaggtgtcctctttgtcggtcaccgcttggaggagcgcgagtcgtga

SEQ ID NO: 5503 - DNA, 261 bp, Chlorella protothecoides
atgccacccagaccggccgtctggccattgcagtccccctccccccccggcaggccagaggctccacagatcgctgccggtgccacggatgcgggggcgcagcggcggtgcatccgtgcggagctggtacgctggcacccggacaagttccagtctcggtttgggcagcgcctggcggcggccgaggcggtgggggtgctggccggggtggtcgcgctttcccaaagcctcaacgctctggcagccggggtggccacatga

SEQ ID NO: 5504 - DNA, 303 bp, Chlorella protothecoides
atggcacgcgatgctcgtgggaacacccctgtacacctggcagccagggggggccacctcgaagccgtggcggccctgctggcggctgaccccccgcccgacatctttacggcaaaccttgccggcgtcacgattacggccgcaataaacgccgccatggctgcccaggaccgggccacagacgccagtcctgagaggagcggcggcaaggcggacgacggggccagcagagggtgggagggaggggatgcctggagcgaccgcctggcagctgagctgtctggcgacgaggacgatccgtga

SEQ ID NO: 5505 - DNA, 543 bp, Chlorella protothecoides
atggctgcccgcggcggcgggctggtggtgaacatcgggtccgtctccgcctggctcgcgacgccctacgccggtgcctactgcgccagcaaggctgccctgcatgccctctccgactcgctgcggctggagctgcggcctttcaacatccaggtgaccaccgtcaccgcgggggcaattacttccagcttctccaacaacgcggaggcaggccagagcggggagcgcttctccaacaatgcggaggcgggccagagcggggagcggtatgaacgtccggggagcctctaccgcgcgcacgccccctccatccgcgcccgcgcccgcatgtctcagaactccaagggcgtgcagcccgcgtcccaggtcgcggcgcgcatcgccggcgtcatcaacgccgccaccgcgccgggcgcgaagccgccacccgcctggttcctggcagcgggcggggcgctcaagctctgggtcctaggcctgctgcagaaggtgctgggcagggccctggacagcaccattgccgggcagtttgggctggcgtga

SEQ ID NO: 5506 - DNA, 339 bp, Chlorella protothecoides
atgaaggagattaacagccggtttggcaagaacagcatcatgctgctaggcgacaacaaatttggggaggtgcgcaccacgccctcaggcgccctgaccctggacatcgcgctgggcgggggctaccccgtgggtcgcatcgtggagatcctgggccccgaggccagcgggaagaccaccctggccctgcacgccatggccgaggtgcagaagcgcggcggtgccgtagccctgatagacgccgagcacgccttcgaccccctcttcgccaaggtggtttgtttttcaatgggaaaggggagggggggggttcagatagggtggctcaggatggtgtaa

SEQ ID NO: 5507 - DNA, 438 bp, Chlorella protothecoides
atgagcttggcggacgtcaccgccaatcttcgcgctcccgtggagaccgcgacagacaacaagccaatcgtcaaggtgcacgctgtggagtgggccaagatcatggcgggcgagcctgtggagatcaatccctccatcgggcacggctacaaggtgatgtccgtcaaggagtgggctgccaggtggaagcccaacgaggcatatcccgagtgcctgacatggtgccggggcaagaagaaatgggagagcgagaccctgtgcctggactgccacagcttcaccaagcgctcctattgcgatccggacttcaagaccccagaggactttgagaaggagcgctggcaggcatttgtgggcagctgctcctctgagccgtggaccgagcacgtggaaagaccctgccctccacgaccgtacgccctcgtgccccgccattga

SEQ ID NO: 5508 - DNA, 897 bp, Chlorella protothecoides
atggcgctggaggtggcggactcgctcatgcgctccggcgcggtggacatggtggcggtggactcggtcgccgcgctggtgccgcgcgccgagctggagggcgagatcgggcagacccagatcgggtcgcaggcgcggctgatgagctccgcgctgcgcaagatcgcgggcaacgcctcgcgtcacgcttgcaccctgctcttcatcaaccagatccggcacaaggtgggcgtcattttcggcagccccgagaccaccagcgggggcatggcgctgaagtattatgccagcgtcaggctggaggtgcgccccaaggagaagatcatggccgacggcgagcaggccggcatcaagattaagtcggaggccctggctatgcatgcgccttgctacaccccactgacaccccaccgtcacaatcccaaccccaacaccgaatcaccacccagggcaaagtgcaccaagaacaaggtggcgccgccataccgcatcgcagagtttgacatcatgtttggcagcgggatcaacggcgcggggtgcgtgctggatgccgccgagaaggtgggcgtggtgatcaggcggggagcctactactacctgggcgaggagcggctgggacagggccgggagaagacgttggagaccctggcggagaggccagagctgctcagggccccccactggcttccatcccagccatcaaaccccacccactcatccactccctgcagccacctggaggaggaaacgcggcaggtgctgaccaaaggtgggcacgcagttggggacgcatttggcgaggcctccagcagcgaggaggagccggagttcctgagcgaggccgacgagggcgaggcggaggcaggaggcttggacgccgaggccgtacagccgtga

SEQ ID NO: 5509 - DNA, 438 bp, Chlorella protothecoides
atggtggagatcgcttcgagctcgcaggattccctgctcgcaaaggttgtgctggtaagcgtcggcctccaggctcgaggctccatcgccggaggcgggctgggccaggccttggccacgtgcctgcactcacagaccacacccgatgggcgcacgctgtacaaggtgtacgcgaccgcgcgccgcctgaaaaccctcgagcccctggcagacctgggcatatccacgctggcgctggacgtggggagcgaggccagcgtaaaggaggcggtggcgacggtgctgtcccaagaggagcgcctcgacgtgctcgtcaacaatgccggcatcagcaagttcggtcccctggccgagcagcccctgtccgaagtgaccgccgtcttcgacaccaacgtcatgggcgtgttgcgcatgacacaggtcggctggctgggctga

SEQ ID NO: 5510 - DNA, 1437 bp, Chlorella protothecoides
atgccggcgggccccacccccctcccagcgcgcaccctcccgggccccagcccctctgcgtcccgcggcgcgctggccgtggggcgcatgctggtgggccccggtatcctgggcctggggtccggcggcactgtggtgttcgaggggtcgctggacggccgtcccgtggccgtcaagcgcctgctgcgccagttctacgacctggccgccagcgagatccggaccctgatcctgtcggacgagcacgtgaacgtcgtgcgctacatcgccatggaggaggacgcccagttctgctacctggcgctggagaggtgcgccggcagcctcaacgacgtcctggcggggggcgggacgtgtggggaggaggagggacggaaggcggggtggcaggcggaggcgaccgagagtgtggaaggtacggacggcgccctgccctcccccgcctcgcaccaccgacgccctcggcgccttgccgccgccgacttctgggacgctgcgacggggacgccgtccgcgctggcgctgcgcgtcgcggccgacgcatgccgcggcgtggcagcgctgcacgcgcgcggcatcgtgcatcgcgacctcaagccgcacaacatcctgctcaccgccgccggctgcgccaagctgtcggacatggggctcagccgccgcctcgtccccgaccagatcagcttcgagacgctgggctcaggtgggatgagaggaggagggggaggagaatgcgtggcttgggccagcatgtttggatgggaccgggacatcaagcagcctgccctgctcctccagacatgctccacacatgccctgccagccgctcgccccccccaggagctcgcactcgcaagcacccgcccactctttcgctcgatcatgatcagcaatgcccacaccaacacaggtggcagctcggggtggcaggccccggagcagctggctgcccgagacgggcagtcggcgaggcagacgctggcggtggacgtcttctccctgggcctggtgggccagcacccctttggctcgggcgtggagagggacgccaacatcttccacagctccctcctgctgaaactccttgccgcctgctcaccctcccatccccgccactacctgcagggcaagctgcgcatgggcaggctggaatcacaggccatagcggcggacctggtgaggggcatgctggcgcaagatccccgccgccggcccagcgcagcagccgtgctgacgcaccccctctggtggccctcggcacagcgcctcgctttcctcatcgacgtcagcgaccgcgtggagggcgaggaccgtgtggtgagttgtgactgttatcagcggatggggccggcgagcccagtgagagtgtgtttccctggcctgaggttgggggtcgtgctgcttgttggcatctggatgggtggtgctccagggtaa

SEQ ID NO: 5511 - DNA, 828 bp, Chlorella protothecoides
atgcccgcttcccaccaccaccacgcacgctcacaccatgcagcacactgcatcatccactgggcgtcgctgagggagcagggggatgcgtgctgcccccagtgcaagacccccttctccgagatcatcacctaccgcaatctggacgggacgttgcaggacttcccggtgcagaactcggtgtgcctactgaagcgcgcggcctggttcaaggatcgggcagagcgccacacgctgccgccggaggacggcgccgcgccgcgccgcgagcgcagctgggctgacgaggacgcctatgacctctgcaacgacgacgacgacgacctggaggccttctacttctcgtcggccgcggggcgcgcgcgcgtgacacttggcaaccgccgcttcggcgagggcgggtacatcgccagcgggcggcgccaagcccgaccggctcccagcagcggcaaggtgcggagtgggtcgagtgtgcatcgaggcaccctcggcgggatgctccccccccacacacacacacctcgccgctcgccatgcccccaaaacccccagccacatgaccttcctttgcagggcaagcatgcgagtcggcaaccgtgccatggcgcctcccctgcgcccgcacccagcgcggccgtggcggtgccggcgcgcaagcgcctggaccccgggagcgtgtcgcccggcgcccccccttcctggtcgggcgcctcccccaccccaggccagcagcagccgatgggctccagccccagcggcactggccggcgggcgaggcgcaatgcgcgccgggcggcgctggatgccgacgtgattgtggttgcctga

SEQ ID NO: 5512 - DNA, 420 bp, Chlorella protothecoides
atgagcatcgaacaggttcaggtaagcgcacatgccggggcggagtgggttgacagtgcagggttccctcgacttcctcgcctcagtctcggcacctcaaatctcccccgcagtccatgcgggaggagttctgggatacagagccacactacggaggagatagaggtgcgcctggtgcatcacatcgccgggactcccgggtacaaagaacgaccttcatgggccacaaccccgctctcccctgctcctccagtgatctgggatgcgctgcgagccgcggcagaggcagatctccgcacagcaaagctcatcctacagagtgccggtatcgtggtagccgcacccgatatgacaacctactatgacgagcggggtgagtgtacgggcctgctgcctcctgaggcccctgttgcattgtag

SEQ ID NO: 5513 - DNA, 429 bp, Chlorella protothecoides
atgcctgtctggcgcggggcgccgggcccggggatggacccggcggaggtggcgcaggggcgcagctccagcgccgcgccgcagcaagaccccctgggaccccagggcgggagggatgcaccggcagcgccaagcaccgccgccacggggcccttgcccctgcccccgaagctcgtccccggcctggtgtccgacaaagcgctgcgcgcgatgctgaagcgcgtgggcctgcccctggacgggcgccgggccgacctggtggcgcggtacgggcgcctgcgacgcgaggtggaggtgtccaacgaccggggagaaagggcgacctacgcccggctggcgcgccgtgtggtcgccgccgagcgccaggtggcggcggcgacgctgctgcaggggggcggcggcgagggcggcggcggggccgcgccgcgc

SEQ ID NO: 5514 - DNA, 762 bp, Chlorella protothecoides
atgtatgaggcgctggaggggctgggtctgctggccatcccctctggcagctgggcccccgcgctcgattcgcgccttgtgaacaacctggggaagtacaggcggtacaactacgccagcctgcgggacctgctccgcgtcatccgcaacaagcactcccacttccgtgaactgccgctggacctgcaggagcggctgggcccgctgccgcatgggttcctggcctactttgaggagaggtgtgaggaggagaggggttggattgtggtagaggggttgaggatgtcagaggaagaggaacggaaggagccacatcggagctgggcgctcactcttgatccagtacgtacccacagatgtatcagcgccccgtccctacacaggttcccctcgctgctcctggcgtgctactactttgcggttcggcactgctcggacgagccggtgtttgccaagtacctcacgcccgacagcgcggagctggtggagaagctgggcccgcccgccgacctgcgacggaccctgcccgtcctcctgtcaccggatcggcccccctttgatcctgggctccgggcggaggcaggggccgggtgggcacggggcgggcagggtggtgctgcgccgccagcggatgtcgagggcgaactcccacgccgccccggccacgccatctgcgagttctacacgaagaccggtgggtgcgaggcatggggcatggagagaagatgggtcgcaaggcagggggagggtacgaccgcctga

SEQ ID NO: 5515 - DNA, 204 bp, Chlorella protothecoides
atgcccgagacgcagctgcgggtggccatggcctgcgagggatgtgcgggagcggtgcggcgtgtcctgggcaatctggagggtgtggaaaaggtggacatcgacctggcaaagcaaaaggtgaccgtgctgggcagcgcggatccaaacacggtgaaggagacggttgccaagtctggaaaaaagacggagttctgggcctga

SEQ ID NO: 5516 - DNA, 1068 bp, Chlorella protothecoides
atggtgatcgacagcgcctggctggaaacggagaacgtgccgcgcaggtctggcctcaccctgcagcagttccgggaggagtacgagctgcccaaccgcccggtcatcctcacagatgtggtgagcgccgtatcgtggggaggggtgtggaggaccgccgtgtgcctggggtgggaccaggccctgcctctgacgccaccccatgtcccagggcacggagcgatggcacccgacctccaccctcctcactctcaaccccttgtacatgttcaggtcaccaagtggccggccatgcagaagtggggcagggagtatttggcggagaagttggccgggcacagcgtgctcgtcggggacgcgcccatgtcgttcgaggggtactgcgcctacgccgacgcccagagcgacgagctgccgctctacctctttgacaaggggtttgcggagcgctgccccgacctgggtgccgactaccaggtgctggcatgtgcacatgggggagggtgtctgccagggctggcggcggctgcagcccagcacaggcactgctgctgccactgcagatgctggggcttacgcgcctcttcgatacccatcctcctcccggcctcaaatccctgcccaccaccacacacatccatccaggtgcccgaggtattcagcgaggacctctttgcggtcctgggccccggccggccggaccaccgctggctgatcgtcggccctgcccgcagcgggtccaccttccaccaggaccccaacgcgacctgcgcctggaacgccgtggtgcggggctccaagaagtgggtcatgtacccgccccacgccaccccgccgggcgtgcggccctccgccgacggcgccgatgtggcctcgcccgtgtccctgaccgagtggtttctctccttctacgaacaccgcgcggcgggggggcgggcgccggcggagtgcgtggtccgccccggcgaggtgctcttcgttccccgccagtggtggcacctggccatcaaccttgaggtgggaagccgggcggaatgtgctgagtgtgtggggtcccatgctgtgtga

SEQ ID NO: 5517 - DNA, 645 bp, Chlorella protothecoides
  modified_base (541)..(550): a, c, t, g, unknown or other
atgggactgtccatgtcaaccatccgtttgaaccccttggaggttgtgacaccacgctccacagagatcatcgtagccgtggagtgcctcaaggcgggccagaaagcttgtacggcagacagcaatggcaacattggctccggcaacaagggcaagaacaactttggcaccaagaacatcggggacgacaatatcgacagcagtggcaacattggtcctggcaacaagggcaagaacaagtttggcaccaagaacgccggggatgacaatatcggcaactccaatgtgggcatagccaactgggaaagcaacaataagggcacgagcaattgctgctttgacaagactggtgatcgcaagataatcaacgactgcagcctgctcgagttgctcaagtatgcacgggtccttgacttaccgttgcctccctccaaaaagttcccgcccccacctgccaagaactcccctccgccacccgccaagaagcctccacccccactttcaagcccgagctgtcctcccccagtccccctcctccatnnnnnnnnnncaagggcaaccgctgcttcaacagcgtcggagatcgcaaagtcctctccacccccgcccgccaagaagtcaccacccccgcccgccaagaagtga

SEQ ID NO: 5518 - DNA, 1143 bp, Chlorella protothecoides
atgcaagacgcatccgcttgcgggctcacccctgcatggaccgccacattccaggtgggcgtgctgttgggcccccgcgccgcggcaggcaccgtccatgccctgctccttcgtaccgcagccctgctggggcaccgcctgcgggataccgtggacctgcccgcgctgttggcggccgcgccagaggccgcgcagtccaggctggcggcggcggcgggcgcctgcgacgcctggcggcgcggctacctggccacccgggccgagctggaggcgggcgggcagaccgggcgctgggagcacgaccgcgccgccctgttcgcaggtacagaccacgcggcgggcgcgtgccggcggctggccggggcgctggcgggggtgcacggcgtgctgggcctgctgggcgccgatctggaaagcgtggcgggggcgggcctggaccggctggctggcctgcgtgccgaggctcgggccgcgctgggcgcgctgcgggacgccgccctggcggccccgccgggggattttctggacccggggtcggcggggcgctgggaccagtgcctagcgtccttggaagctgcggggaagtcgctggccgccggcgcgcaggacctgctggacacttcgctcacccgctgccccggcgcggctgacggcgcccgcctgctgggcaagctcctgcgtgaccggcatgctggtgtagccctgctgcggcacgtgccggagaaggtcacggacctggtgcagacttttgcagcagaggtgaggaggaaccaggcggatgagagaggggggggaggggacaggttggggaaaccggtgcaaggagggggaatggagatccgggtggctgagcgggaggcggaccgctggtgcgagggtggggcagggaaccggacgccctaccccggcctctctgccttgacctccaccttgctcagggtgagcgccacaaggtcacggctggaagaagccgcgacagccatccaggcctcgggcgaggctctgactccagaggatcagggcgtgatggctgcctgtgcaggtgagtgggcacagctacttgaaatcagcacaggtctggtgtggaggtggagggcagggtcaggcacagtccctcagcctgtgcggtcccgtgcctcataa

SEQ ID NO: 5519 - DNA, 759 bp, Chlorella protothecoides
atgtgcctttattgccacatcactgctggggaaccacgctgcgcacccctcctgcaggccatcgcagccttcacctgcaccgccaaagcggtagcctgcgcagcaagcgagatgcggcgggcgctgcgtgccctccctagagagacagactggcccggggaagggaccgatacaggatcgagggtcatcgatcatgcagccaccaatgctggacttggcgggagcgtgcggcggggggaggaggctgccgtggcagcagcacatagcctgcaggccaccctggtccggatagaggagggcgtgctgggcactagcaccggctctgcccggagcatggccgcttactatgagcactgggagcgcaggctccaggatgcattggcagactgtgccatctcctggatagaggggctgacgagcaggctgtctgggagttgcgatgataccggacgcaccatccatgtccaggtttgggatgacgaggatgtgggttgcgaaaggagttgcacgcaccgcgatggcacctccatgtcgacgtgccctcggctagttcaccctcaggcccatgtggcccttgtgcacttgcagatggagcttcagccgcagcagggactgggccccctgctggcctggcagccgcgcccgtcactggtgacggagcagctgagcgctctcgtcacacgacgagcggcgctgggagcggcagtggttcgatggatcccagggacgtgcacgccctgtcacacccagcctctgtga

SEQ ID NO: 5520 - DNA, 468 bp, Chlorella protothecoides
atggatgaagatgtgtctcttcctcgtaccaccatccagaaggcggtgaagggcgccctgccccccgggctgagggtgtcgtgggacgccatcgacgtgctgacctcctgctgcaacgagttcgtgcacctcatctccagccaggccaacgtcatcagcgagcgcaccaagcgcagcaccatcacccctgatcacgtcatccaggccttggaggagctgggcttcgagacccttgtgggccctgtccaagaggtcctggtcgagttcaagggggagcagcggcagcaccagggccggatagggggccgaaaggctgccggcaaggaggcgctgagcaaggaggagatgctgttgctgcagcagcagctgtttgcacaggcccgcgagcggacgctgtcagagccctccccaatggaggcggggcccgaggggggcgggggcgaggggcccgagggtgcctcgctgtga

SEQ ID NO: 5521 - DNA, 600 bp, Chlorella protothecoides
  modified_base (145)..(154): a, c, t, g, unknown or other
atgctccgtcacgcaggtgccgggctattgttctcctcctcgcaaaaggtccccgagagctggtcggcattgcagcgttgtgtcgacctggcgcggtgtgcctgccccaactacagctcggcgagggggagcggcacaccccagnnnnnnnnnnaggtccccgagagctggtcggcattgcagcattgtgtcgacctggcgcggtgtgtctgccccaactatagctcggcgacggggagcagcacaccccaccccagcgaggggacgacagtcgacccattcacccagaagctgcagcagaagacggaggagcagttgcgacagttgaccgaagcccccacatatgcacaggaaggagctgtggagcagggacctcggcctggggtgagtgtgaatctgctggtcacacacagagattcaggaggatctgctgtgccaagtatgcttgagggccaatctcattggaggttattgcaacctcacactcccctcatgcccaacacgcagaatcaaccagagggcgaagaagggggaccaaaggggcctgagcccacaagatatggagactgggagaaggctgggcgctgctacgatttctga

SEQ ID NO: 5522 - DNA, 1116 bp, Chlorella protothecoides
  modified_base (940)..(949): a, c, t, g, unknown or other
ccctccccccctgcagagcaaggagaaggtgctggcaaagatggtgcgcgacgggctgacggagaaggtcagccaggagcggacggtgaagctggcctttgccaacgtgggcacgctccccccccccgtcctccagttctccaacgtcaagtttggctactcccccgacgcggtgctctactccgacgtggagctgggcgtggacctggactcccgcgtggcgctggtgggccccaacggctgcggcaagtccacgctgctcaagctgatgacggggcagctggagccgctggacggcatggtcaagcggcacaaccacctgcgcatcgggcagtaccaccagcacctcaccgagctgctgccgctggacgtgtcggccctggcctacatgatggccgagtacccgggcgtgtccatggaggagatgcggtcggtggtgggacgcttcggcatcacgggcgcggcccagacgctggagatgcgcaagctgtccgacggcctcaagtcgcgcgtggtgttcgcctggctggcgcgacgcacgccccacatgctgctgctggacgagcccaccaaccacctggacatcgagtccatcgactccctggccgacgccatcaacgactgggacggcgggctggtcctggtgtcccacgacttccgactcatctcccaggtggccaaggagatctggaccgtgcaggacgggcgcgtgacgcggtgggagggcgacatcctgtcctacaaggcgcacctcaagacctccatggccgcgctggccaagcgctccgacctgggctaggcggcgcaccgcgccgccgcgtggacctcccgttgccacgacccccccaccccccggaccgagtccctcccacgccgccccgcggcagtatttcattcgcagcgcaggcgggggcccaccgtctcctctctggagccctgnnnnnnnnnnggagccccgtcctcccagggccccctcccaaactgcatacgtctctgcctgtaccttggccttgtaatgcgtggaacgacggagtgggagaggtaggccagggcggaggggtggggtcagcacggcagggcgcgggaggcggtgaaagagcggacgagatgcaatga

SEQ ID NO: 5523 - DNA, 195 bp, Chlorella protothecoides
agctggccgccgcgctggcgcgcacgcgcgagttcggcgcagcggaggccgcgcaccgcgccttcgtccgcgaccttgtgtcccgcgctttcctggacgcccggcccctggcctcgctcgtccaggcgctgatggaggccgccgccaggatctgcgccctgatccaggttggcggtggcggtagtggtgggtggt

SEQ ID NO: 5524 - DNA, 927 bp, Chlorella protothecoides
atggcccccggttcggccagggaggaggcccccctcctgcctggccagcctcccagggccggccatggcgtggatggcatcgtggacatcgacctgtcccgcaagattcacaggaccgcgcccctcggcgtccccgctagcctgctggccggcaccctgtactgcatcgcctccatgagcatggtgggaggcactgacccccctctcccacatggattcccacacccctggcccctcaaccaggtgctgctgaacaaggtggcgctgtcctccttctcgttcgcctcccccaacgcgctgctcttcttccagtgcgcgctctgcgtggtggccacccgcgcctgccacgccgcgggcctgatcacgctggaaccgctgagtgcgcgcatcgtgcgcgcctggctccccgtcaacctcctcttcgtggccatgatagggaccagcttctgggcgctggcctcgctgaacgttgccatggccacggtgctgaagaacctgaccaacctcttcacgctggggggggactacgtgctgcacgggcgcacctatggcgcccccgtcctgggctgcatggcgctcatggcggtcagcgccctgtgctccgcgctcaccgacctcagcttcaacgcgcgtgggtacgcgtggcagatggccaactgcgcggccacggcggcctactccctggcactgcgcggcaccatggacaagatcgcgccgctcacggtgtcgggccgcaagatggacgagttctccatggtgcgtttacttttgggaaggggggaccaaaggagggggtacgcgggtgagatgctgctcaaggcagctggagtccgaggcgggccagggattccagagcgggtggatgtgcctggcatgagcagggcggcaccaagggacactccccggggctggcaacagggtctttga

SEQ ID NO: 5525 - DNA, 894 bp, Chlorella protothecoides
  modified_base (569)..(578): a, c, t, g, unknown or other
  modified_base (666)..(681): a, c, t, g, unknown or other
gtgctggacgccgcgcggcgcgcggccgggccaccctccctggccctgcacctggcggccgcggaggcgcacgagcggcgcggcgcgctgaacgacgcgcgcgccgtacacgaggaaaccgtggcggggctggggcccgacgctgcgggggcgggtgaaagtgacaacgacaccaaggggctgggcctggaccaggcccaggggacgctggcctgggtgcagtacctgcgcttctgcgcgcgggcggagagcctgaccgccgcgcgcaaggccttcctccgcgcgcggcgctgggagggtctgggctggcaggcctttgccgccagcgccgacctggagtgggcggcggcgggcggggtggacaccgtgccgcgcaagatcctggagctggggctggagcgacacctgtcggagccggggtacgtcctgcactaccttgccttcctcagaggtgaggattctaggacggcaaaagccccccaggggggggaggggggtggtaaggacatggtggccaagggtttgaggggcccgggagtaaatttcaacatccttcagcggcgagcttnnnnnnnnnnggggggtggtaaggacatggtggccaaggggttgaggggcccgggagtacatttcaacatccttcactggcgatcttgccgaccgcannnnnnnnnnnnnnnncacacaaccctgcgaccccggtgcagggcttggggacgtggccaacgcccgggcgctgctggagcgggcgctgcccgccacgcctgccgagcgcggccgcccgctgtgggacgcgtacctggcgctggaggcggaggccggcacgctgggcacgctgcgcggcgtggaggagcggcgccgcgtcgcgctggccgcgctcggacccccgcgccc

SEQ ID NO: 5526 - DNA, 2124 bp, Chlorella protothecoides
  modified_base (326)..(335): a, c, t, g, unknown or other
atggaagaggcgagacccatgcaggacctctcacagggtcccgacgcggcctcgcgcactctccgcatcgtttgcattcacccccccggaccgcaacggcaagctgctgggggaggtgagggtggccgagggaccctcctttctgcctgctcgcgtcccggagcccgccgacaacccgcccaagcccctcaagatcaaccaggacctggccatggtgaggagggacctgttgttggggtagtagcgcgtgtggggcgaagtgggggactggtgtttgctggcatgaacgctcgtatgcatgcctggttgggtgacaggctcgagtnnnnnnnnnnggccatggctcgagggaaggtatccgcgtttgcagggtgcactccgatgaggcgcttgatgaagcgctctccagcagtaggctcccagaacatggcccctgccttgcctggcggcaatgccccttggcgtttgcttctatatggggtgccgatagcaggttgtgtgctcggcaaaccagtccgtgccctccctcctccacctcccacccctcaacgcacgcacgcacacacactgccacaaacccgacagtaccgtgcgcgccagctgcgcatctccggctaccgcgcggcctcccccactcgccgcgccaagctgctggctgaggcggagggcgcgctgcgggcctgcatggccatggaccccactgacggccgcgcctacgtggcgctgggcaaggtcctcgtcagtggcaagcgcttcgccgaggccgaggcgctttacgagtctgggtgcaccgccacctgcggcgccaacgcccacatctggacggcctgggcccacctggcgcgactgcagggcgacctggggaaagcgcgccgcctgttcgacgccgccattgtggcctcgcccgcgcatgccgccgcctggcacggctggggccagctggaaaggacggagggaaatgtgaagcgggcgcgtgacctctggatcaaggcaggaaatggtgccagcaggggactgagaccgtgcaggcaaggggagaaaagtggaatgcatgtgggttctgtgcctcttgttaatgaaacgcgaatggtgggatccccctgtgagctcaattgtgcaaagttgtgcaaaggtgtttttgtgccagtgagaccctgggaaatccgactcgtgtgtgtcaatgcacgcaccggcccctttcctccctcctccacccaagcacagggcaagtccagccaggcgctgtggcacacgtgggcggcgttggagtccaggcgccagccggtggacgccaaccgcgtgcgcgcgctgtaccggcgcggcctgcaggcggccccggggtcacgctacctcctcctgtcctgggccatgtgggagaaggcggcgggggacgtggaagccgcgcggaagctgctggagcagggcacccaggcttgcccgcgggacgcggcgctctggtcggcgtgggccaagctggaggagcagcagggggaggtgggcgtggcgcgggagctgtacaagcagggctccgtggccgacccctcgcacctctacgtatggcaggtgggctggggagggactgtgtggtctccaagtgggaatgatggagtggctggggccccaagcttgagcagcggagagtttgcttgtaccatccgaccccatgcaagcctccctccgaccgcccagggctggggatgcctggagttccgccagggtaacaacgactccgctcgggcgctgttccagaggggcatctccatgtgccccccgcgcgccaagagcgcagcgcacctgttccagccatgggcggtgctggaaagcaggaatggaaacacgaggcttgcccgggagctctttaagtgtgcggtcaaggcagacccggagagcagtcccagttggaatgcctgggccgacatggaagccaatctgggggcgctggagagggcgaatgaactgcgcaacttttccatgcaggagcggagggaggtggtgaagcccttcaacttcacgacgctcccgaaagcaggcaccttctccagcatggtggccaagcttcttgggagggaagacctcaacgatgtcatcccttctgagaagaacccagacatgcttttcccctga

SEQ ID NO: 5527 - DNA, 2064 bp, Chlorella protothecoides
  modified_base (188)..(197): a, c, t, g, unknown or other
  modified_base (514)..(523): a, c, t, g, unknown or other
  modified_base (961)..(970): a, c, t, g, unknown or other
  modified_base (1055)..(1064): a, c, t, g, unknown or other
  modified_base (1305)..(1314): a, c, t, g, unknown or other
atggctcgaatctccgcatgcgcggaggtcgaagccgcctgggtcactccaagagtgtccatgacagccacacaaggtgaggagagtgcggggtatcgacgccttaatcagacgaactcatggagtctttggagtcgcagcgggcatggtggagattttggagcccgggcctccgatcgaccacccgnnnnnnnnnncgataaacggcaaagctcatggagtctttggagttgcagcgggcatggtggagatgttggagcccgggcctccgatcgaccacccgaagtctgtttgatcctggcgcccgatcgtcttcatgggccagctcacagacacgcctgccagtcgtcccatgggcgaaggggttggcatggccgctccttgcagcgctcgcagggtgagttccatgtttggagatgcaggacgaagcttggtcactcgagatatctcttaacatggtcgacatgtcgagcacataagatctggagtgtcagcattgtcctgtacgccccannnnnnnnnnctggaggtgcaggacgaagcctggctagccgatccagatctgcggtcatcgccatggcctcggccgcgccgtccaacatcctcatgctaggaccttgtctgtcttggagatttggagcaccttggaagttatcatgtagccccatccaggccatgcatgccccttgcccgggctgccccatctcttcctaccaccatccaatctcctccttcctgcacccaggtggaacccggttcatcgggcagtacctcgcccgccagctggtggaggaggggcaccaggtcaccctgctgaccaggggcaaggcccccatcgcggcccgcatcccggatgacaccgacgaatcgcacgccgcctattctgacgcggtccagcacattgcggctgaccgaaaggatgccgacgctgtgaagaacgctctgaaggggcgggaattcnnnnnnnnnnctctcgtcctaccaccctccactctcctccgtcctgcacccaggtggaacccgtttcatcgggcagtacctcgcccgccagctgnnnnnnnnnntcttggtgtgagggccggagggaaacagtggggcttgtatgtgacgctgccaccaccttgtgctggatacgatgacgcagacgtccctgagaccacctgtgcaagctcaacctccctgcaaaacccatgccatcatgtcctggtgacagcgatctcagccccacgccccttccccatgcagttgtgtacgacatcaacgggcgtgaggcagaggaggcagatctcatcctggaggccctgnnnnnnnnnncctcggtgtgagggccggagggaaacatggggcgtgtgtgtgacgctgctaccgcctcgtgctggataccatgacgcagacgtccctgagcccagctttgcaagctcaacctccctgcaaaacccatgccatcatgtccgggtgacagcgatctcagccccacgtccctcccccatgcagtcgtgtacgacatcaacgggcgtgaggcggaggaggcagatctcatcctggaggccctgccctccctggagcagtacatctactgctcctctgcgggcctctacaaggcctcccacgagctgccacactttgagacggacgccggggaccccaagtcccggcacaaggtcggagggggaggagaggggggttgacaaggtggaggcgccgagggaataccctctcgcattggccccccaaacccgcccttgggcccgtctgcatgggcgcttcaccaaggtgagccaacctcatgcacagggcaagctgaacaccgaggagctgctggagaagcgcggcgtgaactggaccagcatccgcccggtgtacatatacggcccgctgaactacaaccctgtggaggagtggtttttccaccgcattgcagcgggacgacccattctggtgccgggcaagggcaaccaggtgacccagctggggcacgtgaaagacctggccaccgccttccggaaggtgctgggcaacccaaaggccgctcgccaggcctacaatatctcgggggagaggtga

SEQ ID NO: 5528 - DNA, 648 bp, Chlorella protothecoides
  modified_base (342)..(351): a, c, t, g, unknown or other
atgagagggattgctcctcctgttccccagcatgtgtttgggccatttcatggccttacagcacccatcagtgagctgcaatcccttgcacatgcaacctccctcccccgctccaggtttgtcacctttgacggcctggtcagactgtgtgccgaggccgccggggcccccgagcccgagctggtccactttgaccccaaggcacacgacctgggcaaggccaaggcattccccctgcgcgaccagcacttcttcacctccatcgccaaggtctggcatcgcccctactgcaagctctcctgtgctgcaagttcaacagacagctcttcctcgccccctccnnnnnnnnnntgggggttggggtgggtcattgtccaacagtgctgtcccggtgcggaagtccatgacttacccaaggcatcgcccctactgcaacctctcctgcgctgcaaattcaacagacagctcttcctcgccccctcccaggcacaagctgatctggactggaccccggagttcgacctggccgccggcctgcgtgactcgtacgagaaggatttctccaagactgggggccgcaagaaggcggacttctccgtggatgacctcgtgctgaagggggccggcaagcaggccgtgcctgcctga

SEQ ID NO: 5529 - DNA, 2331 bp, Chlorella protothecoides
  modified_base (138)..(147): a, c, t, g, unknown or other
  modified_base (413)..(422): a, c, t, g, unknown or other
  modified_base (547)..(556): a, c, t, g, unknown or other
  modified_base (1098)..(1107): a, c, t, g, unknown or other
  modified_base (1741)..(1750): a, c, t, g, unknown or other
  modified_base (2303)..(2312): a, c, t, g, unknown or other
atggtcccccgtcaacgaatcttgttgcgctccgcgaagagtgcccatgagaaaaatcccgtccgaaataaaacacagaatctcgcaagttcgtggccgagacacgtccatgctttcctgggtcgaataggggcagannnnnnnnnngggtgtcagagccagcaagcaatttctcgtcagggatggtccctcatcgacgaatcatgtcgcgctccgcgaagagggcaggctgtctgtcatcctcctgcgaacgacaccgattatatcgccatggaacgaccatggacgccaaaaagctccactcatgctccagattatcgctcaagtaccacgttgactcctccaagcggccacgcaggccgtcatcctgtccgctctcacccgggattctcgggatggttgcaacccttctnnnnnnnnnncagccctccggtgaggcgtgaggggctagagagtgctgctctatctttcggtcatgaacgacgcgctggcgattctgaacagaccgcggcgtgtcgtctcctggccagcatgcagcatcagcttnnnnnnnnnnccatgttcaaagggagttcctacacggggctcccagcaaacctcatctccagcgccatggctctgcgcagtcagccctccggtgaggcgtactggatcgaaagtgtgggacaatcctggcagggattgatgggccaggttgtcggcaagatggccaggttgtcgccaggaaggccaggcccttacacctggcttccgaggcgtgtgcctagcgccaagcctgcattgtggcatgaccgtttgccatctctcatccagcccgctcatcactcccccactcctgcagggtggcgatcagcggcggcatgtctggcccgggcccccaccccttcaagcagcctcttagcccggggtcggggtcctgctccccttccgacagctccctgtgcagctcccgggccggaggccggtccagctttgaggagacgccccccccctcgaccctgcccagcatcaacacccgcgccttctgcgacgccttctcctcctccacggcctcctccccccccgccgccctgcgccccgcccccacccaacccctcnnnnnnnnnntccacggcctcctccccccccgccgccctgtgccccgcccccacccaacccctgatgggtcagagcggcaagggccacgaccgcctggccctggccactcctcccagtgcgctgggcagcgacgcctggcgcggcgaccaccccgcgccctttggccgatgcagcatggactggccggcggaggaggagcgttgcgtggctgcgagtcgcgagctggacgcgcgcatgaactcctcgcggcagaccatggacttcgtgcgcgcgcggcgcgcgcgctttgccaagctggaccgcggcgcgctcaccgtctggcaggtgctggacgcgctggaggacctggcgccggggtcgcgcgagcgcgccctgtacaccgccgacgcggcggccaagctcttccccgccctgccctggatgcccgtggtgggcctgctggcgcgcgtgggagaggtcctggggcacgacaggtgggatgaagagggaagcgggaaaagtggttggtggtggggagacaagcatgcctgttgtgcttccagagtggtggctgtgcgattctacctcgagcctttcaatgtggccggcgcacagtgtgtccatcgatgcatcctgctttatgaacagggcttccagaggacgnnnnnnnnnnttccagagtggtggctgtgcgattctaccttgagcctttcaatgtggctggcgcacagagtgtccatcgatgcatcctactttatatggggctccgagcccagctggctgttacatgccgaatccttccccgtggggtgcagagtgcgcgctgcggtggcggccagcgcctttgccttcaccaacccggacaggcgcaggaaggcgtactccacgcccaccggcatgtacagcactgggtgcgggctggaaaacgtctacatgagctggacgggggcggagtacctgtacatggtcctctccctcaatggctcccgcctgccgcccgaggcactcttcctcctgaggggaactgacttggtagggatgactacatcaggagaagtgcatgcaccgatggggtatatcgtggaaggagttgtgatactctctcgccaatctcagcgaaacggacctctggatcgcttgccagcaagagctgagatggccaggtcccgccctgaatcggctatcgtctcatgcctgagccgtcaccccctccccattcctcttcnnnnnnnnnnatcgtggaaggagttgtga

SEQ ID NO: 5530 - DNA, 3474 bp, Chlorella protothecoides
  modified_base (1794)..(1803): a, c, t, g, unknown or other
atgatcagactcagcgatgccgcggcacccgctccccgattgccgcacaagttgggaaagagcatatggatacccttaataatgctatcattggtctcaggaagagtcgtgcgtggtaaaggactggcagtcgctgtggtgggcgtgactggactcgggggtcaggctatgaacatgctcgcttccggcgccacgacgcgcgggctgccttgtgctacacggccactggtgtccctggtgggttggggcgatgggaagtatgggttggcatgtcatcggctcttcttactccggggcctggtgtattgcatggacttgattgctatactgaatagatggactcgcataaggttctccatgtccagccagaagctcagagctagagacgctgatgggggtagaggtgcacggcgtgccaagcaatgccatctgtcactcacccagcatgcatccaatgcgcaggattttggtgcgagagaccccttccctggtgagatcgccaccaacttcaccgagaagagctttggaaacgagaacacggagcacctcataaagtgcgatgtgggcagtgaggaggcgcctgtcagaccctggacagggcgggggctgctgcacatgtggggcttggtgtctgagaagctgcagtggggatgcttcaaccaggagttgcgatcccatgcccctgagtattgtctccagaaggttctcagtgactcacccaaacataccctctcatgtctctccaacaggcccccggatggcctggcatccctggttggactgaagaacaggaagtgcctggcctgcgagggcggggatgtcaagcccctgaccgactccgaggccgagaagctcaggcatcagatctgggatggctatggtggggacactgcagacccgcgagtgctgctgatgtcttccggcaaagtgccggccaggggagatttgacacagtctctttttattttcaagttcccagatctgaaagagcgccactcactccagacccatccatgtcttgcagtgccccggctggagattgacaaccaacgacaagggcatcaagagcagggaatccttatcgaccctttgagagactttgtggcagctgtgctagacgtaagagtttgcagtgcttcctctggtgatggtgcagctcatccggccgcacaatccctcactacgtcgtatctctctgcctgtcatcccttgagcagggtggccgcggtggcagaagccgagggccaccaccccgacctccacctggtgggctacaaccgcgttacggcggagctgacgacccactctgccaacggcttgacagagaacgacttcatcatggcggcggtggtggttgcaagctgttgcatgctgcgcatagagtgggcagagggcatgatgggcatttttagagaaggaaagggcaaatgcatcctaacgagagagcatgttttagagacatcatggctgaactacagtcaaactgaagttcaggacgctcagatctcaacccttgtgtttgcaggccaaaatcagcgatctggacgtcgccgacctccagcccaagcgcaagcccaatgtgtgtgtttgccatggatctcacgatgttgtaagggcacgactgagtatcgattgcacagcgaggagcacaagggcgggtccgtgcaaggagaagaaattgtattatcagggtttgatggcgctgccatacccagcagtgctccagtcgttcgtttgtgtgctatcgggcgagaaagaccttgcacgctggccaagtggggtgctgcctggtannnnnnnnnngtatcgattgcacagcgaggagcacaagggtgggtcggtgcaaggagaagaaatcatattatcaggattttgttggcgctgccatacccagcagtgctccagtcgttcgtttgtgcgctactgggcgagaaagaccttgcatgctggccaagtggggtgctgcctgcccctgccctttacggtcggcgtctcacgcaacaaccaccttttggtgcacacatggcccctccccagcgccaatcagcgagacagacgaggttgaatgtccccaccccccctgaggggctcgagtctcatccaccccaggcacccaaaagcacaaggatccacccatctcaccaggacagagggtgggaaggccgcgcaagctggacgaaaagggggacagtggtgtgtcctggcgatgctgtccaggcctccccagcgcaaggtcggcggggccaagggtggcaccgggttgccatgacccccaacccccagcctccaggtccagcgtcagcaggcagccttgcatgccctcgggaggggggctgggcggggaggccaggagctccaagcacaggtcggacagggaggggctgggcgggctggcggggcaccgctgcgcggcaggttccgcgtccgggcagggcgtgtgggtggctcccgcctcatgcgccgcggccactgtgccaggctcgaagccgccgtgtgtgtagcgtccacaccaggctgtggcatggcggtggggagagggcagcggggtacgatcggtggtccgaccctccacaaagctgtgattgctgtagggagggtttgcagcccacccatcgccacaacagtacccacaccccatgctctagcccagcacatcccgaatcaaaatggcaaaggcactcaccaacgtatatcacggggctcccgggaggttcctcgggaaagcgagcctctgcgcagtgccgcaccgtcaccggggtggagggggggtgcaggggcacccggatgatggtgggccgctccggcaaggtcacggtcgtggtccagtctggccggcaggagtgcggggatggtgagcagggtggccgtgcatatgtgtctctgacagaggcagggctcactagaaaccagtggaaagttgggatcacggttttccaccagtgcaccgttcaccggctccatctgctggccgtgtgtcaagcagccagccagtgggctgcggtctctggacctggtaacgatggaaatgggcttctcagagagtgttctcaggcaaacacaagtcgtcatgtccacttccgccactcacagtcgttccatgctggcatgatgatcactgtcattcgacaagagcattcacgatggaatccagcaatgaggcacacggtgtacaaagagcttgtggtggcagtccctgaatccatccatgctgacccgccaggcacacctgatcttcgctttttagtcacattagggcctaaaaagagggaatatggggtgcaaagcccgagtcacgactcccgttcaatccgaaccctatcgatccatccaggatatcgaagtcgtattcatttgtttccagtgtctgctcggaagattataagtccaggcgagatgggagggggtgccggcacaacgccaaattcttgccgtacacgaatcagatctcagcgagcagctaccaatccagactga

SEQ ID NO: 5531 - DNA, 582 bp, Chlorella protothecoides
atggcctctcacttgcaatccattcagaaaagggcggggatcggggtgggtgggcgcgcgccaccgcacctgggaggccgccagcctgcggcgccaggcgctcctcgatccgctgcctgcctctctcccccggacccgcccctcgttcaagcacagcctcagagccgcgccggggtgtggcgcaggcggaggggcgggtcgaaggcggcggccagcacctcctccatccgctggcagcccaggacctgcatgtcctcgcgcaccgaagccggcaggtcatcccgcacgtcccgcaggttgcgcacgggcaccagcgcgcggcgcacgcccgcggcatgtgcggccagcagcttctccttgaccccgcccaccggcagcaccaggccgcgcagcgtcagctcccccgtcatcgccacgtcggcgcgcacggtgcgccccgcgaataggctgacgagggccacggccagcgtgaccccggcgctggggccgtccttgggcaccgcgccggcgggcaggtgcacgtggacgtcccagcacgccgcgggcgaggcaggggcgtcgcggtgcgaaccggccccggca

SEQ ID NO: 5532 - DNA, 414 bp, Chlorella protothecoides
atgcagaccgcgcggctgcagacacagaccatcagcaggagcgcgcccggcgcgggccccgccgccccccccccggacctctctctgcgcatctgcagcctgcctccccgccttgaccaggagcgcgccttcctgctgggcctggaggtccacaacgccggacgccggccctccggcccgctgctcgtgtcgtggcgcggctccgccacgacgggcgccgtggtggcctcgggccagcactctgtccccgcgccggccctggcgcccggcgagcgccaccgcgtggcgctgcgcttccttcccctcgccgccgggcagcagctgctggccggctgcctgctgactgacgagcggacgggggcggtgctggacaccctgcagccacgtgaggtgttcatccaccccggcgcctag

SEQ ID NO: 5533 - DNA, 711 bp, Chlorella protothecoides
atgcgcgagggagcagttgaccgcgccatccgtacgagcgatgccccgtccggaaattggatcgaggcgggaaacggacctcacctgacgccctcgccccggccatcccagtgcgcctgcgcccttagtgggcggggcatgctccagcccacagtcctggagatgtctggagtgccagcggagccaatgcaaggcgaacatgagccagccggtggctcgactggggacacgccagaggtagaccctgttggcgagcctggtccctcccacacagccccagaaactcccggagcaatgcctggatcggatgcgagcaatgaagatgtgctggccctgctcccgaaacatacggacttctccgaggaggaggaggaagaagaggcagccccctcccaggccgcctcccactacagccacctcccccagcaccagcctcgggtcccgctcccactgccccacacggaaggggcctccccccagcgaagatcgtccagccgcactgccgccatcccgcgaataaacctgaacaagctggacatcaacgccctgcgacgatatcgcacgctgcacggcctgccgggcatagggccccacacctccaaggaccagctggtggtggcagtggccgaacacctcagcgcccagaccatggacgagatggcggtgctggagaagttcagggagcgggccaagcgatacaaagcgctgtga

SEQ ID NO: 5534 - DNA, 549 bp, Chlorella protothecoides
atggcggagccccactccctcgctttcagggtgatgcgattgaatccacccaaatttccggacgacagaccctacaagtttgatctgctgaatgacatggaggcgatcccctcggtcgacccccagtcgctccccctgcagcaccctttcgccaacagggtgcacagtgccgatgatggctttggaccatccgcagtcctggccactcctgccactttcgggactgtgtacctgggacacacttttcgtgcgtgtgtcgtgctgtgcaatctggatcgcacaccggtgtccagcctctccgtcactaccgagggcgggagggccctcctccacagcaatgccgccggctcccatctcaccctgcccgctggtgagcagcacagcatcctgataaaccatggcatcaaggaggtggggctgcacaccctcacctgctctgcagctttcacggatgcggacgggaatcgtcggcaggagtcccaggcattccgattctccgccgccaatcccctcatcgtccggaccaaggtgtggaagaatatgggctag

SEQ ID NO: 5535 - DNA, 345 bp, Chlorella protothecoides
atgccgtggactggggtgaacccggtgcaggaccctcccgagtatgacccagagaacaagtatgcagaccctgtgctgtattacaggcaccgcgaggccgctgtgacggaggcctacatcaaggtctcggaggccaaggtcctgcgtcgcaagctcaaggagtgctaccggacagagggcatcgaccacctcactcagtgcaaggaggtgaggcacggggttgcgctccagcaccgagggagacaggtcgcacaaaagtacctggaggccatcaagggcgtgggcatctacaaggccaactctggcccgcatgacaaggccacctgggccaaggacaagcaatga

SEQ ID NO: 5536 - DNA, 1005 bp, Chlorella protothecoides
atggaccttttgtatgacaaaccctcgatcattaagcccgcgcccacggccttccgcgtcgaccggcacttcctggacggccagcgctacaccgcgggcagcatcgcgcgctacgagtttgtgtttggccagggcttcatctcgcccggcggcgagcggctgacgcaggagctagcggcgcggctgggcctcaaccccgacgcacacgtgctggacgtgggttgcggcgtcggcggcagcgccttccatttggcccgcacccttggctgctatgtgtacgggatggacttgtcggccaacatgatcctgacggccctggaacgggccgccgcctcgggcaacggcgacaaggcgagccggcggctgggtgggatggagggtgggcctgccagtcgagtcccgggtttgccttcgggcaaggaggcatcatcggcccccacgcagcggccctgctgcccggcaccccgtgccactcgctgcggacctcacctcctcagccccccttgccccacgcgtgcgcaggtgtccctggaggtgagcgacgccacgagacgcgcgctgcccgaggcctccttcgacgcggtcttcacacgtgactccctgctccacatccacgacaagccggcgctgttctcccgcctgctgcgcgcactgcgccccggcggccagctcctggtcacggactactgccgcggcggcggcccgccctccccgggcttctccgcctacatcgacgaccgggggtacgacctggtggcggtggccgagtacgcggccctgctctccgccgcggggtttgaggtgctgtctgcgcgggacgaaacgccgcgattcgtcgccacactgggcgccgagctggagcgcctgcgggagcgccgcgacgagtttgtggcgcgcttctcggagcgggagcacgccgacatggtggccgggtgggaggccaagcttgagcgcgcccacgcaggcgagcactgctggggcgtcttccacgcacggcggccatga

SEQ ID NO: 5537 - DNA, 1257 bp, Chlorella protothecoides
  modified_base (1037)..(1046): a, c, t, g, unknown or other
  modified_base (1130)..(1174): a, c, t, g, unknown or other
atgcagcgggtggggccgtggggctggcaccccggctggccgctacgcttgccagtggcccaggtggtggatgcttcagatgaaaaaattgagattaagagctcggatcaggaacctttcagactgcatatcgaaatcgtgcagtttgtgagtctacagcaccccacacgagttgggcgcgagtgggaaaaccttgcattgtttgtgaagctacagcacccccatccgagttgggcgcgagtgtttgatggggaaaccttgcattggttcatcagccggaaccatagtgacgcctccagactcacattctgcgttcgatcggcttcagccctggctcatttataccatagaggcacacattgtgttatttccaccagtcacttgtcagacaggggtgccccggtggcccaccgcgcccctggcgcacccaccatgttctacctgctggagttgaaccgggagctggaggttcagccgcggcattttgggccaaaactagcgcaagaagtagagaaacgcctcagacaggaggtaagcggtctgggagggatgcaaggcctcaccatcatgctcggattgcccatactgaacctggagagcctgggaaaggcccgaatccgcgagggtgctggatcggcggtgttcaatgtcacctacaagtgcatcacctttaagccacacaagggggaggtgctggacgtggtagtgaccacagtgaacaaggtaggggtccctctccaccgccaacacccccgcccaatgacacagatgggcttctttgcggaggcgggaccgcttcaggtcttcgtgtccaaccatttgatcccggaggcttttgagttctccagcatacacgagccgtgctacgccaccccggatggggagcagaggatagccgccgcctccgatgtgcggttgaggatcgtgggcacccgcatcgatgccaacgagatcgtgagtcggtgggctacgcttgtggatttttgtggctcagacggtggtgcaagggagtgccacacgagcgatctacatgtggnnnnnnnnnntgtgagtcggtgggcaacgcttgtggatttctgtggctcagacggtggtgcaggggagtgccacacgagcgatctacatgtggnnnnnnnnnnnnnnnnnnnnnnnnnnnnnnnnnnnnnnnnnnnnnctacaaatgacctgagtccctgggcttggaatatctctggtgcggccggcacgcaggggggaagcacctgcttccctgcctga

SEQ ID NO: 5538 - DNA, 330 bp, Chlorella protothecoides
atgtacaagcagggcgatctgaacgacatgtgggtggtggccaagcagacaaacctcacctttgatttggtgcgtggcaccagatgtggcgaggggtcccagggaggcatgcatgcagggcgctcgctggcatggggtgtgccagcgttctcgctcgccccgcagggccacccagggagtgccagaggaatgcgaaacgtttccttcatcgccggctgctcgctgctcatctttgctgccgccgcctacatcttcacccggaaacgcccggtgtacctgctgaactaccattgtttcaagcccgatgataggtgcgttgggctgggttga

SEQ ID NO: 5539 - DNA, 984 bp, Chlorella protothecoides
atggcggcggcgcgaggggaggccaaccaggtcctgtttgagtcggtggagcgagtcctggccaagaccggcatcagccccaaggccgtggacatcctgatcgtcaactgctccctcttcaaccccacgccctccctgtcagccatgattgtcaaccactttggcatgcggagcaacgtgatcacctacaacctgtccggcatggggtgctccgcgggcgtcatctcgctgtccctcgcgcgcgagctgctgcaggtgtacccccgctccaccgcgctggtggtgtccacggagaacatcacccagaactggtactttggcaacgccaagtccatgctcatccccaactgcctcttccgcctgggcggcgcggccatgctgctgagcaaccggcgcgtggaccgctggcgcgccaagctggagctgctgcatgtggtccgcacccacatgggccaggacgccgcgcactacggctgcgtgtaccagcaggaggatggggccgggcagcgcggggtgcacctgtcgcgcgagctcatgcgcatcgcgggccacgcgctcaaggccaacatcaccaccctcggcccgctggtgctgccggtctccgagcagctgctcttcttcctcaacctggtggcgcgcaaggtgctgaagcgcaagggcctgaagccctacatcccggacttcaagctggccttccagcacttttgcatccacacgggggggcgcggcgtcatcgacgccatcgagcagcagctggagctgggcaccaggaacgccgcgccctcgcgcgagacgctctaccgctatggcaacatcagctccgcctccatctggtgcggcctgcgcaagggcgaccgcatctggcagatcgcattcgggtcgggtttcaagtgcaactccgcggtctggcgcgcgctgcgtacctgcaacgagcagcacggggcgtgggtggagggcgggcaggcgggcggcaaggccgtgtga

SEQ ID NO: 5540 - DNA, 798 bp, Chlorella protothecoides
  modified_base (371)..(380): a, c, t, g, unknown or other
atggggaagcacaatggtaagtcccgcaagtcgggactctccgtgggtcagtccctggtgaatcgcgctaagcgggagggcaggaccgccggggcggcggcacacatgtacaccacggacctgggccccgacaacaacatgcagagcgtgatcgagcgcaacgacctggacgagatgatggccatggtgaagctaatggatggcgtggggattgccttggcatgcatgccctgcatgcacgcgctgttggggtggttgaaggtggggcgcccctgggcacatatcccaacctgcccatgccacgctggcggacaaggacttctctgcagagaggcagaatgtggtggtgatcagcaccggctcggtggcgnnnnnnnnnnggcatgcatgccctgcatgcacgcgctgttagggtggttgaaggcggggggcgcccctgggcacatatcccaagctgcccattttgctgcccctgcaaggagggggctccctcctattttatcccttacgttctctcaatccccccatcccccctcccctctccaaggccacgctggcggacaaggacttctccgcagagaggcagaacgtggtggtgatcagcaccggctcggtggcacccagggacaccgagcgcgccgaggccgagcgcagcgctgcggaggagcggcaccgccaccgcctcaccatcccgcgccggccgtcctgggacgaggggaccacgcccgcggcgctagacgcggaggagcgcgcctctttcctcgcctggcgccgcgacctggcgctgctggagggtga

SEQ ID NO: 5541 - DNA, 1800 bp, Chlorella protothecoides
  modified_base (862)..(871): a, c, t, g, unknown or other
  modified_base (1231)..(1240): a, c, t, g, unknown or other
  modified_base (1626)..(1635): a, c, t, g, unknown or other
atgagcacaagcccgagttcatcgccggcggtgccacccagaacagcatccgcatcgcccagtggatgctgcaggtgtgcctattggattggaggttgtttcggtttcatagtgggtcgtgggagtagcagtgcattcgcccctcctcaacaccccatccaccacttaacgatcatccacggcccaccctcggcgcaccaggttcctggcgccaccacctacatgggctcagtggggaaggacgagtacggcagcatcctggccgcggccgccgccaaggatggcgtgcaggtgcggtaccatgtcgacccggaggtgcccaccggcacctgcgccgcctgcattgttggcggggagcgctccctggtggccaacctggccgccgccaacaactacaaggtggatcgaccacctgctcaagccggagaattgggcggtggtggaggctgcccgtgtcatctactccgccggcttcttcatcaccgtgtccccagactcgatgctgaaggtggcccagcacgccgccgccaacgacaagcagtacgcgctcaacatctccgcgcccttcatcgtggaggtgccgcccttccgcgccgccctcaaccagctcctgccctacgtcgacttcctggtgtgtgcggggggggcgtgatcgttgttggggaggtggggaggtggaggagcctgtgttgggttgccactgggcaccaggcgaccctgcagggcggggcgggggctggccacagcaacatggattcccctcgcgtcccaccgggaatcttgctaccatcgcataaggctgccgacaaccatccccctccccgctccttgaaccagtttggcaacgagaccgaggcccgcnnnnnnnnnntgggcggggcggggactggccacagcaacatggattcccctcacgtgccaccgggaatcttgctgccatcgcatgaggctgccgacaaccattcccctccccgctccttcaaccagtttggcaacgagaccgaggcccgcgcctacgccgcagcggccgagtggggcacggaggatgtggaggagatagcgctgcgcatctcccgcctgcccaaggagaatggcgcgcggccccgcacggtgatcttcacccagggtgccgatcccacggtggtggcggtgcacggcaaggtcgcgctcttccccttcccgccctccgtcccttcaacgatcattccctcccaaacacaaaggtggtgcnnnnnnnnnncgctgtgcttgcgtggactgctttacagttcccgccctccgtccctccaacaatcattccctcccaaacacaaaggtggtgcggttgcccgccgagaagctggtggacaccaatggcgccggcgactccttcgtgggcggcttcttgtcgcagctggtgaggatcacgggggtgggcacagggggccagcggtggttctagctcacccactgcatcgaggcacaaagctgttgtgcgagccttccctgcccttggggctgctcagtcctgccaacagatcatcgtgtgctcagatacccccccctcccccgccgtccatcccacaaccccccctgccctcacccccccaatctgtaggtggccggcaagggcgtggaggagggcgnnnnnnnnnntgccgtccattctacaaccccccctgccctccaccccccaacctgcaggtggccggcaagggcgtggaggagggcgtgcgcgccgggcactacgccgcctccatcgtggtgcagcgctccggctgcaccttcccagacctgccctacaacttctcctgggcctga

SEQ ID NO: 5542 - DNA, 1224 bp, Chlorella protothecoides
  modified_base (713)..(722): a, c, t, g, unknown or other
atgtttgcccccggcgccgccgaggcggcgccgggggcggcgggccccttggatttcctccgctccaaccagcagttccagatgctgaaggccatggtgcagcagaaccccgccctcctccagcccatgctacaggtgaaaaagagagaagggatgtgcaaagtgtggccagaaggggcaggccggtacgaggagggcgaaagcatgatggagctgggccggaacaacccggcgctgctggagcagatcaacgccaaccaggccgccttcctcgccatgatcaacgagcccagcgcggcggggggcgcggacctggagaccctggtgcagcagctggcgggcgagtacgagggcggtgagggcggcggcgaggccatggacgagggggatgtgccccctggggccaacgtggtggaggtccacctctcgccggaggaggtggaggccgtcgagcggctcgtgggcctcggcttcgaccgccagcaaggcccagtgtgcatctctcggtaccaactttgccttgcatcgccacaggtgtgtttggaggcgttcctcatctgcgacaagaacgagaccctggctgcaaactacctgctgtacgtgtgtgtggggagggggggaggaggggtgtgtgtgtgtgtgcttgctcttcttgtctcgggctctggaaggagaagagcgccgtgcgaccatgtgaactcagaacgctttgnnnnnnnnnntggctgcaaactacctgctgtacgtgtgtggggggggagggggaggaggggcgggaggggtgtgcttgctcttcttgtctcagactctggaaggagaagagcgccgtgcgaacatgtgagctcagaacgcttgtggtcaagcactagcaagaaccaggtcgctgtgttcgaggggcccatgtcgcccatggcgtgctcgccccctcctcacgcagggagaacgggcaagacgcatagcgaggcccctgcaccgcttggccactgtcctccctgcagctccaactctgcatgtgcagcgctggagccctgtcctgggcgctgtgcatgccggcactcccgatcctgcaaccgccgggcccctgatgccctgctctgcgcactgtctcgctgtgacacacccacacacattccccttgatggaacggatgcattgggccgactttacacgaatgtcagacaaggtgggaagcagcgagaagggacaagcaacccgacatggtga

SEQ ID NO: 5543 - DNA, 561 bp, Chlorella protothecoides
  modified_base (248)..(257): a, c, t, g, unknown or other
gggtccgccgcggctggcgcctccgctggaggctacgaggaggccgcctcccagcttgccaggggctcggagctggaggccaaggtggccgccatcgtggacatgggcttcccgcgcgaggaggtgcaacgtgccatgcgcgccgccttcaacaaccccgagcgcgccgtggagtacctcatgtccggcatccctgccggcctggggttgcacagcggggcatccatcacagttgcctctcccacccnnnnnnnnnncgccgtggagtacctcatgtccggcatccccgccggcctgggggtgagtcatgtgtgtgtggggggggggagtttggatgttggagggtgtgtcatgggggcgggtgctgggaacagtccctgcgctcgagcgccggggctggcgaagggagcagttggggccttggcaagcactgccacagccccgtccagggtctcgggggctctacagcctcccttggagtccctgcacctggctgatgttctgagctgcacagcggggcatccggcacagttgcctctcccacctatttctgcaggatga

SEQ ID NO: 5544 - DNA, 801 bp, Chlorella protothecoides
atggcagcgcgcgtgtcgtgcgccacgccggtgctgggccccgtgggcggcctgctgggggtgggcctggcctcggcgctggccgggcaggcatccctgctctgccgcgagtcgctgcacggaggcggccgggccggcacgcccggcccggccgccgcccgcccggcccgccgcggctggagcgcggagacgctgctggtggacgccgcgctgggcatcgcgctgttcaagctcatgggcggcaggttccgcagcgtcatgcccagcgacctcagccgcgtgggcgccattgccctggagtccatgcccacgcgcggcatcgagtacgccagccgagggaagcggcgcgagctgttccgcttcttcaagaggcacgctgtgggggggttgatccttggctcgaggcggaggcgatttgcagatgcaggcgggccgacgtttgcgggggtgccatcaggtggcttgcagatccaggtccagtgcccccggctgtgggcatccagcgctccctctgaccactccaccgggttccgcgcgcctcacagggacgggtgccatcactgcggaacgcgccgcggcgacgtcatcggcgatcacatgccccccaacaagctggtcctggaccgggtggaggccatgcccgccgcgctgcgcacgctgcggcgcctgcccttcgtcaaggaggccagcgaggcgctgggcgtgcacctggggcccacaccgcagcggtactacccgcaggtgggcgggtggagagctgaggggggttggcggggtggactggtgggcgtgcaccgatga

SEQ ID NO: 5545 - DNA, 771 bp, Chlorella protothecoides
  modified_base (125)..(177): a, c, t, g, unknown or other
  modified_base (308)..(317): a, c, t, g, unknown or other
gaccatgccacagcctgtggggtgcagaatctgtgtgcagaccagtccgtgcctgtcccatacttgcattccctcggtggtatcgctacttgtgcgtctcccttgccgcctctcatgcactcctnnnnnnnnnnnnnnnnnnnnnnnnnnnnnnnnnnnnnnnnnnnnnnnnnnnnngatgatcccagggtactttgcatgcattggatgcaagcagtactctgcagtgcgtttcccccatctctgggactgctgcaactgtcacacccacccctaaccacccacagtggtccaactcagctgaagannnnnnnnnngaagattctagagaggccatgcctcttcctcaccaccaaacgatgccagggtactttgaatgcattggatgcaagctgtactctgcagtgcacaccccccatctctgggaatgctgcgactgtcacacccacccctacccacccacagtggtccaactcagctgaagaagccctcaagctggccctgtacctgaatgacaagtacgagatcgatggacgtgacccaaacggcgtggtaggctgcatgtgggcgatctacggcatccatgaccagggctggactgagcgtgctgtgttcgggaagatccggtacatgaactacaacggctgcaagcgcaagtttgacattgagaagtacatcgctcgggtcgaggtgaccgtgagggaggcccgcaaggcgcacgggaaggtgcagccaaagacgacagcggtgataggcagtagcgaggcctga

SEQ ID NO: 5546 - DNA, 1281 bp, Chlorella protothecoides
atgctttcgaaatcacagcgcctggtcgccggcatcgacgtcgcacgctgccagcccctggctcgcacgggcaccaccaagcacctcccctggaaccaagccccatgcccgggccgcctccgccctggccgccgccagcacggagggggaggtggtggaggttgggggcgtggtccagaaggtgtggttcaaatccacggagacggggtatgccgtgctgcggctgcggatcgacagcccccgcggcgcggaggccatcaccgtggtgggcacgctggcccacgtggccgagggccaggccctgcagctgcagggaagctggaagcggcacccgcagtatgggcgccagctggcggtgagcgaggcggtgcaggtcgcgccgcggtccgacgccgagctcgcgctctacctcgccagcggggtgctcccgggtgtggggcaggtcaccgccaaggtgtgcggggttgtgtattcctatcggctttttgggggggaggcactggtttggcagagttggttggtgatggtgctacagtccctttcctttggaaaactgcgggaaccagaggagtgctgtcggcgcctgacgcagtggcgcgcctgcgccgctgccccggcgtcggcgcggccaaggccgcgcgcatcaaggccgcatgggacgcgctgggaggcagccgcgcggggttcctcttcgccaagggcgcgggcgtgccggcgctggtcgcgcaggccctggccgaggagctaggctccggggtcgaggccgcgctgcgttgcgatccctacgccgcgctttccggccgcggcctgggcctggcgcggctggacgccgtggccgcgcgcctcgcctgccggagggacctggctagccgggccggggcgggcacgctggagtgcctgggagcggccgccaacgccgagggccattcgtatctgccgtggcgcgacctgcaggcggccacgctgcgcacgctgggaggcagcggcggcgaaccctgcgcctccggcgccctggccgcggtggtggccgacctggcagccgtcggagagctggcgctacgtcgcgccgacggcgcggaggcgcctgagtttgatattggcgcgggggctcgccgccgtcgcggcctcgcccccggcgacacgttgcgcgacgccattgcgatgtacccgttggcctccctccccctagacgcacgctgctacctgccgtccctggccgcggcggaggccgtggtggcggccgcggtggccgcgcgcgccgccgcctggcgtggccccggc

SEQ ID NO: 5547 - DNA, 1152 bp, Chlorella protothecoides
  modified_base (708)..(717): a, c, t, g, unknown or other
atggcgtctcggagcgctgttgcggaatggacgcctgaggagatgtatttcctggccaaggatgagctcatcaccatcgtcccaaacttctctctgctaacggagaatggcactgcacaatgcatcggggtgcgatgtgaatgtgcattggaggggcgagttcggaccattcctaccaaacagagagtgcaaggtgcccctctggctagccctcactctgtggaagaggaaacggtgcacaatgaaaccacttccctggatgaatgtggaccacttggaaggtgtggacctggtgcttgtgagagctgcttgcctctaacccaagtatcagaagcagtgcccgactctaccacctccccctccccacaaattctcccagctgtcctcaatctggatcgaagagatgccacggctttccagcccctgcccttccactacattgagatcgcacactttctgttcactgccggcaccgacgaggcgctggcctctggaatctttggggacaatctgacgcgagtgagtcttggcttgcagggttgcaaggatcacgctggtgttggagcttcagcagccaggggtgccttggtgcttggtctcacatatctgtgggttgctgagattatagcaaaccgatgccaaagagcatcaattctgtcttctgtgtccccccccatcaatgtctcctctccccttcagatcaaggannnnnnnnnntatggagcttcagcagccacggatgccttggtgcttggtctcacgtatctgtggatcaaggacctcgtggagttggtacagaaggcgagaatggccaaggtgctggccggcctgtccaccctccagggagccatgacggtgaagctgaacaacctggctgccatggagatcaacgcagtgcgccctttcttcctgggagcactcgacatgttccatgagtaccaaaaggaccccgacgctgacgctgggcatgggaaccgggatgatcaggggacctggtatggcgaggccgcccggcggactccgaaactgctggagctcccgctgcctgccctctccctcatcttcgacatcgccataaagaggcatcgcatcgaggctcggttcctgaaatcgccggcggtccgatcatgggagaaggatccccgcaagtga

SEQ ID NO: 5548 - DNA, 729 bp, Chlorella protothecoides
  modified_base (492)..(501): a, c, t, g, unknown or other
atgccctggcatcggggtctggcatgcttgctcattctagttctcgccgcgactcccgtacttgcaaacgacagcacttcaactgagtctctgaataaattctgcatcgtcgtgcggacgtacaggggtcatgcagacgcggagactgggctgccgcgcctccttcgctctctgcagcgtcagagcttcagcaggcgagtggtgccgggatggttccctttgtgcaagtcatgttggactgcccttttatgggaagctgtcatcctggtcatggatggagctgccttccctgagctgcacagcatagtggccgcgtctgacgacccccgcatctgggtctttgcggagtggcgcacccatcttcgcacagattgggcccgactttgcagccaagacggaggatgggatgtggtcgccctactaccatgcccttttatacaacctgacagacgatgcagtgtttggtgggccaacgggcagtggcatccatgnnnnnnnnnncactaccatgccctcctgtacaacttgacagacgatgcagtcattggtgggccaacgggcagtggcatccatgtgaatcacgctctgtggctccgggggctgcatgaaatgcaccacccatcacttgctacctcagtgtctgaccccctgatccactgttacaatccgtccgttcgcttatcccacgttgggattttgtccttgccgtttctctctcagtgtccatga

SEQ ID NO: 5549 - DNA, 1170 bp, Chlorella protothecoides
atgactgcctaccgcctgcacgacgcgctcgctggggcggggcggccgaccgtggtgcagaagagccagcctaccccaaagggcacaggcaaggcgacaaagcggcagcggcaggcacaagaggcggcggcagcccctccccccgacctgctcgccctcctcctgggcggggcaggggcagggcatcagtcacagggggaaagcgcgtcgcagtggggaggcgcccgcgacgcgcgtctagcggccggcagggtcccagaagaagcggaacgacccctccccagcaacagggcgagcatggaggaagggagcctagaggcctctgcagtgcacccactcctcgcgatgggtgatgctgccttgcaacccatgcagggcaatgggcagggcgatgggcaggttgccacccctgcaccccttgacctcggtacagaagagctgcatgccggggaagcaggactgccagcctccagtgagcccccgcggcgccgaatccagcctcagcgcctggatgccgagctcccgctgctaccaatccctgcgccaggcccgccctcccggggtcggagtggagcctccggcgagcagccggactccgactccgggtctctcccgccggcgcgggtgctgatgcgccccacccccgacatgggcgaggaggagcgggaggccatgtgggcggcctacatcgccgacaaggagtccatgctggacctgctgggggacgcccggtaccgggactggttcgacgaggactccgcgccgccccccgccgcgcgcggcgggggcggcgtggatggcgccctggacgccgcgttcgggggcgggacggcggacggcgctccggcctccctgcccgcttctttcctggagaccagcgtggccgcgccgtggcagggcgccggcgccgcctgcctgggcctggccctgtgcacgctgcgcgcctgtgacggcgcgggggaggtctatgccggggacaaggttggggcagcgaatggacccctggcctgggtccaggccctgctgcccccactcgagggaagtgatgccgtggcgctgggggtgcaggccgcgctgggcctgctgggcttccagagccgcaactgctggacggccgccatgcagggtgaggggggtggaggggtgagggggtggggccgtctgctctga

SEQ ID NO: 5550 - DNA, 627 bp, Chlorella protothecoides
atgcacggcaggccacgcgcaaaggggccacccgatcccgagcgggtgaaggccacggcccagaaggctgagcttctggggcgtcttaatgctgctgtgctccaggccagatcggctgggccggcaggtccggcagagctgcagttgacagccaggctcctggagctcaacccggagatgtacacggcctggaaccacaggagagaggccctcgtcccagtgtttaaggagggagcattctggagtgccgtgagttggctggctccaggccaacctatgacatttccacaaacaggtcagcaggccatgcaggcggcagcggaggagctggcgctcacgctgcgggcactcacccgcaatctgaaatcgtactcggcctggcaccaccgcaagtgggtgatcgggcaccggctgacgtcactggaggctgaaatcacgctggtggagacgctcctggatgcagacgacagaaactttcatggctgggcatatcggcgctttgtggccgatgtagggggtgctgggtcttggggatggggggtggcagagactgcgagactctggggtcctgggagagcaccgatggtgcaggggggaagcacgagggctgctcactcaggcagctga

SEQ ID NO: 5551 - DNA, 555 bp, Chlorella protothecoides
atgatcagcagcagccgcgcaggagccacaggtgccctggtgccccaccagacgctggagatcgagtatgagctggtcagccaggcgttcttcactgagcccgaggaccagagcggctggatctaccatcggtggctgctgggtgaggcggaggggaggcccagtagccagggttgtgtgtggcacgagactgcaaagcaccttcttccatcacaccacacagggtgctccgtggcgcactggcaggccgcccccgagtctgaagcggagcgcgccaggctggcagatgtgctggggtgccagctggcgctcgtgagtgacctcctggacctggagcccggcagcgtgtgggcgaggaagacccgggcccacctcctgggcttgatgcagagggtgggaggggcggcggggggcagcgccgggcgagggagtgggggcgaggccgcggactgcgtggcggccgcggcggcgtgggaggatctggaagggttggacccataccgagccggatactacaggcacgcttgcagcgtctctgcacgtgcttctgtgtga

SEQ ID NO: 5552 - DNA, 354 bp, Chlorella protothecoides
atggtgcgcctgcgccgcctccgttgcagggagggtatgacgcggagtgaggcagaggacctcgtggccactgcgctggagctggccatggcccgcgatggatcctcgggcggcatggtgcgactggtcaccatcaccgagaagggggcggagaggaggatggaatgggggactggagtccgccctgagcatgcctggcccatgggagagagcctcggcgtctcgccgccccctatgctgaaggaccttcaccatcagccacattcaatgcgtgatggtcgcagactgatcaagccggaggagcaccctgtgctctgggacgagctaccgacgcctctgggcgtggtggtctga

SEQ ID NO: 5553 - DNA, 480 bp, Chlorella protothecoides
atggactgcagtggtgagcacaacccctcctccacgtcacctccccacaccgggacaactatagtggcagtgacctacgcggggggggtggtcatcggtgccgactcccgtgtgagcaccggaaactacatcagcaacagggcctccgacaagatcacaccgctgacggacagggtgtacctccttcgctcaggctcggcgtccgacacccaggccgtctccgactatgtttctccgatccttaagcgcatccgcaccctaatcgttacgccccggccccccccccggccaaactcgtcctccttgtccacccccgcagtgcgctacttcaccgagcagcacgagtcccagctgcaacggccagctctggtcaagaccgtggctggcatgatcagatcggtgagtgagtgcctgaagagcggggggcctgggcagccctgtcatcccatgaggcgaacatgcatcgatgtccccccttga

SEQ ID NO: 5554 - DNA, 687 bp, Chlorella protothecoides
atgcactctgtccagtccggcggcacgcgcatccaccctcgcttcgacttccagagggtcgagaccgtgcccggccagtttgaggtgggcgggcatgggccggtggcggaggtcaagtacgaggccaggaagtaccgcgggccggatggcgagctgcacgccgtgacggccaccgactcctaccgccgccacaccgtgctatccatcgcgcaggacctgaaggacgcggtgtgccgcgtctccgacggcccctttgaccccgaggagaacgccaacatcccccaggtcacctacgagctgcccgacgggcaggagatccaggtgggcgccgaccgcttcgccgtaccggaggcgctgttcaaccccggcctgctcgccaggtacggcgcggagggtgcgccggacgacgccgcgccggcccccgccccccttcaggcggcggtgaatgagtgcgtggcgcgctgcgacgtggacgcgcggcgcgagctctacgccaacgcgctgctgaccggggggaccgcgggtttcgcctcgctgcgggagcgcctggagcgcgaggtgaccgaggcagcgcccgccctggcccgcgtcaaggtgcggggaggggggaaaggcgcctctgtgagcccttgcagcagcggtctgggctggcgaggcgactctggccgggccggtgagctcgcatga

SEQ ID NO: 5555 - DNA, 780 bp, Chlorella protothecoides
atggccggccgtgcgaccccggcgccggccgccagccggccgccatgcctcgtctgcaggatcatgatccccagtgtaccacgcgtggccctggtagagcccgactaccgcgtgacggtgaagcgctccagcaacgacccgctgtacccccagcagtggcacctgcccgtcatctccgccgacacggcctggaactcgatcaccggcaccggcgcggttaaggtctgcgtcatcgactccggcgcgcgcatcgaccaccctgacctggtggccaacattgcgggggggtggaacctggtgcccatcccgcaggtgacgggggcggcgccgccctctcccggcaccgccgcctatgccaactacaacgacacgctggggcacggtacgcacaccgcgggcagcgtggcggcggcggggaacaacggtctgggtgtggcgggggtggcctggcgcaccaagctctacatctgccgcttcatctgggatgacgaggcggggtacatctccgacgccatgacctgcatgtcgctgtgccgcgccgcgggcgcgatgatcaccagcaactcctggggcggcatcgactactccaccttcctgtacgacgagatcgccaaggcgcgcgacgctggccagctcttcgtcaacgccgcggggaacagcgccattgacatgaacaccaacccgcgctacccagcctcctacaacctggacaacatcatcagcgtcgccgccaccagcatgtccgatggcctgtccgcctacagcaactacgggacgtga

SEQ ID NO: 5556 - DNA, 366 bp, Chlorella protothecoides
atggccacgccctctgtggcgggggcggcttcgctggtgcaggccgcggcgctgtcacgcggcaagacgctgacctactcggccatccgagcctacctgctggccaacgccgacacgctggcctcgctcaagggctacgtcgcctctgcgcgccggctgaacgtggccaaggccgtcgcggcagtgctggcggacttcccacccagcccgccccccaaggtgagcttctaccctctgcctttgttttggggagtcccaggcccctgcccccgtgcccaccccctgaacccatgcccggtctggaaaaccacgcctgccatgcccgcaccccgccccctcctgatggacaccccccctgtggtgtga

SEQ ID NO: 5557 - DNA, 231 bp, Chlorella protothecoides
atgaactaccagtacaagcacctggtgggcgcgatgatcgtggcggggtgggacgcggccggcgggcctcaggtgtatggctgccccatcggcggcaccctgtccaaggaatcctggaccactgacggctccggcagcacctacatctggggctacctggacgaggagttcaggtgcgtagtgcgaccggggagaggtcgggatgcgatcccccggccaggggactgctga

SEQ ID NO: 5558 - DNA, 489 bp, Chlorella protothecoides
atggaggaggtgagaggtgctggtatgtggacgcatgcacatgtacatcattggattgctcagcctgatcgctggtatgccgtcctgtcaatcccagatgaggtgaatgccgtggtggtggacctggggtccttcactgtgaaagtgggctatgctggagaggacacccccaagcacgtcttcccctcggtgagacacgttttcgagaatgtttgtatcatgttacccttgttgccgaaagcccgaggcctcgtgagtggggtactgaacaggtcattgcccgtgttgtgccccctcaacacccagctcacccttgccggcattgatccaaaatcacaggcccttggcagcattgactcccctcccaatggcgatgccatggaggtggatggtgtcggcccctctgggaggaccttcaaagtgggcacagccagccttgccgtgccccaagatgggctggaggtgggcatagagggccaacactcttga

SEQ ID NO: 5559 - DNA, 897 bp, Chlorella protothecoides
atgcctatccactcctctcgccacccaccacagggtctgaatgacgtggcgtgggcccccagcgacgcccacctggccaccgcctccgacgactacaccttgaggctctggaatgcaggaacgggggcgccgctgcgcacgctgcgaggccacacccactttgccatgtgcgtggccttcagcgcgacgggggtgctcctggtcagcggcagcttcgacgagaccatcgtcgtgtgggacgtcgccacggggcaggccatccgcgtgatcccggggcattcggaccccatcaccagcgtcgccttctcgcgggacgtgctcaacccagccatcgtgtcgtcctcctttgacggcctcatacgagtctgggccggagacaccggaaactgcctggtaagcctcctcgccacgggaggcccacctgtctcgttcgctgccttcaccccgaacgacaagtatgtgctggcgggccgagtggatggcaagatagtgctctggaactaccacaccaagcagccgctgcggacctttgagggtcacaagaacacaaagttctgcctccagtattgtgccgccgttcaagcatgccctccctgcccacaggccgccttcctctgcctgggcgtcgaggaaactggctcctccgctccgcccgcggcggtggtctgtgggagcgaggaccaccacatctacgtctggggcgtgaacgggtcccagggcggcgtggcaccgctcctgggcctcctgcgggggcgggccggccccgatgaccccggcgagggccactgcgacgtggtgctctccgtggccgcccacccccacctccccgtcctggcttcctgcgggcacgagcgggacaggagcgtgaagatctggaggcacgtatccctgccctga

SEQ ID NO: 5560 - DNA, 1341 bp, Chlorella protothecoides
atgcctccaagtctcccccacacccccactcaggtgtacaatcacggccgcctgctggcgctggcagatgaggaggggtacctcaccattattgacacctcacaggccctcccccgcagcactgctgacgaggccgggccgcgcccctctgctcagtggctcgcccaccgcaacgcaatctttgacctggcatggttcagggaggacgaggccatgctggcggcgtcgggcgaccagaccatctccttgtgggacacgggcatggccgagcagctgggaaccttctgcggccataccggcagtgtcaagaccctggaccccatgcccggcagccgacacgtctttgcctcgggggcgcgcgacggccagctggcggtgtgggacaccaggatccactcgcggacgcccgagggcggcaccccccccgtcctcaccgtccagggggatggggcaaagagcaaggaacaggttgccatccccttgccagagctgctcaggcctgggtctgcgtgccaggcactcctcatgccccttaccaagggcgtccggtccaagcagagggtgggaatcctgtgttgtacataccagtgggccggcgagacatgctcattgaatctcccaccagctttgccttcccgcaatccctttcagcaccccaccccaccccgacactcccaacaggacgcgcacgcagcgggcgagcctcggcggcggggccggccgcgcacacccctccagggccgccccaagctgtccgtcacctcggcgctcttcctccccgacgcccgcacgctggccaccggtggcgtggacggcatggtgaggctgtgggacctgcgccgcggcggcggctgcgccgcagcggcgagaccggggcgtggccccgcgccgggcgccgccgcggcgggggcctcgctgcgccccgtggcctgcatctcgtccccacccctgggcagcgggctgaagcagcacggcgtgacctgcctggcgctgcaccccgacggcgcgcgcctgctggtcagcctgaccggcgggcaccacctggccttcgatgtacttcgccccggggcggggccgcgcgcggtctacgccgggcatgccgcggcctccttctacgtcaaggccgggttcagccccgacggccgcttcctggccagcggctcctccgaccgccgcgtgcacgtgtgggaggtggacggcccgcccgcggcggccgccgcgggcggacccgtgctgcacgccccccttgccgcgctggaggggcacgaaggcgaggtcaccgccgtggcctggtgccccaccgaccccgaccgcctcgcctcggccgccgacgacgcgacg

SEQ ID NO: 5561 - DNA, 798 bp, Chlorella protothecoides
ccgcccacgcgcgcgctgggcggcgcggagcaggcgctgctgtggcgctaccgctacgcgctggcgagcgagcggcgtgcgctcacgcgcttcctgcgctgcgtggactgggccgacggcggcgaggccgcgcaggccgccgcgctgatggcggcctgggcgcccatcgacgtcgccgacgcgctggagctgctgagcccggactacggtaatgaggaggtgcggggccacgcggtgcgtgtgctggaggccacgggtgacgaggagctgctggcctacatgctgcagctggtgcaggcgctgcgctacgagccggccgacgactcgcggctggggcgcttcctggcgcgccgcggcgcggccagcctcaggctcgccacccccctcttctggtacctctgcgcggagctggaggacccggggttcggccggcgcgccgcgctggtgcaggccgcgctcctgcgcggcctggaccccgcgctggaggatgcgctggcgtcgcagctggacctggcggcacgcctgcgccacctggccgacgtggtgcaggcgacccgcgggtcggcggcgcggcgcgcagagacgctgagggcgctggtgtcgcccggcggcgcggccgctgacctggcgcgcttggcctgccccaacccgctggacccgggcactcgcctgctgggcctggacgccagccagtgcaccgtgtttaagtctgcgctctgccccctgcgcctcgtcttcttcaccgagccgtggggagacgatggagcgagagcgggggtgggggggagtggggccggt

SEQ ID NO: 5562 - DNA, 252 bp, Chlorella protothecoides
atgccagtagcttctggtggtattcacgtatggcacatgccagctcttgtagaaatttttggtgatgatgcttgtttacaatttggtggtggtactttaggacacccttggggtaatgcacctggtgctgctgcaaaccgtgtagcacttgaagcatgtgtacaagctcgtaacgaaggtcgtgaccttgctcgtgaaggtggcgatgttattcgcgctgcttgtaaatggagccctgaattagctgcagct

SEQ ID NO: 5563 - DNA, 348 bp, Chlorella protothecoides
ggcgcccgacgcggcgcccgccgacgggccgcgcctggccgcgcagcagtgtatggccgccgcgctgcgcacgctgggcccgcgcgctgtgctgagcgtcgcgccgctgggcctgctggaggggttgcgcaccggggcgcaggcgcggacgtggatgctgccgctcctgcgccagaatggcggcgcgggggagctgggcttctgggccgagcagctcctgcccaccgcgcaggccatcggaaagcgcggagcagtggccaccaagggtggacgggggtggaaagggggaaaaggggtgatgagtgtgattggggtgaagcggttggtgatgtgggtctccccccatga

SEQ ID NO: 5564 - DNA, 423 bp, Chlorella protothecoides
atgccatcaggcctccccaagggcgtgctgaatgtggtgcacggtgcccacggcacggtgaacgccatcctggaccaccccgacatcaaggcggtggcctttgtcggctccgacgcgggcggggagcacgtgtacgcgcgcggctgcggcgccggcaagcgcgtgcaggccaacatgggggccaagaaccatgcggtggtcatgcccgacgccaacttcgaggccacggtggcggcgctgacgggcgcggcctttggcgccgcggggcagcgctgcatggccatctccgccgccgtcttcgtcgggcgcgggacgctggagcgctacgccccggcgctggaggccaaggcgcgcggcctgcgcgtcggcgcgggctgggaggcgggcgtggacgtggggccgctcatcacgcccgccgcgcgc

SEQ ID NO: 5565 - DNA, 1059 bp, Chlorella protothecoides
atgaagagtggttgggagacaggggagggggtccaccagggcatcgcgaggcacgctaagcatggcaagcctgcacctcaagggaggaaggaagcccgccggccgttcacctcaagcccacctccctacagccccatgtgcgcagcggtgcaggtgctcgtcacccacagaacccccagagactgccctctcaagtgccctggcatgactcaacaatcactcaccagcctgctgcgccaggatgtcacgcaactgctgctgggtgagagtgccagagaccaggggccggcatgcatcggggcgggagcagtgcgtcgcatgccaagctccagcgaacggactctgccgcgtatgctctccctctacaaccgcatgcattccatggcacgcacctgttgcgagtgccatggggaacatccacagcgggatcatggccgggaagttgaagggacagatgcctgcagtcacctgggcggcggggaaatagagattcctggatgggacggtgggcagtgccgcagccgattctgccacaactggcccccttgcatgtcacgtcacacaagacatggtatccttggccagcagggaacactcaagtccggtgcatcgggcagcctctcccctttggaccaagtccagggccgcatgcagcagcccctcagccccctctccccccgcctagcccctcctcacccccagcggctggcggatgctgtaggtgtcgatgccggtggacacgttctccagcatctctcccatcatgtcggggccgatgccggcggcgtactcgaccacctccaggccgcggaagacgtcccctcgcgcgtcggccagcgtcttgccttgttcgcgcgtcacgctggcggccagctcctccatgttctcccggatcagttgctgcagcttgaggaacacgcgcgcgcgcgtcggcacggcggtggcgcgccaagcggggaaggccgccttggccgcgtctaccgccgcctggaactcggctggggtggtctccggcacgcgggacacgacctcctgcgtggcctgcagggagggaattag

SEQ ID NO: 5566 - DNA, 252 bp, Chlorella protothecoides
atggagaagctccagtccgtggactggaggggtctgtacaagacggccaccaacaaggtcaaaaagtacaccatgaacctgtcggagctggagctgcaggtggaggatgccaccagcctggaggtctggggcccccatggctctgtgatgacagagattgccgagtcctccttcgatccagagagctaccgtcagatcatgggggtgatcgccaggaggctcaaggaggaggtgagtgtgcggggggtgtag

SEQ ID NO: 5567 - DNA, 1581 bp, Chlorella protothecoides
  modified_base (539)..(586): a, c, t, g, unknown or other
  modified_base (896)..(905): a, c, t, g, unknown or other
  modified_base (1424)..(1433): a, c, t, g, unknown or other
atggtgcgtcggcacgcggcgctggcgcctcacggcggccccgccgtgcaggtggtcaacggcaacttcacggtggcgcggcgccgcggcatcgtggacggcgtggactttgggctcatgggccaggtgcgctacgtcaagcgcgacgcggtggaggtgcagctggcggcgggggccatcgtggtgctgaccaacatcggggtcacctcctccggcgagctgctcaactgcaacgtgtacgacgtggccacccacgcggcggtggagctgggcgccgacaagctgctgtgcctgacggggcaggacgtggcggacctgggcctgccggcctacctgcccctggacgacgcggaggcgctgatcgcgcgcggcgcgggggagggcggcaccggcgccggccgcggcgtggacggcgccttcacctttggcagcggcgaggaggtggaggggcagggcggctggggcaggacggctggggctggacctggacagctggcagcagatcgggttcccgcgcgaggtggtggccgcggcggtgnnnnnnnnnnnnnnnnnnnnnnnnnnnnnnnnnnnnnnnnnnnnnnnncctgccgcaacggcgtgcgccgcgcgcacctggtggacgccgccaccgatggcgccatgctcatcgagctctacacccgcgacggtgtgcgggcgaccagaggggggggcgggggaagtggggcccaacttgtggcgtcggggagggggggtggaggtggcgccgtggcggcgccagcgcgcgcctgcatggaccgtttcccccctgcacagcagtcggtgccctggacgttgcgcgctttcagcgcctggagccctgtgccgctgctgccttgcgaagcaaaccccgcggtcctctgcgggtgcatcgnnnnnnnnnnccagggggggggcgggggaagggggggcaccttgtggcattggggaggggggatggaggtggcgccgtggcggcgccagcgcgtgcctgcatggaccgcctcacccctccaaagcagtcggtgccctggacgatgcgcgcttcagcgcctggagccatgtgccgctgtttccttgcgaagcaaaccccgcggttctctgcgggtgcatcacggaactggactgaggggagcccacccatgtgctgctgccctcccactcttgacagggacgcggggggtgaccatgatcgcgaccgacctgtacgagggcatccgccctgccgcctggcgcgatgtggacggcatcacccgcctgctgacccacctggaggaggtggagggctacccgctctccggctggctgcacgaggtctcgcagcgcctgcgcagcatcaccgtcctggagcgcgaggggaaggtgggtgacgcggaggcggggtgcgggaaaggagggcgtgggaagggggggggggaggaggnnnnnnnnnncctggagcgcgaggggaaggtgggtgacgcaggggcggggtgtggggaaggagggcgtgggaagatggggggaggaggctggtctgggtgtgggacgcggggacgatacgccggcctggggagtggaggggagcgcaggaggcgatga

SEQ ID NO: 5568 - DNA, 1782 bp, Chlorella protothecoides
  modified_base (31)..(40): a, c, t, g, unknown or other
  modified_base (721)..(730): a, c, t, g, unknown or other
  modified_base (1094)..(1103): a, c, t, g, unknown or other
atgcttacgaccgcaggccgtgtaccatatnnnnnnnnnnctgtctgtcgacactggcgtgcccatatttgtgctgccaagagcaccggcagaccccccctgctatgcttacgaccgcaggccgtgtaccatatgcctacctcggaagacgacgacccggccaagagcatgccgctggccctccagagcgtattctacaaggtgcgtggctgcgtggtcgtgcctgtgcttcatctgtggggaggtgcgggtggcaggggatgtatgggttggcgtgcaaagcagcgtcgcaggcagggagaacaggcctgtgacccaggtctggggccctatccaatgcctggggtggctcatgaacaaacacagcacctccctgcccccaccggcccacccatgcagctgcaattcacggacggcccagtgtcaaccaaggacctgacgcgctcgttcggctgggacaccagcgacgccttccagcaacacgacgtgcaggagctgaaccgcatcctctgtgaccgcctggaggagaagatgaaggtgtgggggcgggttttgaggagggggaggagctcgtcttttgaacaggcgctgtccattccggacggggtgggcctggagggcgcctgtcatggtgttgcgggtgaagcaccggcacgccgggttcgggaggagagcatgtccctggacgcaacaacaaagacccccacacatgcactccgcnnnnnnnnnntggacggggtgggcctggagggcgcctgtcgtggtgctgcgggtgaagcaccggcacgccggggtcgggaggaaagcatgtcccttgatgcgacaacaaagacccccacacatgcactccgccatgcagagcacgcgggtggagggcaccatcagcaagctgttcgaggggcacaccctgaactacatcgactgcatcaacgtggactacaagtcctcccgccgcgaatccttcatggacctccagacgctggagggcgacaatcagtacctggcggaggggcacggcttgcaggacgcgcgcaagggcgtgctcttcgacggcttcccccccgtgctccagctccagctcaagcgcttcgagnnnnnnnnnngcctttccccctcctccccccccagctggacgtcaaggggtgcaagaccatcctggactcctttgaccggtactgcgaggtggagacgctggagggcgacaaccagtacctggcggaggggcacggcctgcaggacgcgcgcaagggcgtgcttttcgacggcttccccccggtgctccagctccagctcaagcgcttcgagtacgacttcatgaaggacagcatggtgaagatcaatgaccgctacgagtttggagaggagctggacctggacgtgggcgaccgcaagtacctggccgcctcggccgcccgcggcgtgcgcaacaagtacaagctgctggcggtgctggtgcactccggcggcgtgcacggcgggcactactacgcatacatccgccccgacggcgcgcgctggctcaagttcgacgacgagcgcgtggaggccgcggaggcggaccgcgcggtgcgcggcaactggggaggtgaggacgaccgcggcgcgccgggcggcggcgcgccgggcctccgcttcacacgcttcgccaatgcctacatgctggtgtacgttcgcgagagcgagtgggggtctgtcatgtgcggcgtggagcggcgcgacatcagccagcacgtctgcgctcgcctgcaggtgggggtttggggaggagggggtggcaagagg

SEQ ID NO: 5569 - DNA, 1119 bp, Chlorella protothecoides
ggcgggggtcgtggtggcggtggcggtcggcccggtgagtgggagactgggtgtagagcttgctggttgcaaggcatcgacactcggatcaggccatttgttggtgctgaagagcaggcaacaatggagaacgacgtcacgagccacgtcccttcacccccaacccggcaggtgactggccttgccccagctgcggcaacaactgcttcggctggagggaccgctgcaaccgctgcaacacgcccaagcccgaaggcgctgctggtggcggcgggggtggcgggtatggagcacctccacctcgagacaattatggaggcggctaccagtaccaggagcaggcccctccacagtacccgcccccagcacagggcggctaccctccccagggccaggcatacggcggtccccctccccaggcagggggctatgacccccatggggccccgcctgcggccggatatggaccccctgcaggagcctacgacggtgtgtgtgctgtggtgggcaggtgcactggggcttgagccatcgttgtgctggcacgggaccataggtgatgcttttgccacaccttgggtgtcacattcttctcatcatcctgcgaaagtggcgtctccacccccgtcttttggtgggaggggtgggtatggcgccccgccccccaccgccgcaggacccccttacggagctcctgcgggcggccccccgccccgcgagcgcgtcgtggccgcgccgcagggtccgcccggcctgttcgcgcccgaggactgggcctgcaccgcctgcggcaacgtgaactgggcgcggcggcgcgagtgcaaccagtgcaatgcgcccaagcccggcgcggtggacctgacgcgcgagggcgccggcggcggcttcaaggagctggacagcgccgaggtggaggaggcgcggcgccgccgccgcgagcacgaggcgcgcgaggagtacgacgagtttgggcggccgcgcaagcccagcgcggccgaggaccgcgcggcgcgtgagcgcgccgcgctggagcgcctggcggggaagtacggcgcgcgcgagcgcagccgcagcccgcgccgcgagcgcagccgcagtccccggcgcgagcgctactga

SEQ ID NO: 5570 - DNA, 279 bp, Chlorella protothecoides
cacgccgccgtgctgcgcgccgcgcgcgctgcgggcctgccggacgcgctgcgcctgctgcaggagccggtggcggccgcgctggcccacggcctgggcgccgggttggacggcgagctggcgctggtggtggacatcggcggcgggaccactgacggaggcgggggacaaagtggagacgagccgggcggcgctgtcggggcgggacgagggtctgtggagcaggcgggggggctgattcttccctcctcccctctgggtcggtgcctcgggaggagc

SEQ ID NO: 5571 - DNA, 1176 bp, Chlorella protothecoides
  modified_base (288)..(297): a, c, t, g, unknown or other
atggccttcccagggttcagtcctgttgagaaaaagaaggtgtggtgggtaagggtgagtgagcagtctccctgggagggatgtttacaatcttcattggatacatctcatacacatcggcaagtattcctgcgtcgatatcactcaagcaggctcccaaacggccagatggaattataccaacccctccaaaatacaacactagtcccccaaagtggacacgcaacttttattccaaccccacctccccctcccccgcctccctgctcacccttggggcagacggtnnnnnnnnnngtgtggtgggtgagcgtgagtgagcagtccctggaagggatgttcacaatcttcaatggaaacatgtcatacacatcggcaaatattcctgtgtcgaaatcactcaagcaggctcccaaatggccatatggaatcataccaacccctccaaaatataacactagtcccccaaagtggacacgcaacttttattccgaccccccctccccctttcctgcctccctgctcacccttggggcagacggtggcacagttcatgatggtcttgcagcggtacagcttgaactggtcgtccagatcggccaggcgctgcgtggtggcctcgtcccggctgtcgatgacccagcggtaggcctggagcaggacggcgggtcccaggtacttgtcagagttccaccagtaggaggggcaggaggtggagcagcaggcgcaaaggatgcactcgtacagcccatccagcttggcccggtcctccttggtctggcggtgctccaggccgtcggcgggcttgggcttgagcaggaagggcttgatggatttgtactgggcgtagaagttggccatgtccaccaccaggtcccggatgacgaacatgtgggggaggggggccacgcgggtcacggccgaggggtcgcgctccacctttgtcaggcacgccagcccgttcttgccgtcgatgttcatggcgcaggagccgcagatgccctcgcgacaggaacggcgcagggacaggctcgagtcgtggtcgtccttgatcttcagcagcacgtccagcatcatggggccgcacctgggcgaggggaggacgcacggtgccggaagtttgcgagtgaacaccgccgctggttcgtttcagtcaaaccccaggctgggtgctga

SEQ ID NO: 5572 - DNA, 207 bp, Chlorella protothecoides
atgctgtcccttagcagggcgctggccaggggtgcagcccgcgcggcacccgaaattggattcgtacgagcagcagccacatcggctgccaccccagctgcagctgccaagccggttgtggagaaggagttcctggtgtaccggtggaacccagacgatggcgaggctccgaaataccagacatacaaggtcgacatcaactcgtga

SEQ ID NO: 5573 - DNA, 1443 bp, Chlorella protothecoides
atggagagctttggcgaggcctatgcctcgcacctggccctctccgaattctcgcgcgacacctcggtctatgtgggcgtgtcccagctggagtatgcccgcatcagcctggagaccggtgccgccgcgctgaacacctactatgccacgggggcgcacctgtccgtcgcccccggccgcattgcctacacctacggcttcaagggcggggcgctgtcggtggacaccgcctgctcctcctccctggtcaccacccacctggcggccgctgcgctggagcgcggcgagagccgggccgccgccagcctgggggtgaacctcacgctggtgcacagctggacgcaggcctgcctgcgcgccggcatgctgtcggaggaggggcgctgcaagacccttgatgcggcggcagggaatgtcttccgaccccttttcatccccgctcctttgctcacctttgcttggatccctccacccctcaccacagacggtggctggactgccctgtccgtgctggtcggctcggcggtcaaccaggacggcaggtcctccagcctgaccgcgcccaacggacccagccagcaggaggtcgtgcagctggccctgagggccggcgggctcgagccgggggctgtggggcacctgcagatgcacggcacaggtgtgtctgggatcgggctgtgcgctacacacaagctcacccctgaacccgtcccccgccccgcaggcacgccgctgggcgaccccatcgagatcggcgcggcggcagccctgctgctgcgcgcgtcctccaagaacggcggcccgcgcggcgcgccgctgacgctgacggccgccaaggccttcatgggccacgccgagcccgccgccggcatcgtgggcctgacgcggctggccctgaccctgggccaggctggggccgacccgctgccctacctcgtccacgtcaacccctacgtcgacagcgcgctggccgccaccgcgcggggcggccccgcttgccgcaccctggcccctcgccagccggtgcccagcgcgtacagcggcgtcagcagcgtgccactgggcggcgtgtcggcattcgccttccagggcaccaacgcgcacgcgctgctgagccccggcgccggccaggcgggcggcgccaccgacgtctggatggtggctggacgtgacgccccgtggcaggaggcccgctcctggatcgtgcccgcgccgcacgccctgctgagcaacgccagcgcctccgcccgccgcggcggcgagctgcgtgtgcgcctggagtgcggcctggcctcggcgcggctgggcgcctacgcccaccacgccgtgccgcgctggccgccggctgggcgctgggcggcgaggagcgcagcgtgcatgtcgcggccatggccatctcgagccccctggtgctggccgaccccggcgcgttgccggtcttga

SEQ ID NO: 5574 - DNA, 1572 bp, Chlorella protothecoides
atggcctacgtgctggtggcgctgcagcccgccgacctggagcacgtcgtggcggccgcgctggaccgcggcgcgcgcgcgctggccctggtcgcgctcttccgccccgacgacgcggcgctggcgcccgtccagctgcgcgtcgacgcgctgggcgccgacctggtggtcctgtgcctggacccggccagcttcctggcgggcgaccgcgtgcggctgcgcaccgcgctctccgccgcgcgcgagctgctgccgccctatgcggccgtcctcctgccggcggctgcagaggaggaaaaggcgttcgcttcggagaagaccgccggcgccgccgttccctcggcgccggcgtctgcggccgccactgaggtccctgccaccccgcccgccgcggccggtccggacaggaagggtctggaggccgccgtgcggcgtgcgctgagcgcgatcctgggcacggaggccgccgcggccgtggccgacgacgagccgctcatggcagcggggctgtcctccacggccgccgtgcagttcggggcggggctggaggccgcgctgggcctcaccctccccgccaccctcgtcttcgactacccctccgtccaggagctggtggactttctgtgcgaggagactcgcggagaggttgccaccccggcccctcccacagccatgtttacgccgccaccggcgccccgccatgggccgtcaaccgtgacggccaagcctggcccccgcccctccagcctggcggtcgtggggcaggccacggcgcacctgctgggcgtatcccctgcctccctggacttggatgagcccctgatgtcggcgggcctctcctcgaccgccgcggtccagctggtgactgccctggagaccgcgctgggactggagctgccgggcaccctggtcttcgactacccgtccgtgcgcgaggtggcggacttcatcgacgccgaggtggcgccggcgggccctgccgcagtcgaccaaaacgcggccagtcaggcggagatcctgcgtgcggtggcagatttggtggggcacggggaggatctgcaggccgacaccccgctcatggcggccggcgtttcttccagcgccgcggttcagctggtctccgcgctggaggctgcgctcggcgcggagctgccgggcaccctggcgttcgactacccctcccctgccgagatggcagccttcatcgtggacgccggcctggcacccgctctggcccagcagcagcagcgcgctgagattgcgcctgctgctgcgacctcgcaggtgccggtcgcgctcgttttggagcccgacgcgccggccagacccgtctgcgtcgtcaccggccagtcgcacgccgtccctggcggcaagctggcccagggcacacgcgttcacaacgaccggatcacgccggtgccgctggagcgttgggatgtggatctggcgccctcctacaacctcagaggtgctgtggtggagtgcctccacctcactctcatctggcccattcaacaccgcagagctcaacaactcattcggctcgttcctgtcggatgtggacacgtttga

SEQ ID NO: 5575 - DNA, 741 bp, Chlorella protothecoides
atgggggacccccccgatgccggacagtggccgctggccgactgctggcaagtcctggccaacacggccagggcccaacccgacgccctggcagtggtggacgtgggctccggcgccctgcactcctacgcctccctgcacgcccgggccgcggccctggcggccttcctggcctcccagggcgtgggccggggcgaccgggtggccgtcgcctcccggaacagcctgggcgtgatggaggcccattttgccgcagccgccctgcacgccgtggtggtcaacatcaacgtccacctggcaccgccggagatggcctacatcctggagaactccgacccggccgccatcgtggcagacacctccctggcctccggcctgctcaccgcgttgaacgcagtgcaggccgactccggcggcggcctgtcggtgcccagcgcccccttgctttggctggatgtggaggggggccaggcgggcgagcaggccctggcatctgccgtgctgccctcaggcatcgaggcctttgattacgccagcgtcgtagattccctgctggacatcgggctcgagaccgtcgcagggctgggtctggacagggagaacgcaggcgaggacaacttccacctctactacacctctggcacgacgggcaagcccaagggcgtgatgctgagtcagcgcatcgtgctgcaacatgcactgggcaccattcagggtgaggcgaggcagaggcgttggtga

SEQ ID NO: 5576 - DNA, 393 bp, Chlorella protothecoides
ccgcgcaaggcagggcggggcggggcggggttgaccctgggcttcggcggcgacgccagcctgctgaccgcggggctggacgtggacgagcggggccacccgcgcccggggtcgaacgaccccgcccagcctgcagaggacagcgacgacgacgacgatgcgggcgcgggcgcccccgccgccgaggaggaggaggaggacctgcacggcgacttcatcgacgaggacagccagagcgtgcggcgcgggcccgggcccgggtctgctggcggcggaagccgcggcgcggccgccgtgaccaacacctcctggcggacgatgaagtggatgcgggactatgcgcgactcatgtggtgtgtggtggaggcccagggagggtccatggaaggctga

SEQ ID NO: 5577 - DNA, 2796 bp, Chlorella protothecoides
atgcaagcgaagggagcggtgcgagcccaaagatcactttgtggcgtgctgtgcatgcttcaccgcgccctggccctcggctccgcgcaggcgcgaagaaaacgacgagaaaagagtgcagctcgtttccactgccatactattgactgcgcaacaaatcgcgcaggaccggtaagagtcccgcacattgcctgcgatttggataggaaggctcgtccccacgtcccgagcagttcagtacatgcattgaccatgcgcgcctttgtcactcgccgggccctttggtccctgcgagtggcctgcagagcgcaacctggaagtggtggcattgcatgcgtggaggacacccgcgcagctgtgttcgcgggcttccctgcttactgggcctcagaggcacagcatgctgggctgcgggcgttgtgttccaaagtacccacgacagacctcgccaggaagttcatttcatctgtggcagaggtaggcatggacctgatggatgcagctgacaaggcgtacaggcctcccacttggccactcctcggaagatcgagcccgcaagcgcatgccgcgggacaattccatttgtcccaacccatcatgcaacaggtcgacctccccgcgaatgcgagcagcgaggcgccgcccccaccgacggacaccagactggacattgattttgaggagctcctgactcggccggccaggccgccccgccccggcagacccccctcccgcgccagcgagcgtgccgcggccgccttccgcatcctgcgccgcagcggcgtcgtccgcgaccaggccctggccctgtacgtaaacagcgccctcttccccacggccgcggccgcgttcgaggacgcggtgctgtcccgcgctcgcccacgggagctggcggccatcggggcgctggccaccggcggcgcggtggcggacgcgctcttccccgcctttgcgcgcttcgtgctgcgggagtaccgggatcaggtgacccagtaccggtcgctggtgcagaccgctgacctgcgcgcggcgcatgcctggttccccctggcgcgcgcgctgcagcggcgcatcgtctaccacgccggccccaccaactctggcaagacctactccgccctggaggccatgaaggcggcggggtcaggggtgtactgcggccccttgcgcctgctggccatggaggtgtacgacacctgcaacgctgctggcaccttttgcgacctgatcactgtgggtaaagctttccagagccaaggtcgatgccgaggctgcacggcagagcaccgagtgctcgggctcccaccccccagccaatgcctgacgagcgaggtccgcgagcgttgccttgcacgctgtggctgcccatcctccctcgcccgctccctgtacaggccaggagaggcgggaggtgccggggtcaagccacgtgtcgtgcaccgtggagatggtggacctgagtcggcgtgtggacgtggcggtgctggacgagatccagatgatcggggacgaacaccgtggctgggcctggagccgggcgctgatgggcgtccccgccaacgagatccacctgtgagccaggcggtggcggcggcggctggggccatgtttgcgggaggaggcagggcacatgtgtgcggggacggctcagcggtggagctcgtccgctcgctggccgccgcgatgggcgacgagctggaggtgcgcagctacgatcgcttcacggctctggcagtggagccagggggcctggggcccggggtctacgccgccacgcagcgcggtgactgcatcgtggccttctcgcgccgtgacatcttcgagatcaaggcggcggtggagcgcgagacctcccaccgctgctgcgtgatttatggcgcactgccccccgagacccggcgccagcaggcccagctgttcaacgccggggacaacaagtaccacgtcatggtggcctccgacgcagtgggcatgggtctgaacctgaacatcggccgcgtcgtctttcacagcctgcacaagcagtttgcgagggagcccagagcgtctaggaagggatctggtgcaatgtgggctggcctgtacggggggcaacgagagggcgccggtgtccgtgtcgatgatcaagcagatcgcgggccgggcggggcggcgcaactccgagttcgcgcagggcaaggtgacgtgcaagaacccggaggagcttggcatactcacggcggcgctggagggcacattgaagggcatggggaggctgaggtcacctactacgtcatgctgcctcacatgccatacccaaacactctctacacccccgttgcacccccccaaaagacacctctggatgctatggtcaccaggaaggcaggcctcttccctgagttcgagcatctggaggtctttgccgggcagcggccggatgatacatttaggcaaggaggccctcaactgctttcaagatggtgtggtgcgcaccagacaccactgggggaccgtcttcaccttactgccaaatcggctgctcacctctcgccctctcacccatttcccagtgagacgctcaaccaatttacgcggcatgccgtcctggactctacctttttcctgtgcaagcaagacggcgtgtttgcggcggctcagctcctcggcgaggtatcagctgtggcgggagtgttttgttgtggcatgtatgctgatacggggggagcccctcttgcttccaagtgtgccgactggccgctggcaaggtggcatgccaggattgagatgagcatgcagggctggggaaagtggtaa

SEQ ID NO: 5578 - DNA, 723 bp, Chlorella protothecoides
atggggtgtttcgagagcaaagctgtccaggaacaggcagaggaggtcgagatgatcaaacagcccgctgcgagcactgttccggaggagatcttggggttcaacgttgctcggctagcctcgaaaacccacttcaccgctcaagaagtggcatcgctgcatcgcttgtttctcattctcagcaacgagcttcatgaggacaacttgattcacaaggatgagttcttgtgggccttgttcaaagccaggcgggacagcctatttgctgacagggtgagatgtacagtcacctgcctaacatttgcgggggctgttcattgtgcctttgcaatatgcgtcaccatgtctcaggatcattatggtctcgcggtttttgaactcttcgacatcaaacagaatcaggtcttggactttgaggagtttgtctgctccctgagcgttttccaccctgacactcccctcgaagagaaggcctcatttgcgttccgaatatatgacattggtcatacgggtgccattgagcgctctgagctcaagaggttcttgatagctgtgatggccgacaacccagaggttgactttgatgagtcagtcctggaggccatcgtcgatgcggtaagggagtttgatgctgccaccctgcggcatggcagaccattaccttacatcttgaggcacaagtgctcccacactaccattcctggcaatacagacttttgctga

SEQ ID NO: 5579 - DNA, 972 bp, Chlorella protothecoides
  modified_base (693)..(702): a, c, t, g, unknown or other
atgctcatcgccgcggcgagagccgtggccgaggcggtcacaggtgagcgacccatggaagggagggaagggggggacggtgggcgagtggggggaaatcggccgatggagaacttgcctttgctcggccgacagggacagcacttggcccaatgcagagtgatgccaaggttgcatgtgagattaatttggtcatggcaaccgcagtcccggccagccgccccaaagctcagatgtccccctccccttgccataaacaatgcagatgaggacagggcgctgggcgcgctgtacccgccgctgacggcgctgcaggacactgccgccagtgtggcggcggccgtggcggcggtggcgtaccatgccggggtcgccagcgagctgccccagccctcggacctgctggccaaggcgtatgccgtgatgcacgaccccacctaccgccactggccctggtgctgctgccctctggattttggtttgaaaattgcgtcaggctgcctttacatcgaggctgcagctggacagcccaagagaattgagcgattttatcgaaccacgctttctgcccggcaacatgggtgcaagaggggtgtaccatgcaggccaactccacaccttctcttggaatctggcgatgagtttagccaacttggatggacgccatcctcattggaagagcagagcctcttnnnnnnnnnnaactccacaccttctcttggaatctggcgacgagttttagccaacttggatggatgccatcgtcattggaagagcagagcctctcacgtgcaggcggcctggcaggggatttcttcaggggcagtaagttatcgccccaagaccaccacgacgtcggtcacatccccagctcagtgcaaggttgccagctatgaagcaccgcggccgctgcaaaccctcgccagacgctgccctccatgtcaggccctgctcttcggaggtgacgactga

SEQ ID NO: 5580 - DNA, 1260 bp, Chlorella protothecoides
  modified_base (83)..(92): a, c, t, g, unknown or other
atgactgagcgcgtggggcgacatcggctgcatgcaccagggaaaaagaaaacaccggaagggggtgcggcgccctcatacannnnnnnnnncgcaggagaggggtggcgccgggtgtttgtccactgtggcggccatccacctcggtggctgtccacctcagcggccccctctccttcatcatcgccaccaggctgctcacatgagcagggtggtctccaccagcaggcgcgtgacctggtaggggtcgaggttggaggcggggcgcctgtcctcgtaataccccgacttctccacgggcaccatgcgccccacgcggatagagcagccgcggttggccacgccccaggagaagtcgtgcatggaggacgtctcatgcttgcccgtcaggcggcgctcgttgccctcgccgtatgcggcgatgtgcaccgcgtggcgcttgcccagcttctccacctgcttctggatggcgtcccaccccgtgttcttggcgcgcgtctcgttggtggagtagttgacgtgcccgcccgtcccgttccagtcgccggggatgggcttggggtcgaaggtgacctccacgttgtacagctccgcgcagcgcaccaggatgtagcgcgacatccacagctgatcgccgccgtcgatgccggtgacggggcccacctggtactcccactggctgggcatgacctccgagttcacgcccgacacgttcagccccgcatacaggcaggccttgaggtgggcctcgatcaggtcgcgcccgatggcacaccccgaccccgccgcgcagtagtagggcccctgcggccccgggaagccgttggtgggccaccccaggggccacttggtgcgcgcgtccagcaccgtgtactcctgctcgatgccgaaccagggctcgtgcgaggcggccttctccatcacctccgcgcacgccgcgcgcgtgttggtggggatgggcaccgggggcttgaccgagccgtcgggctgcacgcgtggcggctcgtaggcgtcggtcagcacaatgatgttgtcgccgccgcggaaggggtcgcggtagatggcacgaggcttcaggtacacctccgagtcgtcgccgggggcctggcctgtggaggaaccgtcgtagttccagtcggggaggtccgctgcggacttgggcacggagtcgagcacgcgggtcttggagcgcaggtcctccccggtgccgccgatccacacgtactcggcgcagatcttgccagactgcagacaccgtga

SEQ ID NO: 5581 - DNA, 447 bp, Chlorella protothecoides
atgatatccattccagtaggtctactttgtcggggcctcagccctgggtgctgccagcaaaccctcgttcatgagcatcgcatcccctgggcaacagcccatggccgtctggagtgctggaggcctgcccaccggcacgcgccgtcccgctcccaaagcaccatcccgcattcctctgcgtccctgcacacccttaccgtgctgactggatgtggggcggctggactgtctctggagcaggtggcgccggccctgtcggccccgcttctgtccatcgccctggcagcggtggctcgcaccctgggcctactccccgatgccagccccgtgtatgatgccgtgtggggcctggcgatgcccatggcaacagccctggtgctgatggaggccgacatgaccaggtatgcagcaaggggcgaagaccgggatctcagagtctacttctga

SEQ ID NO: 5582 - DNA, 774 bp, Chlorella protothecoides
atggcggcagacaacgtcgccatggccggctacattgcggcgctcatggccgtccccgtgccgcgccgagtctggaggccggcgctgcgggcgggcctggcgagtctggaagttggcgctgcgggcgggcctggcttgcatggtagctcggtcctcggcgatgggacaggacctgccgacgtggatgtccgtcatcctggcctggcctccaccccgctgtccgctgccagctccctggccctggccgccacggcgtgcagcctgggcgtgggcgcctctgccctgctctccaccccccatgcctccctggcggcgacggccgtgctgacacccgcgctggcggcggcggcgcggcgcctctgcgggccgcgcgcctttgcgggcgcgggggcgctgggcggcgcgctgctggcgctggccttcgccaccatcggcgggggggggggggacctgcgggcgctgacctccgcgggcccgctgctggcctttgcggccagccagctgggcctgcagctgggcatcaccctgctcgcggcgactgccctgcgcctgccgcggcgcgagacgctggtcgccgccaacgcggcgacgctggtcgccgccaacgcggcggtcgggggcccgggcactgccgcggctatggccgccgcgcggggctggcacgatctggtggagccgggcgtgctggcgggcacgctgggctacgctgtgggcacggccgcgggcatcgccgtgagcggcgtgctccgccgcggcgcggcgctgctggcctga

SEQ ID NO: 5583 - DNA, 426 bp, Chlorella protothecoides
atgaccctggtcgcgcacggtgccacccagaagcggtacgcggcgcagctcgacgccgcgctggcggccgtgaggtacggcgtggtcgtggtcaacgccaacctgggcctgggcctgtggtccgcccagacgcactggggcgtgcacggtggcgcggcggaggtcgcccccggccgcaccctgcgcctgggcagcacccagaacagcctgctgtatgacgagggggtgaagggggtagtgcgcttccccttcgagacttacctccacatcctcccaccggagtaccgctccatcaccatgcgtgcctcccgccagctggcagtgggcatcgtggacggcatgcgtgggttcctcaggggactcaaggacaagagctgggcgccacccgtcaccctcggggagggctcggggggcgtggtcgcctga

SEQ ID NO: 5584 - DNA, 1422 bp, Chlorella protothecoides
atgtacaccggcttcgggcgggcacacgacgatgagcagcggggggacggcagcgatcagcacgtccccccatgggcctccaccgtcctgactggcgtggacctcatgcgcaacaacaaggtgggcgtggccactgggcctggacacccaggctggggtgccctgcttggtcatgcccagcattcgtacaacaagggcctggccttcacacgggaggagcgcgacaagttcttcctgcgcggcctgctccccgccgccgtcctgggccaggacatccaggccgagcgcgtggtggtgaacatccgcgcccagcgcagcgacgtggaccgcctggcctacctgctggcgctggccgagcgcaatgagcgcctgttccaccacgtcctgcgaggccacctggcggagttgctccccgtgctgcagcaccccaccaccgcgcgctactgcgagcgcttcagcctcatgttccgctccctgccgcgcggcctgtttgtctcgctggaggacgcggggtcggtcacacgcctgctccagaactggcccatgcgccgcgtgaagctggtgtccctcaccgacggctccgcgctgggcgccggcggcgactggggcgtgcagtccatcggctccccgctctcccgcctggcgctgatgacggctgtgggaggagtgcacccctcgcgctgcctccccctcgtcctcgacctgggcaccgacaacgcacgcctgctggccgacccgctgtacgtgggcctgcgcgctccgcgcgcgcgcggcgaggcggcgcgcgcgctccgcgacgagctgctggccggcgtgcggcgccgcttcggcgcctccgtcctcgtcgacgccgccgacgtggaccacgccaccgcgcaggagctggtggtggcgcaccgtgccagcctccccgtctacgccgacgccgtgcatggggtccctgccgccgtcctggcgggcctctacgccgcgctgcccgccgccgggggcgcgctctccgcccaccgcttcatgcttgtcggcgacggccccgacctcgtggccgtggccgagctgctggaggaggcggtccagcgcgagcaccgctccggcacggtgtgggaggcgcgcaagcgcatctggctcgtggacgcgggcggcctgctggtgcgtgacaggcccgacgccgacgccgtggaggaccaccgcctgccttacgtgcaagaggagggcgccgcggcgcccagcctgctggacgcggtgcgcgcggtgcgccccacggtactcatcggcctgtcggccggcacgccggcctgggccttcacccaggacgtgctgcgcgagatggccacgcactgcgaccggcccgtggcttcggcgaggtctccgccgccgacgcgcacgcctggaccggcggccgcgcgctcttcgccgacgcgctga

SEQ ID NO: 5585 - DNA, 369 bp, Chlorella protothecoides
atggcgagctctggagttagatctggcggtgctgtgcaagcccgaccagacgacaagctgttgctggacccagatgaagagtctctgcaccatggcggcagcttccgcacatacatgcaccacaaaatttccaagctgggagagcaattcgaggcacaagccgcagatttgggagtctcctctcgcatctttcaaggcgtggcaatacatgtgaatggctacacctccccctcccatcaggagctcaaggtcctgatggcgaagcatggaggtgtcttcatcaactatccgactccaaccaatcacacccacatcatttgtagcaatcttacggatgccaagatcaagcaatttgagaaagccaggtag

SEQ ID NO: 5586 - DNA, 1041 bp, Chlorella protothecoides
  modified_base (26)..(35): a, c, t, g, unknown or other
  modified_base (323)..(332): a, c, t, g, unknown or other
  modified_base (645)..(654): a, c, t, g, unknown or other
  modified_base (798)..(807): a, c, t, g, unknown or other
atggggcggcgggctccgcgcagcgnnnnnnnnnngcaggcatacctagtagtggggcggggtggggatggagctcaagaatcgtgtcgtaaaccccggcaggaaggagcagcgggatggggcggcgggctccgcgcagcggcaaggacctgcgggacgggacggcgtcgggggccggagcgcaagcgctgcagaggcagcgccgcaacgagggccgctctcgcctgccgagcggccgggcggagccggcaaacccgggtcggaccgggccccctcgggcggccccaagcacgaggcgcgagtccagcggccgagtcggccgnnnnnnnnnncctcgcctgccaagcggccgggcggagccggcacacccgggtcggaccggtccccctcggccggccccaggcaggaggcgcgagtccagcggccgagtcggccgccgctacggcacgcgcagcaggcggagctgctgtcctcggcggcgcgcgccctcaatgcctttgccgacgatggaagcttcatggccggccttgctcgcggcggcgacggcggcggcggggcggcgcccgcagcgcggcagaatgcgaactcaggcctggcgacggcgagatcagagacgccggggccgaggagtcgcaccccctcgcnnnnnnnnnnggcagcgcggcaggatgcgaactcaggcctggcgacggcgggatcagagtcgccggggccgaggagtcgcaccccctcgccctcgccactcgcccctgcccggccagctcccacgccagtggcgccggaaaggccgccggcagnnnnnnnnnnctgggcgccgcagccgccctgcgcgcgcgcctgctcggccggccgctccccgccgccgtgcctgaaggagtgcaaggtgctgatgccgtcgaggcgctgcccctggtggacgcgcggggccgcgccgtgcctggcgcctttggccgcgaggtggccggcgccggcgccgtgccggcaggtcagggcgtgggttggttgaggtgctatgggcgaatgatggcagaagggaattag

SEQ ID NO: 5587 - DNA, 2754 bp, Chlorella protothecoides
  modified_base (1065)..(1074): a, c, t, g, unknown or other
  modified_base (1696)..(1705): a, c, t, g, unknown or other
atgcctcgcagggcatggagtgcatcttcttcgagactgctctgcgcctgggcgacccccgctcccacgcggttgtggagtgcgtgcccatacccatggaacgtgagtctgggtggagggggggtgagggaagggtgctgcgatgtattggtggtggtggggtggggaggttggaagctaaggcctcagtggtctccagctacaagctctgtatggaacgctctcagcaccgctccatcctctcccataccacaatgtaagcagttgccgggcgagcgcccatggtgttcaagaaagccattgacgatgccacgagcgagtgggcgcagcaccacgccaagcggttcatcgatacccgggcaaaggtggggggaagatcatctggcaagagggctggtgatttgcagcaggtggcactcaaaaatcaccaaactcgcaccgagcatgcatcacccagcccatggaccagcgctccgcgcttcaaccccccagggcttgcgaggctccatcccggagaactttgcctacctccatgtggaatttgggctgtcggcaggattcgtgcatgtagtggatgacgagtccacattcgacgcttccttggcccggagcgtgctcataggtgcgttggggtggtggttgcatcgacaaagagggctgcgtttgcttcgacaatattcaagtctaggaatcagagctctgcagggcacctggagtgacaaacactggcttgaatcaccctgcttggcaatcacatccccctgcaggtctgctgggcctgcccgaggcggacatgcatcggaaggcaaaggcagagtctcagacgctgcaggaacgatgggcgcgcgaattccgggcagatgctgtggtgcttgcaatcaacaggataaacttgtcaagtatggagggctgtatgcttccgggcttgggtgtgctggcgctcacatcttgggccctgaccagatcgacgtctcagaattccggacgggcttgatgatcatgctacgaatctccgacggcgtgctgcgcctgccgtcgtaccctctcggcccgtatcgaagcagnnnnnnnnnnagatcatgcgacgaatctccgatggcgtgctgcgcctgctgtcgtaccctctcggcccgtatcgaagcagcgaatgagtgcgagctaaggaagccgataatacccactctacatgcgaaagtcgggtctgtcgcccacccggaagtcacctgggcgcccccggattctccaccacccggcaaaatgacgcacgctgacgacgcctccagctccacatcctccctggatttgcccctcttggtgcatcatccctataaagccggattcacacgtatacagttcgatcccaaggaggagggctgctggcaggagattcggacgagagtggtgcggcgctgttggagcgccccgtattcttcgacctccatgcagagtatatgcgagggcggcagcatgcacctggaccgaatgggtctttgctatgctcccctgcctttcttggctgagggtgtacccggtccgagactacctctggccagtcacacccttgctgaggaccacaaagcatcctctctttctctcacacacacacagcatgatatttccctctcacttccacaggccgacatctccgccggcctgtctgtggcggccatggtcatcccccagggcatgtcctacnnnnnnnnnntccctggcgggcctgccctccgcctacggcctgtacggcgccttcgtgccctgtctggtctactccctgctcggctcctcgcgccagctggcggtggggcccgtggccatcacctcggtcctgctgggctcgggcctgcccgacatcatggacggcctgggcgtgcccgtgaacgaccaccccaaccaccccgccgaccccgacgcgcaggctctgtacaaccaggccgcggtgcaggtggccttcctggccggctgcctgtacaccgccatcggcgcgctgcgcctgggctggctcacccacctgctgagccacgcggtgatctccggcttcaccaccggcgccagcatcaccatcgccgcctcgcagctcaagtggatcctgggggtgaatgtgccgcgctccgcctccgctctggctcaggtgctgagcctggtgcgggtgcggggggaggtagcgctgccggagctggccatgggctccgccttcgtgatcctcctcctggccatgcgcgtgctgtcgtccgcgcaccgccgcctgctcttcctccgcgcgctgggcccgctgggcgtctgtgccctgtccattgccatcacgggcgcctggcgcctggacgagccggggccggggggcgagccgccgcccattcaccccgtgggccgcatcgtgccgggcctgccggccgccaccgtggggtggtggctgccgctgctggcgcccgcgcgccagctcagcctggcggcggtggtctgcctggtggatgtctgcgagtccatatccatcgcgcgcacgttggcgaccgccaacaagtaccgcctggcgccgacgcgggagctgctggccatgggcgtggccaacctggcggggtcggccttcaactgctacaccaccaccggctccttctcgcgctccgcagtttcaaacgccgtcggcgccaagacgccgctggcgggggcgatcacggggggggtcctcctggctgtcctcgcctggttgaccccactcttcacccacatgtctgccaacgtccaggtatggtgtgggattga

SEQ ID NO: 5588 - DNA, 1527 bp, Chlorella protothecoides
  modified_base (500)..(509): a, c, t, g, unknown or other
  modified_base (891)..(900): a, c, t, g, unknown or other
  modified_base (989)..(998): a, c, t, g, unknown or other
  modified_base (1175)..(1185): a, c, t, g, unknown or other
  modified_base (1258)..(1267): a, c, t, g, unknown or other
atggctcggccggcgggctcttcggcccctgccatgaacgccgccggagggagtggcacgggtcatgctactcccgttgaaggcccgactccggaacagcaaagctctgtcgcccggtttgcattcctgcaacacgtcatgcagcagggctacattctggagaagaatgcggaggctctctatcgccagctcacccttgctgaggatggtgggtggcaactggaccaaagatatttcgagttcatcgcgaagatcaacctcgacatatcctttgcggggttcgagctgaggaggctgctctttccgctggacaaccagtactacctagggtatgtcaaccgcctagcggatgagcagagcaaaaaggcgcacccttatagcgacaaggatgggaggccctccctctcccacaccagctacttcaagcacctgtggaaaattgccctgtctgagcctcactgcttcctgcccaactgtccccatctgttctccccccaggnnnnnnnnnngggaggccctccctctcccacaccagctacctcaagcacctggcaagccagggcggcaccgtcccacagcgccttgccgtgggcgagcgagaggcctccctgcagcgcttcctggaggatggctggctggcggagttccctcaggtacccggcagcttcacgctgggcgtgcgcaccctccttgaactccccggctggatcctggaggcagaggagctgccggagaccacccggcaggtcctggaacgctgccgggcttgaaggaaggttgtgcggggatcacagtggtgacgctttccccccattgtcaatcgccgttgtgaccttgctgtgcattacaaatatcaggggggctgcaaggtgcgcaaggggttatgccatnnnnnnnnnntacacatgggaagaacaggaactggtacaaaaagattgggagggaaggtgtgaaggtctagtcgacacagttggtgaggggagaatatnnnnnnnnnntacacatgggaagaacaggaactggtacaacaagattgggagggaaggtgtgaaggtcttgtcgacacagttggggggttgcaaggtgcacgaggggttatgccaggctggcagcaatgaaatcatgctctgggtacaaggtgactgcttgtcacccatgcattgggacggctggannnnnnnnnnnctcaacatacccaaggcatgtggtgggtcaaaggccaggcattgtcgtccggttcacaccatgcacccccgannnnnnnnnnttcaactctttgggggggaaaagcggcagcggccccatcagcatgtgagtattgcagggcctcagggtgatgtggctcaacatacccaaggcatgtggtgggtcagcggccaggcattgtcgtctgaatcacacaatgcacccccgcgacctcagggtttcctccacatacaggatggcatccatgacgtctgcctggatgttctggacacccagcttgtgcaccaggcctgcccgcttcatgatgtgcaagacctgtga

SEQ ID NO: 5589 - DNA, 2277 bp, Chlorella protothecoides
  modified_base (42)..(51): a, c, t, g, unknown or other
  modified_base (1903)..(1912): a, c, t, g, unknown or other
  modified_base (2016)..(2025): a, c, t, g, unknown or other
atgcgaggcctgattatgtcaaacatgtttcgaaatcatgannnnnnnnnnttgaagtggcagattcagaattgcccgggcgcacctccgacatggcccggcatcgcgcatgttcagggcatgtccattcccgcaagcgacaacacagcatggcgcatatcaacaaatcacaatgcgagtcctgattatgtcaaatatgttttgaaatcatggctctccttgacgaagctcctcgggcgacacaatgccgtcatcgagtcgacgctggctgggagtgtggagttggaggtcgcactgcatgagctcgttgccgtccaggtaagcagccgctgcctctcgagcaggacgatgacgactcgattgcagctggaatgcaatgtctgcaggatttgtggccacttcatcatcactagtagcctcttgcgacatatagcacgcgagcatgggtctgtatcgttccattcaagcattcagccagccttgcaggagggagtggccagtgccatgcaggacatgagcgcatctgctggcttccaatccatatgctctctcaaccaggtggggcatgttgtgagcagccgagagaacagctgggcgcatggcttggtttcccactgtcaggccgctggacacggtctgagcgcgtggcacagccccaaggcaagccaccaacaccccgcatcggctccccagcatgcgtccctctcctccctccaggccatcctgcactactacctgtcggactacagcagcgcagaggcagccctgcaagccgcccagaacctgcccacccctgcacacagggtccagcgcgatttcctggccacggaggtcgcgctggcgaggcgcctggcggtccccgcgcgagccaggctccatacggagcgagcctggctgggcctggcgtctgcggggccgggcgtgggacgggggggtgccgcgtcggccgagtgcagcacccagcctgagcctggcctggacctgcacgctgtacacgctctgcacgaggtccgcgcctccctccgggagcgggaccccgcggcgccaggcgtgctggagtccctgctggcagacattgccgccctcgaccctggcgaggcgtgcagccaggcgacctcgtcacctggactgcatgcgtgcctgtacctcttcccaaaccaaccaagatcatgcccgcaatattccctgtctctccagggcgaggcggctgaggtgctcacctgccaggcatctgccctggccggccgtgcgactcaggctctggatccggcgggcccctcctccgaatcgccagcgatcagggtggccctgggctgcggggcactgacgtgtggtcgccccaacaccgccgccctgcacttcacagaggccctgaggggctgcagcgcagcacccgtgcccaccgatgcgccaggcggaagccagccctccctgccagagaccgccacgcggcaggcagcctgcccagacgccctgtctggcgcagggctggcgcatctccaggcgggtcggcacgggctggcagcgcggtgctttgctggcgccgcacagcgtgcacagcgcgccccctggccctggatccggctggcggagtgcgcaatgagggaggaggtgtttcgccggcccctcctggatgcgcttgctctgccgccgcgccgcccgtgggcatggcccgaggaaggcagtgagctgagcccgggtgagcagcggaaactgctggagggttgggacactgggccgccagacctgagcgccaatgctgctgccgcctacctcgggcacgcccgcttcctcatccgacggcgcaaggaggaacaggcggtggaaggcgtgcccggtgctcttgatgcgcagcgggccctggatcacatcgatgcttgtgcagagtggtgggctgtccgannnnnnnnnncatcccagcttcatggccgccggaatcgaagtgtcgagcatgcgcagattcaaacggacaggcttcaggcagggcagggtccagcaatcaaagagagactgagnnnnnnnnnngtgcaggcccttggccagataacggaatttgacatgtcgtgcgcacagctgcacacgttctcgacaacatcccagcttcatggccgccggaatcgaactatcgagcatgcgcagattcaaacgcacaggctgcaggcagggcggggtccagcaatcaaagagagactgaaccagtgcagtatgatgagaataatcactctcttcccgatctcgcgagtgttcgctggggatgtcctgatgggcgcacagtga

SEQ ID NO: 5590 - DNA, 1752 bp, Chlorella protothecoides
  modified_base (1142)..(1151): a, c, t, g, unknown or other
  modified_base (1586)..(1595): a, c, t, g, unknown or other
atgtcgggcttttgcaccagcgccgcccgcctgggcgcccccgacgccggcctactctcgtacgctgagatgacggagcaggcgcggtgctgcgttgaggccacggccgccctgcccatcatcggtgacggcgacacgggtgagggaaaagatggtatggggatctcaccaacgggaagaagtggagggtgctggcaacctggccgtggcgataaacttgctcctgttcgtcactacattgccccaccagcagctctgccctcgcgttcccacgcaggctacgggaatgccatgaatgtgaagcgcacagaggctttcatcgatgacccgctgcatgagcttctacagccattctctggaagagcctgcctgcccttattccttcaagtacccatcacccctgcacccaccgagccttcaggagtggcccaagtcgtgtgggcacgtgggcaggaagcgggtggtgggcagggaggaggcgctggcgcgcgtgagggcggcctgcgatgcaagctctggcccaccacagggctctccactccctcaaccttacttagtaccacactaccccgccgcgctttcttcagggatgagggcagcggcatcgtcgtcatcgcccgctccgacgcgcggcaggcggttgggctgagcgaggccctgcatcgcgcggcggcctttgccgaggcgggggccgatgtcgtctttgtggacgcgctggagagcgatgaagaaatgacggcgctttgcggcgtcgcaggggtcgtgaagatggccaacatgctcgaggggggccgcacgcccatcctgccccctcatgcgctgcaggccatgggctttgggatcgtggcctacccactgtccctgttgggggtctgcatctccggcatgcagcaggccctgcaggacctcaaggggggccacatcccggcaggcctgccctccttccaggtgggacgggggaaattcaaggagtggtgggctttcccgagtactttagggaggctgaccactacaaggccacaagccagggtgcggtggggtcaccctgacaagactctttgcccgttcccaccccctgtgctgctgccccgtgctcctgcctttgaaatcggctgtggaatcccacccatgcgctgtccccnnnnnnnnnngcttggaattggacacgggatgagacctagagcccttggggaaactaggtcattatccccccccaagctaaaatcttgtgtggcccggccagtccccatggcgtggactgaagttgatggtaacagtcatatatgttacatccaggtccctgaatgcagtgtggtgatcgggctctttacttgttgcagcgcggcgcgggcacggcgcagtgcaccagtaccgcatggtaaggcgagagggcttggtcctgggaagccaacaacagagggcacaaggcgttattcagtagcaaagccaaatcaaactgctgagcttggagcccattttcatctggatgtcgtcagtggtgctcatgcattttggcctgatgggaaccatacttccacagaactcatcccgcccaagtacttatgctgcaattcggagtttgttgnnnnnnnnnntgcattttggcctgatgggaaccatacttcaacagaacttatctcgcccaagtatttatgctgcaattcggagtttgtttcctcatacgagtacacagtgtcagggatcgaagagtggatcggtgatggcatgctctccgtgagcacagtcttgtga

SEQ ID NO: 5591 - DNA, 489 bp, Chlorella protothecoides
atgccccatgtcgaggtccatgacaagtatcctgttaagctctactatacactgcatgtcggtgaaagcgcccactcggctcttggacgtgtgagcagcgcccgctcggcagctgccgcctcgcctgaaggtgactcctccaccaccactggcagcaccacatctgatgccgagtcggggacaggacctcccgcctcctccttccagagggcggcagcggtgccagactctcaacaccgggtgctgtttgtcatgggcttggctgcctgcgggaattccgagtacttggaaggacccctccagcacctcttgtcactccaggttggcgtggacgctcatggccggccgctcgtgtgcgcctgcacctttgacaatcgcggcgtcggtctgagcaccatcccccagcgatggcaccactatagctccaccattatggcggaggatgtggcgcagcttctagatcacctcggctggcattccaaggtgtga

SEQ ID NO: 5592 - DNA, 606 bp, Chlorella protothecoides
atgcacatctacttctttggatcaagtgcccctacccgtggtgcatggatggagcatttgggattggtgttgcctgatgtcaagctggataaaaaattgctgggctgtttgccaggcatgcgtcgtggtcatgagcattctagcgttcaatgcaggcctacaggccgtcactccttgcacattgtccctctgttcaggacccagagtttgctcctactagaaggcacaatccccatgtactaccaggtcggctctggtggacggattacgtggagtgatttgtgtgcctttagaatgatgttggatgccgtggtcgtgggcctgacggtcaagtacaatatcccggtggctgtctggctgccggagcagttccccctggcaccccccatcgtgtatgtcgtgccgacccccgacatgatgatcaagccagggcattcggtggtcgacccatccggctctgtggcttccctgtacctagaaaactggctgtacccagggtcaaatcttcgaatcctggcagaggtgggtcggcaggctgggctggctgatggcgtgcagcaggccgggtctcgcatgccagcatgggagtggcgtgcttttcgttaa

SEQ ID NO: 5593 - DNA, 1971 bp, Chlorella protothecoides
atggcgtcatgtccctcccccggatcgcacacctccacctcggagtcaggggaggctggcgctcagagtgcggtgtcgcaccgcggctccggtcagcgctctccaccccctgccagcgatttaaaccccgcgaggcccctggctggcatgcacctgacctcgagtgagctgaaagctcatgctacctgcttggcggccctggcccgtgccggccatggcacccgcaccgtggacgacgtgctgggctgggtgaaggctgagctggaggccaggggccctgggctggcttcggaggagggctcggcgccgacctcctcctccgccctctctcaagaaggccccgaggagccgaccaggcccagtgtcgccccgccccagggcccagcccccgcccagctcttcgccaaggccacacactccagccacctcaactacagcgacatcctgcaggcctttgccgccacagcatcaggtgggaacaccccccccccccaccttgctttgtggtggtatggtgggcactgtctccatggcgcggggtggtcgccccggacctgcgtcccctttgcttcggaccagggtgctgtgcatcccagagccagtggcaggctgctgtgtcccagcatggagccctgtctggacccagagtccctggccgactacctgcacaacctggcggtgctgtgccatgaggcgccggacaacgagctcgtcgtgcggcccagcgtgcacagcgccgacccgtacggggcatccggccgcgctgcgcctgcccaggcacgcgggcctgccccccccagccgtggccacccactgtcctcgatgctaggatcgcagcctggggtgccgcctggccccatgtaccagccccgccccccgggccagcccctgcctccccgccccccggctcatgcctcactcctggacgacggcttccggggacacattgtgcagcccctgcgctcatcctccgaccccctgcgcctactcagcgctctggaggagctggaaaggagggaatcggggcacgggcccctcgcgctgggcggcggcctgcacctgggggagctgccttgggaggaggcgccgccggccctcccaagcctggccgcccacctgctcccgtcggagggccaggggctgctgaagacgtcgtcggcgcccgagcacatgctgcgtggggcgctggccgctgacagccaaggcaagcgagttgatggggtgctgggtgtcgtgggggtactctcgaggggccccaaccctggccgaggagtgggagggcctgggtgcgagtgccggtctggaccggcgtgggagctcgtcctccatattctccgccccgcctgccgcccgggagcagggcgccaccgccaagccgtccgggctgtggccgggggccaggacctttgtgcagcgtcgggcctcgcgcctctccacacactgcatgccggcagaggagcagtgaagggccggtgctggacgaggcaggccagggctaccaaggggaagcatgccgcggacgtccggactccgcgatatgacaaccttccttcgtttgactcccgatgcaccgtccctagatcagaagccagagcatcgacttggaacaagcgaggcctgcccaacatttatttctcgggtctgaatctaacaaagacccatgtcggtgctccaggatctggtcatgcagaaaggtgcgagacaccgtgctttgaccggggctgcgggcaccatccggaaagcatacgcaggcaccaaatgcagactaatgtcagcataatagcctcatctagttctccatatcattacatatctactcctatccccgtgcgatgtggcacaggcgcgcagagctgcaggctggtagtgcagcaggaggacacggcggtcctcgccaccgtgagccagctgggagggcgtgatgctgggcatgcaccacctgtggccgtacagaccaggtataattcgtaa

SEQ ID NO: 5594 - DNA, 1416 bp, Chlorella protothecoides
atgagtctgtgttcacacgaggtgtgctgctccgctcccgttcggggctcttgcgattcaacaatccgcagtccagaggtagcttcaactgcatgctcttgcaaatccctttgggacccgtcccctcacagatacgttcccccttgtggcatgtgtgctagcatgcgtgcacttcggtttcctaatacccttcatatccgggttcgctttcttcatactcctggctcactcccccaaacacacacaggtgcttactccatcgaaagcaccggaatccagtacaactgcagtgttggcacggctgtgagagtagctgtgtacggcatgttcatgtctatgattgtggcagcatgccttgagtttgcaattgtggccgttggcctgaatgtggggaagtccgatcttcttacctggctttgggcctccctgtttcgttgtcgtaggtatggcaatgtgcggaccacaggccaatcaccttgtgtgatcttcctcctaggatgtgaggatcagggctcttcatgcgcctcaccagtgcatttggtgattcactttatcgtttccccagaatgcaaaatcactgtccctgcagtttacagtacatacattgtcagaagtccgtctgtgggtgctgaatgctgggacaataacccttgtgtctacagcgacgagctcccctcggcctgtacaggccccaaagttgcaggtgttagtaccctgagccctccatgccaactcgttaaagagaactccgtgcagtgggggatctgttttggagaatgggtcttctatggtgtgagctatatcttccatacagaagtattccctgaaagccaatgggaatgcccgggcccgccaccaagaccagagttttttgaccaatggctggccgacaaatatctggatggtgaggctgtgatgtatcggtgcagggtctgcatgtatgcttgtgctcattatgttgtggagggcccaaggctgtcatcaggtcagggagatttctgcgatgagcactgtacgtgctcccagatcagtttgggccatccacattctagggctgactttcattctgccagttacaaggcaggtaggtatgagcaggacgggagcctgaattgggtgatgaaggcacgcacacgcccctcctttgcaggtaacatcacgttgctggaagagcttgtggcacaagacgccgatgttggtcagaaagagctgataacgaacatcgactacagcgcaacgggcgggagcagatctgcggtggcgttgtacaacgaacagatcagggacgtgcgatcgctcacccgcgagtttgagatagacttcctgaatgccaccggggtgccttacgacccagccgcagcagggatcagcgccccatggtttccttgtcaaaacactacctgccggcaactcatc

SEQ ID NO: 5595 - DNA, 387 bp, Chlorella protothecoides
atgaaggcagggccgtcctggagcaaccgcaccccatctaccatttcctcattggtcaacaggtacttccgaacgtccctttcgcaaggcggcagccagcctgagatgtaccctcccgggtcggtcatgttcctgcgccccttcaagagagggcgcaagaagacgccagtgcagtgggatgccgtgtggatcaacgccgctggtgagtgtagggctggctgtctgtggctctttacaaaggtaagaaaccccacccttcatcgatcgttccgatggcaatccgtccgtcctctccaaccttggcacagacctgattggggaggggctgcacatctccccagccatgatggtgcaccaccgcctgttcaacctgacagaggcgtttga

SEQ ID NO: 5596 - DNA, 537 bp, Chlorella protothecoides
ccgggccagaaggcgtgtggcagacagcaatggcaacattggctccgacaacaagggcaagaacaactttggcaccaacaacaccgggagtgataacattggtaattccaatgcgggcaacgccaactgggggaacaacaacaacggcatgggcaatcgttgcttcaacaagacagggatcaccaaggtcatcaataactgcaacctgcttgagttccgcaaatatgcttgggtccttagcttcccgccgccacccgtcaagaagtcgccgccgccacccgccaagaagtcgccaccgccacccgccaagaagtcgccaccgccacccgtcaagaagtcgccaccgccacccgtcaagaagtccccaccaccacccgccaagaagtcgccacccccacccactaggaagtctccgccaccaccctccaagatgcctcctccgcccccatccaagaagtctccgcctccacccacttcctctcctccgcccagcccctctcctccaccgagccctcctccctcaccccccccaccacc

SEQ ID NO: 5597 - DNA, 525 bp, Chlorella protothecoides
atgaccttcccgccccgttccggcgagcacgcgcccagcggcaacttccagccctaccccggcctgtcccccggcccgccgcccgacacggcgccccccgggtcggggcgcaccaaccccgccgccgacctgtttggcgcaggggatggcgggcacccaggctcgccgctgggcacgcccgggcgtggcctggcgctgctctcccccgaccagccccccgccaagatccaggccgacctggaggtggcgcgcaacacggtggccctgctgggcgaggtgctggggggggtgcaggagggggatgaccccgccggggtcaaggaggactacatcaccgacatggccgaccaggcgcgcgcgatgcaggcgcgcctggccgcgctggccgagcgcgtgaccgatgaggccctgctctcctccgcgctggagctgaacgacgaggcgcagcgcgcgctggaccgccaccgcgcgctggtggacgtggcggaggggcggtcgccgccgccgccgcgccgcgcggtggcc

SEQ ID NO: 5598 - DNA, 837 bp, Chlorella protothecoides
atgctcaacatagttgagcagtgctgtgctctgctcctaggaattccaggcgaaaacgtggcctcatggagtgaacagagaagctcgcctaagagtgcagagcagtacatccctgtctcagaggcaatacgactccgtaagagtgcgttctgtaggtgtgcgaggctgagaatggccctggcacaaagcaaagagcacagaattggtaggcgggactccccccgtcgaaggctgcgcgcacgaatctcaccagcgcgcatcaacctcgacctaggcttcccggccgtcttgagactggggtcagcagacatggcgctctgtctacggcgctctgtcgcggatttgccaggcttaatcggtctagcatcccgacatgcatcctttcaatttcacaccagcactgtagcgccccagatccctgaagtacccaaggagaccgtcgatttcggatatcagtctgttcctcgaacggagaaggagaccctggtaggaggggtcttccgcagtgtagcgcccagctatgatgtcatgaacgacctcatgagtgcaggcatgcaccgtgtctggaaagacaggttggtagagaagctgcggcccttccccggcatgcgccacctagacgtggctggcggcaccggcgacgtggcctttcgtgtcctgcgggctctgagggaggcggaggccgcggcccggcctcaggttcccgggcccggcccaagcaggagcgcgccgccccaaaaaggcacggtggtgatcgccgacatcaaccctgccatgctgctggagggccggaaacgagctgccggcgagggcattggtgaggtggtgaatggatga

SEQ ID NO: 5599 - DNA, 447 bp, Chlorella protothecoides
atgaaggaccagcacacagatgtgaggggctgggtggcctaccaccgcgccatcggcgtgggcaagttctacctggtggacacggggtccggcgagagcatgcagagtgtgctccaggaccacatcgactcggggttggtggacttcacgtatgactcgggcatcctgcccaccaggggcacccatggccctcagctcggcgtttaccagcagtgcatcgccaaggccagcaagaggaatgagaggtggatggcgctgatcgacctggacgaattcctggtgatcagggacgccacgcctgacctccccaccctcctccacgactacgagtcggctggggcgctggtggtcaactgggtggtgtttggcagctccgggcagacggtgaggagggtgtggggcctggcatcaatgatagggggaaagggattgcttgctttttggtga

SEQ ID NO: 5600 - DNA, 552 bp, Chlorella protothecoides
atgaagtccgccgcctgccagcaggggacggcaaacggcaagagtgttcctgcacacacaagtgcaccctgcttccagcccctagcctttgtcctcccacctctgcctcactgtttcccccatgcttccctttcccacccccacctccttcgccaggtgcgctccccgctggagcccctggcctccttctggatgtgcgccccggaccagcacagcgagaatctgcacgtcaagtccattgtgcagccggcgcgcgtggcggggggcaccaccgatccccaccacctcaagtacgtggagccgtactttgccgtcaacacgacgcacgaccgcgtggacggcccgaagtcggagcgccaggcctcggacaggctggcgctgtaccactacgcgctgaagagcgaggaggagtatcaggccaagatgaagagagggtcgggcatgggcaaccagaagaccatggccttcttccactacgtcaacaactacaccgcggcagtgtgccttgacggcattgacaaggggaggtacctggccagctttgtcagctga

SEQ ID NO: 5601 - DNA, 507 bp, Chlorella protothecoides
atggaggtgggcatcgaggactgcctgcacatcgagtttgagtacgacagccccgctttccatctggacgatgtggtcatcggccgcatcttcttcctcctcgtccgcgtcaagatcaagcacatggagctggagatcaagcggcgcgagtcagtgggcgccggcgcggccgcgcgctccgagtccgacaccgtggccaagtacgagatcatggacggcgcgcccgcgcgcggcgaggtcatccccatccgcctctttctcgcaccctacgaccttagccccagcgtggacagcgtgcacaaccgcttcagcgtcaagtactttctgaacctggtgctggtggacgaggaggaccggcgctacttcaagcagcaggagatcacgctgtatcgcgcggaggagggggcgggggatggcgcggcaaagggtggcgccgcacgcctgccgcggggcctcgtcgccgcgctgccagaggccccgccgcccaaccccgttgccgccgcatag

SEQ ID NO: 5602 - DNA, 489 bp, Chlorella protothecoides
atggactcctacaccatctcgttcggcatccgcaacgtgacggatcgggacgctgctctgcgggaagccaagagagttctcaggcctggcggccgcttcttgtgcctcgaattcagcaaggtagtggtccccgggctgcagcagctgtacgacctctactcctttgccgtcatcccccagatcgggaggactcttcttgtccccggggggtgggcagcccacgaggtggcccctccaagagtgctgttgcagcctgctgtgatgttgagcgatcctgggcctttccccctgttcacaactttcccaccaacgtgcagactggtggcaaatgacggcgccagctaccagtacctggtggaatccatccgcatgttccccgaccaggagagctgggcgcggcagctggaggccgcggggctggtgggcgtggagtacgagaacctgatggggggcgtggtggccatccactccggcttcaagctgcactga

SEQ ID NO: 5603 - DNA, 1812 bp, Chlorella protothecoides
atgaagccttccagctcggtcatggatgtcaccaagcccggcgacgagcgcagccggggagaagggatcaaggccgtagaggagctcggcagcatgcccatcatctacactccctggctcaataagggtgcgagggtggggtcttgggagcgggcgggccaggtcacggttaaaccgcacgtcgggtgccctccggcgaccctagggcatggacaccgtcgcttaataccgtttgtccccatccttacccctctcataggcactaatttctcggagtctgagcgacgagagaagcacctggatgggctgttgccacccctctccccttgctgcatggatggcactctggatgttcccacccaagggcatgccttcacccctccccagccccggcaccaaatggtgagcaggttgatgacccagctacggaacgaggacctgaccaacctgcagcgcaacaacatcctgaagcagatcatggcgacccacaccaccctcttctacaaagctctgatcgagaacatcgaggagctggcccccattgtgtacacccccaccatcggcgaggcctgccagcgatggagcaccctcttccgcgagcccctgggcatgtacatctcggccttccgccaccgcggtcgctttgacgaggtgctgggcaactggccaaacaagaatgtccagatcatcgtcgtgacagacggctcccgcatcctgggcctgggggacctggggaccaatggcatcggcatcagcatcggcaagactgacggtcttgtctttatggtgcgtgcctggggtggggccagctcttccccccctcaaacacctcccctcgactccccgccgcagatcgcgctgtacgttgcggcggtgggcttccacccggagcactctttgcccatcgttctggacatgggctgcaatcggaaagaactgcgcgaggacgggctgtacctgggcgaacgccgcgagcgcctggagggcgaggagtactacgctgccgtcgacgagttctgcgccgcggtcaagcggcgctggccgcacgcgctgctccagttcgaggactttgagacgagcaaggccttcaagatcctggaggcgcagcgcagcgccatgctctgcttcaacgacgacatccagggcacgggggcggtggtcacctcggggttcatcaatggcatgaagtaccagggcacgcgcctgcgcgacgcgcgcgtcgtcttctacggcgccggctcctcggccgtgggcgtggccaagagcatcgtcacctacatgcacaagacggagggcatcagcgaggaggaggcgcgggcctgcatctacatggtggactccaaggggctcatcaccgacactcgcggcgacgagctgccggagcacaagcaggagatggcgcggcgcgatggcgtgcccgacatgaaggacctccgggagatcgtggagtatgtcaagccgcatgcgctcatcggcctttccgccgcggggccagtctggaccgagcccatcgtgcaggcgctgtgccagggcacggagtcgcccctggtgttccccctgtccaaccccacgcccaaggccgagatcagcgcggagaacgcctactcctggagcaaaggcaggtgcatctttgccggaggtgaggggcccgaggggagggtgggtgggtatgttgaggtccccgagggtagggaccttcctgttgctcgtgcgctcgctggtcatggggttccagagtgtggaggtggaggccggcgaggggtggttccgtgggacggggtcagccgggcttggggtcggcaaaccatttga

SEQ ID NO: 5604 - DNA, 609 bp, Chlorella protothecoides
atggcacgaccagcccatgccttgcgccaccgctccctaaccccacatgcacaccgaccccccctcctcacccttgccacaggctccccattcaagccggtaaagtacgatgggcagacctttgtccccggccaggccaacaatgtctttgtattcccaggtgggagctactgtgcagaatggggacaactcccagacccttttgccatcgctgccgccgcgtttcacttgccagcctgtgtgcacgctttgtcaagccctggcgctcccatcccccacccaaaccctccctctccacccaaatcaggcattgggttcggcgccatcatggccaaggcctcctcggtgaacgacgagatgtttgtggcggcagcggcgggcctggccgacgcggtgtctgaggcggagctgcggggcgacaagcgcctgtacccgcagatcagcaacctgcgccaggtgtctctggacgtggccgccgccgtggccaaggccgcctgggactcgggcgtgtcgcagctgaaggaggcacctgccgactggcgggcgtacgtggaggagcggcagtggtggcccgaccatgcctccaagcagtcggccgccacggcatga

SEQ ID NO: 5605 - DNA, 795 bp, Chlorella protothecoides
atggtgcggtgggtacacctttcagcccctgcagcgtcggctggacacaggaacaagctgtttgggggcctgggcatcgggcactcctgctccgtgcagctggagttccggcgatcgggggggggtggagtcccaaccgcagcggtgaagagcacgcgctcggcctccaggagagatgagacggaggatctgcccgtctaccggtccaaggacaccgtggagggggaggtgcgacctgctggcatgggcaggggtggactgggttgctggtcgttcagaccgcctctggccctccccccccatgctccacaccctaccctccctcaggtcaagatcactcccatccccggcaagcgggtggaccacgccggcatccgcgtgcagctggtgggggagatcgaactggcctcggagcgaggctacccccacgagttcctgtcgctggtgcgggacctggccccccccggcgacctgccctcccagcaggcctactccttctcctttgacaacgtggagatgcagcacgactcctacctgggcctcaaggtacctcctgcgcgtcaccgtcgcccggggcctgggccagtccacggtgaaggacttccccttctgggtgcgcaaccactccccggcccccccaagaggggagcccatcaaggtgagcgcggggcctcggctggcttgtgtcctgggaggaggaagcgcggcgctttcctaccccctcgagccccactgccctcgcctgtcctcgtgttgccgatgcatgggttaccctgtccaggcgacgctccctaa

SEQ ID NO: 5606 - DNA, 1674 bp, Chlorella protothecoides
  modified_base (1195)..(1204): a, c, t, g, unknown or other
  modified_base (1576)..(1585): a, c, t, g, unknown or other
atgcgccagaaacaggtcggggtgcacacgtttaatgacttgtcgcaggagctgctggtgggagggttccatggtgcccatcgcgccagggcagggccgctagggctgtatcgcgaggggcgaaaggcaggctcgctcccaggccctctgccacgtcacgcagggattgacttcccagaccctgctcagcgtccccgggaccccagtcgacaccaagatctcgctcgccccgaggcagtcggcatgaaggaggcccagtatgagggggcggacgccgtgcgcaaggaccatgtccttgtggccgtccgcttccgtcccatgaggtcagcgagcagggtggcgggttgggggggggaggagggcggcaggggaccccagtgggggctgtctccacacctcctcccagcactgtcagcaatgggagctgccttgttgcaccgtggtgccgagccgtctctcgatgcctgcagtgaccgcgagtaccagcgtggcgaccgcgaggtgtgggagtgcgagggtcaggcggtgggcatcgccgaccaggacacgggcatgcaggtcaagttcatgtacgaccacgtcttcggcggcgccgccagcaacgccgacgtgtacggcgcggtggcctcgcccatcgtggcctccgccctggatggcatcaacggcaccatctttgcctacggcgtgaccagctccggcaagacgcacacgatgatggggtccggggtggccccgggaatggtcccgcaggccatcgcccaggtgtttgccaccgtggcccgtgccggcgctcgcaccgagttcacgctgcgcctgtccatgatggagatctacaacgaggtgctgaacgacctgctggatccggcgcggagcaacctgaaactgcgcgaggacccgcgccgcggcgtgggcgtggagggcatcaccgaggagaacctggtgtcggcggagcacgccatccaggtcatcgcgcgcgggaacgagaaccgcaaggtgaggaactttggcgtgctacctccaaagtactgggaggtgcctggcaggaggggtgatggtgggtggcgagggaggggagggagattaaggggccgcgggggtgaacgaggggtgcagcgcagcgctccaggacagggtgaaggtgtggagcgcagcagggcgcgctttcctgggcatgcaaatcgggtcctggtccacnnnnnnnnnntgctccaaagtactgggaggtgcctggcaggcggggcgatggtgggtggcgagggaggggagggagatcaaggggccgcggggggtgagcgaggggtgcagcgcagcgcctcagggcagggtgagggtgtggagcgcagcagggcgcgcttccctgggcatgcaaatcgggtcctggtccacctcgggcacccaccagcgtatgtcttcatgcatggcagcgccggtccgcgcatatgcgcctctcgcctcacctgtgtctgcctcgtggccgccgcgcactcctgcctcgaccccactcccctccccaccacccccggactcacccagaccgccgccacggccttcaacgagggctcctcccgctcccacnnnnnnnnnnacgcatacgcctctcgcctcatctgtgtctgcctcatggccgccgcgcactcctgcctcgacctcactcccctcctcaccacaccctga

SEQ ID NO: 5607 - DNA, 960 bp, Chlorella protothecoides
atgaggggagggaggtttcccatgaagtggatgtgggcgcccagcagggagcaggattgcaaaatccggcagggctgtgacctggatgcagaccgggcgtccttggactcaggcgccttgcgcagcgtgcgcagtgaggcgtgcatttcggcactcctgccccatggtcaacaacacgctcccagccacccatgcactccacaccacgccctcgcaggctccggcgccagggtggcggtggtgtgcacggtcacgcccgcctccacgcaggcagaggagacgcacaacacgctcaagttcgcgtcgcgcgccaagaagatcgccatcgccgccaagcgcaacgagatcatggaccagagcaccctcatctcgcgctaccaggaggaaatcaccaccctccgctcccagctggacatcgtcatgcgagaacgtgggtggtgctctgtctttgttttggggggagtggtctcaaggggggacgatacagggaaccgaggggggggggagctgcggcctacgatgtcagcctcccagcccctggccgcctctgcacttgatccgccgtgcgcacctgcgtgcctccatgtccctctgtggcacagtgcatgcccatggccgccaaggcccggcatgatgcaggcccaatgtcaccctaccacacacatgcacgagccaagcccccgccacccttccccgtcaccccacccccctccggcccttgacccaggcggcggcctgcccctgcatgacccgctgcaccccgagatccgcaccctccaggagcggctggaggaggagcgcatggcgctggcggcgcgcgacgccgacctggacacgctgcggcggcggctgggcggcctggcgcgatgcgtgctggacggcgcggcggctgccacgcagctgcaggcccggctctccgacccgcgcgccgacggctggcacgctgagctggcggcgggg

SEQ ID NO: 5608 - DNA, 228 bp, Chlorella protothecoides
atgacgacgacttccccccgtacaccacttccaccccgcaggctgtcgcccggggtccccggcactgctggcaaccgcgctcgggagtgccacatcagcgacgacggggtggtgcaccttgtggcggaggacagcgcctccaccctccaggccctggcggccctggacatgggccgcgcccgccttctggcccgcgtggcgcacttctggcggcgcagggcctggtga

SEQ ID NO: 5609 - DNA, 687 bp, Chlorella protothecoides
atgggcaccatggaaccctcccaccagcagctcctgcgacaagtcattaaacgtgtgcaccccgacctgtttctggcgcatcccttcgagatgaaagtgaactccgactccctccaggtgcgcatggccgtcgatggctgtgagctgccccctggcctccccaccctgcggatggcgcatcaaggatcggccttcccttccccagcctctctcgcctcacccctcaacaccactccaccccaggccttgaatgcctatgcggaccagctggctgtgggcgcatcgcccacccccgcccagctggagttttatgtccggacgggggacgcacaggctgggctggcgctgatcacggccagcctgcccggggacggcgacctgctgcccctgctctccgcctttggactggcggacgaggccgcggcccgcgggacgggcgagctgtttgcccccgccgccagcctcgcggcctggttgagggagtctctgtccgacgccgcgcggctggcgggagagcacgcagccctggccgcggcgtcccaggagctccgcaccgccattgagcgcgcgtacgacctcggtcatctgcaggtgggctggggcggggtgggtgttgggaggggccaagaagggtggctcgcagggcctttgtccggttggagacatctgtcgaagcccctgccctaa

SEQ ID NO: 5610 - DNA, 1149 bp, Chlorella protothecoides
atgctggcggatgagctgttcagcgtcctcaatttgtctgcgccagggattgggaaagggactcgtgagatccgggccaccggagcaggtggtcaaggccgatgggcttgtccgaatacgcacctcggaacaccgcctcattcagctccatggcgcgagacgagagacctgaaactcagttcctcaggccattttcagtgcgcgcccagtgtcgttgtcgagatgccgttgatttggggtacacaacaggcgcatagagaaccgcatgcatgcattgcatctccagttaaaccgtcgggggcacgccccgcattccgaacgactctcccagaaacaagactgcctcgttatgcagtctcatggggtcgctcccactccatgccagcgctccccagggctgccaagggtgacagcagtgagccaaaccatgtccaggaggagctggtttcccagatccagagcgagatcgagaagaaaaaggcaagggcgaacgtggtggacaaggaggtggatgcgctcgccgatgaaatgcgtgcaatggtggaaagagtgaaggaggacaccgactccaggtcgcggcagtacatgcaggagtccatggacgtcatggataacaagctggtgggtctggtttgggaagaggggaaagcaggattgcctggtgccgacctcacacccacccctccctgcccgcagaccgacctgatggctgagctggacgagtacgaggctgtgctcaagcggtcccggcaggaaagcgcagagaacgcccaggagctgtctgaatggaagcgggatgtcgctcgccggaggtcaaagggccacttctttcagagcctgtacacggcagacaaggaggacgaggagcggccccgcaggaccgaggaggggagcaggagtccagccggcgcagcaggccgcgccgactcagggcgggccagtgcagaggccatccagggcgtcgcagcctctgccacctcccagtccctctctcgagggctgctggtggcgctggggtctgtcctcctggccgtggtgatcggcgacctgctcagcgacgaccccagcgcccgagcagacgtcctctacacctgcctggcggggctggcattctggctggcctggaggggtgttcagacaagcaactga

SEQ ID NO: 5611 - DNA, 969 bp, Chlorella protothecoides
  modified_base (139)..(148): a, c, t, g, unknown or other
atgcatgcccgccgctctgcacgagttagctttgcatgcactgcgtccagcagcaacccttgcaccaaaacctcgcagacccctctcacccctgccctcatcactggtaccatcctccctgccgcagccggcgcaaggnnnnnnnnnnttttcccaatccctggcgcagacaaactgaggacgctgaacagctcatctgcaagcatcgagggcaccagcacgtgggtctgctaccaccgggcacatgcacagcgggtggccgtggtgtgggaggagagaggctccctgcggtctggagtgcggcttcctttggtgccctcttctgtgcctgcccgccttgcgatctggacatgcatgcccgccgctctgcaagagttagctttgcatgcactgcttccagcagcaacccttgcaccaaacctcgcagaccccactcacccctgccctcatcactggaaccatcctccctgccgcagccggcgcaagggccctgagtttgcctctgaattcttgaaggtggccccccgcgccctgcgacacatgctggcgcgggccgacgccgccaccgccggccgcgtgcgccgcgtgatcggcgtctggcgcgaccgcaaggtgtttggcagcgccgccgggcgcgcccttgacgagttgctggacgacgccgccgggtcaggggcccccggagctgggggccctggcacagcggtccccggcgcgccgcatggtgcgcccggccccggcggttatcacaacccccctgcccccggcgacaacgacggccgctctgatagccccacccctgtcgcgccggaggacctgctgcgcctgctgcaggccgcgcaggccgcgcggcacgagagcgcggcctcggctgcctcgctggcgcgcgtgccgctgcaggcggcacgcagcacgctagaccccggcgcggtggcggccgcgcacgcggcgctgaccgcggcgctgggc

SEQ ID NO: 5612 - DNA, 528 bp, Chlorella protothecoides
cgcgccgcgaccaggcccctggtggtggtcggcgcgggcgtgctggcgcgccccgacgcgcgcgccgtgctggcgcgcgtttacgagctcctcgccgccggcgatgtagtgcgcgagggctggaacgggtttgcggtgctggccgacgcggcaggcaccgtgggcgcgctggacctgggcttcgtccccggcgcgggggccaggggcgtcgcgccgcgcgccgtctacctgctgggcgcggacgacttcgaggagggcgacgtccccgccgacgccttcgtggtgtatcagggccaccacggcgagcgcggcgcggcgcgcgccgacgtcgtgctccccggcgccgcctacaccgagaagttcgggacgtacgtgaacgcggaggggcgcgcgcagtccaccaaggcggcggtggggccgcccggcgccgcgcgcgacgactggaaggtcctgcgcgcgctcagcgaggtcatgggcgcgccgctgccctacgacaccctggccggcgtgcgcgcgcggctggcggag

SEQ ID NO: 5613 - DNA, 396 bp, Chlorella protothecoides
atgcctcccttctctgccccccccacaaagatctttgccgagatctacgaggccaagtatcggtcggactttgaggccgcaggcatctggtatgagcaccgcctgatcgacgacatggtggcccaggccctcaagtcctcgggcggcttcgtgtgggcatgcaagaactacgacggcgacgccctcaagtcctcgggcggttttgtgtgggcatgcaagaactacgatggcgacgtgcagtcggacattgtggcgcaggggtacggctccctgggtctcatgacctccgtcctggtcacccccgacggcaagaccatggaggccgaggccgcgcacggtgagggtatcaggggattgtcttcttcctggggttggtacatggggggttgcttgtag

SEQ ID NO: 5614 - DNA, 2217 bp, Chlorella protothecoides
  modified_base (148)..(157): a, c, t, g, unknown or other
  modified_base (300)..(309): a, c, t, g, unknown or other
  modified_base (388)..(397): a, c, t, g, unknown or other
  modified_base (1551)..(1560): a, c, t, g, unknown or other
  modified_base (1903)..(1912): a, c, t, g, unknown or other
atgccgagcctggcatgttgcatggccagcgtcacatgcacacatcagctcttggggtcctgcacgcagtgcaatgcacccgcctggccctccatcgtggcacgcacctgcaggaaacggccgtcgtacttcttcaggatggtgttcnnnnnnnnnnaagccctgcatgctgcatggccagcgtcacatgcacacatcatcccttggggtcctgcacgcagtgcaatgcatccgcctgcccctccatcgtggcacgcacctgcaggaagcggccgtcgtacttcttcaggatggtgttcnnnnnnnnnngtgtgggagggggcagagaagggaggcatccgatttggagggtgggtcgacggcgcgaggggtgactttcctggagagnnnnnnnnnnttggtggacaggtaaagtggcctggcgaggaggaggggaaggaggttggaggcagggcgaccagcgtctcgcgcggctcagaaacggtggtgccatgcagatccgtgtacaatgctgagcaggagacgagacgtatcccgcagacccaggccgccaccagtcccatggcgccatcaggcatgcgcgcaactcgccgaccgaggccaggcagtcaagtgttgctgcctgcacagacaccagcacacctggcccacaatacagtgccactcgaaacccgtccccctcaccccacccctgacgcaccacttgcgagacagggcatactggaagcaggactgggcaaagccgcggatggactcctccgtgttgtacatggccaggccgacacccgggcctgcgtgtggcagagcgggtactcacacatactaataatcacggcatccactcgagcatcatgcactcagcttcaagcgccctgtgtcccctccccacacccctccccttccaggccatccccctcttccaaacccacagaccaactcgccctggaacttgaagacctcaaagttctgcacctccccgccgtcgtctggcgtgaagcgcagctccagcttgcctgccccggggacaaccaggtcggtggccttgtactggtcgccaaaggcgtgcctgcccaccacgatgggcttgcgccagcccgggacaatgcgcgggatgttctcgatcacgatgggctcacggaacacggtgccattcaggatgttgcggatggtgccgttgggggagcgccacatctgcttcaggccaaactccctgacgcgggcctcgtcgggggtgatggtagcgcacttgatgcccacattgtacttctgtgggggggaagcggggtgaagaggagcggtgtgcctctcagggcacagctagggggccgaccctgcacggtcgtagtatttgatgtcgaggtcgatgtaggggaagatcagcttctccttgatctggtcccaaatgacgcgggtcatctcgtcgccgtccaggtcgacgatggggttcaacaccgcaatcctggctgctgccattgcagaaccggagaagtaacgatctacacagcgagcccttcatgtacggcgaggagtggacaaacccattccaatctnnnnnnnnnnacgcggggtctgctccatgagagacaagcaaaggatggcgatgacaacccccaccccatgatgccccagcccttcatgtatggcgaggagtggacaaacccattccaatctccaaattgctatttggagcacttgcaaagcaatgtgtcagccactcacgctctccgtgcttggcactcctcaggtggggggccagtcctccgcaacggcgcgcgctcttggccaaggatatctgccggaccaagtcctcctgggggcgggctcccgtcgagcactcgtaactcatggcgagacaacagcgagcaaaatacaagactatcattcagggaatctgtcagagaannnnnnnnnnggggttggggggcagtcctccgcaacggcgcgcgctcgaggccatggatatctgccggactgagtcctctcgggggcgggctcccgtcgagccctcgtaactcatggcgagacaatagcgagcaaaatacgagactatcattcagggaatctgtcagagaatgcgaaagttttaccaagtatgaccttcgtttcaatggaccgtcttcccgatgctcgtttgccccattactctgcccgagtgacactgtgctgcttgactggccgcctggtaccctgaacatgattgcatgcagagtggcctga

SEQ ID NO: 5615 - DNA, 429 bp, Chlorella protothecoides
atgggactaggcggaggagaggggctgactggcggcggaggaggaatcttagatgggaccggtggcgacttcttagatgagggcggtggcgacgtcttagatgagggcggtggcgacttcttagatgggggcggtggcgacttcttggcgggtgggggcgacttcttggcgggtgggggcaggaagctaaggacccatgctggctctgcacatcttggatgcgaatgcacatgccaatccatgctcaccgatgttactattcccgacattcttggtgccaaagttgtttttgcccttgttgccggtgccaatgttgccgttgctgtctgccgtgcatgccttctaggccggcttgaagcactccacagccaccaggatctccgtggatcgatccgacaggatctcatggttgctcacacggatggctga

SEQ ID NO: 5616 - DNA, 618 bp, Chlorella protothecoides
atggcagcagccaggattgcggtgttgaaccccatcgtcgacctggacggcgacgagatgacccgcgtcatttgggaccagatcaaggagaagctgatcttcccctacatcgacctcgacatcaaatactacgacctgagcgtggagagcagggacgccaccaacgatcagatcaccgtcgacgccgccgaggccatcaagaagtacaatgtgggcatcaagtgcgctaccatcacccccgacgaggcccgcgtcagggagtttggcctgaagcagatgtggcgctcccccaacggcaccatccgcaacatcctgaatggcaccgtgttccgtgagcccatcgtgatcgagaacatcccgcgcattgtcccgggctggcgcaagcccatcgtggtgggcaggcacgcctttggcgaccagtacaaggccaccgacctggttgtccccggggcaggcaagctggagctgcgcttcacgccagacgacggcggggaggtgcagaactttgaggtcttcaagttccagggcgagttggtctgtgggtttggaagagggggatggcctggaaggggaggggtgtggggaggggacacagggcgcttgaagctgagtgcatga

SEQ ID NO: 5617 - DNA, 687 bp, Chlorella protothecoides
atggcgacccttgtgtttaagcttttctcgctgaccctcaaaacggtctccaagccccttgcgaacagactcaacggtgctctcctcacgcaccctgtcgtgaggcagcgactggtcaaggtcgccaacgtaaggaagtgttttcttaaaggttgcgcgcattcgtactctcttcaccaccaagctgcgacggagagtggggctgttggtgtcgtgcatctcagcgcgatcccccctgtcgaccccttcgagcagttcatgcacagagtcgaggtcaggattacccgaggagcggagggtcgtacaggaaaggccttcatagctgatatggatgaggagcatgccatggaggggcaggccgctgcctgggaagaggacggcagccacgggcaggaatcagaccagacagcagtgttacttctgctgctagaacagcaacgaaaggccaatgaagatgaagtaaagcaggcaaaaacgattgctgaccgcgcacgcgtagatgctcttcatgagtggcacctgggcgccgagaagttcatggatgctagcaaaaggaatagactgcaggatttacagttttgtcctgcgtttgcagaggctgagcgatgtgacaacagacttgcaacttgcaatgaagtccatggaggagagactggagacgctggaacggatgctcacgccgcctga

SEQ ID NO: 5618 - DNA, 333 bp, Chlorella protothecoides
atggcctttatgaatattgcaaaggcactggtcatcgcgtctctgctgctgctcggtctcaccggttaccaggcgatgcagtatcgggagacactcagactggagcagctggagttcacggggctgccgggaagcctcttgctgaaccttgtggtggcagccgtgatcggtctggtcggtggtgtacagtattggggcaatttcagcccgatccgcctagctgataacccaaggtggggaatcaatgtcctagaggtgctgtggacgagcttgccatggcacggcgctgctctgaagtgcatcagaagtagacaatcccaagtttcagaatag

SEQ ID NO: 5619 - DNA, 1002 bp, Chlorella protothecoides
  modified_base (39)..(48): a, c, t, g, unknown or other
atgcttgcagtgtatggggctctcagttacgtgcatctnnnnnnnnnnagcccgctcctgcagtcggagcaagtgattggattcagtgctcttagaaggccatatgaggtgcatgcttgcagtgtatggcgctctcagttacgtgcattcgcgctcatgacgtcatcatcacattccgggcatgccggagccagggctgatatctttccaacgaaggtgcacaagacaccgtttacacattataatctgtttgaggcaacaagggatcgagctcacctatgcaggcaatcttcctcgccatgctgccgtccgccgggaggaccctctgccgccacagtcctcaagggcagggatgggctgagagtctgggctcgacttataacgacacaaaatatccagaaggagagaggggcacccaaagcttcttgctcccgaatccgtgtcgccggaggagcttcaacgcagggtttgggaatgagaagcaggtgtgatggcagcatggcagcctgcacagcagaccttaagcaaaatataaaatgtcgccgatgccgggaatcgaacccggatcacgtgcgtccagaaaggactggcactcagcaccatttgacaggcacgtatactgaccgttatactacatcgaccggcgaagctgctccgagggaattattgcgaaaaccttcgccaccttgcccaatcgcggtcgtcgctcggactggtcgtgtagcaggtcaccagccccacgtcgtcgtcatgaacgacgctccagcggacagccgcatcggtgtcttggcgctgcagggtgcgttccgggagcatgtgaccagcctgcaatccctgccaggagtggaagccgtggaggtcaggacgaaggagcaactggatggggtagacggcctgatcatcccaggtgacgagcctctggcagatctcaggccgtgcagtccaccaaggggggatgtgcagggccttccgtcccattgtgcgatgtatgtacgtgtgtaa

SEQ ID NO: 5620 - DNA, 1941 bp, Chlorella protothecoides
atgctcaaggtaaggcacccatcgttttggggaagacctccggtggagagtgggacaccgggagacgatgacgaatgtgaggaaaaggctgcgcagtgcattccctgctcagagagcgctaaccaccggagcagttggcggttgttcaagagcaggcctgcacacaatgaccaagaagatcgcgtgcatcgttgttgtggtgctgggatcttgctacctcttgctctggtcgaactagatctagggcctctatttcgacatgtggcgcgggctacgtcggtgaggctccggattgccatcgaagataaatgctgttatgcacatgccgcatacgcaccgaatcagtaccactggttgacactaactcatctaccgcttgcaggtggacctaccatggccatgattgcgtacaagtgcccagatatcgtggtggttgtcctggacatcaacgaggcccgcatcgccgcctggaactcggacaagctccctatctacgagccaggcctcgatgaggtggtcaaggcttgccgcggccgcaacctcttcttctccatcgacgtcaagaagcacgttgccgaggctgacattgtgtttgtgagcgtcaacacgcccaccaagacgcgcggcgtgggggcaggcaaggccgccgacctcacctactgggagggagctgcgcgcatgatcgcctccgtgtctacgtcctccaaaatcattgtggaaaagtccacggtgcccgtgaagacagccgaggccattgagaaggtcctgcgtcgcaactgtgccgacccgggggtagacttccagatcctctccaaccccgagttcctggcagagggcacggcgattgccgacctgaccaaccccgaccgcgtgctcatcggaggcaaagacaaccccgctgggcatgcggccatcgagcagctggcagccgtgtacgcgcactgggtgccccaggagcgcatcctgcgcaccaacctctggtctgcggaactgtccaagctgaccgccaacgccatgctcgcgcagcgcatcagctccatgaactccatctccgcgctgtgcgaggccacaggtatgtgtctgactttgagctgcagaaggcaagacggcaggttgatgggtttatggggattccagagctgcagcctgcccatgggacgattagatgctctgtctcagcctggacagtattcatctgggagaacagtgctttacgcatgcaatgtacatgtgcataggatctcctctcgctcatatcccgcaagatcaggcacctacagtacaacacgttcaccatctgaaacgatgcgtagtccgcccccccccatgtgccgcctctatctcgaaccctgccagatttgtgcatggtctcagaacatggcacccaacatccacactgccacccttccactaacacgggcggatgtgcaggaggttgggcgctccatcgggaccgactcacgcatcggctccaagttcctgaacgcctccgtcggctttggcggctcctgcttccagaaggacatcctcaacctggtgtacatctgcgagacggtgggcctgaaggaggttgccgagtactggcactctgtcatcaccatgaacgactaccagaaacaccgcttcgtggagcgcgtcatctcctccatgttcaacaccatctccaagaagcgcatcgccatttacggctttgccttcaagaaggacaccggcgacacgcgcgagacccccgccatcgacgtctgccgcggcctgatggcggacggagcccactgcgtgatctacgacccccaggtgggggcggaccaggtgcaccaggacctggccacgcccaagttcgagtgggaccaccccgcccgtgcgggctccaccgtcatcggacgtgacgagatcagcatcgtgtcggtgagcggggggcgctgcgccgggtgcactggatga

SEQ ID NO: 5621 - DNA, 414 bp, Chlorella protothecoides
  modified_base (312)..(321): a, c, t, g, unknown or other
atgtgccggtccgaccagggggtccgcacctgcaatttgagccgctccaggaccgaacagagttccctgctcgatcccacacagcttgattccccaccgtctcgcgcacaggacccctacgaagccgctcacggtgcccatggcatctgcctgctgacggagtgggacatgtttgccacactagactaccagaagcgctcccagcaacacgagcgcccctgcccatcaacacagatctttgagaacatggtgaagcccgctttcatcttcgatggccgcaacaccctcaaccatgccgccctgcgtgaggtnnnnnnnnnngaagaccgtgccgatcacttttcaggatcattcagcgctcccggcaacacgagcgcccctgcctatcaacacagatctttgagaacatggtga

SEQ ID NO: 5622 - DNA, 588 bp, Chlorella protothecoides
atggccttggtggcagagcgctggggtctcatccctgagcttcagcgcttcaccagggagctccagcgccccgtctggggcacctgcgccggcctcatcttcctggcagaccgcgcggtcggcacgaagaccggaggccaagcgcttctgggcgggctggacgtcactgttgcccgaaacttctttggcgcacagatccacagcttcgagacgcggctgactgcaccagagtgcctcctgcatgcccccacagcggtggcagggcagcctactttcagggccctgttcatccgtgcccccgccatcctggagacaggcccaggtgtggaggtgcttgccaggtaccacctgacacccgaggaggcggcggaagactcatctcgccccgcctcggttgtggttgctgtgcgaagtggacacctgctggccacctcattccacccagagctcgttggggatgcccgctggcacgcgcttttcgccgacatggtccgtgagacgatcaagggaaagcagagggaggagcggcaggcccgggaagtcagccccctggaggctcgcaagccacgagacttgcccaagcactga

SEQ ID NO: 5623 - DNA, 675 bp, Chlorella protothecoides
atgcccgagttcctcatcattgcgttgaagtgcgtggacctagaagttgtggtcgtcgacctgaatgtctcccgcatcgccgcctggaactcggacaagctccctatctacgagccaggcctcgatgaggtggtcaaggcttgccgcggccgcaacctcttcttctccatcgacgtcaagaagcacgttgccgaggctgacattgtgtttgtgagcgtcaacacgcccaccaagacgcgcggcgtgggggcaggcaaggccgccgacctcacctactgggagggagctgcgcgcatgatcgcctccgtgtctacgtcctccaagataatcgtggagaagtccacggtgcccgtgaagacagctgaggccatcgagaagttcgacattctgtccaaccccgagttcctggctgagggcacagcggttgcggaccttgcaaatcctgaccgcgtgctcataggtggcaaggacggccctgctgggcatgctgctatagaggagctggccgccgtttatgctcgatgggtgcctcaggatcgcatcctgcgcacaagcttgtggtctgcagagttatccaagttgactgccaatgccatgctcgcccagcgaatcagctccatgaactccatctctgccttatgcgagactacgggtggggaagtggggtcgagttga

SEQ ID NO: 5624 - DNA, 345 bp, Chlorella protothecoides
atgaacgattaccagaagcagcgctttgtggagcgaattatcacatccatgttcaataccatctcgaggaagaacatcgcaatctatggatttgcctttaagaaggacactggcgacacgcgcgagactcctgccatcgacgtctgccatggtctggtggccgacggagctcactgcgtgatatatgatccccaggtgggagcggaccaggtgcaccgcgacttggccactccaaagttcgagtgggaccaccccagcaggggtcaggctgccatcgctgggcgcgacgagatcaaggttgtcaaggtgggtgaggcgtcgatcgcagcgctggtgtggatataa

SEQ ID NO: 5625 - DNA, 1137 bp, Chlorella protothecoides
  modified_base (144)..(153): a, c, t, g, unknown or other
tgctgcctgacctacagttaccatgccattccacctgtgagaacctgtgatcacacacacctgcggaccccagaccctgcccctccatcccctcacgctctccctttccacgccttcagggtgcccacggcgaccggctggtgnnnnnnnnnngtggtgtcagaaggtgcccacggcgaccggctggtggtgggcctgaccggctaccccaacgtgggcaagtcctccaccatcaacgcgctgtttgggtccaagaagacggcggtggcgccgacgccgggcaagaccaagcacttccagaccctgaacgtcaccgatgacctcaccctctgcgactgcccgggcctggtcatgccccagtacgccaacagcaaggcggagatggtggccgcaggggtcatccccatcgaccgcctgaccgacgtgcgggcgccggtgggagccatcgccctccgaatctctcgccgccagttctcctctgcctactccctgcacctcaggggagaggggggtgaggcacccggacgcggtggaggtgctgcgcgctctggccctgtcgcggggctgggtggtggggtctggcctgcccgacgaggtgcgggccgggcgccgcatcctcaaggactacatcgatggcaagctcatgttctgcaaggcgccgccgggggcggcgcgggcggtgagggccgtggcggcggccctggcacacggcggcatgcccgaggcgttggcctgttcctccggagcgccggcgctggaggcgccctctggcggagggcaggaggaggcctccacgtctggggaggaggacagcgaggaggaggaagggccgggggtgtctgctgccgccggcgccgagctggacctggcggacctcgagctgctggaggagctgaagctgcaagtgatgctagcgatcgcactctctacaacactctgagagcagcagtatccactcccacaccccctcgcagcgcaagggcaaaagccgagcaagccggtgcgagcggcacacaagttccacaagaaggcggcgcgctcaaagggcacgcgggggatcgcggtggacctcggcaccagcgacggcgcgatgctgcagcacggaaagcgcggtgggctcgtcaggatcgtgtctga

SEQ ID NO: 5626 - DNA, 744 bp, Chlorella protothecoides
atggcaacggagctcgctagagtgccttgtggatcccaccagcgcctaagattcagctggggacccggatcagagctttactgctgtgcggtgaactcctctgagggtcagcttggggaggaggagagcacctcgacggcagtacagtgggactgcccagggcccatatcccgccgcatcatctacgacgcgcacgtcaagtatgtagagtgtgagcaggtcaagggtgatccccttctgcgtccggcgcaactagagcagttctgtaccgacgtcggggccatcatggacgcaagtctccctgacgacgaagagctcttcgatgaggaggcacagctcatcgcagaggagcgtgctctctggacaatactctccctcttctttggcggcatgggagagtcagaccgcctcatctcacaggtgcgctgccttccccagtgtgtggggggggatatagggactcagtgtttatgcagggcagggtgggaggcaagggcatggagagggtgcgcttggtacagctgggggtgcatgttgtggaccgggcagcattctttattccagaggggtccagtaagccctgactgcacgccctgtcacgagagtctcagcctggatcatgggggactcttctctcccttcccgcctacaggagctggccagctggcttcaggtcaatgctgctgtgctcctggctggggaaggcggcagacagctgtcccccgcctccctcgccgcctttga

SEQ ID NO: 5627 - DNA, 1311 bp, Chlorella protothecoides
  modified_base (331)..(340): a, c, t, g, unknown or other
  modified_base (812)..(821): a, c, t, g, unknown or other
atgcccagggtctgtgtggtgctggcgtccactgtgccacgctggtgtgagcagcacaatcccactggaatcggtggctcaccgccgcccctcctgcctgccatcctgcaggcatttcaccttccccaatgtggagcagatggggctgatggccctgcaaatacagaatctgacccatggggctcttcctttctgcatcggaggaggaaggccagagcatttccggtcgcagcctgctcctgtcctgccctcctccactcacacactgttccactcccttccccatctggtccaggcgccggcaagtccaccctcctccggctgatcctgnnnnnnnnnnccccactcccttccccacctggtccaggcgctggcaagtccaccctcctccggctgatcctggggctggagaagccctggtctggtaccgtggagctggggcagcactccatcgtgcccaactactttgagcagaaccaggccgaggccctggaccccaatctctcggtgcttgagaccctggagaggtgggctggtgcagtgaaagagggggaagaattgggtggcatacgcgcggctgcgccggacgctcgcatggatgatatcaaggcactgctgggaaggatgatgttcaccgggactgcacaggagaagacggtcaagtggctcagcgggggcgagaaggctcgacttgccctcgcaaagttcatgctgacaaagggaaccctcctggtgagattatggatgcatgctggagctttgggtggaaacaggaaggtgcaggaaaggtttccctgcgtgccatccctgcnnnnnnnnnncctggagctttgggtggaagtaggaaggtgtaggaaaggtttccctgcgtgccatccctgcttcatgaccagctggccaacaccatacctgatgcaggtcttggacgagcccaccaatcacctggacatcccgtccaaagagaccctggaggaggcgttgcaggcgtttcagggtgagttgtttccatttgagggtggtagggatatgaggctgtggagtgtggtggtcgtctcgcatgaccgctacttcctgaagaaggtcgcaactcgggtcgtcggcgtgggaggaggcaaactcactgactatcaaggggactacgagttcttcctgtccaagaacaaggaggaggggagcatcatgaaggcaaaggccgagcgggaccgggacctggaaaaatcccagatcaaggccaagtcaaagaagaccaaggcagaaaaggtggggcttgctgtgtttggttgggacttggtcatcttattgcttgactga

SEQ ID NO: 5628 - DNA, 912 bp, Chlorella protothecoides
  modified_base (846)..(855): a, c, t, g, unknown or other
atgtatgagggcacggtcggcgcggggctgcccatcatctccacgctgaagacgctgctcgacaccggggacgacatcctgcgcatcgagggggtgctcagtgccatgagatcatgtcctcgtgcatgcccagccccgcccatgcccagacctgctcgcactgccagtccaaaccctgactttacctggccccctcccgactcgcatcgcagtgggacgctgtcgtacattttcaacacaatgaagcccggcgatcgattcagcgaagtggtgtggagtgccaagcgcaggggctatacggagccggatgcgcgagaggatctctccggtgggtggccggggttgtcctggtctggggctacccccgatttaggatggatggatggctcgacgtgtggagatgaaggcatgcctggaagtctgccagtgcctgccacggtcaggcaccgactgagtgacatggtgaggaacaggctcctccctgtgctgctgccttggtgggcatggcggcgagtggaccagcaggtgcacagatcatcttccataccatgtgccctccctccatcacctcctgcgcaacgacgcagcactcatcgcagcaccctccttgccttccaccccatcaggcacagacgtgactcggaaaatcatcaccctggcgcgtggggagtgagctggtcgacacagacggggcacttgaggtcgggccgccctcctcatcatgctggcagggcagggtgtcgaggcagggcgcctgcccgtaggctgggggtgagtcagccggcatcaacctgcggcacggaccagctcccccccccagggtcctacgagccaatgagcaggttnnnnnnnnnnccggcatcaacctgcggcacggaccagctctcccccgggggtcctacgagcctatga

SEQ ID NO: 5629 - DNA, 222 bp, Chlorella protothecoides
atggacaaggagtcaacctgtgagcatcacccagacccctcccacccacacctggctcagattatcaccggcaagatcttggcggatggcggggaggtgatcaaggcgcgggccgacctgcgtgtcgccatgctgtcccaggagtttggggtgcagttggggcgcacacttcgtgaggagttcctgtcggcgttcgaggaggctgtgcaggtcggcgaatga

SEQ ID NO: 5630 - DNA, 504 bp, Chlorella protothecoides
atgggtacgagcaggaaggcgcatgcctgggagcctgatgcgaaccatggacctacctgtgcttggctgcaggccaactccgccgcctccacaatgttctgcaggcgtgccagcagaggtgtccgagccgtggagcgaagagcaagccgacccttccaggcagctcacaggacgccgagaatgacggtgaggtgggcacagggcccttacttgagtgttgcacagcaggccattcaagcagggcgcagggcctgtgcacctgactctccaccatctggcactccaggttgtccgggctgcggcggactctccagagggccattccgtacagagttcgagcgattcagcatgctggggtcctgcccctccctgccccagatcaccaagactttcaagggcgagacagtcttgcatgacgtgacatgggaggtgaagaaaggtgagaaagttggtctcattggcgtcaatggcgcagggaagacgacccagctgcaggtgacctga

SEQ ID NO: 5631 - DNA, 969 bp, Chlorella protothecoides
atgttttggtggctgaaaaggcactcgttcctgggaggcctggtgaatgcaaagcatgctggtctcacccagccagcttcagggcctggccccacccgcgacatgcatgtgcaccaatcgtggcaccttcccccttctcccacacagaacgccaagcggcaggaggagatccaggctgctctggagaatgtcggggaggacatggatgccatgggcgatttgctaggtgtccagggggccgtgggaacccggagtggcctgctccctgcggaagttgggtcgctctcccctgcctccagactcccacaccctgctccgcaccgcgcagacgagctcacacacctgaccgccacggccgtggagctggacaccagcctgatcgagaagcagacccagcagatgatggccaagttggggtttagcccggacgactcggagcgcctggtggcctccttctccggtggctggcagatgcgcatgtgcctgggcaagatcctgctccaggcgggcgccgggctgggcggcgggcgccgggttgagaatgggatgcaggggttggtgcgcagcacctgcgggcgaggagctgcttcctcatgcccggccagggtatggaagagccatctgcgcccggacttgagggcaccagacgcatgcaccgcctcggggttgctggccttgcgagcctctggcccgtctcaactgcccacaccctcctccatggcgcatctgccgacgcaggacccagacctgctgctgctggacgagcccaccaaccacctggacctggctgccatcgagtggctggaggggtacctgagggagcaggagatccccatggtcatcgtgagccacgacagggagttcctggaccgcctgtgcaccaagatcgtggagacggagcggggcgtcacgcagacatacaagggtgcgtctggtatggagagcctgccctgctgggggtgggtgtga

SEQ ID NO: 5632 - DNA, 708 bp, Chlorella protothecoides
atgaggcgcgcgggcgtggacgtctcgcgcgtgctggccaagcccgtgcccaccgcgcgctgctgcatcctctccgcccccggccagcgcacgatgcgcaccgccatcgcggggtcagcggcgctggaccccggcgagctggacgcagggtcctgtgccggcgcgggctggctcttcgcctcagcatacgcggcctacatcccgggcatgctggacgcggcggtgcgcgcggcgcaggccgccggcgcgcgcctggcgctggacctggcctccttcgaggtggtgcgcgccttccgccccacgctgcgcgcgctgctggagtcgggcgcggtggcgctctgcttcgccaacgaggacgaggcgtgcgaggtggtgggcgagcgccgcggcgccgacgagggcgggccgctgcgcggcctggcatacctcgcggcgcactgcgacaccgcggtggtcacgctgggcgagcggggctgcgtcgtgcggtcgcgcggctcggacgtcgtgcatgcccagcccgcctgcaccggggtcagggtcgtggacgccacgggcgcgggcgacctctttgccgccgggttcctgtacggcacgctgcgcggcgcggcgctcccccgctgcgcggagatcgggtgcatggcggggggcgcggtggtgcagaccctgggcgcggagatgaccaacgccacctgggagtggctgcacagc

SEQ ID NO: 5633 - DNA, 3951 bp, Chlorella protothecoides
atgcccgactgtgagacctgcactgctgcaccatcggccagggagacgaacctactgaagtggaattgccacatccccggcaaggagaacactctctgggagggtggtttctacccactcaccatggagttcagcgaggagtaccccgccaggcccccaaagtgcaaattccccgccgggttctttcaccccaatatttatcctagcgggactgtctgcctgtccatcctgaacgaggatgaaggctggcggccgtcaataacggtgaagcagatcctcgtgggcattcaggtaagccgccttctgcacaaggctggagctattggacacgccaaacccccattcaccagcccagtcagacgcctacctgatgttcacccagcggttgacagagtacaagaggaagatcaaggatgtggcgtccaagtacccgcctccacattgagagctgcaggccctgcagtcattggtgcccgtgcccagttggaaaggcgtactgagtctgccttcactgttttgcctgttacctctgcctctctccaccccaaggctggtattgagggggagcccagcagcccacaatctggatggctagcgatgctctcaagggaaggctcatcttctacccccggcgcagtctgggattcgcatgcctgcccttggcagtaccacttcacgcgacttcatgaacatctggatactgtaaatttggcgcatggcatgattatttggcgtagaacggtggatattgaggacaatttaacgctcgtgcacccggatgttagtcggagccgagtcggtgtccggacgatgcccggcacaggagccgcaccccaaaccatggcacgttgccacaggtacgatgggtttcggaaaggtgaaggattcagggcgctgctctacttcattgcatatgtgtttggggtattgtccggcattggtgtggagaagttatgcctccattatgaactgtcatgtgagatgaggggcatttcctcgcccggtgcgagggcggtgcacgagtctgtttcgggggatggcatcgtaggtaacatcctacgccttccggcttctacggttggggaagcaatgattgaatgggtagacacgcgcccctcatgctcccccacaggaacatacagtattgagagcaccggtatcaggttcaattgtaacgtcagtactgctgtgaggttggctgtgtatggcatgtttgccgtcctcctcgtctcggccatcgtggagatctgcatcgtatccatcggtctcaaaggtgggccactcgaggagtacaagcgtgcgcccatcgtcccccttctgtatgcggaggtgttcctttgggtgctggccctggcgtggacaggtgggatggctagatgcactcggatcaccgtcgcccacagggcactgggggatgagcaggacgggggggtgtacggcacgtacatggtcgtcagccccgtcgtggcagctcagtgctgggacaacaatccctgtgcgtacagcaacaggtttccagcagcatgtacgggagttccagattcaggaggtatggatatcgttctggaacaagatgttgggaaagccgtgcttgtgagcggcgtgagggtgtcgagcaagcatcaggagcaagctgccgtcgccaagggagcatggccggttgagaggggatgtgacatgcgcattggagggcacggcctgcatacagtagcctcctcaaggacccattccattgcaggcgccaacaccctgagccctccttgccaaaccctcttggacaactcgcggcaatgggggggctgctttgaggaatggttcttgcttggcacaagctatattctgcacgatgagttcagagatgactctgtttccgctggggattggaactgctctgccaccaccccggcagctgacaacatcgatggctgggtcgccaacgccttctttgatggtgacactgccccatcagcggcagaagaaaaatgcctcgtcccctccgccacgctcctaggtaacttgagctggtaccttgaccgtgctgaccagctgctggatgggagcgtggacgacgccggattcaacctggatctgctgattgagggagggacgctggccgccgtccgggcctacaaccagcagctccggagcctggggtacctgacacgcaacatcgagctggcgttcctcaacctctccggcctgccctatgacctggagcgagtggcccagggcgcaccctgggccgggtgccagaacgaatcctgcgcgtggctcatcaggtgcgctgcgcatgctgccttagggatccgtgggaaggagggacacgtgctaccgcgcagcgctgggggactgcccccgtgccagcctgagcatgcacacgggctggagcagccgccactccctcccaaatcctgcgacctcgctcgcagtgcctctgatgcatgcgagcagtgggacctgctcctggcactgcctgtgccccgcgataacaagcgatattttatgatcctgggcgctgtgttgtgccacgtggggggatcaatttcaccgtccccttctcacccggctgggccgtgtagtttcctggtggcacttgccttcaactccttccccgactacgaggatgtggagagctgggagggagggctgagggtgttcagccgcctgtgctgctttggcaacgtccttcatgaagaggtcatggaagaaaggaccttttctgagggagaggacctgaaggtctgcactctgcctcttgtcattggtttgggggagcatgacgctggaccgaggtcctgcgatactccactgccctgctgcaggcacgtgccttcccgcgtcatcgcccagagcctgagcatgctcttcggcagcatcgacctggaccccaccgaccgcctcttcgctgctctgctgctggcggagcagcagcgggaccagcgtcagatcaacatgcgcctcatgctggacagagccggtgatggaggggactttgggaggagggcggccggtcactgtacgacctctggacgcctgagctgcggaattgctctcatgccatcatgccgcccgtcagccatcccagagactcctcccgtgcaggcttcaagatgcgccaggcaaagggcggggccttcttcaagggtcgtcgtgcctggaatagcggagagcttgatccggaagagtcacatggtgttcggggacagggcatgcacgccttccagccctggctcggagctgtggaggagggccactaccccgtgtactgcaggacggggctgcattacgacgacgcaggcttgggcgaggagaacgggggctgggcagcctcgccaggagtggaggtggccgctgtctgctcgggtgagtgcatgctgcaggcctgtgagtcatccctggaggccacatgcagctgggcagggggcggccgggtggcgtcttgaggaatcaacatggccctgccataatcttactgcaaccaatcccggtgttcagaccctctcccccgtgttccgcatgcctgcagggccgcagagacccgtgatggcatcagctttgcaagacatgcaccgcatggcaacctttgcggttgcagcctatggcgtgcagaaccaggcatggaacggcggaagacgtcctgtgaggtgcagcgggtgcattgatacactgaagagcctatacagccggatcgtgggagggaggcatgggccccgtcagcgcaactgcgatgctatccttgaccttacagaggagggtgttagtcgggcgttttcctcagcacaggtgtccgttatcacccagccaaacctccccatggctcacaggatgcagaccgacggacctgctctatgtctcatcttgatcaacccttctccccacaatgttcatcccagatgcaaacatgccagcaggcgcactcccgtatttggtgatgtgggaccgcagccatga

SEQ ID NO: 5634 - DNA, 579 bp, Chlorella protothecoides
atgcgtcatacccttcgtgtccgtggcgtggggcgcgtgttcagcgaccttgctcttgcctgctggagcaggggaggggtcaccacgagaacatcaggctctccctcacttcttccaggtggaaatattgtgtgcaaacgatgcgcacccgacatctccctcccatccaccccccctcctgccaggtactgcaagacatcctactttcatgatctagagcagcctgagctctaccccccgggcgatttggccttcctcaggcccttcaagcagaggcataggaaagagtccttctgggatgctgtttggatcagtgccaacggtgcgcctttggttcatggtggtggagtcggggggttcgcgcatgctgagattgccgtcttgagggttttggtacgtagtctctcaagtgcacccttttgtctccatgcagacttggtaggggagggtatacaggtctctgcggccatgctcttgcaccatagggtttatagcctgatggacgccttggaatccagtttgcagcatgcacaaaacctcgctgccacacctgttcactgtgaggcgaggccctcctga

SEQ ID NO: 5635 - DNA, 1095 bp, Chlorella protothecoides
atgccggagctccgattgtttagaagacggtggcacatcgcgtcaggtaccacgttctgtgtgcgaggcttgggctgcattctggtcgtacagggaaccctgcagcctgcatggcattgtggtcgcgataccttcccaatcgtagcttgtgtgctggcgtgtgtgcatgtaggcttcctcataccctacatctccggggcctattccatcgaaagcaccggcatacagaacaattgcagcgtcggcacggccgtcagagtggctgtgtatggcatgtttgccgtgatggtggtggcagcatgcctggagtttgccatcgtctccataggattaaatggtgagtcatggatcgatgtggcacgcacagaatcgcgtggagactggcccgcatctttatctggttactctgtcccagggaggggatctttagacgctcaaggggatgcccccatccttgatccggtctgcacgattcctccccctcctccctgcaggtatggcgatgtgcaggcctcaggtccatgccactctgcattcacccagcacgaatgtgtgcgaaagggcaaccactgttcttctgctccacgttcaaggattgagtctgtcatctgtccaccatgccgcatcaaccctgttgcagtgtatgggacgtacatcgtcaggagtccgaatgtgggtgccgagtgctgggacaacaatccctgtgcctacagcgatgaccttcccgcctcgtgcacagggcccaaagttgcaggtgcgtcagcaggaggggcgagtgaaccctcgatcactgatcatggtgtcgtgggaatggctctacgtgtcagtaccttgagccctccatgcaagttcgtcagtgagaactcgcagcaatggcagctttgctttactgagtgggttgtctacggcgtgagctatgtgtggtttgctgccctcgacacagcggatgattgggactgccaagtcccgccacctgggactgaggacgttgaccagtgggtcagcgatacctatctggatggtgaggctgtgatggtgcatagaaagtatggtctgctgcacccagcggcgggacttgcatgtgtccaggactga

SEQ ID NO: 5636 - DNA, 330 bp, Chlorella protothecoides
atgaccaagcgcgtcctcgccctctttgacgtcgacgggaccctgacggtggcacgcaaggtgggaggttgctcagcgggaccgcgatggcacgatcatctggctgtgaaggtgggtactgtcggcggctccgacctcgcaaagcagctagagcagctgggcaagacaggtgatcaggggtcgaaacagggctgcttggattggactcgaggcaatgcatgcagtcgctcacagatgttcagcccttgcgctctgtgcaaccctacaattggtggggcgctcgggcctttgcagggacaggaggacctgctctggtcagaacagacgtga

SEQ ID NO: 5637 - DNA, 606 bp, Chlorella protothecoides
atgttcagccgcaccctcctcatctattatcccagggagccggcttcccgtgagattgccaagagtcttaacatgttgtttggaggcatcgaccttgaccccaccgaccggctctttgcagccctccttgtggcggagcaccagagcgaccagcggcagcgcaatatgcggcacatgctgagcagagccgggtacgtcacaaacatgcaaaggcagggcgccttcatcaaggggtctcagcgtcgagatggcgggcagttgagccagactccagaacccagggcccaccggtctgtgagctggcacctgcccccttcacccttcagttccaggacatctcgtgtcatgcccatgtatcggcgcacgatgatgaagctggatgaggtggcgctggaggagggcgggcgctttgatgatgccatgtcagggacagactcccctagcttgaagtgggtgcgggagcagctggggaccaggataaccctggcctaccagtacgcgcccatcatcaccccagtctgccttccggccgtgtactgcgaccacctcacgccacaggaagcggctgacatctactcgggtgtgtggtggtgtgcgatgggctag

SEQ ID NO: 5638 - DNA, 555 bp, Chlorella protothecoides
atgtcggcctccctcccagttggtgacctggaagccttcttcactctggaccggctgcgaggcatcttgaggaggagggagggggcatctctgaagctcgccctcaccggccactcccttggagcagctgtggcctgcatgctcggtctccaactgcgccaagagtgcccaggtttgctcgacagcggcctggtggaccgtgctcccgcactgcagtcatgcttgaggtctctcagcctcccccctcacaccttctacagacattcggtgctgggcattctgcccgccgggcggcctgatgagctggaacctggctcagctgactcgcaggttctgtacctcgatcgtggtgggcaaggatgtgatcagccgcatgtcgttcaatgctctcaagcggacggccaccctggatcggcaaaactccggcttccaggagctgtgcaggcctgggcatccagggacgaggcactgcgtcgcttcacctctgcccagcagaaacttcccctaacaacctgttccccctgtgtccctggtcaacagatgccgtcgccctaa

SEQ ID NO: 5639 - DNA, 360 bp, Chlorella protothecoides
atgaaggtcctgcggcagctgagggagaagctgcgcttgaacgccgcagccgtgcagtgctgtgcattcgagcacagcgtcggagatttccttccatccctggaaaggcggtcgggacacgccattgctgtgccccgccttcctgcacatgccgtaacccagggccggtccgcggtctacctgcagatccccatgggtgtggaggactccatgaaggggctcatcgacctagtggagcgcaaggctttcgtgttcgagggccccagtggagacagcgtcgtaggtgcgctgaaggaggggagtctgaggtgcctggcgggtctgtggactctcagctgtgtgtgcgaggacgtggtgtaa

SEQ ID NO: 5640 - DNA, 1611 bp, Chlorella protothecoides
atggaggccaagcgcacggagctggtggagcgagtggcagaggtggatgagggcgttggcgagctcttcctcatggaggaaccggtggacgccgcctccctgcggcacggcatccgccgcgccacgctctccctcggcttcgtcccggtcttcatggggtctgccttcaagaacaagggggtgcagctgctgctggatggggtaaccgactacctgccctgccccatcgacatcaccaacaccggggttgacctcgcggactccgaggcgccagtgcccgtacactgcaccaggcaagcctccaacgagcgtcctgtctgtgcctgccagcctggcgggaagcgtaatggggtgctggtcctgctgcgtcccataccttgcttgcatgcatcactgtcaacccctcattcctgccctcctcccgccaggtctgggccgctggtggccctggccttcaagctggaggaggggcgcttcggccagctcacctacgtccgcatctacagcggtgtgctgcgcaagggtgacaacatcgtgaaccagagcacgggcaagcggctcaaggtcccgcgcctcgtgcgcatgcactccaacgagttggaggacatcgccgaggcaggggcgggcgacatcgtggcgctgttcggcgtggagtgcgcgtcgggcgacaccttcaccgacggcacgcgcgtggccatgacctccatccgcgtgcccgagccggttatgagcctggcggtggctccgcgcgcgcgcgaccagagcgccaacttctccaaggcgctcaaccgcttccagaaggaggaccccaccttccgcatggcccaggacggggaaagcgggcagacggtcatcagcggcatgggcgagctgcacctggagatctacatagagcgcatgcgccgcgagtaccgcgtggactgcgaggtggggcgcccgcgcgtgaactaccgcgagaccatcacccgcgccgccaccttcgactacctgcacaagaagcagtcgggggggcagggccagtacgcgcgcgtcgcggggcgtatcgagcccctcccccccggccaccccaccaagtttgagttcgagaacggcatcatcggcaacgtcatcccccccgcctacctccccgcctgcgaaaaggggtttgccgaggccgtcaactccggctccctcatcgggcatcccgtggagggagtgcgcgtggtgctcaccgatggcgccgcgcacgcggtggactcctccgagctagccttcaagctggcctgcgtgcacgccttccgcgccgccttcgagcgtgcgggggccacggtgctggagcccatcatgcgcgtggaggtgcaggcgcccaccgagttccagggcggggtcatgggcgacatcaaccggcgcaagggcgtgatcaatgggtcggagcaggagggggacgacaccgtgctggaggcctccgtgcccctcaaccagatgttcggctactctaccgcgctgcgctccatgacgcagggcaagggcgagttcaccatggagtaccaggggcaccagcccgtgacccaggacgtgctggcggagctcacctccaaccaccaggccgccaagaccgcggccagggggtga

SEQ ID NO: 5641 - DNA, 309 bp, Chlorella protothecoides
atggtggagcgcttcaacataagcagcttccctgcggtggttgctgtgtgcggcggggacgccggcaccacgatcaggcacacgggggacatgaagtccgaagccctcgcaaagtttgtgctgagcttcagggacggtagtcggtgcatcgaagccatccaactgacgccagagacagacttgaacaagttcaaggtggcgcagctgaagaaactgctggccagcaaaggggtgacatgtccggagtgcttggaaaaggtggactacctgcatcgcgtccaggaagtgttcggcctggcatctgtgtaa

SEQ ID NO: 5642 - DNA, 2214 bp, Chlorella protothecoides
  modified_base (132)..(141): a, c, t, g, unknown or other
cggcgcccccgtcgccgtccggcccgagcccaccggctgccacccccccgggccacggggcccctgcgccatggcccgccccttccatggcgacgacgccagggacctgtggcagcactgcctcgcccagcnnnnnnnnnntccaccggctgccagcccccccggccacggggcccctgcgccgcggcccgccccatccatggcgacgacgccggggacctgtggcagcactgcctcgcccagctgccaagagcccgggtggaagagcatggggccgcctatccggaaccgcacgcccacgggggcatagactgggccgccgggctggaaccaggcctggaaggggcgcaggcggatctcctgcaccagcaccagcgggtgcgccaggcgcagggccacccagtctctggaccccgggtccggcgatccccggctggaccagtagctcaggcccaggccaaaggtgacgcgctcctccggcagaagcaggttgatggcgctctcttcgcggtggtcggtggtggaggcgcccagcacgttgcgggccaggctggaggcggggggcgggagagtcgatgggcgggcggagaggaaaggggcgccgccgttccattgccaggatcagggaccagcgctgggccagggcatgatctgagtgctgcaggactgagctggcgagtggcgctgggcggccaggccctcaggaggcagggctgctcgtcgaggcagaccgcagggctacctagcacccaccccagtcccagccccaagtatccctcagcactgcggcccctccgtgcccctcccaccgtttgtgtacccagaggcgagcctgctgcatgggcagggggccagggtcatgcacggaccgcatttccctgtctcccacgggcaggtggaccagtggatccgcgtccgagcgagggtgctccacgaccaggcgccccagcatcagcctgcgagcagcctcagccagcgtggggtacggctgcaggctggggtgtgccagccagacgtctgcctctcggactgcaagaacgcattgcaaggaacaagaaggagcaggacaggcatcctgaccgacctatggatctccagagacggcacaccagctccaccgcctgcagggcgtctgtgggaagtccagagaacaccctggccagcacctccacctgtttagggtggggcggtgagggagcgatgcactggaagaacggctggttccttggcggtcccatgcatgcgacctccatgttgatagattggcgcaccgggagaccctggatgtcgagagggccagacatggttgcaggcactgcgcctggtgccgagggaacctcgcttcaatcctactactactacatgcccttcctcagatcttccgagagtctctcggctcctccagatcacttctccagcctgggtctggatcagaatcatcctgatgtctgggcgccagctgaatcgcctgcgccaacagctggctcagcaagagcccgagccggccaccgacccctcctccagcgaggaggaagaagaggaggacagtggtcccagcaacccattcgcccttcttcaggactcggtaggttctgcatgccgcatggaggcgtgcatgtagctccacactttgttggagcctggtgcagcatggtgctttgtgcccaatgtatatacctgcaggacgagtctgaagcagagagggaggcttcctcgcaggaagaggcatcggatgatgatgctgcgacgaccagcgccgtcggcgcgccacccacaaagcttgcccctgccttgcccaccccaaagcagccgtccaagcgccagcaagccagggaggaggaggacatcgacaaggttctggcggagctgggcatcgaccaaccccccacccctgcacataaaagcacgagtgcgcccagccctgacgggtcgcatgccccaactcgccccactgcggcgccggccaagcccctcctggccgtgaatatgcgggcgctgaaggcctccgacgagctgaaaaggatgtttggcgccgccgccgtgcacgaagacgccgaagatgccggcgctgcatacgcagggagggctggctgggcgaaaatgtgtcaagatgaggtcgcgatcctccatgcacggatttctgggaggcattccagtctcctcaacaacgcctggtgctgcttggcatgtggttgccacgatttccgtggttga

SEQ ID NO: 5643 - DNA, 201 bp, Chlorella protothecoides
atgagcagcggcgtcgagctccagcccatgcagtccagcgcgtttgtcaggccctactccatcatgtaccaactggacggccggaaacggcgctgggacgcggtggagtcccacccctccgtcgcctgtgtgctgctccacaagggtctggactcgctcatcatggtccgccagttcagacctgccgtgagtggcacgtga

SEQ ID NO: 5644 - DNA, 813 bp, Chlorella protothecoides
atgcagctgctcgtgcgtggtgaccgtacctgcgtggtagaggtcgggcagggtgccaccgtgcagacgctgctgcaggcagcctgcgaccgggaaggctccgtcccggcccacgccgcgcgcctggtccacggcggtcgcgccctggatgccgacgcatcccttgcctcctatgccatcgcgtctggggccacgctgcagctggtgtcccggctgcggggcggggcggggggctttaccgtgcacccccggctgcagcgggagcgctggagcctatactggaaggagaccatggccaccaccaccgacctgctggacgacattgccctggacctggaccccgtcacggccacccccgcggacgtgctgacggccaccgcggcagcccagggctgggcccccgtcgccgacctgctggcgctggagggatttgagggcccctgggagcgcctgctgttccagggccgggagctggaggccggaaccccgctcacggagcagggtgtgccggccggcgcggagctgacggcggtgcgcctcgccctcgtcgccgagggctggaaggggtccgccagcctgcacgcccccctgagcttccttgcctgtgttttgcacgtcggacctcgacacaatgagcccggagccgagccttcgatgcagtgctgcacattcaaatccaacgccctgatcccccgtcggccaatctccctgcagatccaggcggacgacgacgacctgtcctccagcagcgacgacgaggccgcctttgtgcagctccacgcgcatcagcgcacgggggtcagggcgcagtga

SEQ ID NO: 5645 - DNA, 618 bp, Chlorella protothecoides
atggaacggcggcgcccctttcctctccgcccgcccatcgactctcccgcccctgccctccttcccccagcccccggggatgcatactcactgcgcaccccacccccacgcaaccacaggctggtggcgcttgtttcgtgcctgggccccgaccccgcctccagcctggcccgcaacgtgctgggcgcctccaccaccgaccaccgcgaagagagcgccatcaacctgcttctgccggaggagcgcgtcacctttggcctgggcctgagctactggtccagccggggatcgccggacccggggtccagagactgggtggccctgcgcctggcgcacccgctggtgctggtgcaggagatccgcctgcgccccttccaggcctggttccagcccggcggcccagtctatgcccccgtgggcgtgcggttccggataggcggccccatgctcttccacccgggctcttggcagctgggcgaggcagtgctgccacaggtccccggcgtcgtcgccatggatggggcgggccgcggcgcaggggccccgtccctggcgtcgtcgccatggaaggggcgggccatggcgcaggggccccgtggcccgggggggtggcagccg

SEQ ID NO: 5646 - DNA, 279 bp, Chlorella protothecoides
atgcgggcggcggaggcagcaggggagcccacccccccaatgtccgtggggttcacctacgagctctgcgccggcattgtcgacaagcgcggcctacccctgaccaagatcatgcaggaggagatcaacgaggagtgcggcttccacgtcgaggaggctgacctggagaagatcaccagcgtcatcacggccctcggcatcagcggcccccgcatgacgctcttcctggcggaggtggacgacagccaggctctgcccacacggggtgggctcgggtaa

SEQ ID NO: 5647 - DNA, 342 bp, Chlorella protothecoides
atgagcatatttcttcgtcagggtgggactcttggtgcgcctgatgaggaattgctaccgggccagacctgccctctcccacctacgcacccccaggactttgacagcccttgcttgaagaccaagcagcactacaactccttcaccacccccttcttcctggacgcggagcggtgggtcatcccgcggctgcaggcagggggccgtctgagcgcccaggaccttcggggtgcagcagagcacatcaggcgccccctggcctgccaccggtgcgggcagggccttgcaaacatgccgaaggtgaaggaccacctgcacgcgtgccgcgcagcgctggcgtga

SEQ ID NO: 5648 - DNA, 429 bp, Chlorella protothecoides
atggacgtcatcttccatgatgagctctgcgtgggtgtgctcgacaagtaccccaaggccagggcgcatgccctcgtcctcgccagggagccggatctcctgtcggtgcacgatctcaggcagcgccacgtctcgctcctcagacacatgctggtgaggttcgcgggcctcctctgggaggcgacctgggttgaggctgcgacgagcaggctggagttgtgtgaacagatccagaccaccgcatgcgctgaggcacgcacagcgctcgcatgtattcctcgcgcccctgccccatgccatgtcaggagagggcacgcgggtggagtgcagccagggcagccgaggaccccagcctgccggccttcaggtgtggctttcacgcgctgccgtccatgccccagcttcacctgcacgtcatctcccaggtga

SEQ ID NO: 5649 - DNA, 387 bp, Chlorella protothecoides
atggccaccgcggaggtcctgggccaggcggaggactcgatgcctcgaggtgtacacatcatccacagcctcctccaacctgccaccttgccccggcgtctgcaggtctacctcctgttccgggacgccagtggggcggtggcatgcatacaggaccagtgtgcccaccgggcctgccccctctcctccggcaagatcgtggacggctgcgcgcagtgcccctaccacggctggcagtatgatggggccggcggctgtgtctccatgccctccaccgtcttccagcaggtgaggccgcaggggtgtcggggaggctgtgcgtgcagccaggtactgcgcagggtacgcccgctgcttgtagtacctgctcctgttgaccgtgcctga

SEQ ID NO: 5650 - DNA, 495 bp, Chlorella protothecoides
atgcgcgtctggcacgtcgcacctgacgtcgtcaccttcaacagcctgctgcaggcggccggggccgggggctcactggcgggggtacgcgccacgctgggtgcgctgcgctccgccagcctggcgccgacgccgaccacctacgccgtgctgttcaccgcccttgccgcggccggtctgcgcgacgccgacgagctctgggccctgctgcgggcggcgggggagggcggactgcgccccacgccccacatggtctccgccttcctggcagcgctgcggcgcacggcgccgcgcgacgaccaggtggccgatgcggtggcgctggtggacgcgctgccatggcctggcgagaatgaggtcaccgcgctgctgagcctgctgcgtcaccgccccggcgctgcgccacggcacgtgccggccctctggcgcgccatccaggcggtgggtgtgctgggatgtgtgtgcatgccagagggagcagaggcgggggattga

SEQ ID NO: 5651 - DNA, 1443 bp, Chlorella protothecoides
atggaggtggtcctgggccccggcgacctgctcatcctgccccggggcaccatccacgaggggcgcagcctgcccgacacccactccctgcacatcaccctcagcgccaaccagggctgcagctgggcggccctgctgcaggcggcgctgccgggcgcgctgcaggaggcggcgcagcgcaccctcgccctgcgccgacccatgggtccggacttccgccgcctcggctgccacaccgccttggaatggtatgcctccgcctcgtactcccaccgcgccgcatcccacatccagggtgcggggccagggtgggtggcgtgccggggcgccgtgccagctcgaccacccgcgtggactgggccctgccctctgtcctgcccccccccccgcactccatctgtctgtcgtccccgacccggaaccccccgtggcggggtcgacaggcaggactgcagccccacctcacggcgtgcgcgccgcccccccttgtccctgccggttgcaggggagtgggagctgcccggcctcctggagcgccgcctgcgcaggatgttcaagcacttcaccgacgcggtgtgggcccacatccacattgcggccgaggagcagtgggaggggttcatggcggagcggctcccgcagtacccgccactccccagacccggttcgtggtggctgggccggggttcggacaggccgtgctttgggcaggccggagcatgctgccatcctcctgcgctgctgcgtcgaggagggaggcctgttgcccctgttgccgactgtgcaaggagtggcggcggtgttgcaggggccatgctccgcaccctggcaacagcaccgcacccaaccgagtgccgcacgcccaccctcccggccctcggggcggggaatccttgtttcgcgagcccgtcggcgaacgctctccataatactcccccatccacccccacccccccaacgcacacgaacacacgcacagggtcggtgcctcacacaaagctgcaccctggctccaggctgtcccccgtcgcccagccaggggccctgcgcttcacccgccccgaacccggggtcatcagggtcgtgcacggcctgttcaacgaccgcgccacgcatgcgcggggcgaggccgcccaggagggcgccggcaccgccggcaccgccctggactttgagctgcggcaggccggcgtgctggccaaggcgctgctgcgcaaagacccggaggcacacagcgtggccgagatccaagccatgtgcaaggggcacaccgagggaggggaggtgctgcaggtgctgcaggccctcgtggccgcgggcctgctgcgggtgctggaccccggcgcgcagtcgccgaagcccgggcggcagaagcgggcgaggcgggcggacgagggcgccgcgggcggccggcggcacggcacggggcgggcgggtgcctga

SEQ ID NO: 5652 - DNA, 1623 bp, Chlorella protothecoides
  modified_base (777)..(804): a, c, t, g, unknown or other
  modified_base (1048)..(1057): a, c, t, g, unknown or other
  modified_base (1280)..(1289): a, c, t, g, unknown or other
atgtccatcctgctgcccgtgggttgtagcggcttcgaggactggctgctggacaaggtcgacgtgggcgcgctcctggcctccatcgcccggggcggggagctggaccttatggccatctgccgcgcgccctccagccagcgcgatgcccccgcctcccgccgcggcagcctgctgggccgcgccacgccgcgcactccccagccgtcggccgaggtcacgtcggccgccacgcccgcccccgcgcccgccgatcgtggcctggagctgagcatccaggacgtgacgctggacctggacgagtcgcagctcaaggacctaacctacgccaccttcctggcggctgccggggaccaggcgtcacccgcgctgctgggcgtgctgcgcgcgcagctggaggtcagcgctgcgcgctccgacgagctgcgcgccgtggcggcactggacgcaggggccaagcaggagatcggcacgctgcacatgcacgcacgcctgctcaaggtggggaaggggggttgggatagtggggcagcaggacccccccccaatcccctcttcccttttaccgccacagacggtgcgcccctcctccttctccagcttcaagaactttgtgcgctggcggtgcggcacctcagccacgctgtggtgtgtgctgcgccaggcggcgacgcagcgctggcgcggcgccagcgacggctccggccgcgcggccctggcacggctgcgcggcgcgctgcgccgcgccgacgtcgccgacgccgacgagtacgacgnnnnnnnnnnnnnnnnnnnnnnnnnnnngcggtggtggaggcggccggcaacgtggccgcgtgctgcgacgcgggctgggactttggctggctcctctgcgcgagcatcgcggaccgccttctgcgcggcacctttgacgcactgtccgaggccgagtacgtggccgagagcgacgagctggtgggcctgctccgcgcccgcgtctggcccgcgctgggcatcacccccgagctccacctggcgctctacgcctgggtccacttccgccagnnnnnnnnnngcgacgagctggtgggcctgctccgcgcccacgtctggcctgcgctgggcatcacccccgagctccacctagcgctctacgcctgggtccacttccgccaattcgtgctgagcggggaggggcgcctgctggacagcgccaacaccatcgtcaaggccctgccggtgctgggtggggcgggggccggggaagcgagcggtggagatggggcggacaccgcatnnnnnnnnnncggtgctgggtggggcgggggccggggaagtgagcggtggagacggggcggacaccgcgcccaacggcgcgaccgggaacgccgtctcctcgactggcaacacgccgacttcctcccgccaggccacaccgcgggcaccggactccgccgcagccgcctcccaggtcctgggctgcctgtcggaggcggtgctgggcctgctgcgcgactaccatgggtcggtggggtcgcagacggccatggcgcgcctgctggccctgctccagggcgtggagcgcgcgctaggcacgctgggcggcctgccgtcgctcctgcgcggcgcggtgcgcagctc

SEQ ID NO: 5653 - DNA, 1062 bp, Chlorella protothecoides
  modified_base (375)..(384): a, c, t, g, unknown or other
atgttttatcccagatgcacgccttccatggactatcggggagcgtctgccacgccgagtccagccagatcgtgctcggcgggtggtgggacggaaggaaccttgatcgccaatgccggaacgccaggcgctcgacccacagctgtaaatgctccggatgtgtttgcaaacaggagacggtgcatgcgcccttcacatcagccaaacgcggtcagggagcgggatcgggacagatgtccttcgcgcgcccccgacacatgcatgccgacttgttgtctccagtggaggtccactgccctccatttccctcgtgtccatctgccctaccctcccccaagtatctatgtcacgttggttctttcagtcaggccgcgnnnnnnnnnngcacatgcatgccgacttgttgtcttcagtggaggtccaccatttccctcgtgcccatctgccctgccctcccccaagtatctgtgtcacgttggttctttcagtcaggccgcgctgtgcattgcacacatgggattatcagaggatccaccgcggcgatcactccttcttgtccttcacctccgcatcttgaacgttctcggcgccggcggcgcccgcctgcccggacagggaggacccgatcttcatggaggcggtctgcagcgcggtcaccttctccttgaggtccgcggaagaggcggactcaagcgccccccgcaggtcggcggcggccgcctcgatctcgtccaccaccgcctgcggcaggcggtccttgtactccgccaagctcttgtcggcggagtacagtgccgcgtcagcgtcgttcctcgcatcgatctgggccttgcgctccgcgtcctcgcttgcaaagcgctccgcgtccgacaccatgctctggatctgggactcggacagcccgccactggactggatggtgatggactgctccttgcccgtggacttgtccttggcggccacatgcacgatgccgttggcgtcgatgtcaaaggtcacctcgatctggggcacgccgcgcggggagggcgggatgcccaccaggtcgaactgggagtgtga

SEQ ID NO: 5654 - DNA, 603 bp, Chlorella protothecoides
atggtcctctctgccaccttcacacaaccacaggtgggcatcaaggtcttccagggcgagcgcgagatggccggcgacaacaacatgctggggcagttcgacctggtgggcatcccgccctccccgcgcggcgtgccccagatcgaggtgacctttgacatcgacgccaacggcatcgtgcatgtggccgccaaggacaagtccacgggcaaggagcagtccatcaccatccagtccagtggcgggctgtccgagtcccagatccagagcatggtgtcggacgcggagcgctttgcaagcgaggacgcggagcgcaaggcccagatcgatgcgaggaacgacgctgacgcggcactgtactccgccgacaagagcttggcggagtacaaggaccgcctgccgcaggcggtggtggacgagatcgaggcggccgccgccgacctgcggggggcgcttgagtccgcctcttccgcggacctcaaggagaaggtgaccgcgctgcagaccgcctccatgaagatcgggtcctccctgtccgggcaggcgggcgccgccggcgccgagaacgttcaagatgcggaggtgaaggacaagaaggagtga

SEQ ID NO: 5655 - DNA, 393 bp, Chlorella protothecoides
atggcgggcacattccttttcccatgctcgtatgagcaggctgggttggggggggtgagcctgaatgacacacacctcccccgcgcacctcccctcccatgcccctcccaccatcggctgacgctctttcctcccaccccaccaccatgcgctgcacagggcggcgtgctgcgtggcgacgttaaggacatcctgctgctggacgtcacccccctgtccttgggcatcgagacactgggtggcgtcatgaccaagctgatcacgcgcaacaccaccatccccaccaagaagagccaggtgttctccaccgctgccgacaaccagacgcaggcacagggtctggctgggaggcagggcgggggaggggcgggggcaggtgcagcacgatcgtga

SEQ ID NO: 5656 - DNA, 360 bp, Chlorella protothecoides
atgctgcccactggagcgcaacatgctgcacctccggctccgccgcctggcctccatgggaaaacacttacttccagtactgatgatcacggcaatgatcaggccgtagatgcccagcacacccgccatgaccacggggataatagacttgatgaccaggtcaggccggagcactcccatggaggcgatgcccaccccggccttggcggttccgtaggccgcaccaaagcctgtggcatgggaagacggaaaagggatgagggtggccccagtcaacacggacgagcatcgagcacgggcaccgtcacgaacccgatcgactcacaggagaaggccagggctgaggcagcgcccaggtag

SEQ ID NO: 5657 - DNA, 1320 bp, Chlorella protothecoides
  modified_base (155)..(164): a, c, t, g, unknown or other
  modified_base (229)..(238): a, c, t, g, unknown or other
  modified_base (734)..(743): a, c, t, g, unknown or other
atgctaaaatttactccattcgtggctggagtttcgccgagcctggtaccgaggcaagccgctggagctgttggcccgtgggtggagctgggcggggactggctatggccagagagatatttgggagcgctcaaccgctcccgctggtcggtgcnnnnnnnnnntccattcgtggctggagtttcgccgagcctagtaccgaggcaagccgcagggagctgttggcctnnnnnnnnnnctgcagacgcaactcactcctgtcggtggcagcgctgggacgagacagggatgataagaaaccaagtgggtggagatggaatgtgcggtagtatgagcatggccatcaccctcatgccactcacgggtgagggaacctgtagtcaactgtctctggcaaaaccaatcctcgcaaacctctgtgtacgtcctagtcattccaagcttagtacatgcccaacccccattgctgctgcagaggactctgccggcaagaaaccgcagggaaactggcggcagttctcccccaagtcagagaagcctggacgtcagctgctggacaccctggagctcgtgtacgctactacacaatggccaagcgacgacaccatccagagcttctgggtgctccacaggatgccgcgtcaccaggtgcgacattcttatggagtgaagatgatcttagcagtcagaaagtgtcgtgaacattgcttgtcagacattaaagatacggaaannnnnnnnnnatggagtgaagatgatcttagcagtcagaaggccgaggatgaccagacactgccgaggatgaccagacactggacgtccaatatcccagaacacccttgtattgttagcctcgagcagcttcccaaagtggtgcttgctcaggcagtgtcccaggaaggaccattggcagccccgcctcctcccacgctcttggctgatattcatttgagaatcttcccttttccctctcctccctgcatcccaggtcgtcgagtggtttgctcatcgccggcgccaggagcggggaattctagggtgtgggacgcagcgcccctgcaagagggaaaacttggggctggggacgcgccaatcgctgacatggcggcacgttggtcccatgggggtgggcgttcaaggtggaccaaagagcggagagagggggctgcttctggtgaggaggtgcatgctgtacacggcgcaggccaccgcacttttaagttcaggcgaccaatggagtctgaacctcttgagatatctcatcatgcatcatcacatgcgggaggcggggccgccagacacgctggcggagaactctga

SEQ ID NO: 5658 - DNA, 615 bp, Chlorella protothecoides
atggggcgccccgcttccggccccgagcccctgcccagcaacgagtcccacgcccagattgtgaggagctgccgcgaggaggccgccaagttcgtggaccccaccaccctgtacagcctgcagctggcgctggcggttgccgaggagcgctttgctgacgccgccaagtgcgcttggactggttttctaatggaatgcggggctgggggccgcgcgggggggccggtccggtgtgaggaggggccccgaggagcccggtttgaggacccacggttttcagccacacgatcgatgtgccagcaacgccgggcccagcacatctgcctggctctgtgctggcctgcattcccccctcccccctccccaaccaaaccctcccctccgttggcgctttccaggctgcagggcgtcatcgcggagggctatgcgcagcaccccggggcgcgcgccctggtggccatgcaggcagcgctgcaggacgggcggttcgaggaggctgccaggcaccgcgatgagctgcgccgggtgcggctgatcgagttccaggcctcggccgtgggggtggacccctgggagcagcgcaatcagcgccgcaccgagaccgacgcgctgtga

SEQ ID NO: 5659 - DNA, 564 bp, Chlorella protothecoides
atgtgcgtggtgagggggatcctgggggtgcagcgagcccggaggctcggcagagcggcggcggcacatcacgagcaccacccccgcagcctgagccacctggccgccgccgcagcgccccccggctcccaggcccggcctcccccgtcaactgggagcggggctcctcaggccccacctgccgctgagcacgacgcggaggcctcctccagccaggccgccggcgggggccccgcggagtccagcacccacccggcccggtcgcaggccaggagcgcgacggcgacgagccgcctcgcctccggcgctgccgccggcggggccgcgcccagcgcggtgtccagccccctcatcccctcgggcaaggtgctgaacgaggccactgggaacctgattggcgtgggcaaggccacctactgcaagctgctggcggaggggtacatcttggacgccgaccgcggcaccatcacgcctccccccaaggcacgcggtgggcggggcgcggcgcgtggcagcgggcccggctcggggacgccctcccggagcagcaggcgtgcctcgtga

SEQ ID NO: 5660 - DNA, 1920 bp, Chlorella protothecoides
atggtgatcaacgccctgaactccggcgccagcgtgtacatgcccgactttgaggactccaacagccccacctgggacaacatgatcagcgggcaggtgaacctgcgtgacgccgttcgccgcaccatctccatggccgccgccggcaagacctaccgcctcaagcccgaggtggccaccatgatcgtccgcccccgcggctggcacctgtgggagaagcacgtgagcgtggacggcacacccgtccccggcggcgtgttcgactttgcgctcttcttcttccacaacgcgcgcgcgctgatcgagcgcgggtccgggccctacttctacctgcccaagatgcagagccacctggaggcgcggctgtggaacgaggtgttcaccgaggcgcagctgtactgcggcgtgaacctgcgcgacgccgtgcgccgcaccatcacccacaccgacccccgctccggcaagcactatgcactcaaggaggaggtggcggtgctcaccgtgcgaccgcgcggctggcacctgtgggagcaccacgtcatggtggacggcgcccctgtccccggcgccctctttgatttcggcctctacttcttccacaacgcgcaccgcctgctggagaacgggtcgggcccctacttctacctgcccaagatggagcactacctggagtgccggctgtggaacgaggtcttcgtcaccgcgcaggcggcgctgggcatcccgcgcggcaccatcaaggccacctgcctgatcgagacgctgcccgccgcattccagatggacgagttcctgtacgagctccgcgagcactcggcaggtgggattagagtcgctctggactcagatcctggccgagtgtcctctcaccccgtggactccaagccctcacctcaccccacccaccccctcctcctcccagggctgaactgcgggcggtgggactacatgttctccttcatcaagacgatgcgcaacgacccctcccgcgtcatgcccaaccgctccatgctgaccatggagatgcccttcatgcgggcctacaccctgctggtcatcaagacctgtcaccggcgcggcgcctttgccatcggcggcatgtcggcggccatccccatcaaggacgaccccgcgcgcaacgcggcggtcatggacaaggtccgcgccgacaagctgcgcgagcccttcctccgcgcctactcccagctggtgatcaagacctgccaccgccggcgcgtgcacgccatcggcggcatgtcggccttcatccccatcaaggccgacgccgcgcgcaacgcggcggtcatggaaaaggtccgcgccgacaagctgcgcgaggtgtgcgacgggcacgacggctcctgggtggcgcacccgggcctcatccccatcgcgcgtgaggtctttgacgcgcacatgccggggcccaaccagatccaccgccagcgggaggacgtggaggtgaccgcggcggagctgctggccgtcccggagggtccgcgcacgcgcgccgagatgcgtcagaatgtggcggtgaccatcggctaccttgcggcctggctgggcggcaacggctgcgtcccgttgcacaacctgatggaggacgccgccacggcggagatcagccgcgcccaggtctggcagtggctgcgtcatggcgtggcgctggacgacggcgcgcccctcaccgcaaccaccgtgaagctggtcatcctggaggagatggaggccctgcgccgcgatctgggcgacgccgccttctccgcgggggcctacctggacgccgccttcctcttcaagctcatggccctgtccagcgagctgccagacttcctcaccctgccggcctacgatgtgagcagatgggaagaaaggcgtggaggaggggaagtggttgggaggcgggaggcatgtctttga

SEQ ID NO: 5661 - DNA, 408 bp, Chlorella protothecoides
atgggcatcgagccgcagagtgtggaggcgctgcacgcctgggccaagatggaggcgggggagggcgacctgaacgccgcgcggcggctgtacgcgcagggcctggccgccgcccccaccaactgcaacgtgctggccgacctggcgctgctggagatcaaggagggggacctggcggccgcgcagaacctgctggacactgccatgcaggcagggcctcggcatccccgcacgctggcggtgtgcgcgcgcctgcgcgccgcgcagggcagccggcgggaggccgccgcgctgagcatgcaggcgcagcagctggggcgcgcccggcgcggccagctcaacgccatccgccaccgcaactggcccgatgcgggcagggggaggggcggcgagcgggaggaggggtga

SEQ ID NO: 5662 - DNA, 2271 bp, Chlorella protothecoides
  modified_base (265)..(274): a, c, t, g, unknown or other
  modified_base (801)..(810): a, c, t, g, unknown or other
gaccccccccctgcccccccttcccgcccctccgacgcaccgctccccccctgcatcaccgcgctgctggacccggcctgcgatcccgccctgcccccgcccgggtcgctggcgctgacccctgcccacaaccgcgagctggacaagctggtggcgcagctggggcggggccgggccacctggcgccgcgcgctggcgttgctggactggctgcgggcaggcgggcatgccccggacgaccgcctgtgcaccacgctcatccgcnnnnnnnnnnactggcgctgctggactggctgcgggcgggcgggcatgcgccagacgaccgcctgtgcaccacgctcatccgcgtggccgcgcagcacggcgaggcgggcgaggcgctggccatctacgactggatgcggcggccacggcgcgagggcggcgccggcctggccgccacggtgtacacctacaccgccgcggcgcgcgccgcgctggccggcggcatgctgcaccgcgctctggcggtgtgggacgacgcggcggccgacccggggtgtgcaccggattgccgcctggccaccacgctgatcgaggtctgcgcccgcactggcgacgcggaccgcgcgttgggcgtctacgcgcgcatgctggccgcgccgcgcggctcgcgcctggagcccagcgtgcacgccttcaccgccaccatgcgcgcggttgcggagggcggccgtgcaggcgaggcgctggccatctgggccgatatgcagcgcctgggctgcaagcccacgggtgagatgtcgtggctcccacatcagnnnnnnnnnnggattaatggtggtgatgtgtgtctgtgtgagtgtgtgtgtgtgtgcgcttggggtgggtttgtgggtggggaggggctccccataggtggctctggcgcgtctgcttcctacaacagatgtcgtggctcccacatcagtcatacaagttggtttcagagggagtcgtggaggctggtgatgctggaccctggttgcgtttatcattccccccggtctcaccccccaccgccctccaatcacacaaacgaaggccacgcgtacgccgccgtcatctccgcctgcgcggcggggggcgagtgggagcgcgcggtgggcctgtttgacgagatgctggccgcccgcatccgccccgacgtcgtgtcctgcaccgccctggttgcggcgctgggcgcggcggggcagccgcgccgcgcggagggcgtggtgcgctggatggcgcgcgccgaggtgcggcccaatgtgcgcacctacaccgcgctgctggctgcccacgccggcgtcggcgactgggaccgcgcgctgggcctgctgcgcgagttgcgcgccgggcgccacggcccggggctggagcccaatgcctacacctactccgcactgctcaaggcggcgggggagcaaggggaggtgggcctggcggagaccctgttcgaggggttggagctggaggcgaggctggacgccgcgaagcaggcggcgctgggcgcgctgcgccctgatgaggggacctgggacgaggggctggaggacgagggcctgttcgaggccctggagaccgcggcggcgatggggtctacgccaacggcgaaagccagcgctgtgatcgctggcccgcttgagtccgcttccgcctggcgatcgcctggcgtgcacgatgcactcaccgttccagagtccagctcttcagacccagacctcgacgcctcgcacgcggccgcactggcggtggctgcggtggcggtggcgcggcccgcggcgtcgccgaccgcttgcgccgacccccagctggagcgcctgctgtgcacgcagctggggccggccctggggggtgttgacggcgccgcctcctccacgccccgctcggggccccgggggccaggagcgggcgcggaggaggcctcggcgcgaggggcgcggggagcgggcgatcatgcagtgcccacaacagcaaactgcaagcctttgcttgctgtctcgggggtgcccatcagcagcagcccgtttccgtcggcagcaacaccatccgacggcccgcagccgtccctgcgcctggcggcggccgctgcggccgcgtggggcgtggcttcgctggatgcgcgcggcgcggcctggggcgccggcgacgactacggctccatcgcggatggagggactccagccctcgcagggaccgccgccgcctcgggagggcgcgatgtgccctccgcgccccacggcagcccggccagcgtgctgcccgcct

SEQ ID NO: 5663 - DNA, 1446 bp, Chlorella protothecoides
atggcgactgtgcgggactcgagggcgctcgtgcagtcagtgtcgggagtcgtcaggacgacacatgcaccgctccccgggatccgagcctctcaggaacactcccaggaacgattaaaatgctgcaacacggtattacagacaagagcgaatgaacagctgcagttcgccccccctttcagtcggacctcgtcgtggcccgcaggatttgaaggcccaggagtgcccccgagaaagcatggtcgcattgccccatcggccagctccggcatggcagcggctttacgtcgaggggcccactattgctgcaatctcgcctgggacagagtccacatcctccgatcatcagcgatggcatcgggcctggaagcggctgctgccaagcttttaaacttcgcagagccgctcgatgttgcactgctcgatgccactgttgctgccttctacggcgcctccaccaatgatgagcgcggaagtgcggaagccatcctgcgcaagttccaggagcagcccgacgcctggacacgggtggatgccatcctggagacatcgaagaaccagcagtcgaaattctttgggctccaggtgacctgcagcggaatgcacgggcgtggatgcggcttgcatggcctgcactcaggacatgcagccacccaccgcatccctcatttcctctgcctgcccgacacaggtgctggagtcagtgatcaagacgcggtggggggcgctgcccgacgagcagcgcgaggttctcaagacctacatcagcaacctcataatcaagctgtccacagacgagttgccaaaccacagacccacctggatacacccccatccacccacccacccacccaaccacaccatgcaggttgccttccggcgcgagcgcgtcttcctgaacaagctcaacctggtgctggtggacatcctcaagcaggtccccactcgccacactccttcaatgcttccccgcaaacaacacaccaagcgcaggactggccccacaagtggccctccttcatccccgacatcgtgggcgcgtcccacacaaatgctggcctgtgcgagaactccatggccatcctgcgcctgctgtcagaggaggtgttcgacttctctgactccctcaccgcggccaagacgcgcgagctcaagtccagcttcaacgaccagtttgcgcaggtgcatgagctctgcctggctgtgctcaacggcaacgcggcgcgggacctggtccgcgccacgctggccacgctgcatgccttcctgtcctgggtgccgctgggctacatcttcgagagcaacgtggtggacgtcctgctccgcctcctcccccagcctgcgctgcggaacctcgcgctgcagtgcctgacggaggtccgaggctatttgtggttgatgggctcgggagggtgtggagagaaggaggggctagggggaacatga

SEQ ID NO: 5664 - DNA, 186 bp, Chlorella protothecoides
atggccctggaggggagcgaggagctgcaggccgacctgctggcggcgctggactacctggtgggcatctcctacgtggacgacgacgaggtgttcaagacgtgcctggactactggaactactttgtgccggaggtctactcctttgtctgcaccaccgctgggaacgagaccgcccaggtttga

SEQ ID NO: 5665 - DNA, 690 bp, Chlorella protothecoides
atggcctcgcacacggtgccggccgtcggggagttcctgccccgggatgcgctggcatgggtggaggagatcatcagcaccgcctggaccaccttcaagcccgggggcaggctgcacccacagaccttcatcgagagcaaggggcacctggtggtggaggccatactgttggcgctcatctcctacctcctgttccagggaaggcagaaaccgcagcgccggaaggaacgacctttgtcaaaggaggtgggcacacggcctggacgaggctgctgcgattctgggtccctccagtggtgttccctggagacacagatcaagacgtgttctccatgccccccacttcccacacaggaggtggacgagctgtgcgaggagtggcagccggagccgctggtggggaagctgacggcggcgcaggctgcccgcccgccccacgtgatcacctccgtctctggctacagcgtggaggtggacggcaagcccgccacctcctttgccagcaccgacttcctcggcttctccaacctggagcagggcaggcaggtgtgcgaggaggccatccacaagtacggcgttggggcctgtggccctcgcggcttctatggcaccatggatgtgcacctggagctggaggtgcgctttgtcagggggatgatgggcagaagctgtgggacggggtgcctttga

SEQ ID NO: 5666 - DNA, 318 bp, Chlorella protothecoides
atgggcgccgaggaggccatcctctactcctacgacatcgccaccatctcctccatcatccctgcctttgctaatgccaaggacctcatcgtctgcgacgaggtgggacctgggtggcgcagcgtccttgacgatgggcattcggacctgcggtgtcctgccgagcacgctggctggggctcaaaagctcctcggcggcctgcgccaacccctcccctccttcccctcccgcaccgatgcaccccaggcggtaaactactccatccagacgggctgctccctgtcccgagccaggctcttgaccttcaagcacagtga

SEQ ID NO: 5667 - DNA, 822 bp, Chlorella protothecoides
  modified_base (754)..(763): a, c, t, g, unknown or other
atgcagcctccacccgtcgggtccgggccgggtcagcagggttacccgcccgagggcctgggcttccccccctcctccgaccccggccacatgcagcagctggtggacctgctggggtccaaggtcccccccaagtcgaccgcggtggtggagtgccccaagaccatggtggggcgcgtgattggcaagggcggggagaccatcaaggcgctgcagcagtatacgggcgccatgatccagatcgaccagtcctcggaccccacgcgcgtgaccatcgcgggcctgccccaggcgctgcagctggcggtgtccatggtcaacgacatcgtgcgtggcacctttaagggcttcgccatgctgcgccagatcgcgctggccaacgcctcctcgcccggcatggccacctacggtcagcagcacgcgcccgtgtacgtgcagggctatggcttcgtgcccccctcccaggcctacggcggtggggaggaccccctggccggaatgttcaggacctcgcccgcggggcccatcacgccgcccatctcgcccatgcgcggcgcgggggagggcagcttctcccccaacctggccgccatgctgctgggcggcggccaggtcggcgggcagcccggctacccgggcatggggccgggcgcaatgagccagggcaacatgtccccccagcaccagcaccaccaccaggacaacggtgagaaagtaatgcatcttgcagggcgggaaggtccatctggttttnnnnnnnnnnaggcggcagccaggtcggcgggcagcccggcttcccgggcatgggcccgagcgccatga

SEQ ID NO: 5668 - DNA, 1248 bp, Chlorella protothecoides
  modified_base (402)..(411): a, c, t, g, unknown or other
atgtgggctccctctgggggaacgatcaccgtggcaggccctttcctgaagctgccaaaggagcgcttgcctgcacggtggaaattgccggatgagggtgtggggggtgacgatgtgcagcaggagattgactgtgatctccgaccctccacctgccgagcagcagggcctctcagccacaacagcctgccctcctggatccaccctccatccccgttacctgcttggatgtccacctcggatctgccagaggcagaggtggtcatcgagggggccctcgcatccggttccttcgagaatgggttggtcatccagctcgtgggtccagcctgtgggaacagagccaatggggaatgggttcatgagggtgtgagggtgattctcgcaaggcccatgcatggnnnnnnnnnnatgatgaggcagacgacaggtgtggagctcaaggctcgcctgccctcgcacgatgaaagggtgctcccccaactcatttcaccatgtcctcccagcacaaatggtaccgccccacccgctcgcaggtactacgacggctacttggcccacctcatgctcttcgaccatgcggtgcgagaggagcaggtggcgcagctgtacaacgcctacgccatgtccgccccgcctggcgcctcgcctggcagcagcgtggtgaccacggccggcgagccgtccctgtttccgccgcccgcgccgccggtgcaggacacgtcgagcggcggcctgtccgcgggcgagatcgccggcatcgtcatcggctcgcttgcgggggccgccctgctggcgggggccgtcgcctttgccctcaagtcgcggaagcggcgggccgacaagttcgagcggtatgcggaggaccccgctggactgccgcccccgggcctgccgccctccctcatgccagcggtgctccccggggcgtatgctgcggggacagggggcaggcacatggaggcggagatgtccagctcggcctcctccatgaaatacgacaaggagggcgagggtggaacacccgacagccagaacggggggaccaaggtgagcctgctgctggggggtgtatatcctccttgctttgaatacaaggccaaccttgatgcatgcagcagactgatacatgtgtgcaggcatgttcgtgccccaaccatgcatgggccttgcgagaatcaccctcgcaccctcatgaacccattccccattggctgtccccacaggctggacccacgggctggatga

SEQ ID NO: 5669 - DNA, 201 bp, Chlorella protothecoides
atgtgcctcaccaacgttgtcaccttcatgttcaacagggcggagctggggctagggaacgagtacttccagacctcggcagggcagcgggaccggctgctcaccgccaccgacaggctgggcaagaccagcgaccgcatccaggccgggcggcagcagctgctggagacagagggaaataggggaggggctcatggttga

SEQ ID NO: 5670 - DNA, 327 bp, Chlorella protothecoides
atgccccagtccaagacggcagccgacagccctgatagtttttggcctgaatctcagcttcaacagacgtcaaaaccctccaatcccgcgacccccaaccatgctcaggagctgggtatctcggtgctgggggacctgcagcggcagcgggagaccatcctgcactcccgcgacgcgctggcaggggtggacgaggggatcagccggtcgcgggccatcctgtccagcatgtcgcgccgcatcatgcagaacaagattatcatgtggggcatcgtggccctactcctgggagccatcgggctcatcgtgtgggccaagctgtcctga

SEQ ID NO: 5671 - DNA, 537 bp, Chlorella protothecoides
atgatctttggcgccgtcagctgtgccaactggggtgactacatctatgagtatgagcctggtttctaccctgatcccccctttgttggccgcggagggctcaagcccgagcaccggctgaagacgctggatgactacagagaacgctatgcgtgctaccgcaccgacccagacctccaggaactgcaccgcaaagtgcccatgattgcagtctggtgggtagtcaaggtggtccatgtattgtcgagggtgatgagagacggcctgcactgtgctgagaggggtctgcaagcgaccttcaatcagcagtctgcctcttgcaacagcattcacatcacatgcgagtggcactgcctctctccagaagtggtcttattcttgtgcctgcaagcacctctgactcacctctccgatcaccacagggacgaccatgagatcgctgactcgacatggcagcatgggtcagaggacttcaagggctccaaggaggagtggggtgtgcagaagctccaggcactcaaggtgggtgtcttttga

SEQ ID NO: 5672 - DNA, 549 bp, Chlorella protothecoides
atgaccacgaggtcccagacggatatctccgccattttgccccattggtacccagcgaaatggagggtcccacgagcctcccacctccgatgcgcagatgacaaactgtgccttcccagtgcaagaggaggtcatgcttttcgcttgactcccagagcgcaccccagcccagtcctggggtctgtgggggaaggaatcgagggccccatccaggtggtgtacctctccatcctcctttccttcctcgtggtgggagcctacctggtagtgcggcaggtgctggcacgcagggagttggaagaggctgccaaggtgtttggagatcgcgtgcgatccggtgaaggcagtggcgaggattacttggagctgggcgtcattctgctgcggaaaaagctgtacacgcagtcgattaagaacctggagaaggccaagaaagcgtggaaggggccccaagaagagttggcaaagggctttgcccacttcaacctggagcagtggagcaaggctgcagctgcctacaagcaagccgttgagctccaggtgctttga

SEQ ID NO: 5673 - DNA, 804 bp, Chlorella protothecoides
atgtccctgttggggaggcgcgcatcatcaatccatttcaaccctgctctcacctttgtctctcttgccaccatctccaaccttgcctcaggggagaagcaggtggagaacatccgcaaggtggtggcggagtccatcgcggaggaccgtccctggcagatcctgttgagccagaccatcatgagccagatcaaggcgccgctgctccaggagacgctgcacctgcagcccaagctcctgcgcaagctgtcgggcggggcgctgaacctggccatggacgagaagaaggcgggaaaggagggcgccgagcaggcgcgcatgtacgtcggcctgggaaagtacggtgttcccatgaaccccgacgcctgggacggcttccaggccgagcggcgcaaggcgtgcgtgtgcctggctggtgcatcacgtttcttgggcacgtctcggggcgtgcccggagccccgcaggaggcctttgcgtggatgggcctggctggtgcatcagctttcttgggcacgtcttggggcgggcccggagccccgcacgaggcatttgtgattgaggccctgaaccaggagggcgccaaccccgtcatcattgccggggacagccacaatgcttgggcgcacaacctggtggacgaggaagggcggcggctgggcgtggagtttgacgggcctgccgtcacctgcatcggcgcgtttgaggacatctacagccgcttcaaggccaaggttggtgcacaatgggcacacatccacacggctttgcttttgaccccccgcagaccttgctcgccgtcgtag

SEQ ID NO: 5674 - DNA, 333 bp, Chlorella protothecoides
atgacgtggcgccgccatgctccagcccctccatcccctggctgcacacaggcatacggcgagtggataccggtgaggggtttcgatcatgacaacatcaccctggactttgcgcatcgcagcttccactttggcaaccttgcgagcctggtgcgcaggaggggcaagggtgtgccatgcaggggtgatgggatgctggccgccatccctgcggcacgggaggagcgtgaccatcgagaaccgggccagtgcccggtccgagccggtggacgtcgcagagaccagcttctacaaggagacggcgcagaagaagctcgaggactggaacgatga

SEQ ID NO: 5675 - DNA, 261 bp, Chlorella protothecoides
atgacgggagaacgcgcaactggaatattcagcgtcgtcacattctcactgagaagaatccctcttccctccaaatctgtgcagcctcagtatgttacggcatggaacaacctgggggatgcctatgagaaggccaaggagtggcggcaggcattggacgcctacaaccaggccttggtggccgagccagggaacagcgtggcccaggggcgcgcgcagtattgccgaggaaaggtggaacgcatgcagctggggcagtag

SEQ ID NO: 5676 - DNA, 234 bp, Chlorella protothecoides
atgatattcaaccctccaggcgtggcgccccgtgccaagatgaaccagcagcgatcgcggcgattcaaggctgccaaggaagccgctgccgctgccaagaaggccgagaaggccgccgcgaagacctctgacgtcgcagaggacagcaagccgcccgtttttgactccaactgcatcacgcccggcacacgtaaaggggacaggggagcgggttgggggagggtccaggcatga

SEQ ID NO: 5677 - DNA, 921 bp, Chlorella protothecoides
  modified_base (481)..(490): a, c, t, g, unknown or other
atgccctctaatttttctcgcacccgggcgacattctgccagtcgaccccacctgttggaattttcctggttttccaaggtacagcggcggagccctctgtactttgccagccttccagtcgggatttttttggtgctgtcttcatgtatcctctctgtaatgtaacatccccgaggaagcaggaaggtaatgtgaagagcagtacaactacgaggcctgcccattgcaagacatcccgctggctcggatcacagactcagacaaccagagctgtccatcgtgggaaggaacgcccagcaggtttgaggggccgcagggcaaaaccttccctcccaacggccgcgggatcggcaggccaccggccatcacttcggtgcaccacggcattcgactgcacaggattccatcggaatgggtgcgttcgggggaaccggcgtacgcatcgctgtttggactggcaggtgggaggcagtcctgccnnnnnnnnnncggaatgggtgcgttcgggggaaccggcgtgcgcatcgctgttcggactggcaggtgggaggcattcctgcacccctgcccccaccctcccaccttcacatcctgcaggcatccccaagttctaccgctggctcagcgagcggtaccccttgataaaccagccaggtggtgccacggtggtccccatcatcgacaacctttaccttgacatgaacggcatcattcacaactgcacgcatgggaacaacccggacgtcagactgacagaggacgaaatgatcctgcgcatcttcacgtaccttgacaagattttccacatcgtcaaaccccagaagctgctgttcatggctatcgatggtgaggtgtcgggagggaaagttttcgagggagggaggttgttccccaaggggtccttgccctgcaaccactga

SEQ ID NO: 5678 - DNA, 945 bp, Chlorella protothecoides
  modified_base (541)..(550): a, c, t, g, unknown or other
atgggctggagaattcgatcacactcgcgcagggagtccaggctcactgtgtgccctgggcgctctgatcgcgcctgttttctgttccctctttctccgtcctccccaccatctattcgggactccaccttcctgtacggaactcacaggagcaaacaggtgcagtttgtcggccagtacgacccccggggagtaacgtgccgactggaggtggggggccccgctgatctggatcgcatgctgatcaagagcgagaacgccaccatctccatccctgagctggagtttgagattctggggtcaaacactccctgtctgggcttgacgagaggggatgtgtcgtcggtgcgggacgtgctgctcacgtcaatcaccaatctccagatgaatcagcacgagcgtgcaccggagaccgcagaggccatcgagtctttcttgacagtgcgtggggctgtcattggggttttgccaccggcgccttgccttgcagtgggtgggaatggatgtacatggggccctcaactgaccagcaacaagcaannnnnnnnnntgggttttgccaccggcgccttgtcttgcagtgggtgggaatggatgtatgtggggccctcaactgaccagcaacaagcaagagaggggtcgacggcctggagtgactcatcgacagactgcaaggatatggcatatcgtgcaaggtacctccctcccctctctgtgcaggagttgcaaaagctgactgaagggcagcagccgttcaccttggtgatggacgacccctctggcaacagctacatcgagacaactggggatggcgacgccgccctcactgtcgaacagtacgaaaggagcgtgcgtcaggcccttgcgataggcctgcctgtgcaggcggagctggaggaaaacacgctggagagtgtggcggaggaggacgagctggacgattga

SEQ ID NO: 5679 - DNA, 189 bp, Chlorella protothecoides
atggtacacaggctgggtaatgtgagcgagaagacgctggagcgcattgcccgcgccagcagcatcctgctccgttgcgcggccgtggcaaagcggtgctgggccctgctgcgcagccaagcggcgctcgtcttcgccatcgcgctcctcctcctcgccattttcctgcgatggaggggctgggcgtga

SEQ ID NO: 5680 - DNA, 375 bp, Chlorella protothecoides
atgcccttcccattcagcgtcgagcgggtcgtggacgactttgtgctcttctgcatgctgatcgggaacgatttcctgccccccctgcccaccgtcgacatagcagaaggctccctggaaaccatgtttgacctgtacaaggagctcctgcctgagttgggtgggtacctgacccatgccgggaagctgcacaggggcaggctggaggtgttcctgcacaagctcgccaacctggaggccaaggtcctgcaggagcgcgcacttgtgagtagtgaggccgcgctgcctggggcaagcgaggtggaaggggaggcccatgccagtcgtagttgtgcctacgtgggaggagcctctttacactggagtcgcccttga

SEQ ID NO: 5681 - DNA, 621 bp, Chlorella protothecoides
atgccacgctttgccaatgtctggaggcggggcgcctccgccccgaggtatcgcgctctgcgccaggacacaagtgcccctggaccgaaattagagcccttcgtggtgcaggtgagctgggacgttggcgagaacagcgcagcccagcgtgcggccaccttccagcggcagggtaccctggcctgcggggatggcctcctggtgcttcccctgcccaaggaccgcctggaggatgcagccaccctgctgaacgacagctttgccgagtccctgggctacatatcgatgtacaggtgggcttggggagtgcgagcggggggtggagactgcaacgagcatataaggcagtacctgcgccagcacctcccgctgctgcccaagacggtcatcctggcagcctttagggtgggtgatgagcagggcacggagcttgctgtggagggcccaggagatgccgagggggaggaggtacatctcgaccatgaacccgagcgcgagctcgtcggcatcgtggagctgtccttttcggcctccactcggaccaaagcactaacgctgaaccctcccccggtaagtggaggggcggtggtgcagggtgcttgctggcgggtcttgagttga

SEQ ID NO: 5682 - DNA, 1227 bp, Chlorella protothecoides
atgccggaagcacagagcctcgacgacaagaagcggaagaaggggcccggcgagactcccgcctgggcctcggagcgcgtggcggaccggcggcgggaggagcgcgccgccggtcccaatgcccccccggccggggacgaagtgcccgagctcggcctgggccacggcggccgtttcgcggcgctggcccctgggcgtggcctggagctgctggctgcggtggaggggctggaggaggaggaggtggaggaggaggtgatcctggcccccctccccgcgccgcccgcggcggacgcggagcccgcgccggagcccgcccctggcgccggggaggcggccatcccccaccccaccccgcggccccctgccaagcccacgatgatgagtcaggaagcgcgggacctgttcctgaagagcgccagcgcggaggaggccgcgctggcgtggaaggagcggctctatgtcaccaagctgggcgtgggcacggaccccgcggcgcggtgggcggtggtggatgcttacatgcacggcctgcactgggtgctggagtactactaccgcggcgtggcctcctggaattggtactacccttaccactacgcacccatggcctccgatctggagcctgtgtgcctggccgagccagggcaagcaagcggtgctccgacgttctcagccctgccgaacactcgcaaggacgccccccgcacgcaggtggatctggagcaggtgcgcatcagcttcacccacggcgagccgttcctaccctacgaacagctgctggcggtgcagccggcagcttcctgccagctgctccccgccccctaccaggtcgacatgtgttgggaggcagggcaggggttgggtggacgggaggaccgcgtgcttccaccgcttgtgggacagaggcgtcaatcctctggctatgcctgcgcggggttgcccttactctgctgtcagagaccaggcaggcgggcagggatggctcctctgggcactcgggcacatggccacgcaactcagctacctcccccactcacattgcagagattcatgctggacccagactcgcccatcaacttcttctaccccaaagattttgtggtggacctagagggcaagagtgagcggggctcgggcagagagtgcagggagtcgagggaagggagtgggggcgcaggtgtgccgcgtcctaggctgccggtaggagggccactggatgagtga

SEQ ID NO: 5683 - DNA, 189 bp, Chlorella protothecoides
atggccgtcagccagaccatgcggaggcagggcatcggcagcttcctcctgtcttcggcggaggagctggcccagacaatgggccacacccatgtctacctccattccaggtgctgcgggcttggagctgatcaggggatggtattcccctgtaggcatggcagggctgcaacacggttggccgtataa

SEQ ID NO: 5684 - DNA, 345 bp, Chlorella protothecoides
atgcgcgtcaagttcggcgtgctccaggacctggagctgggggagctggcggggacgggggactttgggcgggtgtaccgtgcgcgctggcgcggggtgcccgtggccgtcaaggtggtgcagagcgggcctggcagcgtggccctgggcccctccgtctgggagggcctgctggcggccagcctgcaccaccccaacgtggtggccacctacaagatctccacgctgcgctccgcggggtcgggccagggcagcgccgcgcagcccgacctggcggggaacgggggcgtcgaggggcagcggcgcgcagcccgacctggcgggaagtgggggggccgagggtga

SEQ ID NO: 5685 - DNA, 852 bp, Chlorella protothecoides
  modified_base (123)..(199): a, c, t, g, unknown or other
  modified_base (592)..(654): a, c, t, g, unknown or other
ggcggcgcgccgaccggcccgtcgccgttggggacgctgggttctggcgcccccgacggccacgcgccgccggcaggcgggcagctgccgggcctgcaggacgtggcggggggggggcgcggnnnnnnnnnnnnnnnnnnnnnnnnnnnnnnnnnnnnnnnnnnnnnnnnnnnnnnnnnnnnnnnnnnnnnnnnnnnnngcttcgcgccgagttcgacgtgcgcggcgacggctggcgctgggggccctgggccctggactcggccaccgcggtgggcagctaccactccgaggagggcctgcacctgcaggaggtgggctgcttgggcgaaggagcgaggggagggggggaggggggtggagtaacggggaggtggaggttggtgatgggattggagagtggtagtgatgttgggggaggtcgcatcagtgagggcgggaatgagtgggcgatgcctgggtgggcgggcggccagagcaggaagaggaacaacgacgatgctaacccgccgcgtgcctcccacgggcgggcctgtggacgtctcgagcgtcgggatctcccagcaccatcgtccaaactcacccccccccnnnnnnnnnnnnnnnnnnnnnnnnnnnnnnnnnnnnnnnnnnnnnnnnnnnnnnnnnnnnnnntccccgactccaaaaccacgcgaccggcacagttcgcgctggcgctgggcgacgccaagctgctggtgcggggcgggctgcttggcgcggcgcaggacgcgagcctgctgctcaccgacttccccgtggccacgctgcgcccgctgttccgcggcgtgccggcgctgcgccacgccgtccccgccgcgccgcccgcac

SEQ ID NO: 5686 - DNA, 324 bp, Chlorella protothecoides
gcagtgcccttctaccccccaacccaccccctcaacccctcaacccacccgacccaggtggggcgcggcatcgacatcgagcgtgtgaacatcgtgatcaactacgacatgccggagacggacgacaagcacggcaacggcgccgacacctacctccaccgcgtggggcgggcggggcgcttcggcaccaagggcctggcggtaacctttgtggccagccccgccgacagtgaggtgctgaaccaggtgcaggagcggtttgacgtcgacatcaagcccctgccggactcggtggacgccagcacgtacatgaacacggcgtga

SEQ ID NO: 5687 - DNA, 261 bp, Chlorella protothecoides
atgacagcacgcttgcatcttcctcggcagcctgtctgccacggggagtcgggcgattatcgctgcgtcgagcaaccctccccgcaacttcttgtgcctgctttcctccacaccctccaggtgtccgagccgatgctggcttccgtgacggtgtcgcgcatcagtggccggcgactgacctttgacacccagctcaccgactctgcgggcgcagtgcgcgtgtccgggtcggcgctagccatgctccctccttccacttga

SEQ ID NO: 5688 - DNA, 717 bp, Chlorella protothecoides
  modified_base (557)..(566): a, c, t, g, unknown or other
gaggagacactgtccacgctggaatatgcgcaccgggctaagaacatcaagaacaagccagaggtggggtggaaaatgtgtattaagaaggaaggcaggatgtgcccgcctggattgggaggagacaagaaggaggccgtctctgtgttggcaaatggcatgggtgcctatagatgttgcgtgggtttaaaaacctgcaggcacgggacaagatctttgttacacgatgctgtctggcccagctcgctcaggcatcaccttccctccctcccatcatcaacgcagatcaaccagaagatctccaagaccacgcacttgaaggaaatgaatgtggagatcgagaagctgaagctgatgctcaacgccacgcgcgagaagaacggtgggcgcgtcactggggcgaatgagctggacgctgctcagcatttgtgggagacctggccgtggagggggaatcaggccattcagggtgccacaatttacaagcaggcccaccaagcaggggcctggcctggggtatcaagatacccttggagacatggaccccatgcctgccnnnnnnnnnntaggggtctggcctggggtatcaatacacccttggagacatggaccccatgcctgccaacattcgccctacgctcaacgttcgcctccccacaggcgtgtacatccccaccgcccagtatgatgaggagtgcgaggagaggaagttcctga

SEQ ID NO: 5689 - DNA, 1317 bp, Chlorella protothecoides
gacgtgggcgtggcggtcgggtcgggcgcggcggtggccatcgacgccgccgacgtcgtgctcatgcgcgacgacctggccgacgtgttggccgcgctgcacctggcgcgcgcgacgcacgcccgcatccggctcaactacctctgggcgttgggctacaacgcgctggccgtgcctgtggctgccggcgcgctgtacccgcccctccgcttccagcttcccgcctgggtggccgggctggccatggccctctcctccgtctccgtcgtctgctcctccctgctcctgcgccgctgccgcccgccggtcgtgcaggggtgcggcggcgaggagggccgagcgtcggccgcgccaaccccttggtggcgctgccaaggcggccgcggcacgccccgcccgcgcccgcgcgccgaggtcggcctggccaagtactggaccgcctctgcggtgcctactcaattgctttgccgagagatagactcccaggggaaggctccaggcaccaggcccgagaggaagctggccccccctcaccgccctggcatctgcaagtgcggacagcactacctctacctcctcgaccaccagcctgccaccaccctctcgtttagcctacgtgtacagacaaaatcatgtgggaacagcacaggggagaggtaccagagcagggctcatgggcccgttatttgccagggagggcagcctcacggcaggagccaatgcgacatggagagaaaagggggggacaggtcaacggctgcacgctcgtgctatgacttgggacagggtatcgggggggggacagagcctgcctgtctgcactggcccagtggactaccccgcgggcagcgcgtgcgtggggtgggaaaaggcgtgcgcgcctcaggccgcctgctccagcccggagcccttgaacctgggcgcacgggaaagggagttggatgggggtttgggatggcgacgatgccgtcgcctgggctctgcccgggcatcgggggaataacagggcatggtggggggggggtcgccatgggagtccccaccccacccttgcgcgccctggaatggcccgccccgatcccaacaccttgtgccgcagctccctctcccggcgctcacccatgcaggaccgaggagctgaagaccgggaggtgctcccgcccctcacccgccggaacagaccaagccccctccgccggcgcggcctcggccacgcgccccgcggcggccatcgcccggctcagcgcctctacctcagagccccacccgcggcgctccccctcctccctaccgcgcttgacgggcgcgccgcggtga

SEQ ID NO: 5690 - DNA, 234 bp, Chlorella protothecoides
ctggcggccgccgcggttgacgcggagcgtgcggtgcagcgccgcgcgtcctgcaccgcggcgcaggcgctggagccgctggtggagggcgtggaggccgtcttccgcgtgcaccagttcgccggcggcctgaaccgcgcggccacggaggccgccacggagctcatgcgccgcaccgtgcactgcgctcgcatggcggaccccctctggctccgcgacgccaagtttgcgtag

SEQ ID NO: 5691 - DNA, 1134 bp, Chlorella protothecoides
  modified_base (49)..(58): a, c, t, g, unknown or other
  modified_base (1038)..(1047): a, c, t, g, unknown or other
atggatactacaaacacgtcaacgccgcaacttcctccagatctggagnnnnnnnnnngtgttgtcaccagcgtcagttaccatgtgacagtttggactgtgctgcagttgtctccggacggaataccccgcctcgcctcttaccggctgttgtttattatggatactacaaacacatcaacgccgcaacttcctccagatctggaggagctgtccctggcagggaacggcatcgaggagctgcccgaagccatcgcctcccttccctgcctgaccaagctgcagctggcgggaaatgagttgcgccgcctgcccacggcattgacgaccctgcaggacctacgcggcctctggctgcatggcaacgcgctggagacgctgccagaggacctgggcgcgctggaggccctggagctgctgtccctggcggggaatgcgctgcgcatgctgccgtggtcggtcggcgacctgcacgccctgcgcgagctcaatctggcgggcaacgcgctgacggcgctgccggggtccatcggcggcctgcgtggtctgcagacgctgagcctgctgggcaaccggctggaggcggtgccggagacgctgggggcgctgggcgcgctgcgcgagctctggctccagggcaacccgggccttggcgcgttgccggaggagctgggcggcctgacggcgctgacacacgcctccgcggccgactgcggcctggcacgcgtgcctgggagcctcttggcgttgccgcgcctccacacgctgagcttgtacgggaaccggctggcgacgctgcctgccgaggccctgcagcaggtgtactacgaggatgacgaggaatcgatgacgacgatggctgacggcgggggccttgctcatcctgtgttctgtgtggggtgtgggtccagcgggggctggggtccagacgtggccggggatgggatgtcttctgccactcatccaatgccggagccgccgccaatggtcagcactgactccacacatcgtgcaaccctcagggcacctccctgcggnnnnnnnnnntgggggctggggtccagacgtggccagggatgggatgtcttctgccactcaccaaatgccggagccgccgccgatggtcagcactga

SEQ ID NO: 5692 - DNA, 1056 bp, Chlorella protothecoides
atgagccaggacgtgacggtgggtcttgacgagtcgcagctgcagcatgcggcagcaagcgtgggcgccgtcccaataccagcaaacgtccagcgctctgagattctcgcccccggcccgggcctgttcaagctcgtgcgctgggctggtctggccgggatcccggcggccgcgcgaccctctgccacccagggtgcgccgctcgccgccgccgaaaccctgctcgtcgcctttggcagcgcccccggcgttcccaactgggcgggtgcgctgaagaaagtggccgcccggccggaggtggccccgtttgacgtgctcttcgtcgtggacgccgcccgcgcctggtaccatggtgagctcttcgggatgggaacaggtggggggacggtggcgcagcccgcacgccctgagtcacgcgatgagctgtgtgcatgctggggtgcaagcccagccgctgcccatccacaccgtcaccgtcatgccaggcggggacgcgggcatcgaggagtacgcgggccccctgcggcaggcggcctcgtgctaccaccgagtggtcctgctgggcgacagcatgggcggcacggcggccctcctctttgccggacaggccaccaaggtggtggccttctgcccccaggtggacctggcgcgctcggccatccgccccgccggccccgcgccctggcgcgccgcgctgcagcgccgcgtcgaggaaagtgtggcagcgtgcaggggcgtcgtggacgtgcacgtgggaacctgggagcacgaccaggagcaggtggggcgtctggctgggtgggtggaggcggggcgatgtggacctgggccccgtgggaggacggctcgtgcagggccgggagccgccccccgccccaccccatactccaccaccgtcacatgcctgaccacaccctaggtgcaaggcctggagtccgggtcggtggtggtgcatgttcacccggtgaacagccacaggctgagtgcggagctggcgaggagtggggagctcgaggtgatcatcgccggctccctgatgccagcctgaacccttag

SEQ ID NO: 5693 - DNA, 915 bp, Chlorella protothecoides
atgcgcgactgtcggggcatagggacgttgtcattcggcatggcagaaaccgcttcctcgcggccggagtctaccgcggagctggcctccagcggggctgatggcgtcacccacagcgtgcggtgccgctggactctgaccggcttcaacacatccaagcagctctggtcgccatacttcacggtggctggctccgatggccgggagcacgatgggcgtgtgctcatctacccctcaggtgctgggctgggtgtccccctcaagaccccacgtccttgccgtcaccacccgctgccctcttattcatgccgagcaggggatagccaggccctgcccggctacgtctccgtctacctccagctgagcgaccctgggaacagcagcaagtgggacgtgtttgccagctaccgcctcagcatcggcaccgaggcccagaaggggagggaggtgctgtcacgtgattcgtggcaccgcttctccgcccgaaagaaatcccatggtactgcgaagggcctggtggctggtgacattgaatggaaagcccgttgcggtgttggatgcagtggaagtacagctctttgcagcacttccacatcagtagcggcctcgaggtggggctggtgtgactttgcgccgcacgccgcgctgacggagcccggcggggcggccgggtcgctgccggagtcggtggagctgtcgctggacatcaccatcctggcagagtccacctccttctcgcgcgacccggacctcagcgggcgcgtccccggcgcgtcggacccctgcatggccggcaagttcctgtggacggtgcagaacttcaccgccttccagcccctgctgaagacgcagaagatcatgagccccgccttcaccgccggtgcggggttttgggtgtgggaggggcgcgagtga

SEQ ID NO: 5694 - DNA, 624 bp, Chlorella protothecoides
atgagtggcagaagacatcccatccccggccacgtctggaccccagcccccgctggacccacaccccacacagaacacaggatgagcaaggcccccgccgtcagccatcgtcgtcatcgattcctcgtcatcctcgtagtacacctgctgcagggcctcggcaggcagcgtcgccagccggttcccgtacaagctcagcgtgtggaggcgcggcaacgccaagaggctcccaggcacgcgtgccaggccgcagtcggccgcggaggcgtgtgtcagcgccgtcaggccgcccagctcctccggcaacgcgccaaggcccgggttgccctggagccagagctcgcgcagcgcgcccagcgcccccagcgtctccggcaccgcctccagccggttgcccagcaggctcagcgtctgcagaccacgcaggccgccgatggaccccggcagcgccgtcagcgcgttgcccgccagattgagctcgcgcagggcgtgcaggtcgccgaccgaccacggcagcatgcgcagcgcattccccgccagggacagcagctccagggcctccagcgcgcccaggtcctctggcagcgtctccagcgcgttgccatgcagccagaggccgcgtag

SEQ ID NO: 5695 - DNA, 747 bp, Chlorella protothecoides
  modified_base (155)..(164): a, c, t, g, unknown or other
atggctaccttcaagaggcatggcagcaggagacgaatccggaccctcgaaaggcctgctgaccaagtccagccttgcacacgatacccatggttccatcttgagccattgccccaatttgcccctcctgatgttcagaagctgctgtcagggannnnnnnnnncgctgaccaagtccagccttgcacaagatacccatgtttccatcttgagccattgcccccatttgccactcctgatgttcagaagctgctgtcagggaggccttcatcgctgctgacaaggcggtgctggcgcccaagcccggcttcttggggatggtcggggaacgtggcaaaggcgggtccaagtgtgggtccactgccgcagttgccctcctctacgaggcatgtcggaattgattggcgctgccatgtaccgcgccttgcctccccgcaactcgtcaggatgctcatgcaaccaagcccctcacaacacctgctgcagggggacgggaagacgtgcctggtcaccggcaatgtgggcgatgccagggtggtcctcgtgcagggtggcacctcctaccagctcaccaccgaccatgtccccgacagcgaggatgagaggctgcgcatcgaggcccagaaccctaaccccaagatgccgctggtgcggtacgtaggcggtacatggcgcgtcggaggcatcctggcgctcagcagggcgtttggggatgcgtacctcaaagtgagagctggacaggcgtga

SEQ ID NO: 5696 - DNA, 564 bp, Chlorella protothecoides
atgcggaaagagggccttgtgtctgtcgcagcccagggctcaattgttttccctcaagcagtcacgaggggacacatccagcaactcctctctaccacaccgtgtaacctcctccacatccctctcctggcatccagggtagcggacaatttgagggcgtccgtgcgggaggcgatggctactcctctggctttggagtcgttgctgagggtgctaaattcccttcctctactcatcttacctgcgcagccatacacagagaccagggagctcacggcctctgacacctggctggtggttgcatcggatggactgtttgccaacgaggagcgaggtggtgggggaggcctgaccaaccaggaggtgagcagaaattgtttatcaggagctgcttcaacaacttgcccagtcgacatggcactggagcgtgtgatcgcggacgaactgaagcggaagtcttccctgagctgcgaggctctggccaagcacctggcagccgttgccgtggagaaggggtccactgacgatgtgacggtcgtggtgctccgattgggacaggcgtag

SEQ ID NO: 5697 - DNA, 888 bp, Chlorella protothecoides
  modified_base (197)..(206): a, c, t, g, unknown or other
  modified_base (506)..(515): a, c, t, g, unknown or other
atgacgacagggatgaagctggctagcctctccaagatcctgaagtgtgccaacggcgacgacgccatcacaatgaagtccgaggacaatggcgacaccatcaccttcatgtttgagtccccagagcaggaacgcctctccgagtttgacttgaaactcatggacattgacagcgagcatcttggcatccctgaagnnnnnnnnnngagcatcttggcatccctgttccaaggctgccaggctcaaccccaatcctctccaacagacaacgaatatgacgccaccgtgaagctgcccgccgccgagttccagcgcatcgtcaaggacctgtccaccatcggagacacggtggagatcagcgtcaccaaggacgctgtcaagtttggcaccacgggtgacattggcaatgccaacatcatgtgccgacagaacaaggctgctgacaaggtgtgcttgtggaggggagggggagcagaggagcacatgctctgcatagtctgcctttnnnnnnnnnngtgccgacagaacaaggctgctgacaaggtatgcttgtggaggggaggaggagcagaggagcacatgctctggatatatcacctgctcctttcatccacaacatcccatttcactgtctcacagcctgacgagagtacggagattgacatcaacgaggccgtgtccctgacgtttgccctgcgatacctcaacagctcattgccagctcctcatgtcgccgctcggcaccccttctgctccccgcagcttcgccaaggcgacccccttgagcacacacgccgtcctgaagctcagcaaggagctcccgatcctggtggagtaccacatcccggaggtgggccgacttgcattctacctggctccgaagattga

SEQ ID NO: 5698 - DNA, 591 bp, Chlorella protothecoides
  modified_base (179)..(188): a, c, t, g, unknown or other
atgtttgaggcgcgtcttgcacagggagccctgctcaagaaggtacgccactctggctcgggattacacggcactgccatggctatccgatcgcaattcaacccacagagttctacgttaatagcgcaatcacgtcggctatcggcgatagcgctaccgggatctcgactgatgtccgnnnnnnnnnncgttaatagcgcaatcacgtcggctatcggtgatagcgctaccgggatttcgagtaatggcccacgggagtttcaaatttcgacgtgcccactcctcgtatgtctcctccgcccctcctcacgccaggtggtggaggccatcaaggacttgatcgaagatgcaaacttcgactgcaactccagcggctttagcttgcaggccatggactccagccatgtgtccctagtcgctctgtccctgagggcagatggcttcgagcactaccggtgtgatcgcaacgtcagcatgggtgagcttcagtgtgtgatcagatggcgttgcatgacctcgaggggatgcagggcgatgtttgccagcacagactgttatggtgcccatatgctgagtgcgctcaagccctga

SEQ ID NO: 5699 - DNA, 570 bp, Chlorella protothecoides
atgcccaacctggttccgccagtcacgacgacccccatggtgggcagcgactgcatgctttccatgtatggtgctctgtttgggaaaggctgttacttttgtcatgaaaggaacagcatggccaagacctgtcgctggttcactacggtgaatccggtgaagcaaatctccagcgctcaacgagcaggtgtgtgcggagggttggaatccatgctgcttggcacgactgagccaataggaactcactcactcatgcgatttaccgtttggagtgtagggtcgacagcgaggggttcgtttgttactgcgtcttccaccccgtccgtgaccagcctgacgatcatcaggcctgacgactggcacctgcatgtgcgagacggccccggcctggcctccgtcgtcccgcacaccgctgagcactttgggcgagcgattatcatgcccaacctggttccgccagtcactacgacccccatggtgggcagcgtctgcatgctttccatgtgtggtgctctctttgggaaaggctgttacttttgtcatgagaggaacagcatggccaagacgtga

SEQ ID NO: 5700 - DNA, 231 bp, Chlorella protothecoides
atgtctctcacccacacaggcagggatgtctacatcgatgtctccggctggcacctgtacctgcgggacgtcaaggtaccagactcgggcggcaccaccctggcttccggactggcagcaatgctggcccaggagggggatggtgctgacgtggcaggcggcctcggccaagtgcccgtgcccctgggaggaggacaggtaggcgacttgaagtctggcataggaatttag

SEQ ID NO: 5701 - DNA, 1038 bp, Chlorella protothecoides
atgacctcgcactcttctgaggcagcagctcgcccattgcagcatcccacggtcgcatggatcaatctggcgaagatcgtgctggcagtgcatggcgaggtcacagaccccgccgtcgacttcttcgacagggaagcggtcttcatagagcgcgtcctgcgacccctcctcgataaggcgaagatcgtgctggcagtgcatggcgaggtcacagaccccgccgtcgacttcttcgacagggaagcggtcttcatagagcgcgtcctgcggcccctcctcgataaggagtccactactcattgcatgccggcgtcggcatccctggccaattggggggacatgaacttggcgtcctgccattctgtgtcacccacccccccagcagcaacagggtgtggaatccgcctcctcacccaacctggcccccacccaccccccactcctgcactccctggtcaggtcccagacctcaaagtggtgatggagcacatcacgacccgccaggctgccgactttgtggccgagcacgccggcaccgggcgcctggccgccagcctgaccccccagcacatgctgctgaaccgcaacgccctgttccagggtgggctgcggccccacgccttctgcctgcccatcctgaagcgggaggaacaccgccaggccgtgctggcggcggcctgcagcgggagcccggccttcttcctgggcaccgactccgcgccccacccaaagcacgccaaggagtcggcgtgcgggtgtgcgggaatatacagcgcccccgtggcactcggcctgtacgccgccgcgttcgagggcgcggggcggctggaccggctggaagggtttgcctcgctccatggacccgacttttatggactgccgaggaacgctggtgaggcacggggctggcagagtccgatgtggggcgtgcaagtggatgggccaagcttctgcgagtcactcgcgtggaccccctcagatcatgccatgatgacgtggtactcaacccgggtctccaacccgctgcagacaccgtga

SEQ ID NO: 5702 - DNA, 1392 bp, Chlorella protothecoides
atgcctggcctatcatcgccccgcccaaggacattgccgcccccgcggtacaacctgccggcccaccgaccacaccccctctcgtcacgcaggcccctctggttctggcaagacgacgctgctggaccccgtggacattgccgcccccgcggtacaagctgccgacccaccgaccacaccccctcttgtcacgcaggcccctctggttccggcaaaacgacgctgctggacgttctggcagggcgcaagacgacggggaagcaggagggcgccgtgctgtacggcggcgtccagcccagcggcccctttctgcgccgctacacggggtatgtggagcagtttgacacgctgctgggcaacctgacggtgcgcgagaatctgcagtacaccgcggagctgaaggcgcgggtcagcctgcccctggccgacaaggtggcgcgcgtggagcgcagcctgcgccagctgggcctggagacctgtcagaacgtgctggtgggcacgcccgccaagcgcggggtgtcgggtgggcagctgaagcgcaccaacatcgggctggcccttgtcacctccccgctcgtcctcttcctggacgagcccaccacggggctggactcctacacctcccaggaggtcatggacacggtcgccgagctggctcgtacggggatcacagtgtgcgccaccatccactcccccacgccccacgtcttccgcctcttcgaccgcctcttcgtcatcctgcagggcaggaccgcctactttggccccaacagtgagttcagggtgtggtcagaagggggcaaagagcgtgccgcccagggcctggacgggctgtcagagcggtccagcctgtcagacgtggagtacatgaccgacattgtggtgcagtcggaccggcagggcaggtccgacgccatcaccgattactacgcggcctccgacctggccgcccaaaaccgggaggatctgggccgcctggccggcgtgctgaacgacctcaccccctcccagcgcgagtacctggcggtgaagcgtgcgactgtcacgccctcctggtttggcctcaagacgctgatcaagtaccgcctgcgcgccgacctcaaagaccccctcttcctcctgccgcgtgtcgtggacaagctgctcattggcttcatcctcttcaccctctactggtggggtgggctagaaggagtgggactttcatttgaaggggacagtaggggacactcacaatggtcctcaaccggagcacaagacccaggtctcaactcctttgcgtcgagccgccatccgcggcgcgcctgtggtcaagcatggtcctcgcctttgaagagaaagtcctccaacccccactctctcaccgtgaccctatccctctccctctggtaa

SEQ ID NO: 5703 - DNA, 825 bp, Chlorella protothecoides
atgtggacggtggtggtggcctactccgcctccgcctacatccccgccatcctcatggagcgcccgctcttcatccgagagcgctccgacggcctctttcgcgtggtcacctacctcggcttcaagctgctggaggagttttcagtgcagttcatcctctgccttcccatctcggccatggtcttctacccgctggagctgtccggcagctgggccctgttctggctggtctactacttcaccaccctcgtcggcatctccctcggctacttcattgccgcgctgtcgccaaacatggacgttgctaacgccgccctccccctctttatcaccatcttcctcttcttcaccgggctgctcatccgatgggtggacacaccctggtactggaggtgggtcggctatgtcaacttcctgcgctactcctggggggccctcatgatcaaccagttccagggcgccaatgccatctacctggggtcggagtgtcatgtgaaggcagggtgggcgcatgccgctgcgcctgcaagcaacactcttcacgctggtggtcctgggtggtggagcaagtgcacgcgacggctcctgtgtgggcagcacccatgccatgcctgctcaagacacctggtgaacgcctctgcccccccacgcgcccctgtaccaggtcctggagtactttgcgctgagcgggtacgctgcctggcagttcttcggctatctgaccatctttgtggtggtgttcagcttctgggcctggctcgcattggccttcatcaagcacgtcgtgcgatgaagacggccccatgggaccacaggcgaccttga

SEQ ID NO: 5704 - DNA, 300 bp, Chlorella protothecoides
atgcccaccgtgcaccgcctgattctcaccggtgcacccatccagaaccgcctgactgagctctggtccctcttcgattttgtgttcccgggcaagctgggcacgctgccggtgttccaggctcagttcgggctgcccatccagatcgggggctacgccaatgcctcggccctccaggtctccaccgcctacaagtgcgcggtggtgctgcgggacgtggtggggccctacctcctgcgccggcgcaaggccgacgtggacgtggcgctgcccccgaagaccgagcaggcgcggtggtga

SEQ ID NO: 5705 - DNA, 891 bp, Chlorella protothecoides
atgggggtgcgggaaaggcgacgtgtgcgtctggaccaccctcctgcgaatgcagtgccatgggaaatgtgtttgacatatcagttgggaccgggagcatctcacaggcacgaccacccttctcccaccctcagacgcgtggacgaggggtactggcggcagggcaactccgagtacgtgcagcccgtcaagcggcgacggcgcccccgcctgcgcaagctgcgtggcccgcgggaggaaagcgcgtcgtcgggtgaggacgtgggcggcgagcgcgacgacgccgacgaggcgaactttgacgcccgccaggccgcgcgagcgcggcgccgggaccggggggtcgccgaggagggcgggtctggcagcgaggcggagccggaggaggatgccctggtggagtttgagggcgggttccgcatctccgcaggcatctacgaccggctgttcgagtaccagcgcaccggggtcaagtggctgtgggagctgcacacccaccgcaccggcggcatcctgggcgacgagatggggctgggcaagacggtgcagatcggggccttcctggcaggcctgctggccagcggcctgtatcgccccagcctcatcgtctgccccgccacagtgctgcgccagtggctgcgcgagctgcgcgcctgggcgccggacctgcgcgtcggcatcatgcacggcctggcggggggcgcgcgcggcgcgcaggcgttggtgagcgagctggcaggcagtgccgcgggcctgctgctcaccacctatgagcacatgcggctgcagcgcgagctgctgctgagtgtggactggggttacgtaatcctggatgagggccacaagatcaggttttttgggggggtgggggggacccaaggtgggagctga

SEQ ID NO: 5706 - DNA, 324 bp, Chlorella protothecoides
atggcgatgttgcagccacagattcaattctctcccctcgaacacaatgcccgcttgcaggactatggcaaccaggagcgaagtggaaagctggtggtgctggcacgcgtgctgaagcactggcatgcccagggccacaaggccctggtcttcacccagacgcaacagatgctggacatcgtggagaagaccgtgaacaccgaagggtaccgctaccaccgcatggacggcgccaccgccgtctcgcagcgcgccctcctcatggacgactttaacgacaaccccaatggtgtgtgtgatgttgtgcgtgttatcgtgggttga

SEQ ID NO: 5707 - DNA, 189 bp, Chlorella protothecoides
atgttgaccccggtgcagcgcgacctatacaaggcttacctggccagcaaggacctgaaggacatcttcgcggggcaccgggcggcactggcgggcatcgacatcctgcgcaaaatctgcaaccacccagacctgctggaccgggcgcgctgggaggcctcggaggtgtgtggggaagatggggagtga

SEQ ID NO: 5708 - DNA, 855 bp, Chlorella protothecoides
atgatggacaacgaggatgactctgtcgatcaagaaacactcctcgctcgctacaaggacgctgccagggagttgcaggccatacagagcatggtgtcctcccaggcgccggagggcctccaggcttcgctcatgcgccagcgccaggagggactgcaggcagccttggacagggctggctgcgagctagaggctgctggccttccgcggcctcgagtcggtgatgcaggggcgcctacctcgatacaatccgagcgagaggggctcccgaagacccaggctgtgcctgggcaggcacgatccagtgcaaaagggaaggctgccgccgaagagctggtggaggacgacctcttctcggaaggggaggggaaggccagctcaggcgccctggggaagggcagctcaggcgccctggtggagacggatcgagaccgcctcatccgcctgggggtgctgacgccctttgacaacgtgaatggatttgagcggcgagtcatgcacagcaaggctgggccttcaggccgcgccagcccagaaggtgggtctgtggtggcaggcgtgttgctggttggaggctgggaggagaacagaatgtgcagggacgagggtgccagtgatgcatgcagcaaggatgtatatgcctgtcaggtagtcctgaaatggcagcagccacccctgggataccatctccctggggccctcatccacttccagcagaggagccggggtccgaggccgcccagcgcatggccgccaggctggcgagcatcaaggctgcccgccacaccaccaggctgctggacgcccaggacctgcctcagcaggaacgccccaccaagtgcgcttcaggagtag

SEQ ID NO: 5709 - DNA, 2349 bp, Chlorella protothecoides
  modified_base (391)..(400): a, c, t, g, unknown or other
  modified_base (709)..(718): a, c, t, g, unknown or other
atgcatgcaggtgccggtcccatcacgcctggcaatattttctatgatgcaccccctgcaggaatgcaacagcatggcaggtgtgaaacgtttgtggcaatactgccggactgctccccagcaggatgggctgttgcggtgtcgtacacacgacagctttcccatcgagctgggggtgggagcgccgagagtttgctggtggcgcacgggcctgcagcggttgcggcctgcgccgagtgcagggaagcattccccccaggacttgctatttgtcatgtgatgaacagcggcttcgatacatctggacatggaggtcccgtgaatggagtctggcagttcacaccacagcattactccaaactagcagtccggagcacgggcccgtctaccnnnnnnnnnnatgcaacagcatgtgtgaagggtttgtggcaataccggattaagcgggatgctccccagcaagatgggctgttgcggtgtcgtacgacacctttcccaccccgccatcgagctggagggtcggcttcgatgcatctggacatggaggtcccgtcaatggagtctggcagttcacaccccagcattactccaaaccagcagtccggagcacgggcccgtgcacaaagcccggcgctaggcgctccagctcctggctacatggggcgtacccctccaggatgggtccacacctggtacgcccccgcgccannnnnnnnnntgctgatgtcttacccgataagctcctggccacatggggcgtacctttccaggatgggtccacacctgatcatcaccctctgcttcctggccaccctgacggcctatgtggagcgcaccggcttctccatcgcctacacgggcatggcgaagactgcgggactgagcgagagcgtcaaggggaccgtgctgtcggccttctactggggatatgccctgtcacaggtggatttaagggctgatctgggaccactgtgtgccgtcaacatctctgctggtctcccaaggggggcgctggtggagcatacatgcctgcatgcagcccacctgcagggcttcccggcatggacaaaccctgcgagacggtgtttcaccctgcctagccaactctgtgtctgtgggatgcttggaaatcaatcagcaggcatggtccataaatcttcgcccctccttcacatcaacaactcctccaagatcccgggcggcatggcggctcagcgctatggtggcgacgtcatgctctcactttcctttgccctttgggcgacggcatcactgctgaccccgggcacggccgagagtgtgagggccatcattctggcgcgcgtgtgtgtcggcgtagcgcagggcttcctgatcccggcggtgcacacaggtcggccggtgggtgggtggtggcgctgtagtagcagagtgagttcccgccggtaccggccagggtttcctgtggtgcacatgccatcttcagcacaggtgggtcccctgcttgcgtgcccttgcctgccttctgtgccaccacacaaggacaatgcatcccagcatcccctgtgcctgcttggccctgtcgccactcagttctgtctccgcctccccacacccacccacgcagtgctctccgcctgggttccccccaccgagcgcgcgcgcgcggtcagcctcaccacctccggcatgtacctcggctccgcgctggccatgcaggcgctgcccgccgtggccgcggccttcggccctgcctcgctactgcgcctgtccggcgcgctgggcctggcctggctgctgacctggcgcgccagcctggcaacgctgggccggcgcccaccctccatccccgtctcctcctccggccctgcggacgatggcaaggggtttgcgccggggtcgcggggccggccgggtgccacgccctggcgcgcgatgctgcgcagccctgcggtctgggccatcgtggcgaacaatttcaccttccactacgccttctacgtgctcatgaactggatccccacctacttcgacaaggtcctgggcgcggacctgtccaccatgggcgcggccaagaccctgccctacctcaccatgtttgccgccagcaacgccggcggctgggcgggggactggctgatcaacacacggcgcgccggcgtggccgcggggcgtaaggccgtcaacaccgccgggttctgggcggccgccgccgcgctcctgctcatgcccggcgcgcgcagcgtggccggcggcgtcgccgtgacaaccctggccctgggcacctgcggcttcgcgcgcggcggcttctctgtcaaccacatggacattgcgcccaagttcgccggcatcgtcatgtgcgcattttga

SEQ ID NO: 5710 - DNA, 1581 bp, Chlorella protothecoides
  modified_base (61)..(70): a, c, t, g, unknown or other
  modified_base (441)..(450): a, c, t, g, unknown or other
  modified_base (1127)..(1136): a, c, t, g, unknown or other
atggggatatttgccattggatggcgcgtcggtctctttggaatgtgctgtgcacccccannnnnnnnnnctcctccaaagtccatacgcctggagtttgacggcgcgtccaagaacaacccgggcccggcgggtctgggcgccgtgctgtacgacgccgacagcgggcgtgaggtgaagcgcgtgtgccactacatgggccaccgcaccaataaccaggcggagtatgggggcctgatcgctgggctgcaggcggcaaaggaactgggctgccgcgacatccacatctccggcgactcccttctggtcatcaaccagctgaagggggactggcgcgtgcagcacgagggtctgaagccctaccacgccgtcgccacctcgctgctgggctcctttgacaaggtggaggcgcgccaggtgcctagggacgacgtggcgccnnnnnnnnnntggaggcgcgccaggtgcctagggacgacgtggcgcaaattgcacgagatggagcatgaatgcggtggcggatgcgctgtccaaccaggccatctcggagcaccggtccggcactacctcgcaggtctggcagctggagaacccctccactcagcagtgatgctgcactcccgcaatgctgataaagtgctggccctgcacggcagccctgcaattcttgaccacccccgccccgccccattttggcacgagcgtttccccctgtctgtaactgacgacatctatcgttgtgccagggctagggagtcgtggcagaagggttctgggcaagggagtcgtggcagaacggttctgggcgtcgtggttttgacagaatgcgggtgccccaagcccctgtctgttccaccagtctcgttgcccactctatgcaataacccttgcccgatgttgggcaaagcacgacgtgcgtgcgggtctgtaaaaggaggcatcctggggagggtttgggcgtgggccacgtgtcagaccgcgccagctcagtctcgtgggggcgaggcgttggcgtccgccccgctgatgaaaccccacagccctgaggccttgcgcggctccgcagccgtcgcctgcagcctgcacggtcgattcgggaggggagagagggattgcacaggggcccnnnnnnnnnnaccccacagccctgaggccttgcgcggctctacagccgtcgcctgctgcctgcacggtcggttcgggaggggagagagggattgcacgggggcctcaggcagtcggccctggcccagccatgccctggcggccatcagacttcccgtcgcactgcctcgaaaacttcagaggccgtgccgggtacgtactccccttccctccacacccctcccaaccgtacctgtaggagtccagctcccgctcaagctcggccatgcgggacagggaggccctgagctccgcgacctccacctgcgatgcatggatggtctggctcggcgcatgtcggggccagaccggtgcagcgatggggaggagatgactccgcccgtggcggccgtgagggcgatgcctgcttcgcttcaggcccgtctgccccaaatccctgcctcacctccagcctga

SEQ ID NO: 5711 - DNA, 1392 bp, Chlorella protothecoides
atggaaggatggtggttgggggcagcatcaccccggcaccatcatgcctgcagactcaagcaccagaacttcctacatatccatgtccccactgtatggcataagcctaagaccaccttgtctcaatggatgcatccaacttctaccatcagaaacttgcatcctcaagatgatggtgatctcgcaagggaaatttcatcacgcgcctgcgcgagatgcagcggatcacaaaatgggaaggaatctgggctttcaaggagccatctcaggcgacccatgtcgattaaatcgctacattacgaagtgaagatggacgtggggcgtcgggatcccagcctggccaagacagcaagtgatccacgcccctccgccgtgtttgcttccgggaagggccccttccacaatgtgagaggagggaagcgccggtgggatgctcacgttaaggcccattgtaacccttctctcgaccctcccattctggacttcgcccctgcagtcgaagccttacttgggcccctggagcagagcgtgacatctgcctccagtgcctgctggcagctggcagaggtccctgtccaggtcaagggctcgctgttcgggaccaagactctgcaggtgcagcaggcccatttccaggaagagaaggagagggagggcctggccgccgcgctcgccgcctggcagcgcgaagcgctgggccccggcctctgcggcgccctggacctcgccgtggcccaggagcgcctgctgcacgtggtcgcaaggagcctggatgccgcagaagacgggtccctggacgccaggctggcggcgctgggcgccctgctgtcggcccaccccgccgcggcgcgcatcccgcccgcgctgcgcttcctgcagcacgccgcctggcgcgtggccgccgctgagccgcgcctcccacaggcctcgctgctgcgtacgctgggctcccacccaggagcatgcgatgcctgggccgcacacctcctgacgctggcggcgggcgagggcgccggccccggggtcaattcagggcccctgctcagcgtgctgaggtcgctgccggacgcctgcgccctgccggcgagcctgctggaaagcgtggtgcagggcacggactgggccgcgctggacaacacgaccctggcccgcctcgccggcctgctggcggagcgggccccctgtgccggggatgaaggcgcggcccaggcggcgggcatcgcggccgtgctgggcgcgctgagccgggccgggcgggtggcgcggagccaggccgcgcggggagcggtctggggggcggtggccaccgtgatcctggcatacgcgagaggccgacccgcgacggtgtgctttcaaaggggagggggcgcattggaggtgtggccatcctga

SEQ ID NO: 5712 - DNA, 1005 bp, Chlorella protothecoides
atgctcgacgtcgcgctgcggcgattgaagggcttccagacgcagatccaactgcagggcctgggcaggagggatgccggggccgcgacgaggaaggagggtgggggcctgctggaccgcgtcaaggacatcctgcgccccagcgaggggcgggacgagggtgagtgtgattgtgcgggtgacgctgtgcgagttggtgcctgcccggccagcagatccaagatcccagtcctcagctcagccgctgccctcccctgctttccttcatcccgtggcaccctcgccccacactctccagaccacaagggcatggggacgcgcttgccgcagacatacctgcccatggcagaccccgatgaccccgccccgccctctcccgagccgggtcctgcccccgcggcgccaaacaagttgcccaaggtctgggccaagggcctctcggcggtgcgcagcaagatcctgccctcctccaggggggcctccccggccaagggccagccgccgggccgggggagaggaccgagtgtcgatcagggtcctcacaacgcgttgtcgggccatccacggagcgacagcgccctcgagcagggcgactgggtccggctgggcctcgcggcctttgcgatcgcggcctacgttcgcagcgtgctgtgcccgtccctggtcacccccccgcgagtcgggcccgcagacatgagcccggctacgccgctggggcaggcccagcactcccatgcgcgaagcatcagcatggggagctggaggtgggacgagcaccttctccgcgagctagacaccgtgctggaggccaggggggagctggacgtgctggagcagctgcgggggtgccccgccctggtccagcatggcgaggagtttcacgccttcttcacgctggtcccggagctgctgtcagccagcaccggcgtgcccgcctttcagttgcgcctgcagcagctcctcctgcccggctccgagatcctgcacctcctgcagacctgctga

SEQ ID NO: 5713 - DNA, 861 bp, Chlorella protothecoides
atggaccccgacggggacgaggacgcggcgcacgacgccgacttcctgctgtccacccaggagctggtgtgggtggtggacccggccacggggcgcccgcccttcctcggctccggcaccttctccaccgtctaccgcgcggcgctcggcagcggcgaggcggtggccgtcaaatgtctgtcggtgctgcccgacgcagagggcgggaaccacgtgccgttggacgtggtccggcgcgaggccgcggtcctgcgctcctgccgctcgcgctacgtggtcaacttccagggcgtggtgctccccacggcgctggcggccgctgccggcacggggcgcgagccccccgtcccacgcggctcgctgctcgtcgtcaccgagctggtgcagggcggggacctgtactccgcgctgcgcgccgggcgcatgcgctggtatgacggcggcgcacgcgtggcgcacgacgtcgccgccgggctggcctacctgcactcacgccgcatcatccacttcgacctgaagagccgcaacacgctgctcacggagcggggccgggccaagctgggggatgtgggccaggcgcgcatgctgcccttcgcccgatccttcctctcctccgagctgcatgtgggcacctggtcccacgccgcgccggagaccatcctgggccagcgctgcaccgtgcagtcagacatctactcctacggcgtgctgctgtgggagatcgtgacggggagcgtgcccatccgcaatgagatgcgcgaagtccggtggaagctgagtttttttctgaggggtccgggggggggtaagggatgggtgaggggtggacgggactgggctcagggggagttgcctgagtga

SEQ ID NO: 5714 - DNA, 471 bp, Chlorella protothecoides
  modified_base (52)..(61): a, c, t, g, unknown or other
  modified_base (305)..(314): a, c, t, g, unknown or other
  modified_base (394)..(403): a, c, t, g, unknown or other
atggaggcagggaagattcggggttgtagcttgcgacatcgcgtcaagctcnnnnnnnnnngttgcaggcacctgcttcctggtgagccgaaggaggcagggaagattcggagttgtagcttgcgacatcgcgtcaagctccaccctgtgtgcataatgaagaccacatccctccctggcatgcagattggaggctgcatggaggcatttatgatccgaacaggcttttacgaaagggtaacggccatcgaggctggccggctggaggagacacgggaggagagggaggcgttccttgcagcacnnnnnnnnnntgatccgaacaggcttttacgaaaggcgcaagtagagcagaaaactgggggccctctccctccgacactctcgcaagagnnnnnnnnnntaaaggcgcaagtagagcagaaaactggggcccctctccctccgttactctcgcaagaaaagccctga

SEQ ID NO: 5715 - DNA, 378 bp, Chlorella protothecoides
atgtggggcgaaaagcgacggctcaggtggcagggaggtggccctgcaagggccgtggcgggtcactcgtggcttttcagaggcccttgcctgagcctgcagcctcttgaatgtgatcaaggcgcatgcccctcttccctgattccggttttgcagtccacgctgttcaatgcgctgtgctccaatagcaaagcccaggccgccaacttccctttttgcaccatcgagccgaacgtgggcgtggtggctgtgccagacccacgcctggacatcctcgtgagcatgtccaagtcaggcaaggcgggtctagcatgggaaggagtgcaaggacctgatcgtgatgtgttcatcgcacaccatttcgtttcctcaccatga

SEQ ID NO: 5716 - DNA, 1512 bp, Chlorella protothecoides
atgtacggtgcgaggcccgtcccaccccagtcggggtcggggtggtcggtcctgcgccacttcgacgccttccccaagcagcgggaggaggccaaggagttcttccagtccactatggctggaggagtgatcacgctggtggctgctgcgctcatgaccctgctcttcgtgtctgagctgggtgaggaggggtgtgatggtggtgggggctccttggctgcgcgtggagaccgcaggccgagccccaatcaagccgtctcccaaccccccacaggcatcttcatgcacaccgataccgtaacggagctgttggtggacaccagtcggggggagaagatggacatccatcgtggatgcgatggacgtcagcggcgagctccagctggacgtggtgggatggcacaaccgagggaccagggttcggggcgagcggcgggggaggcgcatgcttgccggggggctggtggtcgcggccgcccgtgcggctcacgcgactcatgctccattcctgccttcttccaccaccacccccaggaccacaccgtgtttcgccggcgcctgtcccccgagggcctggccatcggtgaggactcggagcaccacgtgggccccaccgggcagccgctgcctgcagcgctgggcggctccaacgcgacggcggcctgcggcagctgctacggcgccgagttcgaggcgggcaagtgctgcaacacctgcgaggaggtgcgggaggcgtaccgccgccgcggctgggcggtgcgcgacacggccaccgtgatccagtgcgcggaggaccactacttggaggagatcaaggccagtcggggggggggctgccgcatctacggcgccctgtccatcaacaaggtggcgggcaacctgcacctggcgccggggaagtcgtaccaggcggggcacatgcatgtgcatgacaccagcccctttgtgggcgaggtctttgacttttcgcacaccattgacaacctggcctttggacaggagtatccgggcaatggcagggccagaggcaaagaggagtgctgtgctgggccacacggcggcagcggtgatgggagccatgccgggcgcgcaccggaggaggacggttcctcctgcgccccagcccgttttcatgcctcagcctcccatgcttgcaggattgtgattccagccgacccagcggcctcacccttccccttgtccacccttttcaccctcccccgccagggcatgcacaacccgctggacggggtggacgtgcacgctgtgcgcgactcgcatgaccgccccgtgctgggccagcaccagtatttcctgaaggtggtgcccaccgagtaccacgccacgcgcggcgcggtcatcgagaccaaccagttctcggtcacggagcatttcaagccctctgggggaatgggccaggagctgacgggcatcttcttcttctacgacctctcgcccatcaaggcagggccgcgggaagggggggtgcggggtttggaggtggagggctga

SEQ ID NO: 5717 - DNA, 639 bp, Chlorella protothecoides
atgtcggacggtgaccaggccaagccacttcgacgcgatgccgcgtcgctgggctggctggcacagagctctgtacaacccaggaaacgaacagcgatcgaaggcgtgagtgggaccagcctggtgtccctccgctcccagctggccagcaagcagcaggaggctgcggcgactcgcagtggcgccctggaccctgaggagctgagggcccgcaggaaggggagggacgtgctgtcccaatcgaaccccggggtcacgagtcgcgacgcccgtgaccgtgcagacctgccggccacccccggggacgtcctggccgcctcgagggccgcactggagcgcaaggcggcgctctacgagcgcctggcggcgggagaagatagcgcgggcggcgagtacgaggtggacttcgccctcaaggcgcccgacacggcgcgcttcgccgtgacgggcggcctggtgagccgcgacatgctcgcggagcggaaacgccgtgcctggatggaggaggaggaggtggaggccaaccacgcccaggaaagcgaggccgaagcgcggcgccggtcccgcatagatgtgagtctggggggaccttgtgtattgtgtgttcttgaaggcgcagcgcctcggagggcgccctga

SEQ ID NO: 5718 - DNA, 507 bp, Chlorella protothecoides
atgcacgtgctgccccaagcggtaccccatcccccttctacttcacctgcacttgcacgcacccctgcgcaggtggggtcctccctcctcttcgtggcctgcatcggcatcatcattcccaccatggccaagcgcatctatggctcggaggtgatgaccgatgccgcggtgatcaacctcagccacgccatcgccatcctcctcatgtcggccagcatggacctggaatttgccctgggactgcgtcctgtatggcgcaggctgcaccgcttgattgggcgaaggaggccgatgcagggatgcaagacggctcatgccgaggcttttggcggtgcgcagtcgacccgtctcctcttcgggtacttctgttacctgaccttccagctgaagacgcacagcgacctcttcgcctcgggcgagtcggaggacaaccccgcgctgtccctctccggggccctggctttcctctcggccatcacagtcattgtggctgtgtgctcggagtga

SEQ ID NO: 5719 - DNA, 432 bp, Chlorella protothecoides
atgcatgggcaccgagcgcgagaaggagagtcgggcctggacgatcagggagggcatgaccgcgccccaggtgcgtctgcggtgtgcactggcgtcgtcgggggtgacggtgggggtgctgttgtcgtggaaagggccgctggtgcacatgttcatgttcatgggctgtcaaagggccaaggtgcactcccaccaggccgatgccgtgggaggtgccgtcgaatcctccctctcccacacaattctcaggccgccggagtgatccacaccgactttgaaaaggggttcatcagggccgagaccgtggcctacaaagacttcgtggccgttgggggcctggccgccgccaaggagaaggggctgactcggctggagggcaaggactatgtggtgaaggagggcgacataatgctcttccgcttcaatgtctga

SEQ ID NO: 5720 - DNA, 207 bp, Chlorella protothecoides
atgtggtgggcaagcattcagggcagagggcatcgggggatggcaagccaccataccctgccgtacaactgccacccccaggtcgtgcgctgctttgagaacgacgacgtcatccatgtggatgggcgtgtcaacccagtggaggacatcgacaccatcaactttgagctggcactggctgacatcggtcaggtggagaagcggtga

SEQ ID NO: 5721 - DNA, 357 bp, Chlorella protothecoides
atggagtggaggtttggggctctggtgcgcctcgtgaagacgtgggccaaggcccatagcctgaatgatgcgtctgcgggctcgttgaacagccacgctctgactctgctgacccgccctgtcccgctgctgcctcccttgaaagccattttccccggaaagggtgaccgcgtaaacaaagcggccctggcgccggcggacctgctgagcgccatggacctcctgcgggggtggagggacgcagtcccagaaaatacagagaccttatcggagctgttcctggctttcttccaggtgacggctccgctcctgaagctctgggctaccggcctcgagcaagaccccctggcagagtag

SEQ ID NO: 5722 - DNA, 762 bp, Chlorella protothecoides
atggacatctcccggcgccagctccacctggtctctgcggacgccgcgcgccgcagcggcgtggacggggccgaccaggagggcaacctatccctgtccaccagcctgcgctcccctcgcctctccagccgctcccgggcctcggggcatctggaggaacccttgctggacccggaggccgctgcggaagccggggagtcccccgcgggcaacggcgcgctgccccctcaccagcccccgcgcggcgcccacaacagcgagcgcgcgcgccgccactggcgcttcgccgcctcccacgtcagcaagctcatgcccgacaactttgccaactccgactccgacacggccagcatcctgtcggagcggcgcctggcgcggcgcggcggcgaccgctcccgcgacgctatcgcgcagaccttcatctccacgctggcgggcacgctgggcacgggcaccgtgctccagaaccagtccatcgccatggagcaccaccccggggtgtggtcccccgggtcagacgcgcgctgcatcggcctcatgctcgtctcctcctacatcaacgtgctcctggcctgcatccccgtgggcattctggccggcgcgctgggctggagccccaccctcgtcttcatcatggtgaggattgtgaagggggagtggggcgggaggggcacagtgtgcaaggaggggcattccctggcgtgccacactcgggaaggctctgcacgatgcaggatctgcacagtgggtccccgcacgtga

SEQ ID NO: 5723 - DNA, 303 bp, Chlorella protothecoides
atgcgtgtgctgggagtcggctggggtctgcagggagatttgaacccctcgaggtctggcctcgcagccgacatggctgccatcgcacctcttcatgtacggcagccggatcccaatccccttccaccctccacaacaaaccaggtgacgttcatcgagcggagatcgtccttcctcgccttcctgaccagcacgtgcgccatcgtcggcggcgtattcaccatcagcggcatcgtcgacgccaccgtgtaccacggccagaagatgctgcgcaagaagctggagatgggcaagcagttttag

SEQ ID NO: 5724 - DNA, 324 bp, Chlorella protothecoides
atgaagccactgacgtatgctgccaacgtgggggaggcagaccttgcagacaagggtgccagcaaccctcatgtccaggcactgcaagccaaggcagcggaggaggggtgcggggtggtcctggtctccgcccaggtggaggccgagctgacggacctggatgcggcggaggctgctgagtacctggcggacctgggggccagcgagggcggcctgaagagcctggtgcgcaccacctacacccagctgggcctgctcacctacttcaccaccggtgggcagcgagggggcacgggatgttggcggtgtggagtgggcgtgtga

SEQ ID NO: 5725 - DNA, 753 bp, Chlorella protothecoides
  modified_base (194)..(203): a, c, t, g, unknown or other
cctgggcgccgcgctctcccccggccgccttgcggaggccgccccccccgccgacgtccgcgccgtgctcgcctggctggaggaggacccggggaccggggtcgaatcgcgcggtctgggcgtggctggggacccttcgctggcggcacggagccgggcaggcagctccctccagcacgaccccgccgcatcannnnnnnnnnggaggaggacccggggaccggggtcgaatcacacggtctgggcgtggccggggcccctttgctggcggcacgcagccgggcaggcagctccctgcagcacgaccccgccgcatcctccgcgtccacgctgctggcgctgcgctgtctgcgtggctgggcacaggcctcggtggtgaactgcgcgacgctggcacgcgccggcgccggccccgtgctgccgcgcttccttgccctcgccgccggccagccggagcgccaggagctgtgcggcctgatgaaggacctggcgcgcggctgcccgcccagcgtgccccttgaggccgccgggtggctgcacccgcagctctgcacggcggccgacgcggcggcggcgggggagggtgcactcctgcacgcatcgctcaccgcctttgcggcatgcgtgaggaggcggggcccgggggacggtgtgccggtgagggacattgggattttggatgaggccggagtggggggagatgtacaagttttgggcggcgctcccatgcatggtgctggaagggggcgataa

SEQ ID NO: 5726 - DNA, 330 bp, Chlorella protothecoides
atgccttacgagttcctcgtctggctgctggccgtcttgatccaggccgcggtgttggccatcaacatgcacatcactctccagttcacggatcttgagaacgacaataccaatccacacgacgccgcctcggccatcaacagcgtagtgctgtgggagtatggcctggagggcttcctggcgatctggctgatcttgaatggcaagtggtttagcgccttgcttcccctcgccatcctggccttccacatccagcaggcgcggtggatcttggcttggggggttgggatgatggggcacgccttcagccctgggggtctggtcctgtga

SEQ ID NO: 5727 - DNA, 2430 bp, Chlorella protothecoides
atgcacgacataaaacaaacagaaagaaaacaacctcaaaccgcgttgctcaccctggacctcgatctcggcggccatctccttgacctcctcctcggtgtaggcgacgtccaccaggttgcggaagtgcagctggttcacggagtggcacgttgcgcagacctgtgtgtacacctggtacccgcggcggatggctcggtggtcgaacgaggagaagaagccctcgtggctccacttctggttgggcgcatccagcccgtgctccgcctcgtcggccatggcggcggtggcagtcagcgccagcacgccggcgcccacgcctgcgccggccgcagcacgggaccagccctgagagctgcccgctgcatcggcctggctgtggatcccggcctgggacaggcccgcggtcagccccgggaggttctgcgcgaggtggtaagggttggttcacgggatcgggatgaggcgaggcgcggggtttgggacgtgtggacaggcagtgcaggcaccacgcccacgggagggggagcgaccgggggaccaggtgctcagcgaggaccaaaccgactttcgacccgatgccatcgacatccctggcgcacctgcgacagccggctcgatccgctctcgctggtctgcaggccacagcggatggcccgcaccaaggcccctcccgcagagcgcattgcaacccttgctctcctctacgccatgtgcaccgctgaacggcgaggcacccttagtaacccgggatcaaccatcgccgcttacgctctggcgaattttgcaggctcagccccaggcatggcagggttctccgcgcggtccatatcgtgccacaccgcacgactccctcgtagaaggcgagtccctgtgcatttattcgtccggggaatttggggcgggtcgcctgtgtcaccggggagcaaggggcccacgatgctgcagaggtccggcagcagagccgcggagcatgttcgcacatgcctgcgcgcttatagctccgccccggagaagaccagcttcggcggcttggaggacaaagaccgcatcttcacaaacatatatggtcgtcacgacccgttcctgaaggaggggctgaggagatgccctgctgtgttggtgtgggccaggtgggatgttaaccctggggtcagacttccctcatcctgcgagtaccacccactggtccaaccctgtcagggtgcggagaagcgtggggactggcaccgcaccaaggatctggtgagcaagggcgccgactggatcgtggaccagatgaagaagtcgggcctgcgcggccgcggcggcgccggcttcccctctggcctgaagtggtccttcatgcccaaggtgtctgacggccgccccgggtacctggtggtgaacggcgacgagtcggagccgggcacgtgcaaggaccgcgagatcatgcgccacgaaccccacaagctggtagaggggtgcctgatcgcggggacggccatgcgcgcgcgcgccggctacatctacgtccgcggcgagttcgtggcggagcgcctggccctgcagcgcgctatcgacgaggcgtacgcggcggggtacctgggccgggacgcctgcgggtcgggcaaggactttgacctggcggtgcactggggcgcgggcgcctacatctgcggcgaggagaccgcgctgatcgagtcgctggaggggaagcagggcaagccgcggctgaagccgcccttccccgccaacgtgggtctctacggctgccccaccaccgtgaccaacgtggagacggtggcggtgagccccaccatcctgcgccgcggccccgagtggttctccggcatggggcgcaagaacaaccacggcaccaagctctttgccatctcggggcacgtcaaccgccccgtcacggtggaggaggagatgagcatcccgctgcgcgagctgatcgagcgccacgccggcggcgtgcgcggcggctgggacaacctgctggccgtcatcccgggcggctcctccgtcccgctcctgcccaagcacgcgtgcgaggacgtgctgatggactttgacgcgctcaaggagcggcagtcgggcctgggcaccgccgcggtgatcgtgatgaacaagtccaccgacgtgatcgaggccatcgcgcgcctgtcctacttctacaagcacgagtcgtgcgggcagtgcacgccgtgccgcgagggcacctcctggctctacgacgtcatgacccgcatgaaggcgggggatgcgcggctggaggagatcgacatgctctgggagctgaccaagcagatcgaggggcacaccatctgcgcgctgggcgacgccgcggcctggcccgtgcagggcctcatccgccacttcagacccctcatggagcagcgcatcgagcaggccgccgaggagctgcagcgcatcgccgcctga

SEQ ID NO: 5728 - DNA, 879 bp, Chlorella protothecoides
atggccgacgaggcggagcacgggctggatgcgcccaaccagaagtggagccacgagggcttcttctcctcgttcgaccaccgagccatccgccgcgggtaccaggtgtacacacaggtctgcgcaacgtgccactccgtgaaccagctgcacttccgcaacctggtggacgtcgcctacaccgaggaggaggtcaaggagatggccgccgagatcgaggtccagggtgagcaacgcggcacactcagctcagagcagggttggatccagggatctgcctgcctgtgcatgcatgccattccgcttcttgccgcctcaccccccacacacctcatgcccctccccctcccaacaacacaactcacagacggccccaacgacgagggcgagatgttcgaccgccccggccgcctgtcggacaagctgccccagccctacgccaacgaggagggcgcgcggtacgccaacggcggcgcctacccgcccgacctctccctcatcaccaaggcgcgccacaacggcgagaactatgtcttctcgctcctgctgggctaccgtgagccgccggagggcatctctgtgcgcgagggtctgtactacaacccctacttccccggcggcgccatcgccatgcccaagatgctcaacgacgagggcgtggagtacgacgatggcacgcctgccaccgaggcgcagcaggccaaggacgtggtcaccttcctggcctgggccgctgagccggagctggacgagcgcaagctcatgggcgccaagtggatcggcgtgctggccctggtcctggccaccaccatctactacaagcgctggaagtgggcgcccgtcaagtctcgccgcgtcatcgtggacgcgctcaactga

SEQ ID NO: 5729 - DNA, 1602 bp, Chlorella protothecoides
atgctccccccccaggccgtgaagcagtttgattatggccagtacaagttggtgcacgaagctctgcacgagcgcaagaccttcctgagcaacgcgccgcacctgtcccacgagctgcccatcatgaccccctgctactcctggtgggaggtgccctactactgggcggggatgaagctgtacgacgcggtggcggggggcaaggccctgtcctggtcctactacctgggcccgaccaagtcgcgcgcccagttccccaccatggccggcgaccgccccgacggcaagacgctcaagggcaccatcgtgtactacgacggccagttcaacgacgcgcggctggcggtgagcctggcggtgaccgccgcgctggcgggggccaccgtggtcaaccatgcggaggccacctcgctgatcaaggcgcccgacggccgcgtgacgggggcagtagtgaccgacgggctgacggggcgcgcgacgcgcgtgcacgcgcgcaccgtcatcaacgcgaccggcccctttgccgacgggctgcggcgcctgagcgacccgagcaccacgcccatgatcatgccctccgccggcgtgcacgtgacgctgcccgactactactcccccgagaacgtgggcctgattgtgcccaagaccaaggacggacgcgtggtgttcatgctgccctggctggggcacaccatcgcgggcaccaccgacgccgactgcgcggtgaccatgcgcccccaggcgcgcgaggaggaggtgcagttcatcctggacgccatcgccgactacctgacggtgaaggtgcgccgctccgacgtcatgtcggcctgggccggcatccggccgctggcactggaccccaacgcggctgacaccgcgtcggcctcccgcgaccacatcgtgacggtggaccccgacggcatcatcacggtgacgggcgggaagtggaccacctaccgcctcatggcccaggacgccatcgaccgcgtgctgcgcgagcgcggcgcggccgcggggccctgcgtcaccgccgcgctgcccctggtgggcggcgccgggttctaccccgggctgttcaccgaggtggcgcagacctacaaggtgccgcaccgcccgggcgccatcgacaccaagatcgccaagtacctggtggagtcctacggcgaccgcgcgcacgaggtcacgcgcatcgccgaggagcggcggctcggccggcgcctggtccagggccaccccacgctggaggcggaggtggtctacgccgtgcacaacgagttctgcgagacgcccgaggactttgtcgcgcgccgcacgcgcttcgccttcctggacaagcgcgcctgcgagcaggccctgcccagggtgagcgagcgtgtgggggggcctgcccccacgctcctcccctcacacactccaatattcaacacacgcgcgcccaacaagccccccacacacatacaaacaaaacaacaggtggtggagctgatggcaaaggagaagggctggggcaggtggaaggccgccgccgagctcaagcgcgccctggagtttattaagacctttgactccccggaccaccccgccttcgtgcccactgcttga

SEQ ID NO: 5730 - DNA, 243 bp, Chlorella protothecoides
atgcgtcgcctggtgctccgcagcagcctgctggccgtcggggcaggcgcggggtatgccctgaccgggtcatccctggcagatgccaagggcgtggcgcccaagctggccgatcgggtgcccagtcgtgaggagcggctggccagcctcgccaagggcaccgccgagaacccttttgatgtcctgatcattggcgggggcgccaccggcaccggctgcgccctggatgccgtcacccggtga

SEQ ID NO: 5731 - DNA, 1359 bp, Chlorella protothecoides
atggcgagcccgggagcctctggcccctcaccctgtacgatgatcatccgcccccccctccccaagaatcaaccctgcccatcaggcggcgatgcgctgcagctcctcggcggcctgctcgatgcgctgctccatgaggggtctgaagtggcggatgaggccctgcacgggccaggccgcggcgtcgcccagcgcgcagatggtgtgcccctcgatctgcttggtcagctcccagagcatgtcgatctcctccagccgcgcatcccccgccttcatgcgggtcatgacgtcgtagagccaggaggtgccctcgcggcacggcgtgcactgcccgcacgactcgtgcttgtagaagtaggacaggcgcgcgatggcctcgatcacgtcggtggacttgttcatcacgatcaccgcggcggtgcccaggcccgactgccgctccttgagcgcgtcaaagtccatcagcacgtcctcgcacgcgtgcttgggcaggagcgggacggaggagccgcccgggatgacggccagcaggttgtcccagccgccgcgcacgccgccggcgtggcgctcgatcagctcgcgcagcgggatgctcatctcctcctccaccgtgacggggcggttgacgtgccccgagatggcaaagagcttggtgccgtggttgttcttgcgccccatgccggagaaccactcggggccgcggcgcaggatggtggggctcaccgccaccgtctccacgttggtcacggtggtggggcagccgtagagacccacgttggcggggaagggcggcttcagccgcggcttgccctgcttcccctccagcgactcgatcagcgcggtctcctcgccgcagatgtaggcgcccgcgccccagtgcaccgccaggtcaaagtccttgcccgacccgcaggcgtcccggcccaggtaccccgccgcgtacgcctcgtcgatagcgcgctgcagggccaggcgctccgccacgaactcgccgcggacgtagatgtagccggcgcgcgcgcgcatggccgtccccgcgatcaggcacccctctaccagcttgtggggttcgtggcgcatgatctcgcggtccttgcacgtgcccggctccgactcgtcgccgttcaccaccaggtacccggggcggccgtcagacaccttgggcatgaaggacctgtgaagcaggggtgtgacgccagaggggaagccggcgccgccgcggccgcgcaggcccgacttcttcatctggtccacgatccagtcggcgcccttgctcaccagatccttggtgcggtgccagtccccacgcttctccgcaccctgacagggttggaccagtgggtggtactcgcaggatga

SEQ ID NO: 5732 - DNA, 771 bp, Chlorella protothecoides
atggactcacaaaccctcccctcccttcccccctcccccaccccagctggatcgacgtactcgacctccgccaccggcgccacggccgtctctggtgcagtggggtcccaggtgctgaccgggacgacggcggggacggggggcctccccccctccagctactccttcgccgtgcccgccgcggagggcggcgcgcagcaggctggctcagtcacgcccaccggctccaacgccgcctcctcggtgacgggcagcggccccgttagcgcggtcagcgtggccggcccgggaagcgccaccaccagcaccacgcaggacggcgtgaccaccacgggcgggacggggctggccggcttctcgccggcggccgggcgcctgggcctggaggccgggggcgtggtgcccgtggcccccctccaggcgcaggacagcggcttcagcttttccgcgcccggtgcgcagcaggccggggcggtgacccccaccggcaccaacgccgcctcctccgtggtcggcaccggctccgtcagcgcggtggccagtgccaccccggcgggggccagcacgtccaccacccagggtgggcagacgaccagcatgcagacggggggcgcggcgggggggtcgccgctgacgcccggcgcggcggcgctggcgcccgcgccggaggcggaggcggaggcgtatgtggcgagggtcagcgccgccggcgcggggtcggccaccagccaggcctgcgactcggagggcgtggcgatggagctgccgtga

SEQ ID NO: 5733 - DNA, 507 bp, Chlorella protothecoides
atgcccaggggcgtcacctctctgttgttgggttgcgctgtcctggccgtggtcgccggccaggctgttccgacatccgaggccggcacgccggttaccaagaccatccccctcgcggcattctcgaacatctccatctgtacacccctgaacaccctggtgcttcccgggccggccggccagtatggcattgtgctcagtggcgagccggaggtcctggccgagatcgacgcgagcgtcacggggcaggtgctgtccatcgtgctcaatggacccatcgacacctcccaggaggtgaaggtgaccgtcatgctgcccgcggacgccctgagcgcggtggagcactacgcacccggtgctgacgtggtgatcgcacgtgggttcaaggccaccgatttcagcgccaagagcgcctttggggcgggggagctctacatccaggggctcacagccaccaatgtgcagctggatgtggcagggtgcgtcagattttggatgtctgggtga

SEQ ID NO: 5734 - DNA, 720 bp, Chlorella protothecoides
atgcgccccgatgggatgctctgtgaatcgaccccgacgccaaagagggagtggacgggcggcctgcatggcggtcttcaaaggggggagcagggggcgggggcgctggtggccggcacagccgccgctcagagtgctgtgctccccgccagctcgcccgtccccgtcatggtcggtcggcgcctcacgaggcagcgttggagggcgaatcggtgcaccacagcacagccagcaccctcccatcgatcacagcgcaggtggccccggcagcgcgccattccccagcgcactcagcggctcgcccgaggtcgaggcggagaccgggcccgagcgaggcgcccccccctcctcctcgccgtgcgcggcggcttcagcctggcgccgccacatgcgcgcgtacaggccgccgcactccagcagctgcgcatggctgccgcgctccaccacctgcccctccgccagtaccacgatggcgtcggcgtcggccaccgtggacaggcggtgtgccacgatgagcacgctgcggtccgcgcgctgggccgccaggctggcctggatgcgcgcctccgtcagcccgtccagcgaggacgttgcctcgtccagcaccaggatggcagggttcttcaggatggcgcgcgcgaatgccacgcgctgcttctccccgccgctcagtcgcaggccccgctccccgaccaccgtgtcgtagccctgtgttattga

SEQ ID NO: 5735 - DNA, 552 bp, Chlorella protothecoides
atggaataccgaccaagtgcccctgtctgcctgcacagccttcaagggcgacgcggtcatgctgccggaggccttgaaagagatccgatcgcgcttcgaggtgaggcacgcggggacgagaagcatgttggcgagagcccgacatgcatcgatgctgagcctgtccttggagagtcccgtggagtgcgggacccagagaccctggccaagctccagcacgacgccagcgaggctgccgagttcatcacaacccacgtggtgcaggccgcaaccaatgagcgtgggaacctgggtgggttggggttgggagacgcgtgtgtagtggtgccgcctgcacgcagccctcctgggagtgcctggtgctccaacaggccagtgcaacctcctgccggccagtccagctcccgcaacatcatctgctccacagagatgacggtcccccccatcacacacgggtcggaggcggagccggtgctgcccggcatgcggttaccccgcgagaagaagggcaggaaggcggcggatgcgaatgacggcccccgcgccgagtga

SEQ ID NO: 5736 - DNA, 732 bp, Chlorella protothecoides
atgcgcatcccacgccaagcctcggaccagttatactctgacttctccaccatgatgttgccagagtctgcaacctcttcacttgttggtgcacagatcgtcccagcacctgccgcagccccagcaacgcaggccgtcaactcacacagctcatgggatggaaacacagctgcgttgctggaggaggtgctggctgctgtgcaggctgtgcatggcgacaggcccgccccagacatgccgctggtccatgcggggctggactccctcggcacggtggagctgagccagcgtctggcggccagatttggcctccgcctgcagcccaccctggtgtttgaccacccgacggctgccgcgctggcacgccacatcgcagagctgtgtggggttgcaaaagagcacggccaggggcctgaaggtgactgttctgctagtctgggactcggccggctggagagtttggttcctcccacagcggatgtcgtggtgctcgagcatgcacatgcccgcctggcagcgccgatggatgggggccatggaaggtttgcccaggacacctgccgaagcgagtcactgtgcccagctggggctccagcagataaattctcaggcacgcccatccattcatcccacctgcagatccacacccttgagtcgttgggatgtggatggatccaggatccaccctgtccctggtcacagatttggcaggcaggacgtgctgtgttgtag

SEQ ID NO: 5737 - DNA, 1701 bp, Chlorella protothecoides
atgttgcggaaaatttccccatatgcgactccagagcgacccatcgcatgcatgactgcccaccaagcacacccatgccgactcaccccaaccccacatgtgcccccattccaggatgttgcttcgtttgaccgggtcatgtttgacatgagtccgggcgaggcggcatgcctggacccccaggcccgactcctgctgacatcagctctggagaccctctgtggatcaggtgtgagctgcatgggagcatgcaggtccccaaggctgatcagccagatcagcggccccatagaccgccaacttcatccccttcctcctgcacccaacagactctgtgtaccagctggcacgaatgggtccccagactggcacatatgccgggtgggaatgagaataagtaggggacctgatggctgcaccgcctggatgccaacatcgttggctgaagggatggaaatggcgcaccttaccagtcaggccgtgtggcctatgcctttggcctgtgtggaccctgcagtggcatcgacacagcctgctcatcctcgttggtggcagcccacagtgcccgcgcaggtgggttcaaagggttgccagggtgtattggttctggagcctgaagtgcgcatggaatgcccagggcattggcaaaagatctctgacgctccagaaggcattggcaaaagatctctgacgctccagaagtctgccagcccaccctctagactccaaaattgcatccctctcaccccaggcatcctcgcgggggagtgccaggcagggctggcagggggcgtgaacgtcatgctctggcctggcactaccgtgggcatctgccagctgggggccctctcctccagcgggcgctgccgctctctggaggccggggccgacgggtatggccggggtgagggcatcgtcactgtgctcctcgtcttggccgcagcgctgggccagggtagacacagtgacgcacagcagcagcggccgctggccgtcctggcggggacggcggtgaaccaggacgggcggtccagcagcctgaccgcacccaacggccccgcccagactgcactggtggctgccaccctggccgcggccgggactgggcccgccgacgtcggcgtggccggcctgcatggcacggggaccgcgctgggggaccccctggagctgggtgcccttctagcagccctgcgtgcgccgcgtggggtcgccgctcgccccattgccgtgtccgccgtgaagagctgctttggccacaccgagggcgcggcaggtaggcttgacagggctgctgttgggggcagccacgctggcctcaggcggcgcgccccctgtcgcgggccttgccctcctgaacccacatgtcgcgtctgctctgtcccatgggtggggccgcgacgggttagcggccatgcacatcccccgggagtcggcgccggtgggaagttccggcagcctcaccggcaccagctcctttggaatgagcggcgtgaatgcgcacgccatcttgagggggggtggcgtttgttcagggtcgaatctgctggcaggccaggcagcgctgccttgtgtgcctgcggtggcctggccctgccccctgctgtgcagtctgatgacaggggcgttgccgggggcgaagaagggcagcctgcacctggctgccaccccggccgctgcaaagcatgcctggctccatga

SEQ ID NO: 5738 - DNA, 2454 bp, Chlorella protothecoides
  modified_base (2157)..(2166): a, c, t, g, unknown or other
atggtctccctgctctcacaagtgtcgacagcgtctccttccggcatgtctgctgaagttgcgagatctgagcgaccaccttcaactcccatcactgcttccatgcagggcgttcagtgccggggtggacaatgtacaggtggtgccgaggagccgctgggacatcgagcagcactaccaccccggaggagcagcgcacaggattgctctgagccagctgctccgtgcagagatttatttgagatgggagttgacagcgaggcgaccaccctggatccacaaacccggctcctcctgcagcatacagcagccctgcagccctacatcccgtcagacgcaacaggagtctacgttgggtgcatgtacacagcaatctggcatgcacatgggcatgcattccagactgacaaccgcttcccagcaggacaactagtaaacaaccctgaacaccgctgccacacctgcaccgcagagtaccttgattctgtgctgaaggctgcaggtctggcagatacccaggcctcctccattacaggccatgggctgtcattcatggcgggacgcctcagctacaccttcgacctgcgggggccctgcgttgcccttgacacagcatgctccagcagcctagtggctgtccatcaagggagacaggtaggggtccggcatgtcgaaagggctgattccctggagctgctggaagacaaattcctcaccgatggctgtgttgctcccacagcacattcttgcttgcctcagcggggagtcagtgtccgctctggcgtccggcgtcaatctgatgctcgacccaggcacgaccagccgcatctgcctcctcaaagccctctctgcggtgggcaggtgccagacgctggacgcctcgggcgacggctacggtatgtgggttgggggctcagagggtttcgtgagagctgcgcccgcaccgcagggcgcggagaaggtgctgccacactcctgctcaagaggcaggctgcccagggtcaagaagcacacgccccgggagctgacctggcactgctgcaggccagcgcggtgaaccaggacgggcgatctagcagcctgacgtcgcccagcgggccctcccagacggcgctgctggcggcctgcctgcgacagggcgcaggggctttgaccctgtctagcgcggcgatgcacgggaccgggaccccgctgggggaccccatcgaggtcaatgcgctggaagctgccctgaagggcagcggcggccagctgaatggtgacgacgtcgcggctcctcgggtgctcctgacctccagcaaggttggtgttgcctgtttgtggtatgggagccttggaatactccatcaagcagtggggttcattgtggcgctcttcgggcacactgagggcgtggcgggcgtgaccggggtgctcctggcagcggcgaccaccagcacccgccgcgcgagcctgatgcccacccttcggaccctgaatccctttgtcacggcagcgctggcgtgcttcagcgccgcacgccagacgggccctgtgccggcagtcttggggtcagagcctgccgccggggccaccagctcctttggcatgagtggcgtaaatgctgccgccctgctctccgccccgaccggtggggacttggaaggcgccggggtcccggctgcacagccctggcagctccaagcggtgcagccgctgcctgcctgccacgcctgggtccggccggggccatgcgtgggcgttgtgctgctacggcacgccggcgcctctgccctcgaggactgctcgatccatggccagaaggtcctggtcctggggggcgggcttgagatcctggcggccggttgcagcatgcactttggtgctggacctgaaacggagtttgccctgcggaacgtcaccgccgcctcgctcttgcggtggccaggggaggagttggcgctgcgcctggacggcgtcaccggcacggcccagctgcaagggctgggaaggggcgctatgctgcagaccagcgtggccaccctgcccatgcgtgctcagtccagcacttccccgccaggcgcaagctgcccgggctcgtgccgcctcccacctgaggtgaggtggacagccattctgtgctggagtgattcacatctcacaacaatctgtccaaannnnnnnnnnacctgcgtgtcctgtcttggacgccggcgcggtggccatggtgcaggcacgggctcgtgccgcctcccatctgaggtgaggtgggcagtcgttctatgctggattgattcacatctcacaacaatctgtccaaagactgccatcccccctcaagctccacacaggttgcacatcgatccttggatgctgcagggtgggacagacctgcagcatattaatgctgcacaggagcgggccgttgctgtcgaaggcatccttgcaccaggtggctcacgatgggagccatga

SEQ ID NO: 5739 - DNA, 1974 bp, Chlorella protothecoides
  modified_base (292)..(301): a, c, t, g, unknown or other
  modified_base (579)..(588): a, c, t, g, unknown or other
  modified_base (1334)..(1343): a, c, t, g, unknown or other
cgccatgctcagaatggaccggggacgggcgcgcctcctacccctgctcccagacggcgccccggcgccccggggcgccgcgctcaaccggccctgcctcctcatgctcaagggcatcggctctgggaccttggagggggccgacctggcagcgctcaggaagaagctcgcggcggcatctgccgccatgggcggcacattcatcgactacttcccagacggcgggcagtggctcaccaagctggatggctttggacagggcaagggtggcaaggaatgatatgctcgggtnnnnnnnnnncgaccgcttgcgttgtcgcacaggtctggcgcgtgcctcgtttttcgggtcaatgcagaccccctcctggcgcgcggcgcgggaatcacgagcttcccctcgtcaccgggggcccgagcatatcattccttgccacacttgcccttttcaaagccatccagcttggtaagccactgcccgctgtctgggaagtagtcgatgaacgtgccgcccatggcggcagatgccgccgcgagcttcttcctgagtgctgccaggtcggccccctcccaggacgnnnnnnnnnnattgttttgcttgcttgtgaggatggagttgcacatttgctcacccctttcaacaaccggtggcgaggggaaggtcgcgattcccgcgccgcgcgccaggaggggttctgcattgacccgaaaacgaggcacgggccagacctgtgcgacaacgcaagcggtcgctacaggctgagtttattgcaaaactacttatcgacacatcatgggcgacttcagccagctcgtgaacaaggcactgggccgaaatcaggacacggggggtgtgcagttctgggagcacccagagcgtgcaggatggctgatgaagcaaggcaagcatccaaggggtactcatgttgggtttcgcaacttgtgaggaggccagcgccgcacagcgcacctgattcgctgctccacattgtcctcactgcaggggaagtaatcaagtcctggaggagaaggtggtttgtcctcaagcacggcaagattttctggttcaaatcggacgtcgtgcggccggactcacagcctcgtggcatcctggaggtcagtcggtgttccggttgcggacggcgaagcattctgccatttgctccaaagctgtgccggcctgccacccgtttctggcatgtacttcattgccgactccgacaaggtgtgcagggcgagcagaaggagggggagggagatgtgttggtcaatgcctgtttgttgcagctgcatcctgtcctgtgtgcctgtgatcccgctggagctgagctgtnnnnnnnnnnttgctccaaagctgtgccggtcaaccactgcctgtctatcaagggcgctgaggatgccatcaacaagccccatgcgtttgagatctccacagcggatgccagcatgtacttcattgccgactctgacaaggtgtgcagggcgagcagaaggagaggagggagatgtgttggtcaacgcctgttcgttgcagctgcatcttgtcctgtgtgcctacgatcccgctggagtagagctgctatgcgcctccacaggacaaggaggactggatcaatgccgtgggtagggccatcgtcaggcactctagaaggtggactacaactacggcagcggtgggcggtgatgggagggctccgtcgccatagagggggagtccccaaccccggcttcgccccagcccctggcactgttgttgcaggcgaggctctgctcagctggagcctaggggcgggaggccagcgctgctggggtcatgctgtttttctcaccctccagcttgccacacatgtgttccctggggaacaacagcagccaatgcccccgttgggaaaaatcctaccttgctcagtgtcctcctccccctgccctgcacaccccctggtccactggacaaccccccaaccctgcttttga

SEQ ID NO: 5740 - DNA, 945 bp, Chlorella protothecoides
atgcgcgtgagcgattcctcgcatgtgttgatcctggcagcttgcttccgcgcaacacctcctgatcgccaattccagatcctggccagcactggcttcagtggagctggcgtgaggtcggctggccctctgctccccgggccgcatctgcactgcagcctcagtacgactgcatgggcaggcaccaaggtcgccaacctggagtcggccccgcagtggtcccacacagcgagtgaccccatgtcccaggagggcaatcattccctaccaaagaacccggctgcagcgagcagatccgcattcggaaacgccgaacgggcccgggttctctttgagcccctcctgctcagctcagcccctcagctcagctccgactgcttgaataccatttcaagggtccccaggaccaccaacacccgcctgtccatcctggtgggaggcacgggcgggctgggcgccctggtagccgaccagctgctgcacagccgggcggcctcgcggatcctgatcctgggtcggcgagcctcgacccgcgagccaacccgcctggcggccaccctctctcgtcaacccctcgggcttgattcgctggtgtccgtggccagcgtcgacggcgccagcgccgccgacctcgccgggacgaaagcctggcttgcggcgcagggctgggtggtgcaggacgtgctgcacgcggccggtgtcacggccgacgccgccctcccgcagcagtcgccggggcgggtgcggcgggcggccgccgccaagtccctggccggcgtgctggcgctggggcggggagtgcaggctcaggggcgcgtggtgctgttcagcagcatcgccgggctgctggggagccggggccagtacagctacgcgcaggccaatgcgtgcctggacgagctggctggaaagcacgtgcacgaggtgggtgcgggccggcagtga

SEQ ID NO: 5741 - DNA, 1014 bp, Chlorella protothecoides
atgggcagagattgggatgcccagctccggctggatgcgagttcttctggcctcctcgccatgccctgtgcgatgggatcccatgccggaccggtggttgaaagtgatctgatgtgcggcgccatgctgcgctgccttttgctcgaggcatcgctgggcaatgcagcgctggacgtctgcagcccacttgaccccgcccctgctgcgccgctcgtgcctgctgggtccccgccggccgtacgacggcgagcggtcgctgcgggtgtgaccctgattccacacctggtcgagagtaacccaacgcggcctggccatctcaacaacttctcgcacagctccacacacaatcttgtcaccggcggcaccaccggactaggccggctggtggctggctggctggcggtttgccgcggaggagcgacacgcttgagcctgctgggcaggagtgggcgaggaactggcgggctcgcatccatgcatccttggcagaatgtccccaccgtcttcacggtgacatcctgcgacattgggtgtcggtcggacgccagctgcctcgtccgccgggcaccgcctggctcggccctcttccatgccgccggggtgctgcgagacgggctgctggcggccgtgacccctggcgccctgcgccacgtggccggcccaaagactggctgtgttggagacctgacgagcccagcagccggatccaggcaggggactgggatccttgttgcagtccacactcactcctcgccctcgtcccgtcgcagcatgctggtgctgttcagcagcgcatcggcggccctggggaatgcggggcagacagcgtacgcggcggccaatgccatgctcgatgcgcatgctgggcggtgcttgactcaaggatcgccagccctcgccctgcagtggggcccctgggccttcgtcggcatggccgccgccgcgcccaacgttctaagcacccttgcgcgccagggtgcgccgaggctggctgagggggggggggaaggatga

SEQ ID NO: 5742 - DNA, 693 bp, Chlorella protothecoides
atggcaggtttccagctggtggcaggcgcagccgccggtcaccctctgcagacccttgcggccttcagcagcgtggccgggcccttggggtcggtgggccaggccaactacgctgctgcaaacgccggcctggacaccgcctgcgggcggctgcacgcatccgggatcccctcccaggccctgcagtggggcccctgggccgtggtgggcatggccgcccagtcccggggcctgcttccactgctggcgcgccgcggtttccagggtctggccccggccacgggtctggacgtggtggccaagaccctgcttgcaaggcagacacccgctgcggaggcgagcctgatggtatgcctggtggagtggcagacctacgccccggcccgctcaggctggagccgcggactgttctcggaggttgtgggaggcgatgcgatgacacctgcgaaacctcgggcctggcagtccatgggccatttggcaggaggggacgagcagcctgcactgcagtatgggcatgccatggagactggcccaacctttggaaagccgccagcaaccctcgccggcagccttgatatcctaggctgcgtgctggaagctgtggaggctgcaacggggagcgctcttactccggacgtgccattcatgtccaacggccttgactcaattggggcagtggagctcaggtga

SEQ ID NO: 5743 - DNA, 699 bp, Chlorella protothecoides
atgacaaacgatcccagccccatcacaatccccccaaaacaacccaccccactggcaggcctagccaaagtctgggcgcccaagccggccgccacggctctcctcctggaccgcctaggttgccaccccgccgagacggtgcagctcttctccagcatcgcctcctgcctgggcggccctggccaggccaactacgccctggccaatgccgcgctcaacggacttgccgcgggcggcgcggcgcgcggcaggccggccatcgccgtggcctggggcccctgggccggcgccggcatggctgccgccgccgggctggggcggctggagcgccagggctacggcgcgctcacgcccgcccatggcgcgggcttggtgctggccctgatgagagcgcacgccagacccggcgtcgggtcgttcctcctcgcggcgcgcatgcactggggccgtagggataattggccgattgtgctgggatctgataccaagtgtccgggtattatggacgtggcacttgatgataagaaggggatgcctgcaaaggccgtcgcaagcttccctggcgccgggaaggtggtgtcccaagctgtgatcacacagcaggttgctgactgcatcgccgccgtgctgggtgcagcccccgccactgatgctcccctcctggccgccgggctggactccttgggtgagtgcgactga

SEQ ID NO: 5744 - DNA, 465 bp, Chlorella protothecoides
atggatgcccgatcacccctccccagccgtatgcatcatcctgtccctgccacagaggccgcactcatggacccgcagcagggctccctcctctcccacgccgccggcctggtgcgccccgacacctccaccgccctccccaccgcggtcttcgtcggcatcgcacgcgtgatcgactccgccgccgcgtccgcatccactctggcagccatcgccgcaggcagcggacacgcagctaccggcaaggccctgagcgccgccgcggggaggctgtcgtacacctttgccctgactggcccatgcgtctccctggacaccgcctgctcctcctccctgctggccctgcaccttgcggccggcgccgttcgggggcgggagacaggtactgcgctggcggcgggcgtcaacctgcccatggtctgcgagaccacggccgcctttgccgccgcaggtgacactgagtag

SEQ ID NO: 5745 - DNA, 510 bp, Chlorella protothecoides
atgggtgccattgcgcagtacctggcggaggccctggctcagacgcaggccgcacccagtggattgcccatcgccatccattacctggcagaggccctggctcagacgcaggccgcacccgatggattgtccatcgccatccacgtcacggccggacagcctgccacgccgaggcccctcgctgaagccagggccctccccgtctacctggaggctgtcactggagacctgccgtgcacggggaggctgggcatcacatccatgaccttccccatgcgcgatgcaatgggacccgttcccctgagccgctggtccctggacgacccgccggtcaagggcttggtgctgccacgcttcggggccttcctgctggactgggagagatttgacgccgcagcctttggtctgagccctgcaggcaagttgttttgttctaggaagttgtggtgggcgttgcctcacagcgcacccctcccacatagtttacctgtgggagtccttcaaggctga

SEQ ID NO: 5746 - DNA, 1290 bp, Chlorella protothecoides
atgctgtcccctgacggtcggtgcaagaccctggaatctgcggcagacgggtccgtgggcctagaccctaaccctatagtgctttggggaatggctggagtccagtgtgcgcaaggacacatgtgtgtgcaaacctggttggaagccatgtacatgccatgcgtgactcgacccacaccatcctgcaggtacggccggggcgagggctgcgtcacccttggcctcacacgccagggtcaaaacaccgatgccctggccgttctagcggggaccgccatgaaccaggacgggcggtccagcagcctgacggcaccccacggtcccagccagcaggctgtcatcagccaggccctggccgcggccggcgccccgcctggcgccctcacggggctggaactgcacgggacggggaccccgctgggggaccccatcgagctgaacgcggcgctgacggtgctgtgccccaggctggggcgagggagggatgggcatgaccccggaccctgcctgggcctgcatgccgtcaagacgctggtggggcatgtcgagcctgcagctgggggcgcaggccttcacagcacgctgatgaggtgggttggcgcagaagggcgcgacgcgcatggcctgctgaacttttatcatgaagggcacgacacatggcttcccgcctcggagactgctggtggtcgtagactggttttcctcctttcccaacccttctggagcatcacattgcaggattcgctcgctggtgctcccccccctgctgggactgggcgtcctcaacccgctgatgacggacagcttctccgcagcttcccgcgggctgcacgccgcgaagcagcccgggccccaggcctgctgcgcccccgggacgctctcgggcaccagcgcctttgccttccagggcaccaacgcgcacgcgctgctgacagtgccaaaggtgctgacgccgaccgaggcgcccgtccgcaggccagcctggcggcgccagcgctgctggttcgggccccgtccccacgccctgctggtccgggcgggggcgcccagaaatgcgacctgccagctgcgggccagcctggtctcgcgacggctggcctacatctggcagcatgccgtgcgcggcaggcccctcctgcccggcgcagccatgatggaggcgatgcacggcgctggggggtctctgaacgccaacccaggtgtttgatgaggggtgccatggtggacggacacagcgtgcacgatcggtggggtggaagcagggaggactgtgcgtcacgtcagcggtga

SEQ ID NO: 5747 - DNA, 369 bp, Chlorella protothecoides
atgtcggcatcgggacgttgccagaccctggacgccgcggcagatggctactcccgcgccgaggcctcagtcgtcttgcggctgggacgaggggaccctgccgggtctgcaagcagcgccccgccccttctgatcatgggcagcgccaccaaccaggatggtcgctccagtggcttgacggcgccccatggccccagccagtccagggtagtggcggctgctgcaaggcaggcgggggcctgcccaggagcctttgagatgcacggcactggcacacccctcggcgaccccatcgaggtgtccgcccttgccaccgtgatgtatgccctgggaaggggagatgctgaaggtgagctggtgcatccctga

SEQ ID NO: 5748 - DNA, 774 bp, Chlorella protothecoides
atgctgctgtctggtcagccggaggcacaccgcaccaagcacgtgggcgtgtacatcggctgcatgtgggcggaggaccacaccgcgaccttgccacctgccgccgccgtcaaccctgtcgccagcacagggaatgggctgagcttcatggccggtcgcctggcttttgcctttggcctccgaggcccagcttcagctgtgaacaccgcctgctcctcctccctggtggccctgcacttttccactcacggcctgcgggcaacagactgcgaggcggcactggtgggcggggtcagcctggtgctcgactccggcagcgcggccaagatcagcgcgctgcaggcgctgtccccctctgggcgctgccgggccctggacgaggcggcggacggctacggcaggggcgaaggcgtgacggcgctgctgctgaccacggccgaccctatcgaggctgtccgctcactcaaagcggcctcgggcccgctggcggtgctggcggccactgcggtgaacagcacggggcttgccagcggcgtcacggcgcccagcggccccgcccagcagcgcctgctggcagatgccatgcggcgcgcgggcgtggcagcggatggcgtgcagtccctgtccctgcacgggacggggacgccgctgggagaccccatcgaggtcggcgcagcgatggcccagctggggcagaggggcgccgcctgcttgtccctggctgccaccaaggctgtgtttgggcatgcagagggcatggcaggtgagagctga

SEQ ID NO: 5749 - DNA, 681 bp, Chlorella protothecoides
atgggagagctggcggcggccatctctgatcggttcggcctcgacatcccgcccaccgccctgtttgacttccccaccctgggctccctgggcacacgcatccacgagctgagaagcatagtccggcccagtcgcagtggtcaggactcagtgccagtgcaccagctgccagagctgaggggtagcgtacagctcatcagcgatgccagagagccgaggggtagcgtgcagctcatcagcgatgccagaggtgatttcccgggggtctacagagatgacagctcgacctcttggctggcatgcctcgccagcgcccaggaagctgccgcacccctgcacctcgcccgctgggacatggacaggacgtacagcccagaagtgtctgacaccggcactgtggcgtgtcgcttcgccaccatgttccgaggacaggagcatctcctgtttgatgccgagctgtttgggctcagcgcgagagatgctgccctcgctgacccccacctccgcctcctcctccagcatgcccaggtggggttcgggggatcgacacacaatcaagatgcttgcccggccacagtgcaagcttacattctgttacaagctgaggtggtggatggtgtggcgttccagtcgccaattccatgggcggccaagcgggcgcatcaagcgtcgcccccctga
